United States Patent 9,328,346 (POLYCOMB-ASSOCIATED NON-CODING RNAS) - sequence listing, part 36

SEQ ID NO: 6152 - RNA, 27291 nt, Mus musculus
gggaauccgaggauagaugaagcagugacaguugagaaguaaacaccacccgggcugagggaggugaaucuugagagaaaguucuggguuuacccagaggaaguuguccaguagacaaucagacacacaucucucauccuuaacgcuacccccucacuggcccagcagcagccccaaagcgauccuuacacuccacuccgccccgccccgccccgcccaccuuggcuucaacccgcggcccugucuauccucuagcgauucuuucuuauugggccaacuucucgagauuccuacacuuugauaggcugaagcugugaagugcuggccgcggauuggcuacgcacagcagcgggcuucguuuccucccgccccucaauccugagcuguuaguucaagauggcggcugccguggggcccuugggcgauggggagcuguggcagagcuggcuuccuaaccacgucguguucuugcggcuccgcgagggcguaagaaaccagaguccagccgaagcggagaagccagcggcuucgacuucacccucgugcccgucucugccgccgcauuugccgacgagaaaccuggucuucggccucggaggggaacuguuucugugggacgcagaaggcagcgccuucuuggugguucgccuucgaggccccagcggugguggcguggagccuccucucucccaguaucaggugcgccgguccaucgugaaagcaaucagccuuuugguucguuggcggaccugggcuggcgucuuuugggaacgccccacuucgaguggaaugaccccgcuuuguagcucaaucuggucuggaaucacuauguagcccaggcuagccaggaacuccugccccagucucugaguguugagauuacgggucuaagucauuuauaaacaccaaaacagaggcuaggccuguguguguguccagcaccugacauaaaccuagagcaugcacaagcuccguaauaucugugauuugcuucgguggggguggagggguuuguugagacaggguuaacagcccugguuguucuggaacgcacucuguagagcaggcugaccucauuaacagagaucuggaggauccugaucagagcuaggauuaagccaugugcugccacugcccaguucuacaacaggcauuuaaagacaugggccuacagauuuaaaagcaauuagaaauauuauuauauucaaaagaaauccuuauuuaaaaggauuuuuggcuuaguauaauucuccauacuaagguaaauaauauauugauggucucaucauuauuuacgaauaauaaaaagaaauuagaaaucuaaaauggucaugagaaaagaaauaggaaguaccagggugagaguauuuuugaggcuauaugaugcuaugacaaauuauugaaacucccuuaaacuaucacucuuuuauauuaaguccacguagaugaagcaguacugcuugcugcaaggcgcuugaagguaaucuagggccuuaccugugaccuugggugaccuggagcucaaacagagccaccugcaccuuaucuggugcugggaauaaaggcgugaaccuuuacacuuggccugaagcucuuccuuucucuacaguacaguuauaagaugguaaucuguugauacuuccgaguuuauguauuuacuggguaucaagagucugcuugaggccaggaacacagaagaaaaaucucaaguagcgccuacuggguuaugucagggaaaguuuagaauguuuaagaccugugguauuacccagagcugugguguggaacuacagaaaacaugccuuuguucccuggccgcaagaucagggguaauuucucccuuuuuuuuuuuuuuuuuuuaaguuuuuguuuuuaaauuuucuggguauguauguuuuccugcaaaugagugcugcauauaacaucuaugugccuggugcacacagaugcuacagagccaccgugcgggggcugggaauugaacccagguccucuggaagaguagcccugugguuuuuauuuucaguuuguguguguguuuggugagagagagagagagagagaauaugaauaugaaugagccccaagaauaugggugcugggaaccaaacucaggucuuuugcaagggcagcaagugcuuuuagguguugucaucuaucaagaaccuagagauuauuucuuggggaauaaucagcuaaugacacaguuaguacaugcucagaaugcuauuuauaacuuuagaaauuuaaaacgugauuaugguuucaagcaacucugaaauaaauuuauauuaaaauuaacuauuuuuacuaaaugguuuuacuuucagagauuacucugcauuaauccacccuuguuugaaauccaucaagucuuguugaguccaacccaacaucauguagcacuuaucggaaguaaaggacuuauggcauuagaauuaccucagaggugggggaaggacucugaauuugaagguggaaaagcaacugugaauuguagguaaguuguauuuucauuuaguauuuaucuguguaaguugcuaagacccaaaaugguugaaauguauuuaggggccacuauugaaacauuugagcauuuguaugguccugcacacugacuuccugugguacuauuguuguccguucuuuuuuaaacauguaugagugguuugccuucauuuaguaagugcagugcuugugugccuggacagcaagaagagagugucaaaucuccuaaacuggaguuagaguuuagcugcuacgagguugcuaggagccaauguuggauccucugcaaaagcggcaggugcucuaaacuccugagccaccuucccagucccugcuguuauuuuugaagaauacuguguuaauuuuuuuuuuggauuuuaaauuuuuuuuaauuagguauuuuccucaauuacauuuccgaugcuaucccaaaagucccccauacccucccccccaacuccccuacccacccauucccacuuuuuggcccugguguuccccuguacuggggcauauaaaguuugcauguccaaugggccucucuuuccagugauggccgacuaggccaucuuuugauacauaugcagcuagagucaagagcuccgggguacuuguuaguucauaauguuguuccaccuauaggguugcagaucccuuuagcuccuuggguauuuucucuagcuccuccauugggggcccugugauccauccaauagcugacugugagcauccacuucuguguuugcuaggccccggccuagucucacaagagacagcuauaucaggguccuuucagcaaacucuugcuaguguaugcaauggugucaucguuuggaggcugauuaugggauggaucccuggauauggcagucucuagaugguccaaccuuuugucucagcuccaaacuuugucucuguaacuccugaauauuuuuaauuaagagaaacaaucucacucucuuauuuuuacaaaaauagcugcaaguuuggaguuagguucacaagcuuaagaacuaugcacaaaaugaaccaaaacacauggauuaaugguauugucuacugguuaacaagacaccauuuauauauguugggccauuuucuggucauugcaauuugugcuaugauaucauaaauguaccaugaacuacucaugcccucaaagguauagauagcaguuggacagacuuccagguauucaaucacagaaagaagacaaauaacuacauuaauacuuaugcuacuucaaaguuuaaaaaaaacaaugugugggacuuaauacuuaguguaacaaagugugccaguuacaucccuucccugcuuccuccagcacaggagugaaccugugacuugcaggcugaaagugcugagacugcagaaguguguccauagcccagcuuucagucuuauuuuuaugcacacauacacauauuaaaaaguaaauaaaauccaggcaggugggaaucgagacagucuacugcaaaggauagaggguaggagcccagaccccaccuuaccucuguaucuuacagagaguccgcuuaaauugcuuacuacuauucagaucacuguuucuauuuucagaauaaucaucauagcaucugcccuuauaguugccuuacuucauuaauuaguaaaaggaccaaacaagaggcaauaucaaaauacaucuguaauuguauaaacugggugugguaauacacaaauguaaucucagcccucaggaugcugagccggaaggcugugaguucaaggcuggccucugcuacauugugagggccaggccucagcuaggcuguauaccaagauacugucugaaccagcaaaaccaaaauguauaaaauauauuacuauaguauagaaaauauuugcacuuugauuccuuggauagguucuuagaaugcucucagaaugucuuaagagaaggaacgaaacaguguuaaaguagguuugaacauguuuuaaccaagcucuacaaacaaauguucuuaaagauugucuuuauuuuagcaccaucccgauugcugagagauuuuucaccagcucuaccucucugacucugaagcaugcugcaugguauccaagugagaugcuggauccccacauagugcuguugacaucagacaacgugauaagguaaccuuucccuugccuaguuacaccuugugaauggaaaggcuuauuuacugagucauugcucaggauaacacaauuaagucacugaauguugugaugucuuuaucucagugccuauuauaaaccauucuuucccuacccuccuugagauauugucucacugugugcacaaggcuggccuucacuuauagagaucccugccucugcuuaccuagugcuggcaucacagcuuuuaauagcacuucucucccugcugaaugaugaaggcugauuguagaacuuuuaauggcaucuuaaagagauuucauagcuuucagcuuacucuuaguuauuaaaacuaguguuaaaagccaguguggcggcacacgccuuuaaucccagcacucuggaggcagaggcagguggauuucugaguuugaggccagccuggucuacaaagugaguuccaggacagccagggcuauacagagaaacccugucuugaaaaaccaaaaccaaaaaaacuaguguuguugaugggcggcagugguggcacaugccugaggcagguggauuuccgagaguucuccacuagccugggcuacauaaugagacccuaucucaaacaaagcaaaaaaaauaaguguauccagcuuagaacucugaucugaaaauauuuuuaaaauuauauauaugaccguuucauggucaaaacugggucuuaaggaaacuggagaguggagaggcaagcugaguuuuuccucuuuuucaacacuguaaguacuguacugcacauuaauguacaguacaguacauucugaggcgcauaguaaaguguaaggacuggggcugcucucuuccucuuagcuccuuccagaugagcagggauaacaggcaagugaggcacaaagacccuaccuguuagcagugaguacaauaucugaccuugguuuaacccaguuccaugcauugcuaaugaucucugaauguggugucugugcacagaugguguguguuagggcacauuguuuaacuucccaacucccucgucauugaggacaucuguaccccacuguuuucuuuguugucagucaucuagacucaagguggaagauucccagacuuacuauauccuguguccuuuuuuuuuaaaauugcauuuaaaaauaagggcauguguaugugugugcacacacaugcucacaugugcgcuugcaugcacaucuacggcccacauaugaaggucaaaggacaacuugcuuacagaacuugauucuauccuuucaccaugugggucuuaaggauugaacucagguugccauggugacaggagccuuuaucugcugagucauucugacaguccuuuuauccuuuuaaccuaaguuuuaugaguuuucauauggacccauaccagugcccuguuuuccuccaagagcugcagaaaauagauguaguccuuucaagcuuucuuccuaguuucccuuuuaucuuuuuuuuuaaaagauauauuuauuuuauguauaugaguacacuacagcugucuugagacacagcagaagagggcaucagauucccuuaugguugugagccacuaugugggugcugggaauugaacucaggaccucuggaagagcaguuauuuguuuguagccaucaucucuccagcccccuuucaagcuuuaguauaucccuuuuagaauuucuagaagaguagacaccuuaagcccucagcucugacauaucagguucaccuaagaauuucuuugauggcugauagguuucuccugcuuauuuagcuagaacuuaaauaccagguuuucuuaugacagguacugcugcaucuucucgcucuuccuucuagaaccuuuuccugucaccuacuuagcuuuguaauuggaguuaacaaagaggaaacaaaauuaucccaugucagaccuuacucuguacuaccaaggaccccuugauaaucuauuauuuuagcaucuuuuguauaugcuagaaaaggaagugggggauguagccuaaagcuauaaaggugucuggcaacaaauagcaaggguuuuguguaaaauaugggucuuaauccucucauucugagccuugggccuugccggcauugguugcuuagcugcacuuaugucccuuaguauuugccaacacgguguuuaugugucaacaguauuugcaugugccuaaagagaccacggugaauauauuuauuuagaucaaauuauuauuaagagcacgugcuaaagaaauauuuaugugacuuuuggguuguuuuuguuuaugugagacaggguuucacuauuuuuagccuuggcuguccuguaacucacuguauagaccaggcuggccccuaacucacugagauugaccugccucugccucuugacuucugggguuaaaagcaugggccaucaugccuggccaugaaaguaaaauuuuacugauaauggaauaaaaguuuaaacauuauuaguggaaagagacaaguggcugacuuagguaaaacuuagugaugagugauggacaucggauuuucuaguaaugacagugcuaguauuuauuuugaauauucuuucaucuuuaacaagagcaauauaugcuaugaaauaaaagauguuuuaggagauggaggauuggcuuagugguucuaagagcgugcuuauuucucagcacccauauugagcagcucacacugccugaagcuccagcuccaggaaaucagauuccccuagcuuccaagagcacauaccuguacguaauuuaaaauaaguuguuuuaaauuaaaauuauuuugguaaaacaguucacucucuuuugggagcaugggggcggguauugaaacaggguuucucugugcaguuuuggcuguccuugaacuuguucuguagaccaagcuggccuagaacugaggacugccugcuucugccaggcuaacaguucacgcuuaugcugcucuuugagaaaacagggaugacacaauauugagucuuuuuguaauaagcaucuuauagauuucagguuaaauaccacucagucuucugaauauuugauauauaaauacauuuuaaccacuucuggucuuagcaagauaugguugcugcuuugugugguuuugugucuagcagacaaagacacaugguaugauuaaagggaagcuggccagccaggagccacagugagaugacuacacaaagcucuccagacagaaaggguagaggugcagucacaugcaguagcugccauagaauugugauaaaugugggaaauguaguucaguggucaaauaccuaugguugaggccuuggguuccaccccuaacacuauuaccucucuuccucccccuucccccaaaauauguuguuauagauagcauuucuucagcucauaaaccucccucuuauguaguuaagcagaggaaauaggcaguauugccaggaauagcaagauguuugacaaagagcugauuuaagaacuggugauuugcugggugugguggcgcacgccuuuaaucccagcacucaggaggcagaggcaggcggauuucugucucgaaaaacagaaaaaccaaacaaacaaaaaaaaaaagaacuggugauuugagauuuuaaaaauucucuuaaaauuuacuuuagguuuauuuuaugugugugggugucuugccagccuguguguauguauacuguaucuaugucugauacccaaggaugucagaagaggagggauccucuuuaccuggaguuacaaacgaugugugccuccauggaggugauagggaccaaacccaguuccucugcaagagcaucaagcgcccuuaacugcugaugguaggaaaauccuuaagaacugaguaugugggggaaggggcuccuuuucuuggaaaugaaagaaaacuuguauuuuguugaaacaguaucuuacucuguaacccaugcugcucuguaaccgguguagcuuguaacuugguguccucuugccucagugucccaaaugauagaauuuuagugugagcuacucuugccuggcuucaaagagaacuuuuuuuuuuccuagaauuuauucucuccgugagccccagacacccacuaaggugauuguacuuucagaagcagaagaggaaaguuuaauacucaauaaaggguaaguuuuuauuugugucacaaaauacugaguuuauagagacuauaaaugcaguuuuaccagaacuacaaagaauuuccagaguuaaguuuuagaauacuugugguauuauaacaagaagucacaagucugaaugucacuguaacuaacagcaugaucucuuuuugagauaauucuaaaauacaguuggcaggaacaaugcauaauaaaauuugaacaguucuaaaaauggcacaguguugggcuggagacuuaagcagugugcucugugugggugaagcucacugcugaacucccagcucugugacagaauagacucagucauucugauuaacagguguuuugucuuuuguuuucuuuucucuucuuuucuuuuguugagacagagucucucuacauagccuuggcuguccugaaacucgccuuguagaccaggcuagccucaaacucacagagauccaccugccucugccccccaagugcugggauuaaggguguguaccucuacgccugacuuuuuuuugguuaucuugugcuccuggcuucuuucuuuuuuuuuuuuucuuaucuacuacacaaccuggcuuaagcuuaccacaaauggaaucacccugugaacuuccaaaccaaacccucuggccucccgaugagucuuugugauucgcacagcacauggucacguggacuacacaugcuuagaaugaaaacuagugccaagauuucuggauuuuucauuuaguuaucuucauguuuagucuuuguucuaaacauagucuugaguauuuugugcaucuuuauccuguuuuugaucauuucaguacuggcaguccucgugggauggcgcugauauacuuaaaucuguguugguuucuuccuguccugcagucuugcuuuucucauuguugaugaucgcuuacuguaaacuuacauuuacuugcucuucaaguguguggauauugagagccugagugggauauaaugcauuuaucucuucuacugcugggagccagggguugcuauagccuggaacuguuuacucccuggcugucccagcacugaaaguuuacuuaaaugauaugaagaaauagggcaccagcuuaaauuccaaugcaucauuuccauaacagggcaggaccuagcucagaggucauccuauucuagagucaaggcauuuucuguucugugguauauuucuggggcuaaccuaguugggugguagguggguuuuguuuguuuuugauaggcacaguauguauauaagaggcaguagagcaaauauagugauaagaacucugcucuaaaaaaaaaaacucugcucuagcugggugguaauggugccuuuguucccagcauucugagggagagauggguggaucucugaggacagccuggucuacagagcaaguccaggacagccagggcucuguuacacagagaaacacugucucaaaaaacaaacaaacaaacaaacaaacaaaaccagaucucugcucugguaucagucacccaaccugguugcaaucaagccucaaccacuugccuacuuuggcaucuggaaaaguuuucuaguuguacuaagcuuaauuucuguaacuauauuccaugaauauaaaaaauuggcagagcucauuucuuaggauuauuucacagagugaaaugaaucauucauuagaaagugcucagcaggggcuggaaaaauggcucagcaguuaagagcacugacugcucuuccagagauccugaguucaauucccagcaaccacaugguggcucacagccaucuguaaugggaucugaugcccucuucuggugugucugaagacagcugcaguauacuuaacuuauauaaauaaaauaaauaaaucuuuaaacaaaagaaacuguccagcaaccuugaauauagcuuaauauauauaguuauagacuauauuuagguagaguacuuaccuaaagggcacuaggcccuggguaugugauuguaucaaccauuucuaugcccacagauccccagauaaugacacggaggcuuauauuuacuaaugaaugccuaggccuuaugccaggcucguuucccacuagcuugugacucaauuauccccuuuauacuaaucuaaguucugccauuuggcugguuuguuaccucuccucaguuucauucaucugacuucugaguccaugugacuucucucugaccagaagucccaccuuacuauucugccuuuugcuauaggcuguaggcuuuuuauuuuaaccagucagaaagugccauaggcaggcaaggaaggacagggacacaucuucacacaggguacaaaaacgucacuccaacacucguaccaggaaaaggagauugcuuaguauguuguaagccagaguaagcauucauaccuaauuuccagucagucggucugucugucucuuuauguuuguuuguuuauuguguguguacauaaauaagcucauguugcauacauguguguguucaucccuccuucaagaagucaguucucaaccucugccaugaguaucacaaggauccaacagacugucagucuuggagucaaguaccuuuccccacugaguuccugcucugauuuuugagacagguucucacaguagcuccucuggagacacucggauuacuuuaaauagugcucccaccaacacccuucggcccuccuuucucuaacaccacguucuuucaggaaaaaugacacaggucuauaauguuagcacucggaaggccaaggcagaaagauuguuacagguuaagucagucuguaagagugugugaccugucucaaugaaaccaaaaauagcaacaacaacaaaaaaaucauuuucugaacuauuauuuuuuaucuucacucaagagcagagccuuucuuuaauuugcugauauauuuuaugaaccuagaacaguacauagcacauaguaaaugguaaguguuuauggaaugaauaaauuuguauuuaucagguuuucauguuuucuuccauuucuuauacuucuauauauguguuguuuguaucuccauguuuaaacuauuucaaaauuaaaaauuuucacaaauuuuauaagaauuuguuuauucauaauaauuuuuguuuucaacauuuuuuuuuucaacucuguuugcagaagagcauauacagcgucucuaggagagacugcaguggcguuugacuucgggccccugguaaccgucucaaagaauauauuugaacagaaagacagagaugugguggcguauccacuguacauccuguaugagaauggggagaccuuccuuaccuacgugagccuguuacacagguaaggaaggcagcagccacuguugcugucugcaucgccacucugcugaaggaagauccacaucucuguaucugagggauagaugagaaauggcacacuuuauuugauuaccuacuuccuuguuuauuuaaggaaguuguaagguuaggaugaacugaaaaggcauugcuucucuuauguaaacaagcaucgugaguggguaugauuagauguaaucugacauugaacuccuggagaaacaggcauguauacucacagacauaggauucacuccccaguagugggaugcaguaagugcucaaaggaaggagacauuacagacauuauuuugaguauaggagcuagggggauuuuuguaguaugggacuuaacaagucucaagcaggcauaaaugaaacaucaaggaacaguuagagcaguuuagucacaaagguauccuagaguagagcaugcaaaagcacagaugccagucaagguuucagugacucgacaucuugaucucaagcagugaauucagguaaaaaacaacaaauauugaaguugccgugcagguaaaaauugauggaguuacugccucaguaaggaagaugcugaggucuguucuaaaagagcagagugguuucugagcagaguagaaggcuggugagggacucgaguggcgaauguuuauaccugggacaccugagggauuuuagcauuguuuuuguggugguggugguggugguggugguggugguggugguggugguguuuaaauaugaguuuugcuuuuuugguguugggguuucuuuuuugguuuugguguuuuauuuuuuggcuuggucuuagguuuauucauugagcccagaaaacaagagaaaaaaaugagacagcacucugcaaggacgugaugaaagaggcagagagcacaucagaaacaaaauugucgggagcauuaacaggguuaggcagcugcauauggggucauguguuuuucauuccagcacuuaggaggcagagacagguagguagauuucuugugacuuugaaucuagccuagucuauacagguuauagagcaaguugcaggauagccaaggcuauguagagagacccugucuaaaaaaaagaauaucagacaacaacaguuaaccaguggugauacagcaggucagguuaaaccuuuggauucagcaacuagaaucauaggugaucuuugcuagaguacuaccaguggaguguugcaaaugggaaccagacugcaugugcugguacaugccaguaauuccaucccaccaaaggcugacacagcaguccugaguuuaaggcuagccuggacuguguaauggcaacuugucuuuuuuuauuuuuuuuaauuuaucuauauuugauguauauguguguuuugccuaaauguauguauguguaugcagugcuggcagaggccagaaguagacaucagauccccuggaacuggagcuacaaacauuuaugagccacauguggguguuaggaguggaacccagguccucaagaguagccagugcucuuaaccacugggccgucuaugcagcccucugucccucuguuuugucuggugguguaguaauuacagggauggaaccuccagucuuaccacuaacaauagauaccagucuugccccgagccucacagacaaucuagugucuucuaaggcauaauggauucucuuggaauccuagcucuggaagcuguaacgggggucaggaauuaaggcaaccuagacuacuuuguacuuugucuggaaggaaaaaagaaacuaaacaaaacaaaaaccuggaaucucuucaggcacugcaguuuuccuuucaaggagaugaucucagaccaagagucaccaccguuggaaugugauugggaaaggagaguagggacagucuccuucugugagcauuuuccugauagugcuuuuauucuuccuuuagcccagggaauauugggaagcuguugggcccacugccuaugcauccugcagcugaagauaacuacgguuacgaugccugugcuauacucuguuugcccuguguuccaaauaucuuaguaauugcgacugagucaggaaugcuguaccacuguguuguacuagagggagaagaagaagaugaccaaacgguaaguaacaggcuaguguugcuauauuucauaucuaauagcagguauaguucaugggccacuuugacugcuuaaucaugagaaauucuagcuuacauaugguacuuuugauauuuugguaauuauauguuuuauauaagaauaauugagaguccaaguagaaagaagaaauuugccuaauuuagaguccaugaaacuguauuuguuucugaccuuuguauuaaggguuuauaccuugcaccaguaaguugacuccucuaaacauaagauugcucuuggggcuggagagggggcucaggagauaagaacacuggccacucucuuaagacccagguucaauuccuaacaccuacagcucagcuguuuguaaucccaguaccaggauaucuuaacacacucuucuggccucuguggguaccagguaugggagugguacacagacauacuugcagauaaagcacauggguagguuauuguguauauggauacaugauaaauaaaagguuagaccaugcuuguuuguaagcuuucaagguuuuuuuauuuuguuuuguuuuuuuaauuuaucagaaaaagggcaucucugcuggaacuggaguuaguugucaugugggugcugggaacugaaaguggcuggucuacaagagcagacagugcacuuugccucugagccaucauuucucuuacaccuguucuuugacuuuuuuuuuuuaagauuuauuuauuuauuauauguaaguacauuauagcugucuucagacacuccagaagagggcaucagauuucguuaccgaugguugugagccaccuugugguugcugggauuugaacucaggaccuugagaaaagcaguuggcucccuuaaccacugagccaucuagccagcccuguucuuugacuuuugagacagaguuucacuaagugucuaaugcuggccuuaagcuugcuguacagaccaagguggucugugacugaaacccuccugcuuuaauguucccacuuagugcugagguuacaguguuuaacaccacugucgauggugauucugggccucuauagucuuauuuaaauuuugguuucuugagauagggucucucuauguagcccuguccguuuuggaacuugcuacguagaccaagcuggccuggaccucacagagaucagucagccucugccuccuguguauuaaaggcaugcaccacacccagcuugauuucuauagucuaguccuugguaacaaagguuuugaccuuugggccaaaucuuuggaccacuaggccagcuuuuccccaggcuccugauguuuuuguuauugcugucuaagguuaacaggggagagagauguuuaaggauaggguacgacuaucugaucaaacuuuugaaaggacuaugugaccugucuuuuuuuguuucuguguuuguguacauuuucaaauucaugagaggucuaaauuucggucuuuguuuccccuuuguguuuuuaacaguuagaaaaguccugggaucccagggcugacuucaucccuucucuguacguguuugaguguguugaguuagagcuugcccugaagcuggcaucuggagaggacgaucccuuugccucugacuuuuccugcccaauuaaacugcacagagguaagguguucacccgguguacuuacacuaacucagcacugugguuacuuacucuaugguuauuccugugcucucaaauuuugaaaaguuaauuggauucuuuuuggacuuuuaguuacuauacaguacagucuuuccuaggcaaacucauuuuaacacucguuguggcuccacacacauaauuaauuuuauuuauuacucugugugugugugugugugugugugugugugugugugugugugugugugugugaaguuuggguaccagaggacagcucuuugauucuuuccauuuuacauggauucugaggaucaggccuggauggugggcacuuuacccacuggugccacccauuuguuugaugaugacuuuuuccugauccuaacauaguuggcauaguggucauaucuuuaaucucaacagaaggccaaaucagaagguucaaggcccucucggauaauauaucagagcaauauuccuuauauaauacaacugcaaagagaaaucacuaagcaucucuacaaaaucaaaauguuuaaucucuuugaaaauuuuuuaauuagauuuagccauuuuauuuacguguuuggguguuuugcuugcaugugugucugugcaccacauacauggagaccugaagagggugucagaucccuuugaaacaucaugugggugcugagaauugaacgagggccugugaaagagcagcugcugcucagccucugagccacgucuccagcuccuuuuaaagucuuagcuuugcugaagauguggcuaaggacaaguauugcuaacacugacaaggcuuagaaagggcucaauccccagcaccaccgcaugucuguaaucccagcacuuggggucagaaguuaaaggccauuuucagcuaaguuuguggccagcaugggcuacaugagacccugucucaaaaagaaaagaggagggcugcaaaguggcugagaggauuggggugcuugucaccaagccuggcaaccugaguuagaucccccgcacccauauagugaagcaagaaacggcugucugaaagguguucuccacaugcaugcccuguuacucucucucucucacacguacacacacacacacacacaccuggaugcauacacuauaaauauaauuuucaaagagaucuuaaccauagagauaaaucuuuauaaguagcauuagaaauucaagagaggugaacaugguaguauagucauagucacagccccuugaggcuaaaguaaccuagguucuagcuguaaaggacgugauaucuuauuucacaccugcuuauuguuugauggugggacugugugcugagcacugugcugaugucuucugcguuaccuguccuacauguacuacacucguuacauguacuacacucguuaugugccagugggugugugcaagcuacccuuuuguuuguuuuuuuguuuuguuuuguuuuugugguguuuuuuuuuuuuucaagacagaguuucuuugaguaucccuggcuguccuggaccucacuuuguagaccaggcuggccuugaauucacagagaucugccugccucugccuccaaaaaggcauaugccaccacuguccagcuuuuguuuuguuuuguuuuaaacaaaugaaaacuccuuuaguaauaacauguaaugguucuggcugauguacaagugggaacuggccccaaacagaaaauuccccucaacuuucauagauccacaacagcaaauuacacuuggaacaguuaaacguguuuugcagaaacagaaauuccaagauuugguuuuggacaaaugacgagcucuacaacauaaaauacugucaaaaguucuccccacgaagaccaggcccacucugcucagcagcuguuaaccaaggcugucuucucuaaacugccuagcagaggcaguaagcuuuacuuuugugugacuuaaugucuucuaaguaaguuuauugguaaauccuuucuaaggucaguucacggcuuccauuuucuuuauagggugcugguguaacaggcuugcaccaccacacacagcccucuuguauguucuccacuugcacuuagacacuucucuguuguauuucuaccuuuuuacaaaaccacuggcauauccauucuugcaccuuggggaguuuuccuaacuugaacuuggccagacaggguggacaagggauuugcuggcugauguuuucuugggacauugcuccaccuuuucuugcucugcuugguucuuugguaucuccuuugguuucuuucuguccucuuuccucuaccucuguucuuccuuugcuccaucuuuaugaugauuucuauaggacucuucuggguauuguucccaauguauaacuaguuucuuuuaacaaaauuccaaguuuaugauuuuuguaaaguugucaucagcauacagcuuuugguucugagaaggucucauucucagagauuaaaacaaaaaucuuuagccauacaggauuauauccaagaaagucaaucccagacgucagaggaccccagugggauaauggcccucuuucuacuaagucccgagcuguagaaucuuaauacgauguguagggucccguucuuuuuuugauuuuuuuuuuaagauuuauuuauuauauguaaguacacuguagcuggcuucagacacccuggaagagggcacuagaucucauuagagaugguuaggagccaccaugugguugcugggaauugaacuuaaaaccuucagaagagcagccagugcucuuaaccucugagacaucucuccagaccaugucuguuguuuuuaauuugaaaauggaauucaagccagguacugauggcacacaccuuuaaucccagcacuugggaggcagaggcaggcagauuucugaguucgaggccagccuggucuacaaagugaguuccaggacagccagggcuacacagagaaacccuuucucggaaaaccaagagaggaagagagaaugaauggaauucagauuaaaaacuuucaagucccugacaacagugcacaacugugaaaauccuguagacaguggguuucaucaccauguguuuguaagccacugggguaaauucuucuuguuuccuaguugcuaucuuuguaucuuugauggucucacuugcagaucccaaguguccuucgagauaccacugcagccaugaagcuggcgugcacaguguggggcugacuuggauucacaaacugcacaaauuucuuggaucgggugaguuacuaaguuucuguauuucccaguaaguuucagagauucugacaaaguguaguuuggagaagcaaacauuagaaucagugaaccuaagcguucuuuagaaggcucauuuucagagcugaugaaccuuuagccagacagaccaaauacuagaacaaaaaaacccuaaaauuacuauagucagaaaacauaggcagauuacuauuaagccuauagaaauuaggaggccuagguaaaauggauggacuucagaacugacuggaaugcccuaaaccaagugacuuuacauuuaaaauguugauucuccaugagcuucucccaaaaaaacaguacuguuaaccucaaccugugauaccaaagccaagcaaaauaaucaaacuauagucaguguuaagaacaaucaaagagccugaauauggcucaaugguaggucauucgccuacaugaagacugacugauccuccacacuacguaaaacaacaaaaucaacaaacuaguuuuagaaaggaauuuugucaggcaaauaaagagcacuuaugcaaaccugacagcgaacaccugaauggcaggcugaaauguuuuccguuuugaauauauuuauuuuuugagacucguccaugcagguguauuuugaucauauccacucccucacacacacgguuuccuuaacucuucucagauccauuucucaagcccuaagcccccucccaacugucuuuuuuuuuuuuuuuuuuuuuuaauggccuaaguucacauugugcugccuguauucucauguauaugguaccaugcauagggcaugcucaucucccgggagccacacacuaugaaaacuggcucacccucucccaguaaccagcagcucucaauaacuguucagcugggcuuugucugagaagggcgcccucugugaaaaguagugacuugagacaagaacuuaaauacauuuaacaaaugacaagugcuugaacuuggagcuuugucuaaguacauuaauuucuauaaugcauucuuuuguagaugaagaagauaaggauaguuuacaagaacucacugcugagcagaaaugcuuuguggagcacauucuuuguacaaagccauugccgugcaggugaggaagaaccuucuuuacuuguaggagcaucaugguuaccagguguuuguuuaucuaaagccuucgugugcuucacagcuaccucaccacguccugugugcccaacuacagcuugccaucuucucuuagauaauuuuuauuuucuugucuuaaauuacuucuucagagaagggucccuuaauucuccaggcuaauuuggggcuuucuuuguagcauauccccucacacacacaccacaccccacccccuucucaugugugggugugcacuacaaaggcagucucuuacuuuuuaugaggauucuguuggcuuugugccuucauacucagaauguaagagugccuaguggauauucaguuacugugacgaguaaagaaaggugcauggaaugguccccaggucccuugucugugugaaugaacagauguucauuccccuuugggggggaaaaaaaagaugcagaagagcagauuugggaagaugucccucuagaauguuuaaaguagaagagccuaauacacauuuauguguaugggucuaaaguuuguaaauugccuggaaauaauaaaaaugucagcauugaaccugugauucugacagauguugacuaagaaaagaucuggagucagaaaaagagacuugagauaaacaagcaacacauaauuaauugugagcacugaguggagcagaagagccaggaaggcaagggguucagagaacggaggagaacccagagcggggcugugaugaacgccaaggagcgacuauugacaagaagacgaaguaguauuggauaagcacugccaggccggagaguagagacuccccacucuacuggaaggauugaggaaugacagcaaaaugugccagguuaaaaaguggacagggaacuauagccauauuuggcuagagagauggcuuugcaguuaagagcacccagcuucauuuccaaccacagcucacacccaccaugcaagaaaaacacccaugcacaugaauaacuacauaaaaugaaagugaggcaaccgcgacacggcagugugagauggggcuagugguuuaccuuuaugaaggauggacauguaggcuucgauggcugcgacugcugccuccuccccuuuugucuucaagguacuaaaaucgaaccuuggaccuugcuaggcaggcauucuaucacuaagcuguagccuugguuuucuuuuuaguacugguuacauguuguauaugcacauuuuuauauauggauuacauacugacaacuguaugacaaaguuuauugagaaguauagacuuugguuaauuuuagugugugauguuuauuugcaagguuuuuuuuuuuucuuucuucuuaaaguuuauuuuaaaaagagaaaaaagagauggggaggugugucuguggauaacagcacuugcugagcaagcuuuaagaucugagcucaaacuucuaaauagauuaaaaaaaagcuagguauggccaaguacugguuccccgucuccaguagggacagaaacaggaugauaacugggacuugcugguugccagccuggcucagugaaacccuggcucaagggaccaaacugaagcugugccuacacacaggugugccaauaggcacuuguauauacacuguauacucauacaugguugcuguuacaaaauaaagaacaagucaaaggaagccagacugggcacaaugaagcuucccgucaagccacaguggggaaugucucaugaacaaaacuaaacacaagcuugucuauaagcaugucuaacaugcauaaugggacacuuugaaacuaugcaguugauggcacaaggugcagaaaugugguuaggcacaaguaggacaggcauguagacauaaagcacauugguggggacagcaauucccauuugagacccuuguuuucuccccaccucuggugaaagaaguaggaaggaaacaaaggaaacaauguugugcacacuaaaugaagugaauucuuguggcagguauugggucacuggguauguaagauuccaaagcucucuucauuuaggucucugagcagcuuguagacacugaacuaggcucacugagauagaugggccuuagauguuacuggggagaaaaacauauaagcuguguaucccuagauaauugguaaauagcuuguagauugcuacuaagugggagcuuuguuuaaacugaucaagguauguuuccaaauaaccauguuuggggugguuacugcauugacagucaggaugucacaggccccaaaaggccuggaccagucauauaguugcuauugguucugguuaacugcugcuuuguaacuuuguaaccucuuugcaggcagccagcuccaauucgaggauucuggaucgucccagacauccuggggcccacaaugaucugcaucaccaguaccuaugaaugucucauacggccuuuauuguaagucccauucuguaucugccacauaacucucuaauucugccaaaucaacgcuggagagaaugcccuuaguaacuaguuugaggcugugugguuuaaguuuuggcuucugaauucagucaauauuucuguuuucuuuacuaucucugaaaaaguuucauuuuagacaucaugggauuuuuuuuggcucguaauugagaaucauagcuuuucuguucuguuuugagauagggucucagccugcaguccugcuggccuagaacaggcuuuaccucaucugagauuacuacugugauuuucuacacccagcuagagauuuucucccaaguacagaggauugagacacuggacuacauuguugugauuggauuuaguugacuguugcaugucaggcucagguauaagauauucuccuguauguccuccuggacacauuagagaagccccaaggaaucuucuaaucuccauguaauagaaaaaggcuuaaacaagucaaggguugcacauacauauagcucuggugcacaugagggucugcguggucccucucucugccagccucagagggacauugcacuauguaaacucugaggaaacaguauaaagcugaguuuauguauuaaguuguaaucaccaguucccuuggaaggucuuauaaacguagaaauagacaugcaaaccaagucacugggguguuaaaacaugagacuuugcgaucucuugguguccauucagaacagguacuucugacagaagugugacagaagugugaaggguuugcauucaguuacuauccuuacaugccuuugguuuugguuuugguuuugguuuuuugagacaggguuucucuguguagcccuggcuguccuggaacucacuuuguagaccaggcuggccucgaauucagaaauccaccugccucugcuuccugagugcugggauuaaaggcgugcccaccacacaccuggcuuccuuacaugcuuuuuaaagauugaccaguuacacugcuugauaagaaaaaaaaaaaauuacaaguauaaauuuuauguugcuuuauauaaaaaagacauuaaaauucuaacaacuuuaaacaaaagaaauacuaggaaaauauuugccugagagcugccucagcagguuaagagugcuugucacugacucugacaaccugaguugaauucccagaaccaugugacauagagaaacucuccuuuauacuauccucugaccuuguacgugugcugugccaugcugugcacaugcacaugaagcaaauaauagguaaaaauaaaacaaaucuuccagggauuaauuuuuuuaauccauuauauaccuaccuuuuuuuuuuccaauuuguuauuagauauuuucuucauuuacauuucaaaugcuaucccgaaaguccccuauacgcucccccugcccugcuccccaaaccaccugcuuccuggcccuggcauuccccuguacuggggcauauaaucuuugcaagaccaagggccucuccucccagugauggccgacuaggucaucuucugcuacauaugcaacuagagacacagcucuggggguacuggucaguucauauuguuguuccuccuauaggguugcagaccccuucagcuccuugggugcuuucucuagcuucuccauugggggcccuguguuccaucuuauagaugacugugagcauccacuucuguauuugccaguguuuuuuuaaaaagccagucaugcuauuuggauaauaaaaacaucaaucccaaagugaaaccuuuuuaucuggguaauuuuuaaucauauuucuaccaacugccugaaauaccaguugucuacuaacugguauaguaacacuguuacuuauaaagccccuccaacuaggaauugaauuggugccuucaaaguaaguuacuuacaugcugccaaagaccacagaccuuugagcuuucuuggaaauugucuuuggaaauguuugcucuuggauguaauuuuuagaaagcaaauucugaggaaguaaauucuguacacagcagucaucuggucccacagccagcuuuccucaaaucucaacuaugcccgaaaaaggagugguuagcauugugcugcugacucaaguccuuugcaagaaaagggaugugugaguugccuugaucuuuucaaaaagaauuuucagucuaaaaugcauuuugagucaaaauguucaaauaacaagaucagaguuccccaagaugaccuuucaggccagaacacacauucuugucauauuccucuuuuagguucuuagguuuuggguaguguggcuaauaacuccauaguggaccugacuuguuuauuuugcagaaguacaguccacccagcaucuccuccccugcucuguacccaagaagaugcugaaguugcagagucuccacugcgcauucuggcugaaacuccagacuccuuugagaagcauauuaaaagaaucuugcagcguagugcugccaacccagcauuucucaaguaggaaauuuagggcauaugaauuuuaagaugggcuuuuugguuaaaauggggauugaacuuauggcuuugugcuuacuagcaaguguuuauuguugcuuuugguccuuuuucuguccuuacuguggugcagugggaggggacuuggcacaucucuucagcuagucuaggacuugucuauuugguuguuuuauuugacuaaugagaauaaugacagaaacuguucugcaagaucaucugaaaaggauuuggcucccccucccgaggagugucuucagcuuaucagcagagccacccagguguuccgagaacaguacauucucaagcaggaccuggccaaggaggagauucagcggagguagaguccugugaugaacagccacuaguccuugcuagggguugcucaauaacugucuauggaagccuggccuuccuuuuaacuuuacuacugcuucuuuuugaagggucaaauuauuaugugaccaaaagaggaaacaacucgaagaucucaauuacugucgagaggaaagguagguaucaaacccagaggggagagaacaauggugaguaguggacugcauucucacuuaggaugcugugccacaucauacggacccccaaggguuucucaucucuucaggaaaagucuccgggaaauggcugagcgcuuagcugacaaauaugaggaagccaaagaaaaacaagaagauaucaugaacaggucaggggccaugaagcauccaguuuccugcccacacaggguuaaugaugccacaaguauuuggguacugccaguguucacacaccuauagaguaaaauggaucccccaacccuuugaaguacuaugaaagaggacacuguccccugaccccuucucuauugucuccucaccaaauucuugagcuacaaacuuuguuucucuuguaauuagcacuuuacucacauuuccuuccuuuucuuaaggaugaaaaaagugcuucacaguuuucaugcucagcucccaguucucucugacagugagagagacaugaagaaagaguuacagcugauaccugaucaacugcgacaucuaggcaacgccaucaaacagguaagaaugggugcaguaaucuagggaauaguuuuauaaagugugaacaguaaaauacuguaaaaaugugugcaaaccauagucaaaauaucuguguucuguuugguacuugagguuacuaugaaaaaagauuaucaacagcggaagauggaaaaagugcugaguccucagaaacccaccauuacucucagugccuaccagcgaaagugcauucaguccauccugaaagaagaguacguuuacuguugugcgacagguuucccuuggcgguauaccaaaagcugccggucugccuggauaagaauccggaguccaggcauuugcuugcagaauggggcacaaaagacagaguauaugguggaauggaaaguaguggcuuccuauaauauaauuuuguugaauaaucaaaagaacaucccaguuaugguuggcaauguuccugggcuggggcucaguggcugauguccuggguuuagaccccagcacuacacagaaaaccacugcuguccaacugaaaccuuuugagguuauucagucuuagcaaagccauucuuaggucuauugcaacacuuaagaguuugaagucuuacaacucacugggcaugguggagcacaccuuuaaucccagcauucggaauuagcauguggaucuccgaguucaaggccagccuggucuacagagcaaguuccaggacagccagggcuacacagagagacccugucuaggauggugggaguccuuacaacucagcaaugacagcucaucuuauucauuugaugauuuugcaggggugaacacauaagggaaauggugaagcaaaucaaugacauccgaaaucaugucaccuucugacaccaccuggaaugaacauaacuugaaggcuguaaaacaaacagggagcacuguuuaauuuauaaaggagcauuuuggauaagauuuggugugguuauucuuuuguuauuccuuuuuguuauuauuucuguuaaauaaauuuauuuauucaaauaaaguuugaauaaauuuuuauucaaaaauuugacuuugcuuuacaauu

SEQ ID NO: 6153 - RNA, 7757 nt, Mus musculus
ugggcuuuuuuucucuguacaaauuuauuauuuguagauuuuuguauaacaugaugauggacaauaaaucugacuccaauaaaucuccaggaaaguugagguucuuucgcccacaucagaacaccaagagcagagaugucugaaguuuuaauauaaaauccguuauauacaaaaggcuugugcauacagggcccucucaggaaaugaguuguucucagcucaguagugaagugugaggucgggauggcuagaggaucacagcccaggugucacaagucuggauuaaacagaaaacaagauaguguaacaucaacaguuagaucuuacauggcuaaaaguugucaucagucgugacauguguacuacaaguagaaccacuaugaguuaauucacuggaauucaaagaagccacugcguucauggaccuguucuacuaaacagaagccaucagcaauguagcuuauaagccuaggcacccucagaaagcaaaacccgacagcuuggggcuuguggagccugacagcgagccucuuuggauuuaccaaguauucuaagucugcuucacaguagccucuuaagugauccacaccuauacucgccucauccuugguaucugaaucuuaccguuugccuugaugugccuuugagaccuagugacacugaaauuuucaaaugccuccauacuucucagggcugaacuuggagccugcucaaugguuuuuuucucuugcaguuucucaucuguggugacaccccuuacucaacaauagucucucuagccuggccagugcuggucugaaagcacggcuucugacagcauuggucgcacugccguucacuuggcuacacugcuguugugcauuucaggguacugaaggacaagcucugcuugucgguuaggcugagcaggaauaauuaggcagucaucugcugcuuugagguuagggucuggcuauuuugcucaggcuggucuugaacuacugggcucaaauuaugcuacuucggccucccuaguuagaauuauuggcauacauagccaugccugccugcuugcucuugaaccucucuucccaucuccaguacuugguuuggaacugaacuuuuuuuuuuaagauuuauuaauguccacgaguacucuguaacagcaaacagagcccuuaaccaccuacuugaaacugacauuuaaaagaacuugaugccaggcagugguggcacacgucuuuaaucccagcacuugggaggcagagguaggcggauuucugguucgaggccagccugguuuacagagugaguuccaggacugucucaaaagaacuugguacaugccuuuaauccucagcacuggaggggcagaggcagguacaucucugaccagccuuugagaccagccugauacaauguagcaagucccagggcagccaggacuauguagaccuuauuucaaaagcagauuuuaacauuagcuacuauuugaaguuguacauggcuggugugcuuauguguguguuugugugcgcucacacacgcacgugcaugaguauguaggccucagguuggcgugugucuuuccucaaauugcucuacauugacacaaggacuguagcugaaccuggagucccuugucuggcuaguccauaaccagcuuuucucaggcaucucucugccccuagccucaugaauucggggaguauagguggccaccaugucuacauggcuuuuuauaugguucugggcauccagacucgggccugcaaggcauuuaucacagagccaucucagcacugcacgcauuuuccaggaaguuagaggcugaggccauuuggccugcaccucuucaacucuccuuccguuucagugcauucacaaaaacacauuacguaucuacucacuggugaaagaagucaauauacaguggaggucaaaauaaauaaacaagugggagaaaaauugcccuugcccuuagaaacaaagacgugaacagguaagaaaaacauggagucagguacaguugaagcccaaaaauacuggacaauuucauguaaggggucagguuaucaguacguaucuggcauauuacaguagucuaugaugccuuaguuccccugcuugggaccugugagccaugagaauaugucauauauauuaguacuguuucccacagcaaacucuguuucuuagucagguggcuccuguguguuccucacaccugagcuaccauuuggccaggcuuagaccucuaugcaagcuuacugaaagacaaaacuaguguugcucaaaugugcuuugaguccugugugucuaucuggaaaaagcagugccacucgugaccaugaccugauggcacagaagagcagcuauugcuccugaucuagcaaaagcaugcaguucagucaggcuccaauuuccagacaaugcuggcacaauucuaagccuacuccucccuucucuuaccaggcuguuugacugaaguuacucauuuccuaugauuuaacucuaguguguggaugcacaagcacaccauauguugugggagacaacagacaacuuggaggaaucaguucucugcuucugccacgugagacccaaggguugagcucaggcuuggcagcaagugcucucuacccacugagccauccugccuggccaacaucuguuucugacacagguucucacuauguacacuagccuggccuuaaucucuuccugccugggcuucgauaguacugggauuacagacaagugccaccacacccagcugauucuuucugugaaguaaaugccucaaaaaaaaaaaggcauuaaacaucucccuauuucuaagccauuaccuccaccaagaggagaacagaaccgacuugcugaugggcucuugccugggccccacgcaggcuuaccaggcaguucaucagaagacugggcuucucuucuguuccaccggugacugagaacacagggguguggggacaguguacacugugcucauucacauuuucuuccaaacaggcucgaagcuucugcucugucaggucuguugacuaagaaagugcagccacaaccaagcuuaacuacuguauaaccagcaggcugaaagcugaagccucauaccagucaacugacagcuugauucuugggagcuuuagacugcugggcccuggggacugagcucagguguagagugccuaacaagcgugaggcacugugcuccauucccagcgcagucuaaagcccagagggaguggugcaagccuauaagcccagcaccuggaaggugaggucagaaggaucagaaguugagcuacaaauaagucugaggucagccggggcuacuacuagacucaaccucaaaacaaaagaguggaccuggagagcugacuacgcagugguuaagagcacuugcuguucuugcagagggcccuggaugacagcacccacauggcagcucacaaccaccuguaacuccagguccaugggauaugacacacucuucuuacauccaggcuuuccagacacacgcauaaugcacagacauacaugcagacaaaacacauaaggucuuucugguggacauaggcuacuaggaacaggucuuguuuccuauuagccaagauacugaguccuggcuuucaccuccauggaguccucugccauguuuucucugccaugacggacuguccccucuccucugcuggcuuucuuaucaagugacaagaaagguaacugcuacacauguguacugcccucaaccacccaccagagggccuuuaauacagucuguauguggggaauuggugugggcacuuacgugaacagggaugugcaggccacauggacacgugaccacacuguucauuauucucagguuguaccuagagauagaauuaggauucccagaucauuagaguaauaagaccuggccccucuaccuuccggucaauaaacuggguguggggguggggucacacacacuuugaaguaggggaugagaacugauaaugcuaaaaaaaagauuuuaaauucucacuuuauacacacaggacagaugagggaguuugcuucccacucagccaacauucuccugagacaacuuucaucaaacucuaaguccucuucauacucgcuuaugauggacuuuucugcaaggcaaaaagcccgagguugucuuguauccagggcaggucuauuauuucuauuuuacacauaaaugugaaccaauucaagauaaagcuauguggacuaagucaccgugacauaagaugcagaacuggccgggcagugguggcacacgccuuuaaucccagcacucgggaggcagaggcaggcggauuucugaguucgagaccagccuggucuacagagugaguuccaggacagccagggcuauacagagaaaaccugucuugaaaaaaacaaaaaacaaaaaaacaaaacagaacaaaaaaugagaugcagaacuguacucuacacagagcuaugaaaaccucaagaagcagaugcucacaagauuucaggcaaucaauaaaggauggauaaaucuauguaaagaucugcccauggacgcaaagugacaaguuuacuguaaacuuuuuuucucagagaggcagguuucucugugcuacccuggcuagccagaaacuacggggcucaggcaucuuccugaaaggccaccuuccuacacuaagucacaaguagcuucuacuacaggcacaagccacaguguucagcuuaacauggcagcaagaggcaggagcuuuaaucccuaacacggaaacaaccuaaaacagcaaaccuaauccugagccaggcaaaggccagcauuagggucggucucauagguagggaagacucugcccugggauuaccuucauuacacagcuccugcucgauguccugcagcacagcuagguccaguggcaauuccaacuacaagaaagcagagggcagggguguggcucaguagagcagcacuugccuagcaugcaagagccuggguuuaaucccugagcaagacauaaacagagacagagcagagagaaagugguguuuucccacuccacaugaaguauuaacuggccacaugucucaugaggauuuguaacucaaagaucacagauuuacuggauaaaauuggccugguccacaugcugaauuugcugacaguuugguaauuuggccaagcugaacuaacaacaaaugaucaaaguacaacaguaccaaauuuaagggagacaaaaucaggcagcaguuaaguaaaugaccuucuaaggcuggccgugugauaaagucuggucuuugaaaagcuguuuuagcuuuuguaaagcuggauuaagccugaccugagaggccuacucuaaguacuaccuguggugauguuaggcuaaccaauuagcauaguguaggacacauaacgcuaugggaaaugaaucauuauuauacagagcuuugauggcuucagagguuuucauguuuuguuacucaauucucauaaugcuugugcgagcuucucuauuuuaugucaauguaaaaacuaaggcucacaggaacaguaauauuugugagucaguaaaacuaaacuuagaauuccuaaauccugaugccaacccauaaccuuuccugauacacuguaaaggguuuucuaccgacacacagcuccacauucugaucaacuagagucagaauguagacguccuuuuuaaagagaggucccuagcccauucuuagcaagucaaaauuuccgauggaaaaagcaauaaugaaauuuucuuucccuuuaguuuccuaaguuacuauauugcaagguugcuucaugccuacuaugcauguaguauggcagaaccauggauauauuucuaaugaagguaaaaacccugagccaaaugacggugagaaucaugcuuggggaagugagcagacugaaaggaccaaaacaaacagaugcaaagaggucaccagacgcuccucauggagucaguggucuccuagcuacagagauccuugacugaccugaagcaaggccuccggacaauucuccacagacugcaaagaagcccacucuuccuccauuacuucuugcacaagaagucugucugaggcuguccccggcgugcuaccugcagccuggcgauauuuguucaggagccugugccugcuguuucucauucucuccagacaucccuggggagguaagggagggcaguauugguuaagaagaaaaacaucaauuccacuaaaaagaaaacccuccaauuagucaguaaaaauauaagaaaauucaagaugcaaaauuucauagccucaaguccuccacacacagauggguuacauuacacacauuccuauauuucauauuuuaucuuauaagaagacaguuggauacacaggaacuguauccacagacuaacuucagacauuuauauggcuucuaaauuccuggaauuguacaaauggcuauaguaauggucuucuuguaaaauaguacuuuacaacccugguauggguuuuuaauuuuuuuuccugugucuaugugugugccuguaugaguuuaugugcaccacaccagugcugaugcacaccagggccagaagauggcaauagaccacuuggaacuggaguuacagccaucgggucugcuacugaaacauaaggacucuugagccaucucuccacccccaacucgggacaguuuuuguucccaagugguugucacagcucugcuugaagaacugcuacugacuggugccauuuaguagguggagagaccaaggcugcugcaucuaaguguucuacauuguacagaaccaccucccauaauagaacguucuccuucgaaacgucagcacucacuguugagaaacacuacuccacacaacauguucagcaugaagauuguuuuucugggugguucuucuggaauacacccacccuuuugagacugcugaacagggagauaagcugcuucuuagaaggaacuacuugaguucggaagaaggcggagcuuaaguucaacucuccuaaccgugucugauguucuucaggagagaaauaacuucuaucucacgugacguauacauacggagugcuucccucuguaaccgaacguuagguggugguguugcuacugcugucaugacucuuaaaauaugaaacaaagucgaauccuaggauagcauaacaccuacgccggccaacagcccgggcggcggccgggacccaauccuauagcaagagauccaccucgcuggccaggcacaccgggcaccugcuccacaaccagugcugaagcgagcacaccgaggacagagguccuugggaagauuagggaagugaugacaacccaaacuucacacucaccugccugaaaguuucuuuccaguggggcgagcccaccugcuuguacaacaagcggugcggagaccccgaggacucugccaucuccucccuuagcgggaaacagcgcccaaaucaccgccccuuagccgcgcgcaaaggauucuggaaguuguagucucggcgcagucugucuguacuucaggccgccgggcuuucuuggaauuguaucuaguuucuauccccucacagugacagauuuaggggaauccgaggauagaugaagcagugacaguugagaaguaaacaccacccgggcugagggaggugaaucuugagagaaaguucuggguuuacccagaggaaguuguccaguagacaaucagacacacaucucucauccuuaacgcuacccccucacuggcccagcagca

SEQ ID NO: 6154 - RNA, 6165 nt, Mus musculus
cggggcuuccggcagcgcgcgaggucacacggugccuuggcccggucguccuucccucugcacguguccgccccgcgaugcucccucugcugcguugcgugccccgcgcccucggcgccgccgccuccggccuccgaaccgccaucccggcccagccgcuucggcaucuccugcagcccgcgccccggccaugccuccggcccuucgguuugcucagcguacgggccggcucggcucggcgcucuggccuccugcagcccccgguucccugcgcgugcggcuguggcgcucugcacacggaagguaagguucacgcacccuagucggagugcggccacccagcuuggaacagacccucgugaucgaaagcuuccccccccuucucgcgucuuggaaauguggcuuagcaaaguccguagggucgugguuucaaagugugguuguugguuaugucuuuuggaaccagaaagaggauaauugggaauucuuuuguuuaauaugggaaguaauaguagugaguccaugauaagaaauaaccaucucaugauaaauaucaguucagcucaguaaguauauccugcucuuuuuauagagugagaaacggacguuuuaaggagugauuugggcuagugucguaagaauggauacaguccggucuaucgguaaccggcuuuucucccuuugggucaucuuggcuuuucuuuuaggagacaaggccuucguugaauucuugacugaugaaauuaaggaagaaaagaagauccagaaacacaagucccuucccaagaugucuggagauugggagcuggaggugaacggcacggaggcuaaauuauugcgcaaaguugccggagaaaaguaaguggcccagggcuuguauucuggguucucaagucgggaaucccugacuacagcacccuguccuggccauccccaggagagccucagcuuaggcccaguacuuugauaaaauggcuuuucuuuuuuggguuuguuuguuuuuuuuuuuuuuccgaggaaggguuucucuguguagcccuggcuaucuuggaacucacucuguagaccaggcuggccucgaacucagaaauccgccugccucugccucccgagugcugggauuaaaggugugcgccaccacagcuggccaauaaaauggcuuuuaagaaagcauuuacuuggaaaaguucuuagguuccagggagugcauucucugaaugaauacagacuucugggcuugguuauuaaggaggccugaagcagcuccaggguguguagaggggagucugggagccacaagcgcagucacuggcuuacuaaugagggaugcugugcccagucuggaccuaagggcugggacuuuuuuuuuuuuuaauguuuaauaguacugauaaauucauuuguuuagaacucccaucuggcuuguguuuguaguaguuaaaaaugcaagguauguaacuuuuaaggaagaaguuagaguguagaaaggccaucagacaaagguagaagguucuuagccaagcuuagcucucgcuuuccuaaaccgaucauuucugagacagggucucuguguugcugcuguagagcacagaccagccucugacucuugguccuucagacaccugugugcugagguuguaggcacgugcuaccacacacccuuaagaccguuaagcccuuguuugugcuguucuguguuacacagucgcccacggccuuccuuagagaagucuacuuggacucuugagugcuucucuagcaugcgugaggccccaggauccaucccuggugcuuuaggaacacaguguacaagaaagcaguuuuauccaguggggccuauaagccuagugguagguguguguguguguagauuagaaaguucaaggcuagccgggcgugguggcgcacgccuuuaaucccagccaggcagaggcaggcagauuucugaguucaaggccagccuggucuacaaagugaguuccaagacagccagggcuauucagagaaacccugucuugaaaagccaaaaaagaaagaaaguucaaggccaggcugagcaguggagggaggggcucgccuauaaugcuaucacccugggaggccggaguagguggauuucugugaguucaaaccagccuggucuaugagcaaguaccagaacagccaaggcuacacaaagaaacucucucuugaaaagccaagagagggagacugacugacccggcucagcuuagucugggcugucacagguuguacaugcuuucugguuucaucuugccauucuuuuuuugguggcaaaguggcagcaaggcauugcccagaugaacuccgggaagcagcacccaguacccucuugcuuggguuaguuggcccugcugaaucaguguagcccuggaacuucugcuugcagguguggaggcaaaggaauuuuaucugauuucagaacaugugcugucacauaagaauucugaccaucucacaugggccagggugcagccgugaacuucggccaggcacgcacagaguacuuguuugagcuccagaaucccccagaagggggaagagccacuagguguuucaguuccuaguuugugacuaugcaaagugaaucugcucugcagcacgugugaggcuuccuggagcagauggcuucccuggaaagacccccgggacaccagccuggcagcuacauccacagcuguagucauuuaauuuguagcacuuuguaugaacacuucagaagguguuuaauggccguguugguuuaggcacccaggcugguuuuaaguucuguuuaaguccuggugcagcucgcuaggauggagacauuguuuuagcgugccuucgcaccugcccuaccgcagcaggccucccucuuccugugcuaauaguguaccuuagugugcuucuacuugccguucuaggaucacggucacuuucaacaucaacaacagcaucccuccaacauuugauggugaggaggagcccucacaggggcagaaggcugaagaacaggagguaagcuaguaacacuccagccagccagucuuucuguccgagaaggaggaacuuuuuagguagauugugcauggaccauguucucagaguguguggcccccuguagagcuuaggcuucauuauuggccuguguccucuuaauacaaaggagcuaugaccgcccaccccugccugugugggguaugggaggacuuagucuacagauaacucucauugggaguguuuucagugugaaagaugacaaguggauggucaacacucgucgugugaccaagauaggaaggcuggggugguggggcuuagagacuuuaaauuauguuuauuuguauguuugacgcuaaugugugggcucguaggaagcaguugcauccuucuuaccauguggggcccgggguugaacggaggccuucaggcuucagcagcaaacuccuuuacugggugaaccgucacuccagcucaaccuuauuuauuuuauuuugguuuuugagacaggguuucucuguguagcccuggcuguccuggaacucacuuuguagaccaggcuggccucgaacucagaaauccgccugccucugccucccgagugcugggauuaaaggcgugcgccaccacuggccggccuuacauauuuuuaacauuugaccaguugaaauguuuuccuuaaguugcugcccucauggcuggaucuagauaccccacugagggccacaggauccccaggcuaucuaacuaagcagauaucagucuuguguaugaagagcugaguccccugcugugcuucuguguccuagccuguacccaacuccuuaggccugccccuugggucacaguaaaaggaaguugcugcuauuucugguuaagauggccacuuagcuagagcccauauguuccaggccuccaucgugcaccaaaacagucagaggggaaggagguccaggucugugcugcagccuugugugcucugcaguguaugggagcagaaacagcccugaagaauaaauagcuagcugugccugacggcagauaucauucuggacccaugugauugauaaacuguuuagugcucuguuggaagauuugagugccuuauccacagccuaagacuaaaaaauggcuaauaguaaccuaauggcuauggcugucagacauucugagcuuccuauugguccaggugugugcacccucccagcacugguguaugcugacuuaauuccugucucuccagccagaacugacaucaacucccaacuuugugguugaaguuaccaagacugauggcaagaagacccuuguacuggacugucacuauccugaggaugagguggguaggguggagucuucugaccuucauguagcauacacaggaaagaucuguuaaucuauuagauggagggggugggaacaggguuagaacuacagagccucuuugcacuucccuuaccucugcuguaucucucagauuggacacgaagaugaggccgagagugauauuuucucuaucaaggaaguuagcuuucaggccacuggugacucugaguggagggauacaaacuauacacucaacacagauucccuggacugggugaguguuggcugagggggugcugggcguuugcagagaaguguccucuuucaagcauuacaagaggggaaauaaaugugucugcgugggugugcugaaccacacgggaaggucagcccacagaccuugccagaccacuuuuggguuuuguuuuucaagcuaguaaauguauuuucuccccaggccuuguaugaccaccuaauggauuuccuugcggaccgagggguggauaacacuuuugcggaugaguugguggagcucagcacagcccuggagcaccaggaauauaucaccuuucuugaggaccucaaaagcuuugucaagaaccaguagaacucagagacugcgggccuuaauuuaaauggcaagcuuuggccagugaacaaaagcucccuuggcaucagaauuaugcuucaaaaauggcugucauccuaauauaucggggggaagcaaguuuaaauuacugcuguuacaccuccauucgcuauuccuuugggcuuuuuuucucuguacaaauuuauuauuuguagauuuuuguauaacaugaugauggacaauaaaucugacuccaauaaaucuccaggaaaguugagguucuuucgcccacaucagaacaccaagagcagagaugucugaaguuuuaauauaaaauccguuauauacaaaaggcuugugcauacagggcccucucaggaaaugaguuguucucagcucaguagugaagugugaggucgggauggcuagaggaucacagcccaggugucacaagucuggauuaaacagaaaacaagauaguguaacaucaacaguuagaucuuacauggcuaaaaguugucaucagucgugacauguguacuacaaguagaaccacuaugaguuaauucacuggaauucaaagaagccacugcguucauggaccuguucuacuaaacagaagccaucagcaauguagcuuauaagccuaggcacccucagaaagcaaaacccgacagcuuggggcuuguggagccugacagcgagccucuuuggauuuaccaaguauucuaagucugcuucacaguagccucuuaagugauccacaccuauacucgccucauccuugguaucugaaucuuaccguuugccuugaugugccuuugagaccuagugacacugaaauuuucaaaugccuccauacuucucagggcugaacuuggagccugcucaaugguuuuuuucucuugcaguuucucaucuguggugacaccccuuacucaacaauagucucucuagccuggccagugcuggucugaaagcacggcuucugacagcauuggucgcacugccguucacuuggcuacacugcuguugugcauuucaggguacugaaggacaagcucugcuugucgguuaggcugagcaggaauaauuaggcagucaucugcugcuuugagguuagggucuggcuauuuugcucaggcuggucuugaacuacugggcucaaauuaugcuacuucggccucccuaguuagaauuauuggcauacauagccaugccugccugcuugcucuugaaccucucuuccc

SEQ ID NO: 6155 - RNA, 20371 nt, Mus musculus
cgagaaaggggcggugcgcgcuugcuguccccagccgagcggaacugucugcgucccugccuccggccgcgguccucccgacaugccggaggaggcgagccucccgcccgcuaagagauuccggccgggcuccugcccucccgggagacgaguagugaugcuguugacggcuggcggcggcggcggagcuggaggaggccggaggcagacgccgccgcuggcccagccuucggccagucccuaccgcgaggcccuggagcugcagcgccggagucugcccaucuuccgggcgcgggggcagcuauuggcucagcuccgaaaccuggacaacgcgguccucaucggugaguggcggcuuugguggaucuuccuugcucuagaucccuggcucugugcacgagggcgggguuucuuaggggcuucucacuuucuuugcguugguuucuuccacaaacuugaaaggguuucagugcccgguguggacagggaccucuggaaagaggcggacagaguuacccugccggcgcugaccgcgcucugugaguuugaggauauucgccuuccgugacgaggcguggggagcauaucggaggcucucagagagcuuugcaggaugggccucaccaaggcuuuugaggaggcagcugcggagcgggucccuggggaccggcauucuaagcgaggacggagagacuggcgccagaaagaauucaguuggcgagaaccaauuucuuguguacgagaagaacuuggcaguguucgaaggcagggacugacuucuaguggcuuugcuacaguauugacgauagaggaguucccgaaggaaugucauaagcgagaaagagacuggaguacuggcagucaguggaauagagugcuaaggagggaaguuccauaacaauauguagacaugguggggcgugggagugcacguuggauauguaguauugauugcaacucccacuaagaauuuuuucaaaauaacuuuaagaacagaucuggcguuggacugaggaguaauuaggaggugaaagaaugaaggcaguggaaacagguuucugcuuuggccaaccaagggaagcugaggcacuuguaaauagucacagauuuuggcgaacugagcagagaggacacugaagauagauagaacuaauggaucaaaguuuaggaaauuucagagaugggggcgcagugccgggcaucaggaguuauggagagcccaccuggcacaggagaaaggcugucucuuuugaagucacauuugagaagauccaagaguucugaggaaaacaaaaguuccagagccucaaguaggcuuuuggggagauggagacggaagacaggcugcaaaaacaggaacaagauggacuguaaagcugaugcccaggugaauuuugucccucuguuuguauggcuggcauauucuauuuuagcaauagucaguugcccuggaauaggagugggaaagaugcacaagaggcauugaucuaugucugagguuguguggaggguucaguaggaaaaugcaggauaaucagauucuuggucugagagccuuggcuaagucuggaaaggugaguggucagaagcaggccgggagcuggaagaaaauguaagacucauggaccuguuaaagaggauaagccauggcaaagaagggugugcaaguuuccugaguuguucuaaucaggugcuuuuagagguaccaacagacauacacaggaaacagccuucauugagugcuugcucugugcaguguuuaagccuaugaagagagcgucugcccucuggaauuagggcagaaacauuuaaguacuucuguacuguuugaaccaggcguggugguguacgccuuuaaucccagcacuugggaggcagaggcagggggauuucugaguucgaggccagccuggucuacagagugaguuccaggacagcaaggacuauacagagaaacccugucuugaaaaacaaacaaagaaaaaauacuucuguacuguuuggaauaaucagugcuaggagagagaugaagcaggcacuaaggauccuagagaugaggcccccugguacagcccagagggugagagcuugcaggcugacucauccuugaacuugccaguuagugaggcagguagguauuguacccacaguaggguauacagaggcagaagguuugacgagagcagcaagcagcagccagagcaaagggcgagcagucuaugaauggacaucucgucguaucaguuuuuaucaagcuauaugacugucguaucucaucuguuguaacuacaccaguuaccuaccauuauacauguuuccaguuuugauugggguuuuuguuuuguuuuucauuuuguuuuugcuaucauggggcaaauuaaauuaaaacauguuuguuuucuuagacucaauuucggcaaguggaauuuggagccaaaguauaugaacaguuuguuugacagucugucuauuauguagcucuggcuguccuggaacugacuguguagaccaagcugaccuagaacucaaaaagauccuccuaucucugucugcugugauuaagcgcacuugucaccauguccagcccauucuaaaaguguuugaaaugugauugggccuccggggaaagagugacagugacuguucgccagccaccucccaggugcccauuugccugaggcuuagcaacucaguguuuccuuuuaagauuuuguuuuuccugacugugagcuguugguuucccuuagucucauuugaauaagaguuucucuucucuccuaggggaaacuggcucugggaaaacaacucagaucccacaguaccucuaugaagggggaauuagccgccagggcaucaucgcugugacccagccccgucgaguggcugccaucucucuugccaccagagucucagaugagaagaggacagaacucgggaagcugguaccucauuguguuacuugcuaugaguacuguuuaaguagccagcacccacugugcuccagccuuuuauuuuuccgaacaaguucuuucucugccucccccucccacccacaucguuauguugacucaguauguagcacaaacuggccugguacccugaguucucaguccuucugccuuagccuucugcaugcugcgauugcagggugugccacaauaccuaguugagcagcuugcuucuuuuaaguaaauaaauagccacugcuauuuagguuauguauuagucaggguucucuagagucacagaacuuauggacagucucuagauaguaaaggaauuuauugaugacuuacagucggcagcccaauucccaacaaugguucagucgcagcugugaauggaaguccaaggaucuagcaguuacucggucucaugcagcaagcaggcgaaggagcaagagcaagagcuagacucccuucuuccaauguccuuauauugucuccagcagaagguguagcccagauuaaagguguguuccuuaaacucggagauucaaucuucuggaauccauagccacuauggcucaagaucuucaaaccaagauccagauaaggaucuccaagccuccagauaagggucacuggugagccuuccaauucuggauuguaguucauuccaaauauagucaaguugacaaccaggaauagccacuacagguuaaucucagcauuuucgagagaucagugacucuugguacuaucagcuuugcuuucauagguauuggcaaguucgguaaauucgauuuggauucuguagguuagauguacgugaaagcacuugcauggaacuugcuggagauugaacucaggucaucgcacaugcguggcaaguacccugcuaauaagcuggacgcuuuaccccuaauuuauguguuuaagacuucaggcauguaauuuuuuuguuuguugguuguuuuguuuguuggaguuuuuuuugagacagcgucucacuugcaucgcuagccagcaugggacuuaauauauagacuauagacuagaguccuccugccucugccuacagagugcuaggaguacaggcaugcaguuaucaugucugucgugaaaccucuuuuaagucuacuauauauucauacguauguaaauuucuguaaaaauuuauaacuuucuuacuauagguaucuagaaugagucuuggagcuauguuggagucagauucauauuuuuauuauauaugggugugucaccuaugaaggucagaggacaauuugggaguuggaucucucaucucucugggcuccggagauugaacuuauauugucaggccuucaaggacagugcuuuuaccccguguuccauagugcuuacccuagauuuuaguucuuugugauguuucauuacaguguuucucugcagauacacuacacuccugagggagcagccagagugcuguaggucucaguuuacugcauugcugaggacaggguuggauauacagucaacggguauucagugaauguuuaaugaauaaaggagucauauuuucucacagguuggcuauacagugcgcuuugaggaugucaccucagaagacaccaggaucaaguuccugacagauggcaugcuucugcgugaagcaauuucagacuccuugcuucggaaguacagcugugucauuuuggacgaggcccaugagcggacuauucacacagaugugcucuuuggaguggugaagacugcacagaagaggcgaaaggagcuagggaaacugccucucaaaguaugugcgcaguguuuaaggaccaggccuuucuucccagggugugucuccugcccauucugcuucaggcacgugggagaaaguucacccuggugggagcagcauuggucuccgccauguuuugagcauuuauagacgggcuggcccaugcuuacuucccauccuccucauuuucuguaggugauugugaugucagcuaccauggaugucgaccuguuuucucaguacuucaauagagccccuguccuuuaccuugagggucggcagcauccaauccagaucuucuauaccaaacagccucagcaggauuaccugcaugcagcccuugucucagucuuccagauccaccagguauggagaggggugaaaaucccuggcaaauucuguuuccccuuacaguugguagugagaauaguuagucucugaaagaaaagccacggaaccugacagcuuugugacuuguaucuucuagaauaggcucguuugagggccagggagaugucuagcagggaaggcgcuuggugcugagccugugaccugauuucaaucccagggauccacauggccaaaagaggugacacgcaauuuuccucugaccuccacacauaaauaaauaaauaaauaaauaaauaagaugauccuuuuaaaaagguucauuugcuacaucugguuuuuuuuccucuuucaaugauauuucucacuuucucugaaaaaacaaauuaauaaauaacucagcucuaaucagcagccauccuccucugagccagaaagcucuccuaugcuagaagagugguucaugugcuuucuuucuaugggaaccugucaaggaaaguacaguuuauguugcaaccuaguaugcuauacaaguguauuuugucauguaacccaggcuggcuuccaacuugcuggcuuccugccuagguuuccugagugcuggaacuacagguauauaccaccacacacguccugagguguucaaaaacuuuuagauauugcgaaauaccuuuuuuuaaauuaaaaauuuacauuuuuauuaaaaauuacagcaaaugaucaaaggcugggaaaugguucaguggguaaagggcuugccgaagaagugugaaggaagaccugaguuuagaucuccaacacucauguauaaaaccaugugugucaacgugcaauugugacaacuggccuagacagucugugagcucuagauucagugagaacuccugucuaaaaaguaagaugggagugguagguaaagauugggugccuggccucuaugcaugguacauauaugugcauaaacauauguauacaaaaaagauugugagugauuaaauccuauuguuuuaguuuuguauaggcuuuuuaauuuuuauauuaauuuccugagacaauuuagagguaaacaauuuuuuuaaagauuuauuuauuauuauacauaaguacacuguagcugucuucagacauuccagaagagggugucagaucucauuacggaugguuuugagccaccaugugguugcugggauuugaacucaggaccuuuggaagaguagucaguacuuacccacuaagccaucucaccagcccaaggcaaacaauuuuuaucuuaaccuaaguauugcuuacauaguugaaaguuuuagaaaccagcaguuggauugggaauguagcucagucuguagaaggauggcccaucaugcuugaagcccugaguuugauccccagcacugcauaaagcugguauggcagcacugauggaaagugaaggcgggaagauggagaauccagggccauccuagccugcauagugagcuugaguucagucguggcuguuugagaacuagacucaagaaaacaagggguuuaguuuaacaaucucaguuuaaagcagcaguugagucuggcggugguggcgcaugccuuuaaucccagcacuugggagcaaaggcagguagaucuccaagugugaggcuagccuggucuauauaaugaguucuagcugggaauaaauccuaaauagauucaacaguugcuguaaaaguugcuuuugaauuuuaaaauacucuguguauguuaauguuucuuaauuuaucgucauucaccauuauaugccuauuucauaaaguaauaggccaggaguaauguauauucuuucccaauccuccuguguucaccauccuuccaacauagcucuaucauaauggccuuuaaauccagcaucaguaauuacucuauaaggaggauacaguguuagcagcccucugucccucuccuggacugacaguuugggcaagccuucagugugacacaugaugcacugucucuuauauggcagucaugaaguguguugugugcaguuugucucucaagucauuuguguuuccauccacauggaacaguugcuuugcuguuguacacuuuucccaugcuaaaccagugcucuacacugagccacagccuccauucacauuucuugucacuauucuccuuagcagcuguccccuaaccccugucuuccaccuuucaaaaaugagcugaacccacuugucucucaucuuugucaauuuaggucagugauuuuuuuuuucuucuacgggauggaaacaguuauuuuuacugucaacuugguaaugcuugaaagagaaauaaaagccagucugccucuuugaacugccaagaacaacuucagaagagaauuauuuuuuuagaauuuuauuuuaaaaauguauugucuauccucagaggagaauaucugcuguguaugcacaugugugcaauguguuagaggaagggcagaguacacauguagaguucaaaagacaacguuauagaguugguuuucuauuuccacaucuacaugaguccuugagcucaaauuuaggugaucagcaaguaccuuuaccccugugccagaguaagcuuccaguucagugagauccugccucaggcagacaggugaaggaagucaccugguaucuucuggccacacaugagcacaggcacaggcacacacacuccaugugcacaccacauucacaagaaaaagaagggaaagaagcucuuaaaaauuauuguuugugugcuugcuucagcaacacauagacuaagauuagaacgauacagagaagauuagcauggccccugcacaaggaugacacacaaauucaugaacauuccauauuuuuaagcugugaacugaaaaauaauuauuuuuugcacucauuuauucauuguguauaugguagggugcaguacucaagucacagugccuguguggaggucagagacaaccugagagaguuuccuucccucuaccauauggguccugggaacaggcucaggccagcaucguuggcagcaaguaucuuucuuuucccccugagccaucucaccaaccuuuuauacagaauuucuucaccucugauugggcuuucacuguacuagcuuacagaagcaguuucccuucaaaaguuccuuacuugguuuccagucguaguugucuggcucucauguuagcagcucugugcaccauugauaaggaucuuuucccagagcgguaccacucacacuugcuucaucuucauaauuaaaaaaugaaacagaaaacaaaaacccuggaauuaccaccaucauaaaugcucucucucuaggaagcuccugcuucucaagacauccugguguuccucacuggucaggaggagaucgaagcaaugagcaagaccugcagagacaucgcaaggcaccucccagauggcugcccuucaaugcucguccuuccucuguacgccucccugcccuauucgcagcagcuucgagucuuucaaggggccccaaaggugagccugccaccuucugccagccacaucacugggcaucacgucagaucuguccauguaccaucauccagagacguggaaggaggagacucggguaccaggucagcugagagagagagcuggccugugaggaggggaauggcugucaggaugacagaaggcauaagguauagagguugaaaggagaaugaguggauccucuaagcucuggucuaaacucauugcccauaaaccauuuguuuugugccagacacagugcugacacucacacaggccacuugucauccucauggagugccauaagggacgcugaggcccccaagaagagaggugggauuuccuuaaggcacacaguagggccaggauuccaacuccuaucuaucuacucgccuuuagcuugauccaguacaccucauugccucaaauuaacauucaggaccucagagaagggaccaguguccucccugucccucugucccuuaccaagugugagaacugaaauugguaugacuacuauuaacaaugaagucaccuuuucuugaucauaagcaaguuguggaaaugcauggugagaauguuuucaacuucugaaucaugugugugucauauggcuuuuugguucucuuccuccuuuuagggcuaucgcaaagugaucauuucaaccaacaucgcugaaaccuccauaaccauuacaggaauaaaauauguaguugacacgggcaugguuaaagcaaagaaguauaacccuggugagaaaacuggagcucaugagugucuccuguacacuacauagcgagcagcggguagagcuguaaccccaccauuuccuccccaguaaacauuucaugucugugaggagcugagauuugaaugacaggaacaguucccacccauguccauaaaggagaccuaauaaggcaggaggucuagagaaggaggaacucaguucuagagaaccugaggagaacaaaucagggcuguacugagaucugaaaaccuacuggaagcuggcugagaacggugggagaagcccaggcacagccuggcaccaggcacagacucuucaagggccacuggacuguggcugcuguggacuucagauuucccaggaaggagacaggcgcgcugggcuggaguagcaagcaugcaggggaagcacuggcugucucuugcaagggucaagcuggcuugaagucagcuuuacacauuucugauucauaccuuguuuuagucuacagaggaguuggggcugcugcaauuauuauagcuacccaauauuuaauuggcaucuucuacuaaacacugaaggggucaacuuucacacauguccuggugacaaaguguagaucucuaguucugacacaacauauuccuguucuugagagaauugaugucuuuuacuuccaggaaguaaaugucgcaugaucuguuuuuauagaacugggagggaugauaaagagcccugucgucauugguugauguaugaccagccuuuuuguuuagcuagaaccugucucagcaccaaaauccccaaggaacccucggugccaagcagcagggacaguuggccauccuaugauggaagcccaaacuucuaaagccauucuucuguucccuugcuugcagggaguguugugauggguuccuuaacauuucacacaugacucguugcugaguucaacuucaccaugagguuuaaaguggcugagcaaccuggguuugugcuuucuugcuuagccucaaguuuucccuugaccccuguguugcagaaacacucaaugguacucagcaucauuucuuccugccagcauucuagaaacaguuugcuucugugauaaagccaggcacucauggcccuuucuucccugcagacaguggucuugagguacuagcuguacagagaguaucaaagacccaggccuggcagcgcacaggcagggcugggcgagaggacaguggcaucugcuaccgacucuacacugaggacgaguuugagaaguucgagaagaugacggugccagagauccagagguagguccaggucaccugcacugucaugcauccugcucucuccucccgccugcuccuguucuugggcuuccaagagcuuucacuaaugcuuucuggggaacaguuuugacucaguggagucagggacagacgaaugacccccauuucuucccucacagguguaaccuggccaguguaauacuucagcuccuagcaaugaaagucccaaaugugcucaccuuugacuucauguccaaaccuucuccagguaaacuggcaggcagggaggcaagcaggcagacagacagacagacaaugcaaaggaggucuuaccccaagaaaaguaccuugguguggagggacaaaacauuuugguccuguucuuuugcugauuugauuccauguuauagugcuuugugcagggaccaggaagcaucaucaggcauccauggaugcuccugaagcccagcgaaagggcaaagagaucagaucucugcauuaaacugagauuugacuggucucugcccuuuugcaccuggaccuugaucacggugccguuucccucuucuuuacggaaaugcaguuguuaaucgagaggauaaauugucaauaggugccccuggucgcacucugaacuucagcccaauucuucucucaaagagacauuuucuggcucuuuuccacacaaaagucugugcauguggggauguguaaaucuucgagaacacaaacugaacauaggauacacuguucuaugcuguauuuuuuuuuccauuuugaaauuccuagaaaggaauaauaaauauaaaguauaaugguaagauagccaacaucugugugaugcuacccacaccauggaagccaagccccuggaccucugccuaaccauuugccaccccaccccacgccccauguaacugcucucucauguacaucuuuugcuacuuagugugucacucggcuuagaacagugugaggacagugggugguccugguguuuguagagucagcagcacccagacacacucaacuagcugcaucuucucccuguuuuggacuucuggcuccuuuuuaugucucuguuucuguagaucacauugaggcggccauugcccagcuggaccuguuaggugcucuugaacauaaggaugaccagcuuacccugacuccaauuggaagaaagauggcagcauucccuuuagagcccagauuugccaaaguaaaugaccccuccuccucauugcucuuucucugccuuacagguuaggacaugcccagugcuucugaacuaaccucucuuaaaaacugcacaucaccccuccucugcauacagugcugacuuaauguugugugugagacucagaugucagucacaauccuacccacaaagauuggaguccuguggggacgucaucuuucuguuuuacaaagaugugaauggcauugacacagcauuauggucuuaaagccacuguacuacuucaagggaagcugcaagagaguacacagaaacacuauucagaagauaggaagcuugacucaugcauuuuaaauuuuacuuuccagacuauccuccuguccuccaaauuccacuguaccgaagagauucugaccauagucucccugcuaucuguggacaguguccuuuacaacccuccugcccggagagaugaggugcagaguguccggaagaaauucauauccagugagggggaucacaucacccugcucaauaucuaucggaccuucaaaaacaucggugggaauaaggugagccuuccucaugcuuuaaggcaugugcuuuuaagaauguugcuuuuuuggccacaucaucuuaaagagucucucugucuggcugucucucucugucucuguaucucucucacauacacacaauacacacacagauguguaaauacugggauaucccuaaaaauguuauuucagguguuuguucugcuuguguuuaguagacucuguggacagguuaguugaguaauuaaagacuaucuuagccacuagaauuaucccauuuuuuuggaggaggggguaaggguacaagggcucucugcgccccuggcugaccuggaggcucgccuugaaugaauagauacccaccugccccugccuccucaguacuucgauugaaggcaggugccaaaucaaaaaaaaaaaaaaaaaaaaugccaggcagugguggcaugccuuuaaucccagcacuugggaggcagaggcagguggauuucugaguucgaggccagccuguucuacagagugaguuccaggacagccagagcuacacagagaaacccugucucaaaaaaacaaaaacaaacaaaaaagauuugucucacguucuagacugguaagacuuagaggucuucucugaugcuucaagauagaacagcaucgcacagcuagagaaaggcagcguguguaucugugugucugggcucuuccucuucugcuaauuagggaccaauggggauucagucauggggcucuaucuuuuggccuuuaaaccgagucauuuuccagaugucauuuuaaaauuggugugugugucugugucuguguguuugccuuuuugaguaucuaggcaccacaugcuugcugguuuuuuggaggcuggaauuaggugucagauucccggggaugguuuuaagcuacuaugugagugcuagaaacugggccugguccucuggaagaugggcagaguuaacccuugaccugucucuccagccccuaaguuuuuaaauuuuguuuuguuuuugauacagguucucacuacguaacuccaaggcauggaauuuucuauauaggcugaauuuccaauguaugccugcuuauuccuaucaacugcuaggauuaaaggccuguacuacuaugccuagcuuuuuauuuuaagggaaguugguuugguuugguuugguuugguuugguuuggugagacaggguuucucuguguagcccuggcugucuucuuuguaaaccaagcuggccucaaacucauagagaucuaccauccagcuuggcucuggcuguccugauuucacuauguagaccaagcuggccucaaacucagagaucugccugaagugcuaagauuaaagcucugggggaggaggggcauauauauggaggucaggggacaguuucccuucuugcuuuccacuguguguguuccagggcuugaccuugggucaucaggcuugguggcaagcaccuuauucacaaaaccaucuuacuggcccacaaguaucauaauugaauaaguuuccacuuaaauguuuugcgguagggauucacugcagcuuuggagaauauucaagccauacaggaugguuuucuugccuaccugcucaaauuuuauacugguuuuugauaagucauuucaguuccuuauacuaaaauagaaaaugggaauauauucucucuguguuaauaaaucuauaauugugccuuagugugcauuuuuuaaaaacaaaaaugguaccccacgguuuuagcauuuagcauuuguuaacucugcuauauuuaccuuuguuuguuuauuuauauuugcacucugugacucuguguguguguguguugaagugcgcauggcugugugcacacacacauacagaugcacuuguggcaccuguugagaucagaggacaacuuguaggaguuggcucuguccuuccguggaaugggcgcaugggguuugaauucagguauucggauuuggcagcaagcaucuuuaccagcugagccaucuugcuggcccucaauuuauauuuaaaugaauaaaaaaggugccgaggaugcaguaaaaagcucagaguccuuccuuacugaacuguucugccuuuggugugugugcuccaucaacaggaugcccuccguuugucuuuaaagcagagucuugcuuauguauguaacccagguugaccacagacagcgauguggcacacacccagcacuaaggacaugcuugcaacagggcuugguuggcuccaguuggucgacuacauuacguaguaaaacugucucaaaacaaacagaaaaggaaccauuagcuucgccugcuuccacagucugcccuuucagcugcaucuguuuccaucaccacggugucuccugcucagcucuauuugugccccagagagaauauucugcggugccagcaugugagcauaaacuuguuggucugugcucuguggcucaacuucaccuagcuagcacacauuuacuagaccuucagucccuccuggugugggggagaauugcagucucuaccaucucuccagauguagguugaaaucacuucuguaaucuguaaucuguaauauuguucuaaacauugccuccaucccauacaaaacaagcaucuuuacauaaauguauugggcauuacugugucuuuugcccauuuuucuccaguuuccuggucuuuuucucacuagucuuuaauaauguucuagaggugcguguccuuaugagaugguggugcaugcauagcuuuuucgugaugacccuaggacaggaaucuuuguuuuacuuuaguuuaaauaauucauauuucuccuagcucauacuucucaauauaaagguguauuccuauauuccuuugacaccuguagugucaaaauugagcugugccauccaggccuuggucugugcauauuuccucugcauagaaaugagaggauuaagguaucuccuuuucuucuauucaggacuggugcaaagagaauuuugucaacagcaagaauaugcugcuaguagcugaagucagagcacagcugagagaaaucugcuuaaagguaguacccccuuucauggaaaaguuuuuguucuauuguggggaucuugaauugcuugucaccagugguaugaaaaacauucuaguuguagaaaaacuuuuaaauaaacaagaauauaaaaguuacucauaauucuauuuuuucucccucacaauuaugguuuauucauagaaguccauggugguuuggguuuuuuuuuuccccucccccuccucaauucccaucccacccuaguacuguugauugaacccacuaggcaaugcucuucugcugagccaauuagcuugucuuucacauaguuuacauuguacaguguacuuacauuucuuuugugggguuggugcugggcauggaacccuggaccucauguauaacuuuuagaaacuauaacuauucucugauuuaaaagaagagaaaaaaaaaaaaaaagcuugcugggguaacaguuaacagugcacaucuuuaaucccagcauuugggaagcagaggcaggcagaucucugaguucuaggccauccagggcuacccaaagaaaccuugucuguaaaaagcaaggggagggguagagaagaaagacagacuacuaaaagguaaaaugaacaguuggaaaacaccaggggaacauuuuuuaaaccaaggucuuccguauguaauaacuucacguauguaauaacuucacgguauacuugaaacuuggaggcugcccaguguguggggugaggaagaaggaacuucugccccugucuuuccugugguucacgccuguggcaagcaugauugaacacaugucccaugucugcugaagcugucgccacguuaguggcuccccuuuuuuuguguuccagaugccccugccagcugcacucaauuuugcaguguccgggcccagcagcuucuccacccugcagggacucccuaauucauacacccagaauugcugcuuuucuagcuagggaacuugucuguagugaggagggguaggcagccuuugcucucuagacucccugguucauacgcccaaggauggcugccuuucuguugaggggucuugucuggaguguguugugaggagggggaaggcagccucugcacugugauuuucaggagacucagucucuaugcuuuugaaucccaccaagucuucccuugcuugggggaaggcugccgcugugugugugacagagacagucagagucucuaucagugagccucauggcaggugaguggcuccucagguugaucucccaguagccucagcugggugguuuugucucagaggaaguugcuacucggcacacccagccuuuaucuaucugucugucugucuaucuaucuaucuaccuauccaucaauccauccauccauagugugcagccuauauggaugucucucucccguucccaccuuuccuaggcugguguuuuccuuuuucguuuaguuuaguuuucaucucagucucuccucccuuauccauguccuuccucacccuuuacccuuuacccaagcugcugccuaaggcauuggaagugacuccuuuggaugccaaucgaaauuucacuuuguguuggcugcagugugcaaugugugugcagugcuggggagaauuaaugcuugaggucuuuucugucuucuaaaacagaugucaaugccaaucaugucaucucgaggggacauggagaguguccgccguugcauggcucacagccucuuuaugaauacugcugaacuccagacagauggcaccuaugccaccacggacacacaucagccaguggccauccacccaucaucuguccucuuccacugcaagccugccugcguggucuacacuucacugcucuacaccaacaaaugcuacaugcgugaccucugugugguggaugccgaguggcucuacgaggcugccccugacuacuucaggaggaagcugagaacggccagaaacugaaccguuccaggaugcugccagcauggcugggccuggagcuuagaucacagcugucuuccaaacauaaguuugcagccagacuuccagacuccaagagcuuaaaagaauugcugaagcuucucagacucacccgugcagaaugauccuacguagagcaugagaagcugagcuugugccucgggucucaccaggcaguuuuggagacugaauuaacuucugagccucagauuccucauaugccggagucggauaagacuuacacguucagaguaaugaaguuuagagaaaaugaacagaaugugacagagacuugccuggugcaagauaagacaaucugugacuugugagccauugugcuuugugauacuaauuagguacagcacagccccuugagcucucaugacugggggaggagccauaggagacuacagauccaauuuguugaaauguuucuccccccuucuuacucccucucccguggaucccagagccucaugcaugcuaugcaaaacacuuugccacugagccaauccccagcccucacuucuacuuuaaugucuaccuguguguauuuuagauagaaaauuaaaaaauugacucccacagacaguuccagaguaagguauauucugaccuguugacccuuauggcucaggguguagcacauugucuugucugucuccaagcagaggccagcaaguaguuccuugguugguccccagugccucuguggcugcauguccccaacagugcuuucaggaaaccagcagguuuccuggaacuaggaagccaacuuuucagugugguggccuucugaagccccgugguaguuuucucuuuaacugagcaccuacaaaugugugccugugagggaagagaguucaagucagagcugcuacauggggaagaggaaggagguaccugacggcucggaagccagaggaucaguuuguccuuucuccuacaccuagucuuaguuuggguuguuuguuaguuuguucauuucuuaagggguaaaccacuugagacaggguuucucuguguagcccugccuguccugaaacucgcucuauagaccacacuggccucaaacccagagaucagccugccuuucccucccaagugcugggauugaaggugugcaccaccaccuggccagucuuuguauuuuugaugcuauuaauuuucaguggucugccuuugcggaaaccuggggacaauuagcuuugcugcuuccuaaccagucgccaucugaaaccuucgucgucugcacuuguuagagggaacuagagaagccucggcauccuuuucccaguuggaaaagagucaucuuugcugaugacuaggagcaaacauuccccaguuugguacuacuuaccuauaaucacuccccgcugagaagggagggcugcgaguccuaggccagccugggcuaggccuuguaucuaagugaaggaaggggaaggaacacacuuucacagagaauguuugaagggggggggaguuuuagcccuuuuauugugcuuaaucgguccaaacacaucuguacuacugggauuuucucauuuauacagugaauuguauuuauaagcaacaaaugggccaaacugccuucaaggcacuucgaagacagugggcaguuucuuugaguccagcaagcucuuuccagagagccuagccuggcugggcacuuccauugccaggaucucauugguucacagcugugucuguugagucuggucuaggcuuuaucuaacccuagccgugggcaaagcuuuuagucagugcuuagggcugucugaguacucgugacuacuuggauagaaauggucacguuaucaaccuucugaaaggcucuccggaaugugcuuucuuuuucaguguauuuuuuguauuuaugcaagguuuauuuagccuugcuugguaagaggaacuuuuguauuuugaaaagaacauucaucgugcuaguuaaagaaaacaaggaggcaauauauuccccagcaauuaacaguuucuguuccacuguaaacuaacaguaaacuaucgaggucuuuucugggucaugggaacaguagcuugcagugacuggcuccagggugaggccuaggaccuuacccuggagggacugcugcagaggacugggaccucccagaaaagggagugauggauacaguuucuaaggacccaauguuucuguauagaaauauguuuaucauucuaacauuguggggggauuuuaauagaauauuuaguuuuuuauuaagcuuuuuuaaaaauuacuauucaacacagcugcucagggauuacaugaggugggagccccauucugacuccacagaucacuacgaagaaauuaaugcuuaucuucagccaaagggacagcucucuucaagcuuucuuaagaaagugaaauguuuugugguuuugcugcaguacaaccugagcuacuuuucaaguuggcaaacucuccaaccugaagacuccagccuggacagaauagccuccaacagacagaugaacuuccacaacagcccugcgugcugcagggguuuaucuucuugguaaccguggccugcgacacccggggcaccaguuccauuaccaggaucccugugagaacauuugcaucucuuauaacaggauuccaaaacagcaaaguauuuacuguggcacaaauccuugugcuccagcuaccagggucuguuuggaacuguggccgcgcaucuaagaugccauuccuugagcacauaaacuagacuauaccgguggggaaacaauucucuauagacugcuguaguguagaaaacugacaagcggauuuggacaugugcucuguucucucuggucucaaacauaaaagaacaguucuaguauauaaugcucgaaauuugcuuuugacuaucaaauccauaaaaacugaaucuuguauaaugaucuguguggccucuuuuguugggccuccuuucccuuauuuaaagaaugcuguuuagaauauuaaacauuauucuuacugccauucauucgauaag

SEQ ID NO: 6156 - RNA, 12873 nt, Mus musculus
aggucuccguacccaggccggccagaccggagggauucccuacagaacgcuccgccgccccgacgccacuccucggucccgcccuuuccgcuccuccucggagagcacacagccccuaccgaagcgaucccgggagugauggauuccgccccacaccggcuucccgccacuuccuucaagcuacacucagcggcuggaagaaggcgguaacaccggcuccuccgaaucgacugagaccugccucugcgaacgaacgccaaggcgggcuggaucgcacuccugauuggcuagccgugggucaaaaggagccacugcgauugguaaaaggaaggcgacaaggagggaaagcuagcuguggccggcagggauuggcggacggaacugguccuucucucugcguugguaggcggagaaguaaggauggaccgacgcagaggcgcaacucuugauuggugggugagcggccccaaggcgccagcgauugguggcuguccgaguacgcagcgcugauuggacaggaguggguaggcugaaggccagcuuugaguccgccccgccgccuggcauacuggcggaaggggaaggggggcaggcgcggugggaaagauggcguaccagagccuccggcuggaguaccugcagaucccgccggucagccgcgccuauacuaccgccugcguccucaccaccgcggccguggugagcagcuguggcgccacauccucuuuuuccaggcuagcuaugacugcgucuucagaaaacggguuugggccgcggagaagcccagugggucuggucccagggguggguggagacauccggagcugacucuaggguuugggauauucccaagggugccaagccagugaccugagaagggugugccccuucgugaagggccaggucaguuucagacaaaugaaauccagaccuguagugaaucagaagugcgggagccgcccacccaaaaaugugucugagagguccaggugacuagugggagugagguccgcuagguucacagacuauuauauugaguauagaaaucucgagcuaucuggaaacaucuuucaaaagacggccuauggauauaagugucuggccgcuuguaccuaucccuaaugguagcagggucuuaguuaaaccccuuauuccgaguugucucaccuagcugagguggugaccacgugacgcacagauuuguaaaagaugcuguuggcuugucucuaaaauaugcucacccgccugccuuauagcauccucaaauauugcaacaucaaacugacauuguguguuuauacaaaacgguugugcaaauucuaaagaaucucuuaccagcugucacaagcaagacagaaauguauuccaagggacagaaaugauuagaucuacucauccuucgugguucaugaugaaauuuuguuuugcgguugaucggcuucaagaagcucuuuuuccauuucagcaguuggaauugaucacaccuuuucaguuauacuucaauccugaauuaauuuuuaaacauuuucaaguaaguggucuauauagcaacugugauuaauguuuucauuaucuuuuuuuuuuucguaucguuuaguaaguaguaaauccugugaaauagagucucaaaaaaaauaacccaguaggggaaucucugauuacaggucuuuuugagauguaaagagggcauuccacagccugguuggacucuagaaugguuugagagcugcuaaguauuugggaacuccuuauauaccaaacuagaguugccaggggggagccaggugcagacagagcaagcaggaggauggcaggugcuggauaagcuugagcuagagagagagagagacugucuuaagaacauaauuuuuagugugucuuugauguguugagauuuuauauuugacuacaacuaguuaagaacuaauguggccauagucccagcagucaggaaccugagcccaccuugaacuacauaccaaggaauugucucaacacacaaacaacaggaacaacaaccaacaacgacaacaacaguaauaauaaugugaucugagaauagacugaugagcuggcugcccagggaguuucacaggauagccagccuuauuuuguguuuuuuccacccagacacaccuaccuaccacuguuguuaguccucuugggccagcucauaaacucaguucugguacaacuuuaacauugaucugucuucuagaagucagauuauccuaacaaaagucuuauaccauuaucuaaaagagaaugugacuuuccagauuauaguuugaagaagucuuuuuuccaguaauuaaaaugcuaaagagauguguguuuucgugccaggauggucauuuacacucuaggugaaguggcuguaauucugcuuuguugaugcuuuccccugucccagauguguuacacuccccuuguaccguugaacucuagcuugccuuucaagauucagcuuuuguguaaccucagauacuuuaucuguuagagccucucucaccugucaguguccucacuaggaugagaauucuauaaacucuggauuguuugcaugugaauagaaugcuggcuccuuuucacacugcugugacaauaucugacaaagcaaacuuaagaaaaaaaaaggguuuauuuuggcuuaacaguuuguugguaaaguccacugugguugagaaauuguggcauccagagcugcaggcaguuggucccauugcagccaaagcucuaaguagaggugcucaauucacuuccuucuguuuaguuguccuaggaccccagcccauggaauggugcucaucgguguuguccuuuccaccuugagugacugagucuagaaacucccccacagacaugcccugaguuugucuugaaugacuagaucugucaguaugaauuaucacaaguaaauuaccagugaugaggguuucaggguguauaaagcagucgguccucugauaccuugacauugucacaucaggaugcuuguggccuuugcuaggacugcuuccuucugcuuuguuuggcuuaacugccuagggucagguucuuuguuuuguuuuugucuauuuuucuagaucguuuaucuuguagcuauggcuggcaugacccucaugguguccuccugccucagccucuuggugugcaucauugugcuuuuuuuuuuaaaaaacagagucucuuauguagccuggcaacucuugagcuuaauggcucuccuguguucuuccugccuggacuccuuagugcaaggauuauagacauaagcagccaucccuagcuaaggucaaauucuugcauuaaguuuggaacuaggagucuucaccuaucugcauguccuugggcaagcuauaaguuuuaaaauuccuucuaugugaagugaggauggucaccccaccuugcuugcuuaucucacauaugauaguaaauuuuguaaagcuuugugaguaguuguauguugaguaggugagauugccccugcaucuuuccuugucucuuagagcaguaauucugucuuguacggaaguugacuugaaaccagaaccuggcuauuuauccuagaaucuuucuaccaguauguuguggcuaauacaaaaacauuucuuggcagcuuuacauacugaaucccugaaauuuuuaguaccuauaaacuccucauuuagcacucuguucugcacacuaaccuaccuuuuacucaguagcauaguguggauuuuuguguuguuaaauagaagauaaucaugauuuugaggucuuuuuguccuauuguccauauuaauuucacagucaaauuaguaucuugcgcgcgcgcgcacacgcacacacacacacacacacacacacacacacacacgcagcacagaacaaauccagaaucaucagacugggugucccauuugaaugugcccaccuaggacuuuggagcgucagagucaaaggauguuguuuuuaucuuagauagaaauguuuccuggucauguguuuuacuuaaugugucuuucucuugauucccuccacccgacucccccugcagaucuggaggcuaaucaccaauuucuuauuuuuugguccaguuggauucaauuuuuuguuuaacaugauuuuucuguauccuuuauuaaauagagucaacaucaaaacuuuagguuauauaguauguauauaauuauauuaauacauauaagacuuaguauauacuauaaguugaaacuauuacucuuguuuauuuuuauaacauuuuaguuauggcuccugggccuguaguuuguaaucacaucauaauguuuugaaacuguuuguaacuccuuguuuauacaggagguuccagcugugaaaagauauuaguguccuuaaguugugauuuauuauaggcauauuuguaaaauaacaucagcaccagcuggcacaguagugaagcagcgugaaagaucgguaacucagcagacuuuccccagguuucagaauggcuuucugagaguggggguuuugauugcaaggcuaaaaggacagugucagaauaucugcuggcuugacacguuuagguuugguuaaagauaggaaaagccgugguaguugaagagugaaauggcaguugggugugcugagcuagucauuccucuuagaccugguacuccugcucggcugugggaggcagagagccguuagggauggugggacuuagguccuaaaaugguuucuuguguuuccugcaaagaauaucauucugauaaguuucuaaugugaggcuucccauuauaguuuuuauuuacuaggaaauggagaugcuuagccugccuggccuggaaaggugguuuucacacaaggcuucuuugcagggaguucuucccaauuagcaaaccaaguauggugcaaauuaacauguaucugagugugggaaagagcaccacgaaucggaagagaugugagagugacuggaacgguguucaugcaguacuugagugaguuagcaucccagugagacaggcuuuggaaaauauagugcuaguucugacauugccuaaaaugcuugauggaaaaaaaacagaaaccagacuacucuucaaacauucuuagagaaaagcagcuugauuauuuacaaauuguauaaagcccaaguauguuucagugguucauuacauuuuaucuucuuuauauguguauuccuaauauuuccuuaacuugaaacuuaagauaccguuauugucgaaugcuagaagaaggcucuuuccgaggucggacagcagacuuuguauuuauguuccuuuuugguggauuuuuaaugacuguauccuucaacaaauagcauacaggaaaauauugaagaacagacugucaucuguucuucaagcuuuucaucugucucccaugauucacuagauauuuugaacaaacacaaacauagaccuccagauuguagccucgggagcuaccauuuauuucacagcccccaugacagcccagagguuggacaggaagcuccacugggcgagaaguuucaacccagguggauuaucuugaagcaucucaguaaguucacaguugacuucguuuuuaaacuagguugguaagaagacguuuauuaagucacugucaagacugauacaaauguuuuuaaaaagaagagaauucguucugugugucacuuagguguagugccgagugccaagaaggcuuucuuccagccugcaugcuucagcaccuguaaagguggugguggugaaggagccucacuguacguacugucaaaggaauuaauguuuccccaaaaggcaagagcaucacgaaacagaauucuagggcuggagaaauggcucagcgguuaagagcacugacugcucuuccggaaguccugaguucaauucccagcaaccacaugguggcucacaaccaucugugaucugauguccucuucuggugcgcauaaagacagugcacucauauacauaaaaugggugaauucuuucuuuagagcagaauuuuaguuuguaguagcuauaauccggauaauucagcccaagccaguuucugccuagaugccuuggguaauuaauuucaggcuuuuuuuaauuuuaguuuaaaaaugucacuacucagcuuuuguaacucagagcuuagcuaaagggcagccuuagcucuuugcuuuagccuugccuaccaagcuuuccugcugauauuucccuuaaugcccuuugcuagcucuuugguuuguuugugagcuuaguuuuuuuaggccaggccuuuacaauaaugcuggucuacguguggagccgaaggaacccguauguccgcaugaacuucuuuggucuucuaaacuuccaggcccccuuccugcccugggugcucaugggguuuucccuguugcuggggaacucaauuauaguggaccuuuuggguaagugucuuaucacuacuuuuucuacuauuuuaccugaucauguauucugucacugucuuucauguuuauuauguuuauauauagauagcuauuaauaugauuguuuaauaauuauaucugaaagcuauuaacucauugauauuuuuuaaauaauuauccuaaguaaaguauacgaugauagggaacuuaaacuugaaauuugacucuuccuuuuauccuuuauuucugguugauuauagguauugcaguugggcacauauauuuuuucuuggaagauauauuucccaaucagccugguggaauaagaauucugaaaacaccaucuauuuugugaguauuuaacucuguguuccaugguucaugcagacaaaccaugaucgcgauuuauuuugggcccucucagugccugguucguaucaguaaguguuugcagauugagcaacaugucugcaguggggagcucuuggauuggccagaaacagauugggccaggguugugauuacugagcucuugacaucauggggugacuugcagguacuguccugaaugaccacuaggacucgugucccagagaggagcuugcagguuugugaaagcugcugucuaaguagagagacgugaacagcagcaugagcagcacaguccagaggacaagcugauagcguucugaucagcgaagggggugcuggagagaugcagggaaacagaagggaaaggcuuuggaccugaagcuauacuggcuggcuggucuaccaauuugaaacacauuuuuuuuuuuuuuuuuuuuuuggacaggguuucuccguauaguccuggcuguccuggaccucacauuguagaucagacuggccucaaacucagaaauccgccugccucugccucccaagugaugggauuaaaggcgugcgccaccaccuccuggcucaucucuucacuuuuauacugcaguuccuagagcuauaguuuuaauuuauaagaccuuuuucugcucuagaauguuguguucuugggaauuauuacauggaagaugggcucuauugaggcaacaaaaugauuugauauaagcucugcguuguggaauaguuaagcaaaaaggaaugaacaugguucagugguaacaggaccagcugcuucccccagaagacccagguucaauuccuagcacccacuggaugcuaacaacugucuauagcuauagucccauggauuugauacccucuuuugguguacagauauacaugcagacaaaauacccguauacauaaaauacacaaguaaauaaaccuuuaaaaaaaaaacuaaaauggaaaauaaaucucaaaaagaaaaagaaugagcuggugagguaugcuaguguauaccuguugccccaucuacucugaaggcugaggcugaucaauucaaaguuugacgccaaccuagcuaccauaccaagaggccaucuuacgggaauuuuuguuugcuuguuuugggggguuuuuuuuguuuuguuuuucgagacaggguuucucuguguagcccuggcuguccuggaacucacucuguaaaccaggcuggccuccaacucagaaauccaccugccucugccucccgagugcuaggaucaaaggcgugcgccacaacaacaacaucaagaaaaaaaauagaaggaaguaaauccucugugauucuucuuacgcauagcaguuucucugucggauaagcagucuugugucuuucacucucuagauacuuuuuugguaauuuccuauauaauuacuguauuugcaucaugucugcuucucccugucuccccuucaacuccuucugugucucccccacuccucuucaagucaugaccuccucuuuaauuauuauacagacauacccaaaaucuauucaccuauuuaguccaucuaguguugcuuguaugcagauguguuuagggcugaccacuugggacugggugauuguauacacuuuuuuaauagcuauauaauuuuaauuuuucaaagauuuauuucauaaauguguuugcgacacuguaugccuacauuuuaugugcacaguaugcauggaugcauaugcccacaaaggccagaggacaguguauccccugaaacuagaguuacaggugguuguaauuccccaaugugggugcuggaaaccaaaccuggguccucugcaagcuuagucagugcuccucacugcugagcugucucuccagccccugucuauauauuuucuuaaaaugucauuucuuaaugugcaauaauuacuuuucauagcugggugugguggugcacaccuuuaauuccagaacucgagaggcagaggcagguggauuucugaguuugaugccaucuugguuuauagauccaguuccaggaaagccagggcuacacagaggaaaccaucuugaaaaagaagaaaagaaaaaagaaauuacuuuuccuuuauaaauggccuacgggauuuugguggcugcaugcuaguccgggguuccuaugacauaacauaaguauacgccucccuugcuaauagacaucggccucaguuacugcuucuccuucucuacuuggaguguuggauguccuuguaacugaguccacacgcuccaacauggaagucaccgucguagccguuguaaagugaacaauucaguggugguucgugaguuuguguugugcugcuauggccguuuccuuagaagguuuuaucuuauaauccuaaaacucugcccaugauguaauucccuauuucugucauccagcaaccaccuuucuuuuuaugugccugugaauuugacuauccagguacuccaucagcauuuauugcuuccauaguaacaauuauuaauaagguaaauauuaaugcaaguguuaaauaaguauagcgccuuuaagguauaguaccucuguaguuggcaggcagggacaauacuuaccuguuuguggaagcccuaugggugcugcuuuaucguacguccaaucuaagggggcucuggcacugaauggucucuguguguuuuaggaggacuauuuuugauacgccagaugaggaucccaauuacaacccacuaccugaagagcggccgggaggcuucgccuggggugagggccagcgccuugguggguaaagcagcggugccaauuacgagacccaucugagaaagacucagugacauguccaugggggucuuuuaucccuuguugcaaaagcguggacaguuuugacagcuugacagauuuuuaacuccagaagcacuuuacgggaugguacacugacuaacauagaagacauuuccaggaguuugccagggguuccucacuaugcugguacuaaaaguauaaccucuuggagccaaaaacuggagacccaggcacccugccugugccgugagcaaguccauggguacuugagcucaguggcacaggcgggugcuccuccuccucuuugauagacaaggccgugguguaaauggaaguuacggagaggacaaaauaaaacugaauuccaucucucucacacuguauuuaagcuuucgugugaucuuuuaaaucaugguaguguguucuagcucuccugcguauguuugaacacagcaguuuccgugccugcccucaugucuccacggcuuucaacuggauuucauuucaagauuggaaauacacagcugcuauguacaucugacuaauucuaguucagagucuuagccucuggagagggaagauugguuucugccauucagauaguucuccaucugaauaccaugaagcuucaaguuuagaccacaggaggagggagaagggaggguaauuucuuguagccaaggaaucugacuguagagaagccagcuauaaaccaaaagcaacugugauaucucuuugaguuggaguuccucuacuaagaaauacccagauuaguaauggccacccguugucaaagcacaggaauaagaaugggcagcauugggcauguguuccucuugucauucauuucaagaaaagcucaagacccuuccagggccaagggccugguucaccuucccagucgggcagaaaucagggucuuuggaagcagccacacugaugguucagaguacuuaucaaagauggcacaucuugucugacucaacaguuuuccauucaugcugcuuuaucagagcucagaaagauggccucagacaguuuucauaaaugucaaagaggcacaggacuucccaggcugggucauccuguuuaggcugaguugcuuuucagaugagauuuucucagagguuagcauaggcuuaaguaagcucuaguaaacauucuagguggaaaguuucagauacauuugagguagaaaguauuuuaaugacuaaguggaacucgauaaggaauggaaugaguacgguacuaguaaaucacugaagaccauuguaacucuaugggacgugggccaaugggacugcuuuugucuuguuuaaaaauuuuuaacguuuaaugacaaucuuagauuguaugauccuuaugggauucuuaaguuugauaauuguuuuuguucaagaaggccuugucaguaacuuuuaggaauuuauuuuuauuauuauugcuugcuuuuaagccagaaauggguuucuuuaagguuuuauuuauuuucccuaaguuaauuuuagauuuagcuaguucauggaguuauugugaccgaucuuuaauucuaaaaucucuccaccagcuauuuucauuuuaaacagugaauaccuauacauauuagugacugaaaacagaaaauauauuuuggauuauuguuagggugugaauuccuagugguagaacaccaugcugugugacacacugucuccuggcagugcugauuucagucacuuggccucuuaguaguuuggcaggucccuggcccuguguuguuuggcaagaucccugugcucacugggacacaagggaaaguccucacuuccccagccaaccucucaauuccaauucuuccaaaacacacuuccuuuuugcgauaugagucagcagaaaagugagauugcauuaugggauucugugaccgcuuaaacuuacaugaauacaguuugagccauuuccuggauugauuguaucagaaauauccgaaaagcacaccuaaagcauagggcauuuuguuucguuguuacaggaauacaguauauguucauuuaaaaaugaauggacaugccaauugcaucuccauaggagauagauuuuauauacuuugguguguuuuuuucacuaugaauuuuuacuuguuucuuccacuucuuuuucugucccucuguguccuccugucuuuuauauuucuuuuguacuugcgugaggcaaagcguccacauccuggaucuugaaauggaaccauaacacugucucuagaguccucugggaggaauuaggaaacauuggagcuauuggcauguuggcauaacaugcuuccuagaauugucaugccuucggccacuguuuauuuuguggcuauaauuuccuuucucgggugaguucuaucuguguuagcuaagauccugcccuuccauccucucgggaugacuaaacuacuuacuguuuugaguuugauucaaguucuugaaccuugcuugucucguucagccgcucuguuccgaagucugcaaucacgucuuagcccuuaucaaaugcauauuuugugucuuuucucugaaccuugcuccuacuucucccuugcaggaacgucgauuuaaguuucuucaagaccuugacacuaaacucuuaaaacuaaggccuauuucacugucuucuuuaaauccuuaugaagcuucaaaucugugcuaaaauuccuauaccaaaucauauauugucuuguacuguucuuagcugcuacauguauguuaguuuuguuccccucaugagaauguaagcuccuuaagggcagggacuaugucuuaauuuuuguauccaccacagugccuagcacugugcuuggcacaugggugcugaauaaauacuuuguuuauugaucagcaaacuauuaucuuguauuuuuaauuaugaaagaaucgauguguauguauccaaacuuggaccugauugcuaagguuuaauauucuuucuggaaacaggauggaacaaaacugaccuugauugaggagcaaugauuugguggccuugcaaucggaggagaccgugagcugguagggucauggucggaccagggaguuacuucgacagacuuggccaccucagauaagagugaaaugugucugacagaucaucuuuuggaggaauaaucagaauauucuuuugaaugcuuaguaugugagcuucucaauaugaaagccacugagccacaagagaguuuuuuggaggggcaacagauuucagaccgccacugaagggcaagugagcaacaugcagggaaagauuuaaguuuccaacucugaucauuuuacugcugaguaaauggguuaccaggaaugaguuccuuacaaaaguguuag

SEQ ID NO: 6157 - RNA, 7780 nt, Mus musculus
uacauaaauacugaaguauuuauuuauuacagguauagagauuauuuauuguauguauagaauccaaaguuacaugccuuccugcugucucagguguuacagggugagaucaugccagagcagaaggaccugaguccauccuuuauugggaaucuauucccuaaggaacacuccuguucccacaguacugacauuaaucaaaguauaaaccucuacaguguaccacuaagaagucaagaguuuuaacauaugaauuuuaugggauacauucaaaccccuuauaccgacccuuuuaguaauuuuccauccaaugauacuugcuuugucccaacaagucccauucugucccuuaguugcacauucccaaacaucuuuuuacuucuuauauucagaaucuaaucucucaaugcaaaauccuucugcaauggucccaguaucuaacuuaaggguccugaauaaagucugcuuuaccaaucuaacaagugccaucaaucacauuuggguuuuuuguuuucugagauggggucucuuuaguccuggcugcccugaacucuuuauguaaaccaggcuaaauucacaagagguccaccugccucugccuccugaguacugggaucaacggcaugaaauccagcuaggaguuaguuuuuaauagcacauacucacacauacacagagguuuugcuugucucuuaagagagacuguguguguacacacaaugugggggaugagaguguacaugccacaguguaccuuaagacaacuuuguggagucaauucuuuccaucuuuaaguagguuuuggggauccuacucaggucaccaggcuuguauuacaaguauuuuaccugccgacccaucucaucagacuuacaaaaaguagacuggaaugugacaggcguaucccauuuccuaaauuggccauaucuguuccagcugugugaauuccauauguucuaccuuauggguuuucugcuauuuucuuugccuagagugaucucuuaggugagaggcuaacaccuucuaagcuugacuugaaucuuacauuaucaaugggacaugccccuuuaauauauugcacuauaugucaucccauacccugauccccucuacugugcccugcugcccuuugauuuccuucuccuccuucccacuccucuuucugcuucucuccauguuaaauccuaaguauguugagcauacucuaccacugagcuauguccucagcccggcucuauuagucccugauguaccucaugguuauacucaaugaauacagaccugcuuuauacagcaaaaaugagcagaaacauccaguuccaugaggauucuauucccuccugaaaucauacuaaacauaccuaacagcaaaaugagugcaaucccaaaagaacuggaggcuuuaccagaugugagccaaguuugagagagaaaagcaaauggacacaagcucugcuucugaggucuccacugcagccugcgauuuagaaggucugcugauuugcuuuguguaacccaggacaggaggggagcguggccccaaaagaccuaaacauaagaguaaauaaacaaagaaaagcuaucuauuucuaugcucucuuuucauuacugagaaaucacuguguuuccagucuccugcuuucuuuuucuacauugucucuaaugcucugaaguuuucugcagcucuggaccagggaugccaaacucucccuaaaguuacuaguuccuugauaucugccgauguuuucaagcucaucaaagaaagucaaggucucucugaguuuggccuuaacaguuuucugcuccucuaauucugcaagaagggccugcucagugcacaacucaaccuuguauuucuccuguaacucuuugauuuccuguuggagaagcucgaguuucucuucacugaaaggauucgucuccugacacuugucuucaggaagcaggauguuuggaggaauacacaaaaucgacugcaaaaucagcugcuccauuuugccaaaaagguuaucgaagcguccuuucaugaagcaaagaaacuucucugugcauuuccgagucuggacaggggugaucucacaguuuggaauguccuccagcuucuuuaggauaaccuguucaacagccugcaucacuucaaacagguggucuugaaaugcuacguagauccucagcaggcaagucuguggugugaagccaaagaacugggccucauaggccaucggauccacagacauccugcuuuauuuugcacucucagcugugaaaaucugcaaguaaaaaaagagagaaaauguucauuuggacauuuccacagcagaaauuaacaaaccucauuacugauaagcaaauaaacaaagaaagcaaauaaaaucuaaggaguguuccuuugauaccuuaagucucuuccagccuuaacuguccacagaaagacagaaucugagucaaauauaggaaagccauagccucuuuauuauucaucuccuuuaauuauuauuacucaaaacuuaggcaaaagcccaaccucaauucuguuaucuugggcaacuucaaaaguuuaaauacacagccucaaugcccuagagaccuggucuccugagcuuccaugaucuacauguggcucuucccuacccacccuaucccacccuccacccccccauauaccaaccucugaagacaauuucuugcugugucgccuauggguuggccucaaacucuuucauuugugccagggucucauguagcugaagauggccucaaacuuggaauguagcuuaggauggucuugaauuuuugauccuucugcuucuaccaccagaaugcuggaauccuaggaguauaacaagcccaacuuuuuaugugguacuggguuuagaacccauuguccagauaagcacucuauugacuuaguuacauccucaacaguucccgugcuagucuaguugucauucacauugcaucuccuucaaucuuccucuaucccuucccccaacuuuugcuuucuugcucccaguucuuccacuuaacuuacuccccuauuccuuuugggccccaugaucuaccauuuuaauuaccucauuauaaauguccucaguuccgcuaucuucuaccccagccaucugauaauaauucaaugaaaugaccaagccuauacccucacuuguuucaaggcccugaguggcauuccuuuccaguguaagcaucuacaaccaugucauccauuuccuauggccaugggagcauuccuuagcauucccagguaagggcacuuaauguaauuuauaagcugcuacuucaacuaccagaugaauguuuuaaagaaguaacugagggggaaaaaaaguauagcuagugauguggacaacuuaugagaagucagaauacaaucacccuugaaaauuuauauauauauugguuuuaaaacagagguaauaacuauauggcuacauaaauaaauuuguuucuguaguguuguucauagaucaucucuggacuggaaagaguuuuacuuccugaacaccucucacagauuauguuccuacuaagauuuuguuuuguugacacagagcaucacuauguuacuuaggcuagccucaaauuuucaauuuuucuaccugagccucccaaggagcaggaugcuagaacuauagucuuaaauuuuguguuguuguuuuuagucaagcagguauggcugaccuagaacucacuuuuuauguguaugugcauacauccaucuguguauggacacauacacauacacgaagauguccacaacaagcagaagguguuagguccgcuggaguuacagacagaugugaacugccagguguaaguccuaggaaucccacucagguccucuguaaaggcagcaagagcccuuaaaacuacagagccaccucuccagccccugcaaacagucuaauauacacauguuacauuuuuauguccuugucauuccauauuauugcgcucauuuacuugaaugacucugaccacaguaguagagcaguucuaucauauucacaaaucccacauagagugcucaugcucuuugugacaaacaccucauugaguucuaauacuuuuuuuuuuuauguuggaaucuggaucugggcaucauacauguuagguaaaauccuauccaccagcuacauaaaucccugacccugguucaagcaucuuacuaccagaaauguuuaaaaaaaaaaaaaugcuucuucuaagggauucagccacucaucucuccucccucucagcccacagcccacaucuaugcccuagccaaccuuuggccaauuuaguaagaagaugcuguuccaaaaaggacaagagaaaggguggcacaaagucaaccauccauguaaagaaacccauuccucuucaucaagaaaccuggucagacuugugagcauacaucaagguaaugaggagcagggcuaaagcauggcucagcaugaagucuacuugcugcucuugcagagggcccagauuugguuuccagaauccauccauaacuccagaucuaggggaucuaauguccuguucuaaucucuuuaggagaccaggcauacuacauguacauguagugcauauacauacauauaaacaaaacacucauacacauaaacauauauuucaaaaauuaaaauuauuaaacaacaaacaacaacauuaguggagauggaaaaaugacucaguaguuaagaacuccagcuguucuuguauaaggcccagguucaguucccagcacccacaugguggcucacaacuaucuauacuuccagucccagggaauccaaucucuucucuggccaccaaggaaaucaggcacacacauggugaguauauuuacaugcaugcaaagauaaaagaagaggaaaaaauauauaauaaauaaauaaauagugaggaaccagauaaaagccagacuaugacacugaaauagauucaugauuucuuuaugauuuuguccuugauacuccaauauaagauucugcaggcucagcuaaagauauguuucacuggcaagccacaaggauaaaauuaaugacaguucauaucaaggcacaauauucuuuggcaauccacucuccuaccuucaaaccaccuagggcuacauuugcagaagcucucaaauaguaacaauaaugguaacgacugaucuccuacucuuaacuauuucuacauuacuucauccucuuguggaucuguuuugugauacaaguuugcaugauccuuuaacgccaaacauugcacagaucuauaaaucagggauacauuuaagagacuuuguugggaacaaagucagaaacaugucauaugauaugaccuuaaagucagaagagucugcauuauaauuggaauaaacuuuuaaaauucuuauuuggcaguuccuuuaucagaccucauccauuuaauuuugucuuuuguuuacuccucucuauucagucaguaggucaucugaaaauauucaagucuuucaguuuuauacaauaauuuuuugguuuguuuguuuuucgagacaggguuucucuguauagcccgggcuguccuggaacucacuuuguagaccaggcuggccuccaacucagaaaucugccugccucugccucccaagugcugggauuaaaggcgugcaccaccacacccggcuauacaauaauuuuugaaagaguugauuuuauuguuuauguguauaugccuuuauaugcacaugccacaugcauguaugugccccuggaggccagaagugggugucagacaggcuggagccaggguuauacugaacaugcgcuguaaugcaaacucaggucuucuggagaagcagucugggcuuuuuacuguugagccaugaccaccuacacacaagaaccaccuuuuagacacuguguuauaagagaacagcuacucaagacuacaaaauuuaaguggaacguguauucuguguccaugucuucacucaccuugguuaugagacuaauucauuccucacuacucuaacacaaugacaaagucaucuaaguagggcgaugugguuauuuaguuaucccaccaaaggacgcaaccuuagcaucaucuguucuuguauaaucaacguuacaaguuugaguuuauaaggauauuuuuuuugcuccuaacugauggguuagaaaacugguuuugcauauguagaacuaugcaagaaaaacauccuuuauauuucaaacuagggucucaaaacaggucuucauuuucacuuuaacugcuaggagccuuggagguauuaauugaucuucuaaucauaacagauggaugauggagauuuuucuauacuaacuucugggggacuuguuacuuuauuugcauguauaaugucacuaaagauugccaaaacauucucagaauaucuaagcuguuuuacacucacuuggaguagaccagaacuucuuguaucuaccaauacucuaacuuuugugaauuugguagucauaaacuuguuuuucuucccuauagagcuaagaguauucccagggccuuuguacauaccaguacgcacucuagcacgagauucccagacccacacuguauuuugaagacuaagaccauauggcuucgcauacuguuuggacacugaaacuaccuccaccuuccaccuucacauauguuguuucuauugagaugacuuuccuaaagacuguauuuucauuaucugaauagauuggucaucuguuacaaauuacccaaucaacugaccacuugcacccuauaauucucuuaaguuugcacucuaacuuugccuccaaguuuucaccauuccuggauugaugcgccaugauuacauaaccaaauaccuacauccaaacuuccaguuuugagaaaaguuccaauguugccuuuucucuguuggacacugccaaugcuauaaugaggcaguagcuauaaagaugcaguuuuaccaacaaguugcuaagaccacuccccaguguuugcucccauucuacguuguccacacuggccuagaacuucaggauggaacaaauccucuggcuucagccuucagaguggcuaggagccacaggucgguucaacuacuuucagcuuucuagucuuccuucuaaaugccauucucuccaacuuuuuacuugguuccuaccagucuugacggucgcauuuuuuugucccacaauuuuuaaagcuucuuuauaacuuacugaacacgucugccacggucaggauagucuuugcuccagcccaaucuaauucuauuuucuuuccuucaaguaagcaugcaguaggcgcagauuccagagccaguucgaauacacaucccugaagaaccgccuccgcuuucccuucaucuaccgucucuucucugcuagauuagaguuccugcggcugaagauaaacaugagagguccucacaccgucucgacgaauguaauggacuucagagccuacgaccgccacagacaaggcccagaaaccgcagaacgggaagcgcuuccuucagcuccagcucccguacuaccccgcggccgcgaugcaugccgggaacucuaggucuccguacccaggccggccagaccggagggauucccuacagaacgcuccgccgccccgacgccacuccucggucccgcccuuuccgcuccuccucggagagcacacagccccuaccgaagcgaucccgggagugauggauuccgccccacaccggcuucccgccacuuccuucaagcuacacucagcggcuggaagaaggcgguaacaccggcuccuccgaaucgacugagaccugccu

SEQ ID NO: 6158 - RNA, 5343 nt, Mus musculus
aaagcucggcagucccagccuaucgcuuugacaaaacuacuuaucgugggagagaaguuaggcggggugaaggacugaaaggggcgcgugcccuggguggcggugaccugaacccccgcagcauccugcacccugaccugcaugcuugaagaagagagcuugggagaacgauggacuaggcgcggucgccugggaccaagcagccgggauguagggaggcgggcuggucgguaacagugauccgguggcgaccuggaccccucugcggcgagccagguggggggucuacgaacgauguaugggcguggccaggccaaucccaaagcaggauuuacagucacgagagaaaaagaccaaucgaaauccggggcggcggugguggauggcugauagggccaaugggcugcaagcgccggggcggggcggggccgcgcggaguuucaaaucggcugcggugggcuaggagaggguguugaucuucggguccggguaucgagcagggaggugagcaugcgggguuaccgaggggcuuaaggaggggggugggggacggucucacggggagcucugaauggggaacgggucaggagcucuggauaggacccacaagacaaagggaaugucuaggaguugcaaacgccccaucggauccgaggccuuggcuggauugcuaaaucugcuccggagaggaaaauuugugaaaacagcauacugcuggugcccugcguaagcgccgaggcuccgugaccugugugccacuccacuuagccuauggggaauaggcuaggauggaaagacggacaaauugccgccuugcaacggaggcagcugcugaccaugaugccauuggucaucuuucuggcauccacaauugcccaacaggccuaccccgcgagguuccacuucaucucuuucccaguucccaaggucccuggagccuuggaauggggucagggaguacuuugaugaccuuuugaccuccccaggaucuagcgggcagcggaaacuggaccaagcacauggcgucucaguggcagggcaugaggaccucugugcgcagacgaucacuccuaaaggaggaacagcuagagaagaaggaggugacccggucugcugggggucauccggagaccggucccuugggcucccugugcagacaauuccaaaggaggcugccucugagagcggucagccugaaccucgguaacggccccuccuggaaacgccuggaaaguccagagccagagcagcaaggucuucaggcugcagcucgcucagccaaaagcgccuugggugccaugucccagguaacaaugacaccaccagccgucuguuuacagaagcguccuugguguugacugucccuauccucagggagaccccaggaauauagacuccauggggucuugggguuugauuagguucuugccauuuucccagaaccccggucauucuggcacauaauaguuucccaacaaaucaguaggugaauaaagucauggaagaaauugguguuccccaugcaaggugaccugccauguccugugauagaaaauugcaggaaauggcuaucuauaaagagauaccagucucaagcuuaguggauaaagacuuccuagaauaggugacucuuccaagaucacucaggaaaggggagguguauguaggcacagggccagugggaugcugugagugaguccagcguggaugcugaagagaagaguccccagugugaagcuaagcagucaguauagugagagaggugauccugugugcugacccccauuuaaagucucccagucacacucuuacaccuuagcugucaacuauuugguagaaaaaggcagaggagcggggcuugcagaaagggugcaacuuccugagcgguucagaaggcagauuugaggggugguguuugugugugguguguccaagagccuucgagcagauaucuucuuuuaauguuuuaauauuuaucuaugggaggagcgcuuaugcagugguacuugucuggaggucagagaaggaauaaggucucccuccaccguguggguucuggagaucacacgaguugccugguuugguggcaagaagauguaccuguuacgauaucauguugaccccaccuaggucuuuaaaccuggagcuggagaugugggcagguguccccuggacaggacagaagcuaugagaaugagcagaccucuaagaagagaagggggaauggccccuggcaucuugcuggcauucugaugguguagggagagagcagaggccucugacgacuccacagagaggucuccuugccaaagucuagcucugacuuggaagagcccuaagauugcuuucaacaucgcuauagcucagaacaaugaaaugugacaguuugucuaaggucacccaacucaugaaaacuuaucucgggccuugcuccaacuucuggguucugguuugccaaggcaaagacaaucuagcaaggcuguuugacccagccacauguugaagauccaaggguugggacucagcccuguagauuauugggagccauggaagggcucagagcaauuaaguguuaugagcagaccugucauugaaguauguuagacugagauggaggagggaagagaaagaauaggacuaagguaggauccagagcuggcauccagaaaacugagccucccucacucucugaguuagucucugccugggggcucagauguagaguggucuugcugcuaccugcugaguuaccacacuggaucucaggaaggucuuggaggagaguaccaucucauggggagucaugcuguugcucuuggcuuacuguugcugcugcuuaguaacagcagacuguguuuguggggccagcccugggcuggaagaauggcuagagccugguagcccaccuugguccuaucugugccaaccuucucacaugaacccaucacagaggauccaggaguccugucagaguggcaccaaguggcugauggagacacaggugaaagugagaaggaagcgaggagcccagaaagacagagggucaccaccacccagucugagccagaagaacacucggcuaugcagggccaaccgggaugcuagagucgggggacaucuucgccucucuggccagauggguccgcaugcccaucgccgucagcggcuaaggagggagucugcccuccggagccccuguuccuccacagaaccucucugcucucccaggcaaguagucgucugagcccaggaggaccuccccuucugucccacgagucuccucagucaccugggacgagaaugcccugaucugucacauccuaguucuggcccaggucugccccaaagcuggugaggaccugagggggaaaaaaaaucucugagccucaguuugcuuagcuguaaaaggaauaggagaugaguaucacucccuccuagaugggagacaucuggaagaccgaggcccaggugcaagaccagcagcagcccucaccgagcuauaaaauaacugcccauugcuuggccucucaggcuugcaugucacaccccaaagggaggcucuaguggggcuuucccagucccccagggucaccugggcccugcucagggcucuuucuaaucccugcugagacaucuccuuguguucagugagucugacagugaccuagagccugugggagccggaauccagcaucuucagaagcugucucaaaggcuggacagagccaucaaggcugaagagaggugagcugcaucuuggggucaggguaaaauggccaugggcuccuugagccauacuguauuucuagagaaggugcugguucuaauaccaaccugccacaugaccaagaccaaguccuuguccaucugugcaucugccuccugggaugaugguaaaggaugcacuaggaaucauccagguuauagauucccaccuucuccagucaccuugaaccucacauguggcuggguaccugcuuccugagagaccuccccuuccuccaacaccuuucauggcuccucuauacccugucuacccauaacuuggcaaaagcaacaugguugcucuggagucccuggucugucuguucaggacuccaaucuggggucagagcuaugacucugaaucuguccaaacuuagaaacuguuuucccacaaagaguuuuugggccguauguccccaguggccauguucccaccauuccuacagguucccaucuugucuagucugugcuuucagaacauagaaugugccuuaggacauaaagcauccugggucagcaauccuucccccuucucuguccuuaguggugacaugaccgucucccuuauccgugaaugaggacagcaagcauccuacagguaaugacccugcgucuuucucagucucuuccuccuccuucuccuuuucccacauguaaguuugcacgcacacuugcaggaguguaaagaaaugaauggaguaagaaaaccacaggguagguugguacagaguuguccacuucccucagccaaagcugauuacaucaacacccugugauuucagaggacugaaagucaacucucagccucucaauugggagaagggaccuauaguauccuauaucuccugccuugagaauauagagacgcacaguggaaccucugucuuacaggaagccggcucuguccaaccaccaagccaccaggauguccaugcugcccaacccaugaacuuccuggagacagcauuggguuuaucagcauccccaggccacugcuaacaaggauuugacuaacauaggguccagaacccuucuacuucagccauaucugggcccacugguaaccacuggccacagccugagaguuauuuaggaagaccuugaagaggugaugggaacugcccauguucccccaggggacuccuggacucgggcacacccaucuggcucuccagcuucauaguuguccauccauauuaggaauguaccagaagaugcuagauaguucugagucuggaaacuaggaccaaggaccugcaggagucaucccacaaacccucccccuguauucccagggcagagauuccggaggacccacuuucacugcugcuucccacccccaggaccccacaggaagagaggagguauuugcagacugcaagccucagcucacggagccuacuuaucuucuccauguaggggcacuagcgugccuggaggggaaugcuguucgaaagcaguuucuucucuuuguaaauuauuuaagacaucugcuaugucauucuauuaaaaagauaccagugugucauuuguaggucacauuguuuuucguaauaaaagcucgcuuuccaugcuugg

SEQ ID NO: 6159 - RNA, 2975 nt, Mus musculus
cugcggcggccccgcccacccggaaccuuguccacgccuuacuugggccccgccuugggggcgcaggacccuagggcuccucccgugcuccucuccgcacuguuguacccauggccaccuucgaggaggugagcgugcugggcuucgaggaguucgacaaggcagugaaggagcaugagggcaagaccauuuucgccuacuucagcgguucuaaggauaccgaagggaagagcugguguccggacugcguggaaggugaggcugggaccaggacuggggguugcugcgccacagcagugcuaggaagaaggccccugcugaagucagaaagugggaugagaugaggaucuugguccugcagacccgcagaagcgccugagcuguaccccgucucucguuaggcccuuacugccccacccaaggaugacccucauuuuuaucauggauucggaucuuggaaccagguucuuuaaaauucucaguuccccaaacgauuagugucucauaaaaaaaaaaaagaccagacucaggaguugaucuuuccgucaucauauauguaugcugaguuuucugauugugucuuaaagacaaucaggacuaggacuuaagugauucacgaguccagaggacacgcgacuuuaacauccuaucuuacaaccgguuaaagucuaagacuggggacgggagggcgugggcuaucgcaguugauguguaauuacuuuuuaacucuuuuaaaaagcugagccagucauucgagaggggcugaagcauguuaccgaagacuguguguucaucuacugccaaguaggagacaaaccuuaguaagucauguauaccguaucuccagacauggacuauauuauuaaaaagcuggguaaaaaggaccucagauaauuggucaggcucuguguuuuagguauugucugauaagcuaaacaauuagaauuacugaauucauauuuacaguuuauguucaaccacauaucaucauuaaugaauugggucuggaauaaguucagaacucuauugacuuuacauuuguuuuaucuuagccacacuuuaaacuuugcagaaagugacacauaaguuacaguucucaaaauguuuaaagguuaacaaaagcagugguuacaaguauauuauauauaagucaacuguugaguaaacuguaaugaaccaaguaguauuuuucauuaucuguuucauuuuggaacagcuggaaagacccaaauaaugacuucagacaaaaacugaaaauaaccgcagugccuacacuacuuaaauauggaacaguaagugucuaccuuuauguuuguagcuauaauguaguuaaaacucaaguuguuuuuugagucaaguuugaaaagaucuugaccuuugauuuccaacaucacauuguuguucagagugcaucagaaacacacaaguugguguccauuccucugccaauccugacaaacuauuaauaaugcagauauuagugucugggguguauuuuuaagccacuuuuaagauucugucuucagaagaaaguugacucauuucugaaagcaccuuugucaauguuuucuaaacccacuuuucaggcuuaaaagggcucucccucuauuucagcccugccccuagaauccuaaauuaaagaguugagggaaagagauggcaccaggcaugcugucucuuguuuucagccuauggggcuuccuaguguggaaauacaaggccucucaggccaaguguuuuaaugauucaucuugacacaagcauccuaacuauuuaauaaagcuuguuauaacuagcugauggcauaauuuguguucaaaaacuugucauucaaaguagaauucacuccaccccuaguaauauucauagcaacagugaaaacuuaaccauucuuuuuacagccucaaaaacuuguggagucugagugcugucaauccagccuuguggagaugaucuucucugaagauuaagauuugaugaccuugccggacugugguggcacaugccuuuagucccagcacucgggagacagaggcagcuggaucucuuugaguuugaggcuaccuggucuacaaguugaguucaaggacagccagagcuacagaguaaaacccugucuggaaaaaccaaaccaacccaaaaaagccugaugauugcaauuuuguauugauugccugguuuguuuaaaagcagccacauuauugcuuugaauugaugaguaaaugauguuauuaaaucaguguauaucuaaacaauaaagaauugaaauacaaaccauuaaguuuuuuaacacguggcuaucuaaaagauuugaguaaaaugagucuucaguauggugguaguagcucaaaggaaauauugaagauagaaaguaacuuacuaacuuccaaaucugcagcaauuaguaucuauuaccuuaaguucuguguauuugcaaaacccuuucugccuuugaaauggagaacuucauuaaaccauuuaggaaagacaugggauucauaugcuuaacucaggcaguuuucuuucacaaaugucuaaaaugugauucuuuuguugugaaacaggcugguucuccuagccacaggccaaguacuaucuaaaucuucauuucuucaaguaacaauugugucaggcauagugacacacaccuguaauauuauuuuagaugcuaaggcuagaggauaacaaauuuaaggcaaggguagacuacagaaccagaccuugucacaaauuuaaagcccaacuauuauucugcaaguaaagcaagaaugugggcugaagaggugguucagugccuaagagcacuggcuguucuuccagaggacaugguuucaguucccagcacccacauggcagcucaugagauguccauaacuacaguuccagggaaugggacacucucuucuggccucugagagaaccaggaaugcagugagacauagauaacacauguacgcaaaagauuaauauccauu

SEQ ID NO: 6160 - RNA, 2157 nt, Mus musculus
uggauucaggcauuuagcugcagcgcacacuuuauagacuuuaaagcacuuaaauuacagcagaaugguugaccagcaucguagaucccagacuuugagugaacguccugaaugaggccugguaaaggguguuaagugggcacauggugauaaauaaaacgaagauuaaauaaaaacuccaaaaggcuggaaagcuggcuccaugguuaacagcaggacucacucuucuugcuggaagaggaccuggguucauuucccagaacccauauggcuguucccaacugucuauuauuucaguuucagggacucugacacucucuucugacucugggguuaucagacaugcaaaugauacacacauauauaugcaugcaaaauacucauacacauagagucuugaaacacacacacacacacacacacacacacacaccccaaagcaggaacucuaguuuuaauugcccugggggaagggaugggcccagggccacauagaugcaaacaagcaaacaaaccgaaaauagagagggccugaagaaggcaguugcagacuugagggcaaggugacaggcaggucacaggaacagagucaaaaaucuugauacaaauguguguucuguuuuagggccuucgacauucacaggcugagaagguggggaauucaguaguucuuuccuggugguggugguggcagggcuagggguggagaagagggaggagagguuagucucauauaauucguagcaauugcauauaaccuauucuuuacuucaucucuggauugcuugcaacaccuaacacacaguguaagugccgugcuaauagucggucucuguuguauauaguucagaguacgccgaugguuuccauguuuagaacagaagcagccauccuagucguaaacacgcuaaccaugucagcaacuagauagcaucuugaucaguggugagagcugacuguacaggaaucuggacucagccaugugucaaguagccuguggauaagacuccccagaggagaaugagaggcaggcagaagagaaagaacucaccgaagugucaauaaugucauugcacccucuuguguuggugucccaaacaggacuuagcacagcagguacuacacacaggucuguuaaggggaggauuaaugaaugaacgaaugccucgaugaugguuggcaggauuaugcccccucuuuucuaaggccccgucucccaccauaaaaugguacuagcgaggugguugguaagugggcggcagcaacuacccgcgccugggcaaagacggccggccugcgcaagcgcguucgcuggaggguaaaagucguucggucugcgaggacagugaccgccuuccuuagcggucccucuagagcgccuacggugcgcuggguaggagacggcacgaggagggaaauggguucuaugucuagagucgggcuaacgcuaggaggaagccagcggaucuuggaggugagaagaccgcgguggcgcagggcucggccaucgccucuaggagacgccccuccgggauagggaugagaaggagaacgcuuuggagagagaagccugagaauccuacaggcugguguuuuucaucugggacauuccggaguccaggagagagcaggugagaguacacaaaggguccucacgcuuaagcuggcagaaugaccggcacacccugcaugguacugaggaccagagcagcgccaacgggcuggcaaguggugaggugccaggguccaguccucuccauagagggcuggugccaagcacugaaaucugcaaacgccucacucugccgcgggguggcagaguccugggacagacacuccccacagaccccgagggguggcuccgccccaggaccgcagggaggccuggcaauggggggcggaguuguagccgcccccaauccggugggaccgcgcgucccccuuuuaagcucgugaagcuucuagcugccucgcaaucuuuucucccuccagucagucucccuuucacgcgauggauucggcgaagacuugugugaccaaguucaaguccuuugcgauuuugcucuucaccccgauccugaugcuuccacucgucauucugauaccugacaaggucaguugcgugucugggcagccuggcggaauccgggugcccag

SEQ ID NO: 6161 - RNA, 437 nt, Mus musculus
ggagauuuuuggguguggaccaagagaaguccaggauaccaguuguguaaguaggucuagaggacaagugguucagacaggagcagaacaagugauucaaggacuuauuuacuuucgguuccaaaaagauagugauagauuaucuuauguuagaccacaugggaaccauagagagaggcugucugagauucggggagaguagaaaugagcaguaagcacuuuagaaagcucagugagaaauauaggcauugucccuaaggaaaaugaaaggcugucaaagcacucaacaucacagugcuugggucaacaggucauuguucucaugaugugggcauugaguuaaccagaaugcugauaagauauggagaaguugcaaaaucauaguuuauuuuguuuugaaacguguagguaaauaaaugccgggaaucccuguugca

SEQ ID NO: 6162 - RNA, 10967 nt, Mus musculus
auggacucaagaugugaaagcagagaacuauugggaagaaaagagguucauaggaguagguuggggcaacggaaggcaauggggauaagcaugauuacaauacauuguaaacucauaugaaacaguuagaaauuaaaggguggggggaauucaguuacagagacugguaaagaaaacaaaguugugaccacuaggaaaggaagcuggaaagcuagugggaacugggaagcuagugggaucugggaagcuagugggaucugggaagcuagugggaacugggaagcuagugggaucugggaaguuagugggaacuggugcucuucaaucuucggaauccagcuggccauccucacuggaguuucuuuuuuuuuuuuuaaaaugaagauaucuuguccaugagaugcuguuuuuuuuuuuuuuaaagauuuauuuauuuauuauauguaaguacacuguagcugucuucugacaguccagaagagggagccagaucucauuacagaugguugugagccaccaugugguugcugggauuugaacuccggaccuucggaagagcagucgggugcucuuacccgcugagccaucucaccagccccacuggaguuucuuuuggugagcuaaccucuggcacuucuccuaaagaaaugaaaauagauguuagaaagcgucaacaucuaaguuauuaagcuauuuucuagcuuuccugucauuggucuuccccaccaacaggggcugucaaaggcagggcuuuuuagaaugcuacaccagcacuuuguuacacggugcugcuaguuucugaaccacccccucuggguguugcugucccuuguucugaaccaaggggugguggugcucugauugagaccguauagaaaagacucugagcagggagggugacuaaagacuugggguagugccuuauggaggugggcaucacaggggaauggggagaaacgcauguacauccucuguguagccacuggaauuagggagccguguuguuuacuugguuagugccaagucacagaacugaggggcggaggaaugcguauaucaacacucccaaagguucguguuuguauauggguguaucagggcucacggguaaaauacagaugacucacugacuuucuguuucagagaccugaagaaucaccaugugagaaauaaugaucccccccacccccucauaauaagaauugggagacucagaguagcgaaacagaagcaagcaguugaagugacuuacaaccuuguacagucucuacagaaagggcaaaaaugguuagcgcucccauuugguacaagugguuuuuauaguucucaagugugaaaaacuucugcccaccauaggcuccccaaguggugguggugguggguggugguuugagagccuucucuauccuagugcaggggcucaguugugcaauguuuucaacccugacauaaacuaagaagcauccgggcagaggcagacaagggcaguguccccugcuuacuugggacucaguagguacuucuagauguacuuucacacugaaacacauuuucauacugaaaauggaccauaauggcagaucucuuacaaugucugcagacauacugagauuaaaaaaugguccccauuucuuugaaauucaaguuugguuggggcauauuguacuucuccuugcuaagucugacaaagauggagaaaagugcggaagcacccgacucagggugaaauuaggucauucuuauaaaacauaaaugcauaaagaaauuaaaaaaaaacuauugagaucuccuguuuuugaaggacugcaccucugggggugggggaggcaaacagcagaguaaugaauauucuaagauaacaugugggccguagacuauucagcccuguguuugcugauaggguucccguugagaacccacaggcugcugaaauugcuuccucagggaugugacuggagaagaguaagaggggagaaucagcuugugugcgugugugaugcugaagacugaaccuaaggccaucugcaugcaugaaggacaaaugcuuuaccaccuaaccauuuaccuagucuucccuucuccauugauuuguuuguuuguuuguuucuuuguuuacuuaauuuuugacacagggucuuacuuuaacuuaguuggccuugaauucacuauguagccuagacuguccucaaauucagaguccuguuucagucuuccuuuuuaaaaauuuguguggugggcaaauaugugguugaagguccaugcucccauauguaaaggccagagagugccaucuugguaugugacucuucuugucuuuucuugaugugucucugccuuguuuugggauagggucucuugcugaucuuaaacacaacauuuugucuagacaggcuggccagcaaagucccugggacccaccugucucuguccccugagcacccugagguuuccggagugagucacugugccuggcuuuugcaugguaucugcagauuugaacuuauauccucgggcuugcacagcaagcucuuuaaccacuuaguuaacccuuuagcccccgccgcccuuaccuuuccugagugcuaggauuacagggauucaccccucuaccugacagaguguguugcuuagguuuuuguuaacucaacacaagcuauggucaucugggaagagggaccucagaugagaaaaaugucacauuggccuguagcaaauccguguggcauuuucuugacugauaauugcuguaaggagguuuguugugggcgguaccucuggugggcugguggucaugggcacuauaagaaaccaggcugagcaagccaugaggaggaagcaagccaguaagcagcauuccuucaugaccucugcaucaauuucugccgccggguucuguacugacuuccccaagcacuaaggugaaauuaacccuuuccucuucaaaugccuuuuaaccuccccuaccccucccaaaaagccccaaaacaaucauuuggaacaaucauuuggcagagcagagguagugaacucuuuaaucccaguaccagggaagcagaggcagguggagcucucuacauucaaugccgguuuggucuauaaaacagaguuccaggacagccagggauacacagagaaacucuguuuuggaaaaaaugaaaacaaaaaccccaagccaaaccaaacaauaaaaccaaaccaaaccaaacaaaaccuaagcaacuaaucaaacaaaaacaaacaaaaccccauagcaaaagaagauagccuuggguggaaaacucaggaugagaaaggccagcuuuggguaugcuagaggcaagccaccagccgccuucacaucuggagucagggccuucugccuuaucuccaccuggagggaguucacugacagcccugggcuuccaucauucauguggcccuggaguauugccaaguguagggucugauacagaugcagacacaggagauagauugaccuuccuucaaagguuacucagugacugagaggugacacaaaccagauagccgagagaaugcacaaugacacagaagcagaaggaggcacaggaggagccacacauugggaagcaaggcuggggugcuuuaagacacugcagcagguuccuagacaggagaggaggcaguuagggaugcaaggagaacaaaguaccuggugcucauuuagaaugggcaagggaaguaaaauucggcacugacaacaguucuggagagugucauaggccgucucgucuccugugggaagaucagcccucugcuggagcccagacuucaaaggcagagccacagugccauuuuguuuuuuugucucucgcuuuguugagcuguuucuauuuuuugucuuuggacgaacaucuuuacucacuguggaucuucgauuuccagaguccauaaaugcaaggguugaaggaaugacuauuauacuuucaucccgaauacgugucacaguguuuggggcggaacauuguuucugcaaaugucaauaaugugugaaauuaaacaagcaauuacuuaagcuauaauauguaauaguuggacaagacagccgagauaaccugaaaggcuucccccuggauaaaggcuagcaagauggcucuguggguaagggugcuucuugucaagccugaagauaugaauuugaacccuggaacucaaacaguagaaaauccccauaagaccuuuacucagcaaacacacacacacacacacacacacacacacacacacacacacaaacacacagaguaaaaauauuuuuaaaaugcuggauaauauaaggcagacauuugauuuuacagcuaacuucgcuagaagacucauguuccaggauggaagauuggguacaucccucuaaaauccagguuuugggggccggagagauggcucagucuuaaaggggcuugcugcucuuucagaggacccaaguuugguugguuuucagcacucaugccagacagcucacaacaaccuguaaguccaguucuagaagauaugauaccuucuucuagccuccauagacacugcacgcauguguugcacauacagacaaguaggcacauauaaaaauaaauaaaaaaaauugaaaauaaggugugagucuuuaauccaagcacuugggaggcagaggcaaguggauaucugggaauucaaggccagcauggucuacauaucgaguuccaggacagccagggcuauauagagaaaucuugucucucuuuguccccuaaaaauaaaaauaaaauccauuauguuacacaggcuaauagggggcuguguuggucaugacugcuccucuccuugcacacucaugggauuguaaaaggcuucaagcagccuggguaacugcugcuggcuugcucucuugcacucugcuguucaugcagccgcaaggcccucccuaggcuccuaacgcccacgcucugcacuuggguucuuuggcuucagaacagugagaaauacauuucuguuauguagaaauugcacagccugggguuuucucucaccgagcugcaaauggauggggagacacgagucuuguaacuaggggcucaggcaaggggaaaauccuaguuaguaaaagaugagaaggaaggaaaaaccccuuccccugcaccacacugccaggaauagcaaguuucaggugcggcaguaaauaucaaagagcuaggucaccucuaagccccuuaguuccgcuguuccaacgugguuggucuuucuuucuuguuuguuuguuugcuugcuugcuugcauuuucuuaguucccuuuuccuuuucccuuuccuuuucgacagugucuggccucaaauugagggaucugccugccucugccuccucagugcugagauaagucuauagcccugggcagggcaggugggugggugggugagggggugggggacaagaagacguuucugggagagaagcugugggauguuucucaagaggagaacguuccauaagagaagagagcagcuuggcucaccagugugcuaaaaggcaguaaggcuauggagucaaccagcuacaucaucugcccuuuuauccucaguauccugugagcguuauuauagaaagauggggaaagcccuuuuagucucaugggggaggucauagccuaaacaugggcagaaagcccaagagguuauaaugcccaggccuugaagguuggugauggucagaggugaucagaggcauggggaguugucagagcugcucuuugaugggauaggcaaaaugaaagccaacucuacaaaucugcccaaaggaaaccuuggaacaaaccaaaccaaauaaaugaaauaacaaacaucagaaccuuugauaacugugauuugcgaaguguaucgagaaucugcugucggaccugcucuuuggaauacgaacuggcuccuggcacaguuagagagugggucauugccacucaccauaugggaggcauacguauuuucuggaaucauuuguuugcaaagaucacaacggguuuuucuuccaggagaugauacaauucucuucccugaguaaacaaagaaacacaaaugacuguucuugagaauagcuaguccaucuuuccccugguuucucccucggccuguacucaugagcauucccaggcuagcccggucuuaggcuugcuauacugcuagcugccuuagccacacaggaaaggcuuacuggacgacuguuuguuuguauuacacugguacucagggcagaagaugacccagaugaagagacaucuuccuggagcacaacuguuuuuuaaucaguugaaaggggcuguacagaguugcccagccugucgaauugagcuauucuacccuguucccagcucugugauucaaccagguguuguaacaucgugguguuaaaguuguguuguauugaagcugucaaugaacuuguguugcacacuguugguugugugggagcccaggcacaauguaaugaaggaaaagcacacaaauuuccugccuuuccuccagccaauuuugaccuuggguagaguguugaccuagugggacuuacgaagcaguuucacaguuucucugcauguuaucacauuaucaaaacaaccaaugaaguccacgaaagaugugccacagagacgucugugcucuuggcaaacucuccuauaaagaggucauugaauugggucaacagacugcaaagaggucagugcuagagcacguaugaggcucuagguucaaaucccugguacugaacuggagauagagauggggguggggggaggaaggggagugaggggaaagaaguaagggaagggggagaaagggagggaguaagggagagggagauggagaaagggaaaagggggaggaggaagagagagagggagagggaggagagagagaaggagaaggaggugguauuagaaagcugauauacaaaccuagucuugaagcagcagccucccaucuggccaucacuaauugcugugguuugaaugaaaacacucugcccugcuugugagcucauguguuugaacacuuggaccuuagcuacuaaaaugcuguuuugggaaguuguggcacccuucugagauagagccucccuggaagaagucagacacuagguucagguuucuuagcccaaccccacaucuugugcucucugcuuccugacuguggguucagggagacagugaggaguaccucaugcugugaucaugucuuccccaacacaucaaggcuguuauggccucacacugugagccacaguaaacccuuccauccucaagcugcuucugccucucucucucucucucucucucucucucaaauuacagaaugauaaaaacauucaauagccuaggauccagcucggugauggaaacugggguguccacuuuuguuuccugaucucucuguauguuuucaucuagaggugcaccuuaccaggcuagcgccauguccuuggaacgaaaagaaagcccuacauguuuaggauucccuauggcuuucucccucuucagugugaguucuuauaacccccccccccccgccucuuguuuucccugauuaagucacugaagacugcugcagacacacaagaaggcuacuccaguuuaguggaaacacacagaauagacacaccuccccugugcagucaaggguucuacuucuugcauccugcccaggagacugucuagcccuggaagcugcccucucccucuccagcuucucucugcugcucaccuuccucaggccugcccuuugcacucagacacauggcuuugugcugagacaguacuuggagugugaugggcugguugcaguguggacaaugcucuguccggcugccacagugggacucauggacauccagauugcuaagcugcacggccagcucacagaacuugcacuuggcagggugcuguuggcuuuccuuggucugugggaagauggaggacauagacccaaccucuaagggaacugaagucaaucaaagaaaauauuggcaagggucagaggcacagaguguccuuggggauuaugaacuccuuagacucauuauucuaguuuauuuucuguugcugugauaaacaucaugaccaaaagcaacuuggggagaaaaggguuuauuucauuuuauacuucaacaccacagucuaccauugagggccaggacaggaacucaaggaaggaaccuggagguaggaauugaagcagagaccaugggggaguugcugcuuacuggcuuguuuggcuuguuuucuuuacaauccaggaccaccuggcacaguggacugggauuucucaauucaguuauuuaucaggcaauugccuggagaugcacccacaggacaaucugauggaauucuucaaccgagauucccucuucccagguguccacagcccaugucaaauuagcagaaauuaacucauggaugguggaaaucuccucugucaagcauguacauauguauguaaguauguuugcauguauguauguuuguauguauacaugcauauaugcaagaauauauucagaugcagaugaaucugcaucuuucggguaggauaguccuucaucauucuccuggccucucagguggggagauaauggugguggugggaauuuuuaugacuagccucucugucuuucaaccagguuauccuauuugccuauagagaagaauucacuccuacuccagaaagggagggcuugcacaagcugcugacauaguccaaacuacucaaacuguucuggcuaguuuuauaucaacuugacugaaguguuuguugggucagcuugaaucuaaauggaugccugaacuugauucucagaaagauaaagccgcaagagacugacucaaaaagguaggaaagaagacugagaugggcccuccugccuccuccuuacaagucucugaagaacaguuagccuuucuuuauauggauccuuuguucugccagacccauagucuugggguagcaagaagaaagggagaaacuagggacagccucaggguaacacaaacaaaaaacagaggccaaacauggaggggcuaaauaacuuacccaccaggccagggaaggcuggacuccaguuguugaccccccaggccucugccccaccugcccaccugcucaccugcuggugcacaacuuccaugugcucuuucaucuuugacucugggaugggcucuucacauucugggcaaaggacuaugaagcgcaggcagugggccucguggagcaugaaguggagagaggccacauuucuuuugcuucaggauaaagugggggugggggagaaagaaaggcacagugucuuagcauaagacaugacgccuuguugcauaccugggguaagcucuuuccaggccugcggccuggggaaaacagugaugaugcugaugaugcauuccuaugccugccagugcuggugaaacagauaagcucgccaucagaaaauaggugugagggcacugugccugggagagggggaggaagaggguaccagggcaacaggcaacuuucaagauugaugauagauuucauuuccuagauuguaagaugguuucacaaauaaguacuguguaucaagauguauauuucaaacauguacaaguuagcuagggcuguuggcacagggguucaggagccugagucaggaagauggcuaguuuaaggcuuaucugugcuuauagaguaaguucaagaucagccuaggcaacuuagugauacucugugucaaaaggaaagggaaaaacagagccagggauaacgcagcucagagugcuuggcugcucugugcaaugcccuaggcucagugccuggaacgacuccucagcaucaccccacagagacaggguugggggagguaaaguucuauccuuuuccaguuaucuccuagaaaggccaucacgagaacaagggagcacagcagugcagcucugcccugaccacaccucagacccuccaaggguuucccaacucucaagagcaaaaguccauccaccacgcugucucccgucccugggcucccuugcagcuacccagagagcaucugagaugcaggggagucuuguagggcaggguguccuccucugauaggcucaucaccaggaacgcugccaacccauuccaucugcucaugcucacggcagcucgggagaaaggaaacaggcuguauccuuaaaggaccaauuguucaggcccugugaucuggcucauggccuccaauuguucaggccccugugaucugguucauggccucacugcuguuagccugauccagcuguccccacaaccgcacagaaugacguccuuugcucuguuugcccucucuguuuugccugccuccauacuccauagaccagagauccugaaaggugaaguggaacaaagaucucuguggagcuuuaccccaguuacugcaacagguggggucugcugaggaaccagcucuuuuuacuuggaggugugguccuugccuccugcucagcccuccauguucuaucucccagcuccuuugucaggcggaggacaggaauaacccuggaacaucucucaaaggguccucucacagaugggugggaagaccacgaugccccccaccccugcuacggaucuaagcucugacaggaauagccugcuagggaccagucccuccauacuucauggcuaaaacuagccagccugaaauacccaagcuaagagggaacagugauauugagguaccacugagcacucuacuuagagauuuggaaccucuucacuccagagguuccaguccccuucggcuugcccucugguguuguacuucauccccaucacuucagaauuuguuugcucugcccugccccucugucuggccagcccuggagaaaaugccuucuuaccaguuccugcacacuuggaagucagccuccauggucaagcuuccugcagugcuucuguggaguuucguuucuuugcacacag

SEQ ID NO: 6163 - RNA, 3051 nt, Mus musculus
guccccggaagauuugaacuuuauuagcuuccaguccaauugauaaagaucagcagggaaugguccaguggaagauggagcugcccacccugcccaaagacucaguaagggcuggugaccuuccacugggcuuucccaaaggugaguggcacucagacucuuuuucaucaucuucuggucuuuauuugauagaaaagucagaaauuccaucaguguggguaccaggaaaugugguuggaccagcccuggaugccagagccagagccagguaacagauuaggauggaggcuucaugugauggagcagcaaacaccucacagauacauucucuucauacauucauugcugcuagaccuucucugucuggcucucaaguuccagacaccucugccccucuguuaauaccccugaaaggggcagcagccacuggggacacuggagacaugggcguguucugcauggacuaccgccugcaguagggccccuuggccacauaugccagggcucucugugggucuuugaugcuggggcugcugugggauuugggguguugccagaugauugagcaaggugcaagucauggcuuuggccccucuggagaucccugaagccaccauccccaacauaucggcuucugugucauccagguugucacgaaggaugaguggacaggcccaggcacuaggugcagggcuggcuuccagguugcugagcagaacaccaguacuuggggauagauguccagaaccaaaggaacuguugauugaggagaugaggaggagcauggagccguugcuguccacgguggccagggcacugcucacugggguuucagcaguuugcaggaauggugggcagggagcagagcuggguguccuggagugaagaguagacuccagcaguuccacaaguucuggaccugcugaggggccaggagucgugaacaggaccccccgaggcagaagaagcugcagcgcaggcucuaaggaaggcacgggcugagcagaagguaacucuaaccccaggucucugaccagcggguucagcaaggccuucccagcgagaucugggcuggaggccagggcugcgcugcguaauacagcugccagguugggguugguggcccgagccccaaggcccagugggguuccauugguauggcagaacaauggacagagccccuuugugcccuggauggcuagugcguuugccaggggugcaucuaccucaaagcccuuuucagccagcauggcaggcuuggucagcagguguggccagggcaggcggccgaagugggcaugaagcaaaugcagagcaggcagacccgugggcagccccaggccgggggccaggaguuggguugggccugcugucagggcaguugaguuuccugaagagcuauuguagaagagaccccagaauguggcaccuguugggagacagaggucacauggggaucagaggcacuggccagaauuggggucaagauccuccaguggucccagguagagaaucacugucuugcuugcaauagaggucacugacuaagccugaaaucaggaguugcugaccagggucaaagguuacucaagacuaggccuggugcucagaucccauguccugcucacuagcuagucuugagguaauggccacugacugcccuaaugaguuccaggucacuaacuaggccccagguuagaagcucugagguucagggcccacagauuacacugaccuaagccuguugcaugaggauguaccaccgccagacacaaagcugcuccaacuccagcauccacgacauugcccccagcgacaagcaacucuuggcccaguugggaacauguggcugcaguaaggaaaggucugugugugauggggaggugcccugaaccacugaccccuagccccuucccaaacacugaccugccgggcugauaauggcgcuguggugguacacaccagggcgaugggagugucugcuggcuggaggggccacagagcccaaguuuccucuugggcugucccuacugugcagcugccucagagccagagagcugcuaacagccagcagcaacaagccugccagcaggcgggcccaggcuccuggcaacccaccaaccucguuccugcagaaaggggaguccugagccagggaugggguaaaggagcacccaggaaccccaagaagacccaaggaauguuucccccaaagguuugauuuugcaagaguauaaauuggagagagagagagagagaagagagagagagagagagagagagagagagagagagagagcccagggcacugcauuggcaaagacacagagguaggaaaaaguuggagaaacugaggcuggcuuggagagagugucuaacagaagagcuggaggaggcagggguggccagucagucagagggagaccuggaaggggcuuggcacauggggagaggugguugaggagcaggguucauccagguguagcccagucccaacccguccagcaggugcuauggcauggagcuggggugaggcugggagagcuggggcaguacuggguccagcuugauacagaugucuaagaugucuucucuuaagauacacagaccuuccucugacugacuggcucagucccaaguuggaucugcagccuagagcuccccuccccccaaacucaucuagaaagucccugaugcucagccaagugugagauugccugacccagcuuagggauuccagagagaggaccuugccagccguccagccugaguuauggagguccccaggcccuugcugacucaccgggggguauuuuggagucuccuuagggagaggaccaguggcucugcuaucucuuccucuuccuccuccuccuccuccucugacuccacgccaggcucccagaguuguagcuugugauagugcacagguccugugguggcauccauggcccgugcuaccccagaucuuugccgagagcccugacaguugacacugccagagaggcaagcaagcagguuguggcuggugcuggguggccuuggggaaug

SEQ ID NO: 6164 - RNA, 12050 nt, Mus musculus
agugcccuccccucccuggaagggccgggagcauaggucagcacuggaacuugccagguccugcugucuuccuaaauccuccuggacaaggguguaggucucugaccuucccaguggccuagcccuggaagcuuuagcuuucugguaauguuaaacaaggaucagagccccaaguucacaggaauggcgggagaaagcugaggaagccagcuuuggaacaauacccaaagcuccaccucugaccugaccccuucccacaggugccgcugggacagcaaugaacugcaguuuagguugggagagguucuccagcauccuggaccggcaggacggucccaaagcuuccuguguaacucacaguuggguacccacccucuuuggccugggaccgccaggacugaguggcccuaucuucaagaagaagccgcauccucaguuagccuggaaggcugugugugcuggaaccacucaguuggacacaacuccagcccuggcuggggacuggagggccaagauagaagccaccgugcagcagggauuuggggagauucuggccugcccuuagcucauaugaucuugagggagccacugccguccuccuucgacaguagaaacaaggagcuggagcuuccuccauugugugccaugcaaggcacacuccacagcuuugaagaaacagguccugggcuauacacagaagacauggcucaggucucgggaccucaguuccaguucugaggucugccaaaggcucugguguauggggaccacuuccccacucuuaggcucuaaccuugggaacagcaaauucugccuggcauauguagcuggguauccacuuuuggguguuucuggcugggacagucucccaggauaccaucucugcugucuucagcuaguucuuugccuggagguuuucucaggugggagcacccccuuaaagaaagcugcggcacuagggggugaaggcccuggugguaggcugagaacuugaccuuuucuuaccccagccccccaacuccuacaguaccccagaagccaccucauccuacaggaugcaggaugacccaagaguccuuuccaaugaggagucagauaagaugcuaaaggacuuacccagcuguccacacuacuuggccuaggguauaaaacugcuggagauugcccaccagugccuauagguaucauaccccaacugacucuuggggccgggccuucaccccagccuuugaucacacuucccccacacacacaaccccucacuccccugcagccaccuuagucaccuuugggcacuuauccccagcuuuacacuccuugcacgcuguaaccaagguggcucugguccugggguaccauuacaacuugcaggaaacuuccagaaccagcuuggguaacaacagucccuguggcuguaucccacuugcuguggcuucagugguguuaguuagugguacccaccccaccaaacucuggggcacccuggggguuugggcguggguuugcagagggugcuaucccuaaagaccagccuggcucccacccuaaccccagcaggggcccuagcaauguuuucuuguuguacaagaaccagguccaaguguugccuccucuuccuuccggaagcugaacugcuccuuuauuuuuuagagcugcugauugugaaucucaaagucuuaagagagaagccaaauauauauuccucuuguaaaugaauaaauaaaccuauuuaaauguuuugguggcucuccaguggaacaaccuggggaagggaagggcacacgggcccuaacccuggaagguugagucagagauuggcgucauauagcaucauggauuguuuauuaaaauauuggugaaaaaauaggagucucuagggcagggaaacagacuauacacacucaaggugucugcacucuccugcuggccacucuccuuuucuugaccccacucuguaacaggcuggggcuccugcucaccagagacagccuugcucuuuucuuuggcagggcagacuggggguggggggacuuucuuaugaccuccuuugugcugagugccuccugaugaugcuuuuugcuuucaggcucuaugggggacacaggaguggcuccauucaccugugacagcuucucuuuuuucuucugcaguuuuggggucuuggcaggggugcuggggcuuagggugggguuacugggagcuggacucuuggccccaguuaucccauucaccugggauggggugcuggccuuuacccucuuccuuuucuucuugccugugcuggggggcuggucuuuaccaguggcagcaggcauggcacccucugucacugcauccugcugugacgcagcauucuuuucugguguggugcccucagauuuaaguuucuuucgcuucuuggucucuggcaagaaucccuuuuucuuccgcuuugugcugacggggcucugggugucacuaggaauauccuuggcauucuucuuuucugacuuuggacgucuguaaggaaggauacagaacagugugugugugugcaguauugguuggagggagaguccuuuuagccacaugcccaaugcuggucccucucccagaacauacuggacuccuagcauccucauggccugccaguagagaucauagaggcgauuggagccagaugagugauuccccugcugcaggcuuugcugcagcuucuguugcuugcucugaagcacgcccaagggagcagugagguccacagacagcuucugcagaggaaaggcaggcuggaguagcagugguggugacauggccucucgccagcauuugggucuucccaguggcuccugagucccuuaaccauuucuguccuuacaucacuagucccuugguuguggaggaagcaaggaccacuggcacugacucccauuccauagccaggguccugggucucugcuuuuguaguucuucagccaccugcccaucuccaguggucuucuggcccucuauccugauggcucaugaguaacucuugccccucuauucugagccucaucucuagccccucucacugauuacuaacaucucaguuuucuuucuggcacacaguaacacagccucccucccaaucuaccagguccaguagcauuuaaucuuuuaaaaggccagaauccuccccuuggaaccuucauguggcucccaggccacacuccucuggagauccccccacccccgggaggacuacugucagaacugcugcccauuccaccugggcacugauuaccgggcagcugccuuaccucgugauugacuguccucaacagaguguucagcagcuccaagauggauagcuccuucuggugcucccccuugcucugugccuccccaagagucugcagggucuacagaggaaggccaacacugagacaccccugagaacagcccaaggccuuucuacaucccacaccuaacaguggcccaggaggaggaaauguguuccaagcaaucugguuaccagaaaccugggacaaguucaugggugggggcuucacagcuauuaccuggguggccuuucccaagaguuggguaaucagcugcucccacucaggauccucaaaacagacucucagcucucgugcagacagagucuucuggagcaucaggcaugccugggccugcaucaaggcgaauguaauagucaguaggaaccccaguaugucaggucaagacucaggaacucacagaaacuuagagaaggcugcaugugcuaggccuuacaaucaucaauuucucucuucuuaugugggaaaaggguugccgaggccuggagaggcaguggucccaacuggauagaagcaagaucgaccucauguugaucucccucuagccugucugauagcccuggcaucuaagccgacaagggaagcccucuuaugcaggccagagagcaagguuccuccaguuccucugugccaaucacgaguuacagcacgagcacagccaaggucagugacgcaggccucucaagugagaagacuguccagguguuucugacagccccuuaccugauggcggggccgagaugggccagccacaugcugagccaggacgggaagcagguucuuacagaucaccuagggauuggggaaggacaagaggccauuagcuggggacugggcuggguagaguucccaacagacaggcuggcucccauacuuacuggguaucuggagaagaggcugaggaacauggggaccguaagugagcuguuacgcuuggucagaagagauuccagugaugcugaauacacccgggucacaaaguccaagucuaagcaguuagcagccugguccuggugagagagcuggggugagacugggagcagggagaaggcugagggagagucuugagcagggcugacccuggcucaccucugaguccucugugucagcuccguguaacuuaugaccaucuuggugccucuuauugguguugcccuugaggacucgcagcagguacagagaggcauugaaauaguauagggcgacagaggcaucagccuggcugccagccugcugcacaagccucuccaccugggcaugcagagccucugcacacggccccaccucguggcaguagcggcgggcacgacacagguggugccuaugggcaggaaaggcaaaguuggucaaaaggugucucucuacuuugcucugucaaguacagcaaagagcagccccaagucacguugcuaaguuaggaaaccagcuuagagauggacagaaacuugaugccucuaaagugucccuccucuccuacguguaucugucuugugggacaguggcuucuggccucuguaaaguaagaugaaguucuauguccucagagacaggaacagagugggcuugucggaauccccaacuauucuaacagugauggcugggaugggaccucuccucuaugcacaggaagccgcaagcgugagaacccagggguggguaacucgugugcacucacaugaagaugcgggcggucuugugcaggagguccugcuccugcuugguggagccuuugcugcgcaugcugugcuggaucacguucagcaguggcucaaguaguuccaggaucagggggugcucaggcugcuuggucaccagcaccucgaucaggucuagugccuguggccaaaaggcuaagagucagcucaugcagaaacaugggagaggcaggaacagcucagggugcauggcaacuaccaguacacucacccugauuuggaagucccgucggagcuucuucuccuucuguagcuuguuuuucuccucauuccgggccuggaugcgcaucuucugcucuuuaaauaggcuggccagguucugguccagggccaucauggccucauccccaagcuccuccuccuccucguuguccacuccacccugagacacagcagagccaucagccgacccuuaaauggcuggacaaacccccucuccccuggguccugcucaccaaugcauucccagcuuuuaacacuuccaucaacuguugacggaagccuggguccacaucuuugucacgguccuccucuucacuuucuuccccauccucacuguccaugucacucucugaguucuuauuguccucauuaucugagucuucguccuaugggugggaagagguaagacaccuuuuugaugacacuaagagacuauguccagauacccgcccuaccaagcgcccucuggugaguaccucuccaugcugcagcugcuucucaucagcgucaucagugaccaccacguugucauccucauccucguuugucacagggcugagcaccugagaaguuccagaccaccacuguacuugcugccccaacuucauacucuccuuaggucaccccugaaagucucuucuauguuggccaaaggcccccaccaccccagggaggaaaagaggagugucccuugaacggccuguggggauggcggcauguagcacuuugaggugcagagguacagaagacgucacauacucccacauaucaguagacccaucuuacaaucuauuucuccaaaggccccaacucacagccaggauuagcugcagacaacguggaguaagguggggacagauaugaccaaauacacuccggaccaccuggcgcaucaaguugcuggguugagccagcaaggacagcaagaucuccaccaucaccuccacccauacuggcuccugggaggcuacaggagggagagcagauuuaggcugagcgggauacagacagccugauuacuuagccugcccaggagcaaugacacaccuuuggcucuagagcgugaucggcggggauucugcuccaugcuuuucuugaugcaagucugaaugucuccuaggacaucacagcuuucugcaggggacuaugggcaggacaaagcagacaucagagaggaacugaaacuagaguacuuagguaugccuggcaggucacccuuacaaugcaaaauguguaccccuaagagccuuuucacagccuguguauauuaacgaggccauagagccuaaguucccuaccagcacccacaguuaaggcugaaaaggacacccagggccacaggacuagcaaaucccagccccacaauguugggcuaaccuuguacucauccacaaaauaaauucuaaaauguuagcugacaaacagagggagacaguauggugguucuggagggcaauacaaaugguagaaugugauauauugacuacuaaaggacaaguguccugugugucaaacuggccucccuccugcagggggcagcacuuucgcucacacccuuaacuuccaaucaguaaaucacaucuagaagggacugugggacuaccaaucucagucacuggagguguggcccaaagcaaaguuucugguacccagcaaguacagggcagcccucuagggaaugccugggaugguggcugguacucacacagauggagcaggguuuuuuccccuugggcaacuuucaugcaggacugaauuggcuuaggaaauucaauuucaaccuccaugucccacugcccccgccaaagccacugaguugggggagccccacagugccuuucucuauagacgacaauaccuugaagauguggaggcccaccagaagcagcaggugcuggaaggcaauggcccuggucucagaggagcgggccucuaauuccuucagaguacucaucauccugggggggggagaggggggcaggggcacauuugcaggcaccacuggcagacagacagggcacccuccuccacccccagaaaucccaugcccucacuggucccaggccugacgcugcuguguugucaaggaugucacacugguuacauugcgguuaugguucaacagcaugucugccaacugaaccaggcgguaaguccaaggcuucccauuuucagccaggucuggugucugccugaacuucacacugagcgucugcaguaggcuggguaagagggagggagguuucacaagacagcauuagcacacccaaccccuccaacuacccugggguucagcccccugccccaaucccaggccugcugaccuuguucacaguucagaaaaaaacaaguguccucaucuccuggguagcccagaccuaccugaagaaggcacugacaaagaccccacgguugcggucguccaaagggaaggagaagugcugcuucgucucugggaucuggggcguagccuucuucgucuuaaagaaggcauggaacaagcaaaaccugcgagcaaaucagcagcggcauggggagacgcccuucacuggaccaugcaagggccacuucucuaguuugacccucugaacauaagcaggccaccugagaucaaguggaggagccagagcugcuugcuacagaacccauagauugagucugaaccuuugcuuucccucaucucuuuccuccauaggaagcauacccaguagauacccuauugcaugccagcaacguaaccugaaggcuucuggcuccacgggaaccaaacaaggaccaggcaagggaccuaguuucguagucaugccacccacagugucccucacacaccuggcuauuugcucaaccacagcuucauccuucuccagaugcaaaugauccacaaggcugaccaggcgguggaugauccacuuccggagccggaauacagcucgcucaggccuggaagcagaggccauguaagugaccucagaaacaggguaccccuuugccccgggaucacccgcacccugccccgaccucuugucaggagaaacaagggcacaaccaagggcuaacuuuccuccucuccugccucuaguuugaagccauggcacucaggcuuugagcuccucagagcuccugacacgugccacucacacauucaacgaggcguccugagcucucuucugguuggcagugcugaagucaaccaaggaguucaggucaggcugcaggaacaugucccgcaaccaggccacauagcucugcagggcuucagcauucaaaaaccgcgugacacgccagaagguaggcaugacagggagaccuugauuggugaugguuguaaaggccaccaucauagucaacugccgcuuagggucauccuggcaccccucuaggaagguacccacguauguacuuaucucugggaugaucuuaaauagguuuuggggcugcaagagaugagcaugaguuuggguuaucagagugaagaggcaggcaaccaccuuugucuauagagacuaaacccaggacuucgccacuccagucacacagcagggcugaaccuaacuuugccacaacuccaucaaggucuauccuugauuccuuaguucauccccagcacaagaagguuccaauucucccucaaagauugcggacaagauugacuggcaugaagggaaccuaagcucaagucgugauagaccaguaccuacccgugccauccuguggcucaaaacccaagugcuuucuguauagccccccacccccaucacugucuuacaggugcuaggcacaaaaugcagaacacacuggggucaauaaccacuccccucaaugugacccccccagcaguguuccaaauagauggcuggcugggccugcugguaagugggccccaggacaaaagggccugauuacuggccaaguccuccccuaccagaucuucagaggaagaaccccugcccuggcccugcaggcagcacugaaccacaugggaagacgacaccuaccuuagaaauaaccauguucuccccaaaauggcggaucaagucuccucgcaucaccaacugcaacugcuccucugacagaagcggcagagacgcacccaguaggcggaagcacauguagcuaaggagaguuggggcagagccuggucagaggcccuguacuugaucaggucccacccaggcuggaggagagggaagaccagugucacacacaccuggauguccaggacggauucuucagcagccccuccuccaaaaccuucuuccagaacaguucgaaucugcucuccuugagcgccaggcggagcagguccagagccacauuaggcagcuugugcuccuucuugacagaguuggcggccaccuucaggauguucaccagacuagaaggcagaggagauucaguaaacguuacccggaggacuacagugcaggacacccccgugagaacccacucacaaucuccucaaaccugggaauauugucuucugagaacaggucaaccgagcccaugagugacucgagcuuugucggcacccucugcuuagccaggaggaagagcuccaaguacuugggagagcggaggaucacuuucauguuacccuugaggaccuuuggcaggaucuccuggaacauggacucugggaccuggagugggggcacagguggaaagggugggucuuguucuacccaugggcuucggauacaccacuagucagucaacuugccaagcagcagaccccagcacuguauugaugacuaacuggccuggggucuauauucaaaacuauaccucuuuuuguuuuguaagagggcuagccggugucauauacacagagcccuauguggggagcugcaacuuaaauucuggucugucuccauuugugccaaaaggacaaaucagggacaagacaguggcaaaugacucuagauacaaacagacccaggcuugaccaaaccaacuauggcaaauguacucagauugccuucuacauacucaggcauugacaagcacuguuccagacccacacuagccacacaaaggccaccagagaggguuauggaguaucugaacugccuaacugaguggacaugugcugagacccugaaagacaaggcagauuuaagauaguuggugagagaggaauaacaaacaaacaaacaaccuccucauaccaguugcauggucaaaccaucuguccucaucauguuccuacccaaaucuuuucaacguuucccaaaucagacggcaugacuugugauucucuaccucagagaggauguccaccagagccuuuauuggcugucccuguaagugguugggguguugggacaggaucuucagcaauugcacggacuucaucagggccucuuuguccugguauccacagagagcaaaaggugaagagcagggucuguuaccaucuguuccccuccagcccuaaaccagucccugcgccccgugccaaaagcucuuaccuucacuaggcggccugacugaaagagggcuagcacuccaaaaagguuugcaaagagacuaggucucaucauugccuagaaaaagauugaaaacacaggugaagagggucccuccccauagcuguucaggagcagguugucugucugggaaucucacgcaccuuguucauggcuuguaggcuguauuuuucuuguaucugauccaggaugucacacaaugggaugucuucaaaagacugcaacagcuaccaggcaagaccagaaagagcucaggaguggcccagggacaacaaaccagaccaaguccauuucccuccuucagcuuuccccaauauaaucuccgugcuccucccaucccucacaagcgcuacugcuuucaagggaccacaucuuacauggcuaagccccaccuccaucaaggcuucagaaggccuaggcugcuucuguaccucuugggaaaacccaucccauccaaagauccuguucugaguugccuugaggcugguuagucuucauugcuuuuugcuguacaaauuucuacguggucugucaucaguugccuuccuaaccuggaggcggcuccccaaccuugcagaaaucaaccucaaaguucacuacuuccaguaacuguagcuaauacucuguagcugauaaacguguaucagaaagaaaacguguucaacucuuccaccugccuggacuuugcuguacauaggccauguuuuggcacuuccucccacccaaguaaggaugccuguauccccucugaagcaucucggauuucuucuuaccccgcagcuucggugcccccuacccuuagacgccaccuuugcccagcgagaucgugcccuugccagacacacagucucaccugugccagcgccaggcuguagcagggccuagcggcuucucggcccaccccaagcccagugauuaggcgcuucagggcauauuucaucuccgaauccuacggaaccaagaacaucccucguguucaacagugaucugaagggcccaccccucccccuugcauccagagccacgaugggccugggccccuccaucauacauugggccuugugcgcaaguacuccaacaacuucuccguggcccggagccgcguuuccugauccgguuucgcaaugucccagaagaaguccaagaacucgcggcugugcuccagcaggcuguggcggucgcuuugcgccgcuucugcgggagucgcaggcucagcuuucguggggcucuucaucuccgccaugcugagccaaacacgugggcucagaagacagucacuuccaggucaggucucggcgccu

SEQ ID NO: 6165 - RNA, 80885 nt, Mus musculus
caggagugcugcuucugaaggaggcaggcucagcgcgcuugcgcggagcggcccugcgcgcagugaggcaguggcgggggaaggcaccgguggggccgacgggcgggcagaggagggaagcgggcgagcgaagucccagugcgcgccgcggcggcccggguacccuccccuuccgggcgugaggcgcugagcgaggaaagccgagcggagcggacucgcauaggcggcgaggugcuucucgggucucccaagaccggccuccccgcggcuucggcgcuccgguccggguuccucaacacacaucuagcuccaggcaccggcagagcuugucgccaguccgucgaagucccgguggcggcccgggcucucgguggggaggaugacggagcugcagucggcgcugcuacugcgaagacagcuggcaggugagcggcggggcgccgggccgcgaucgcggacugccgagccacucgccuccucucgcccgcucggaggcugggugguggcgggccgcgagggugggagcccgcgagucgcggcgagcuggcgacacuccuggcccggcuguggaggguguugggggcggggacgcuccccagccucgcccucggacgggccggacgcccugggcggcugcccccucccccacggcacuggggcguugcgggggaggggcgugggucccggucgggccgacccucccugaggggcggaucccgggcucaggugcggcggaggccgcggaaccucggggaccccgggagcuugcgggguccccgcgcggcugugaguccgagccgugucgggggccggagaggggaggcgcgccaaacuucuggcccggcagcgcgggguucgcggaguuagggcagacaacaaaagcgacggcggggcuggcccgggugcugacgcggggcaccggggggcucggcggggagcgcgacuccgcuucgccugccuccgccuggcacgagcucgggcugcgccgcccgucugggggagggugggcgcgggcgcuggggagagcggcucgcuggccggcccgggcuuugugcuccgugggcacggcucgggcuccuucgcgcaggcucgcggccaccgggcugcggcccgccuuaggcucuggccaggggcggcggcucagugccucccccguggagucucugucccccucccccauugucccggccucuggccguuugcggcuuccagguugacuuuuuaggggguuggcuccuacucugcuaggacugugugagcggagcaugcgcgcuggaggcguacgugugcggaguggaagggggggagggaggaggcggguuggugccuucacaaugccgccccacgugcugccagauuuaaagagaaaugaaccgguaguuagcccugcuguccuacgccaagcgugugccuggcuugguucaggcgacuucaccccuccucaaccuguagccaguccucuccccccaccccccuuuuaaacuuucugaaagccggaauguugauaaaugaaauagauuucuaugaguuugaggugucagcuaaaucaccuuuaugacuucuuaaggaaaaggucgacaggggcuguuacagauuguauaauuagguuuauuauuagaccaugagcuaacagguuuggacaaguauuaaaauucuaggugggacagcaauuugaaguggauggaaaaguuagaauccccaucagaaauauuuucgaaagaaguuaaacaauuuauugcaucuuauuuaaaaacauucuuuuucugaggucuuuuucgccuuuuguuuuggaugaaggaauuaaaauuuuugacuuaguaggaauucuuuaucgaaaccugccuggucuacuguaguggauucugggacaucaagggcuauguagagaaacucugucucagaaaacaaaaacaaaaacuaacaauaaaaucaacuaucugcauuaauuuuuauuauguggcaaauuauuaaauagacgguaaacacugaauauuaaaaggauaaccuuacauaguggaaaugacauacauuuuuaaaggugcaaaagauuuuacaguuuaacaauaccacuauguuaaaauaagacccauuugugagcaucuuuuuuuugggggggugcugagguuagacaguuuuucuaaggaguccuucacugucuggaacucacagaaauaugccugccugccucucucugccugucucucugugucugucugucugucucucucucucacagguuuucucuuauauaacccugauuguuuuggaacuccauguagaucagguuggccuugaacuuaacacagaucugucuucugccuuccaagugccugccccccaccuucuuguucuuugagcuggaauuugaauccuguaccaccauacuagguuuauuuauuuuauuuuccacagaaauaauaaauaauaguuuaaaucauauuuuagggauacuuaacuuucucaaaauguauggaacaaaguuuguugguugaaaugugaaaauauuaaauuuauuugagaagacuggaugagcaccuaaaaauaaaggcuuuuucuuuuuuacuuuagcauuuuuaaaugaguuuucuuaucacuugaaaauaguaaaugguaaaauauaaucuugaaaugaaugaacuuguauaaaugccuuaaaaauacuaaauugagcugacuagguaacauaaucugauaaaguguccucagugcuagaguuucagaaauguauagcaguggcugcauuuguugaacuaguaguuugccagugauaaaagguuuugauucauuaccuaggagaauuuauccuguaacgaggcuuuguaagcauucaguugagcagaauggugcccugagugacagaauuucucauuucugguaccaugacauuuagggcaguuguugcuguggaggguuguaccugugcaguaaagguuacagcauuccugucuguaccuacuagauaccaguaguacaucccuucauugugacagugaaaaauauaucuauugccaaaguucccugagacggagucauuggauuauggugugucacagugguggcuacugggaagccaguaagagcaccacacacacacaugaagucagacagcuuguguauuucucugugauauuauuagcuuaugacuuacugcucgacggauuuaguggcaguuuuuuguuguuuguuuugugaugcauuaaacaccaagaagucacucaguaugauagaucaauuaaaaaaaacacuuuaaagguauuauaaacacaaauuaaaauagaauacagagcugggcaugguggcacaugccuuuaaucccagcauuugggaguacauuugaggccagccugaucugcauagaucuagggcagccagaguuacauagacacugucucaaaagaaaaaaaagaaaaaaaagagagagaacaaaaauuagucauuuuuccuccugaccaagaguccucuuugagggaccuugucuuuacagagauuaucuuuuauauuuaauuuuaauugagaaauuaucuugcuuuguagcaagguggguuuagaauacuuggacugccuagcucuaccucccuagccuggauuacaggccccuaccccagcugaagaggugaugcacuuaauggcuucuuggcugaagacugacacggaccagccacuguuauuuuacacauuaucucauuuaauccuccugaaagaaaacagaggcuuagugaggucaaauaaaugcugaaggucaaauaauugcugcuaauggaguugcuagagccaggaccuucuuauuuuuauaaacuucucguauucagugggcaaauugcucccaaggagccguaguugacgcaaucaaugaaguauaauuuuacuuuauuaaauuuuuuuuugugcaugaauauuuugccuguauguaaguaugugugccgcgugggugccuggugcauguuuggugcuagaagagggcuccagaccugcuagaacuggaguuauagaugguugugagaugccauguggguacuggguaucugucuggguucucuggacgagcaauuaguguucuuaacuguugagccaucuaucagucaccaugaaguagaauuuaaaaaucaaauaccauauguauugguuuacuccuuugguccuagcacuuguaagacagaugcagaugaaucucugaguucaaggaaauccuuaguuucauaguaagacccugucuugagugguagggguagggcuagggacucucaaauacucaaaauuagcuuacucaguauuacuguauaaaauaacauaaaucuuagguaagggcuggagaaauagcuuaaaaguauugauuugagggauauaaugcucuuuuuuggcuucugugggcacuacacacauguacccagacauucaugaaggcaaaacuuuuauauacauaaaauaaaaauaaaccuuaauaaaagaucuuaaauaagcuagguaguugcucaagccuguaagucccagcuaugggagagaggcugaggaggacagucaaaguuuguuggcuucuugucucaaaacaacaaaauaaauaaguaaaaagaaaaaacaaaaccaaaaauuguauuuauuuugaaagguggggucugauguagcccaggguguuuccaaugaugaccuaaaguucugauccuauacccuuuaucaugugaaugcuugaauuacaggugugugucaucaugcuugguuuuauguuauucuagguauugaauacagaauugaaugcuaggcaaguacccuaccaauugaacuacaucuuuacacucuacuuuuucuuuccuugauuuccuuuccucauuauuucauagacauucuaaauuaggagaaucccuuuaugcaauaacaaaauacuugagcuuuuauaguauaaacucugauuguguauguuaaauguaacuuuaaaaaucuacaaccuggggggcuggagagauggcucagugguuaagagugccuacugcucuuccaaaggucccgaguucaaauccgagcaaccacaugguggcucacaaccauccguaaugaaaucugaugcccucuucuggacugucugaagacagcuacaguguacuuacauaauaauaauaauaauaauaauaauaauaauaauaauaaaucuacaaccuguauuucuuggcuaccugucuuaaguagauuguuauguuguacgugucagacuguaaaaauagagauuucucgccuccuucaaagaugauuaguuuguauuuguugauauggccuaggaaucaguggacuucuuuacuuuuuuuccuuuauuuuguggugcuagagauugaaccuagccgaaugcuaggugcaagucuaccuacuacugagccacacucucagcccaagaauuuaauacuucuuaguguccuuuuaggauauauuggccuucugauaaucccaguagaaaucacaaaagagagaaaauagaauaagugauaauuccucuaguacgugaaagauucagaguagugaacauguuaauuaagaauuguugaggaacuagagaguuggcucagugguuaagagugcuagcugcccuuacagaggaccaggguuugauucucaguacccaugugaugacuuacaaccaccuaauuuuauuuuccggguaucugacacccucuucuggcuuuugcuggcacuagauaugcagguggugaagauacaaacaucuuuacaccguacaaagcaaaacaacaacaaacaaauuuuaaaugaaaaaaauuguugaaaugggaagugugguucagugguacacuuugccuaggaugugugagccuaaguuagaucuccaaccauugcucaaacaaacaaacgaacaaaaagacucuacauauuuagaaauuaaagaaaagcugcaaguaaauuuauauaaacuaccaauuauucaagugcuagaggaauuugcuuuuauauuuuggggggagccaagugguucuaaacuuacuguuuuuccuuucuaacugccagguuuacagauaacugguuugauuaagugcuagggauccuacgcaggauuuuguguauguuagacaaacacugccaacugagcuauauuccacccaaacuugggaguuuuguuuuguuuagauuuguuuuuguuugucuuugagacggguuuucuauauguagaccuguuucucacuauggagcuucaagaccaagcuggccuugaauuuuaauauccagaaaucauguauuauuaaagaaaaauaugacaaguguuuauuguacugaaugcuuugauacacaaacauaaauacacacacauacacagacagacagaacuacuagggcuaguaagggcugguaauuuuuaaagauuaacuuuauguguguguauguccaucuguguaaguauaugucauauguguucaugccuaaagaggccagaagaagguaucacauauucuggagcucaaguuacaggcagcuauaaaaagccugacaucuagccgggcgugguggcgcacgccuuuaaucccacuacucaggaggcagaggcaggcggauuucugauuucuaggccagccaggucuacagagugagcuccaggacagccagggcuaaacagagaaauccugucuuggaaaacaaacaaacaaacaaacaaacaaaaacaacaacaacaaaaaaagccugacaucugugcuaggaauugaacucagaccuuauaggaaagcagcaaacacuuugcuucugagccaucucuacaacccguauuaaaaauaccaaauuaacauuaaugaagcaaacaugguuuggagagguauuguaugguuuaaagucgcucuaauuaaggaaacauccaguaauuauuugcuugauguauuguaauauggaaucugaagaaagccuuaacuuuuggugaauaagagaacuuuaaaaaaaaaaaaaacuaccgcuccccccccuucucuggccccauuccuuccauauuuauuucauauguguggauccauuguuacugucuucagacacagcagaagauggcaucgggcaucagaugcccauuacagaugguuguaagucaccaugugguugcugggaguugaacucaggaccucuggaagagcaguuggugcuuuuuuuuaaaaaaaagacuuauuuauuuauuuauuuauuuauuuaauguauaugggugcacuguagcuguacagaugguugugagccuucaugugguuguugggaauugaauuuuuaggaccucugcucacucugaucagcccuacuugcucugguccacuccacuugcucagguacacuguagcugccuucagacgcaccagaagagggcgucaauucucauuauggaugguugugagccaccauaugguugcugggauuugaacucuuuggaagagcagucagugcucuuacccacugagccaucucaccagccccccaguuggugcucuuaaccacugagcccguaagugaacuuucuuaauguugaggacuaaaacaguuuuuaagcaguagauauuuagugaauaguuucaauaauagaaaauuuagguauuuauaaaugcuaauuugauuuuuaaaaauguaaauaaaauacuuucgaaugaaauauacuuucugcauuagucuuuauaauggaugaccucacuucuauuucuuccuuuuugguuuuugagacagggucucauuauguagcuuuggcuagcuugaugcuuguuguauagaccaggcuagccucaaacuuacagaggaacacuugccuaugccuucagagugcuggauuuaaaggcauaugcuaccauacuuauauaaccuauucuaaaucuaaaauacugguugauauguuuaaguguugaacuaaccauggcuuuuagauauuuaucagcacauuaauauauuuacuauaaagcaguacuaacaguuccauauguagcuuacuuaaaauaauacauaaaauaaaaaaagucauuccaauucauaacuaguguguauguaguauuaucuguaggugguguauuuccacauguuuguaaauuaaugaccccuggauuauuacuagaaugaaagcauaauccauagaagaaaauauugguacauuagacauuaucaaaacuaaaaccuuugaaaacuuuuagggagaugagaagauagacuacaggguugagaaagauggcucucagaaagaaugcuugaugcauagguaugaguucaaguuccuagcacccaugcaagaaccuauagcugcaaguaucuguaacaccagcauagaugaagauggagacaggcuuacaucuggaucccuggaguuccuuggcuagccccucuagccaagugaaaacagggagcuuuaguucagguucagugagaaacccugucucaagagaauagagaaaggcucuuggauccuuuuguacgcuaagcauguggagguaugaguccauauaccauuuacauaaccaccgccuacagauaauacugcauacacacuaguuaugaauuggaaugacuuuuuuauuauauauuauguguguuuguaaguucaugcauguuacaucaugcauaugagaguucaaggacaaauuaaaaaaaaaauaaaaaaaauuuuuauucugaagaaaagguggagagaaaaagggucaaaaaggccucacaugggagaccuaaccuugucccauccacagaucccauuuagacaacucuacuacuuuuucacuauaggcuucucucagaaaccauuccaucacucaaaaaacucuaagcucuccugggaaagaugagauacagcauaauuaucacuccucugugggaugguugauccugagccugcgggggggggggggggggcaagcugguuccagaccuucccaaauccaccgcauuucuuugccuccgauucuuauguguccaaggacagggaaccaaaaccacgcccuuguaggaggaucaaggacaacuuuguaagagucuguuuucccuuccaccuuuguguuggauucagauguaaguuacacuuaggccaucaggcuuauauggcaaaugcuuuuauccagugauccucucuaguccuagaguaucaguucucaaccuuuuggggguuagaugucucaagcuacccuuucacagggucagugaagaccaacagaaaacauagauacuuaugauuuauaacagaagcaaaauuacaguuaugaaguggcaaugaaaauaauuuuaugguuggggguuacaauaggaugaacuauauuaaagggucacagcauuaagaagguuaagaaccacugucuuugcaagauguguuuggcaaaugccaauguguaagaaacugaacuauauaguaaaaaccagucauuuaggaacaaacaaaagacagacauuucacuaaagaaggauggauacacagauguuaaauaagcaaaugaaaagauauuugguauuaguagacauuaggaaaaugcaaauugaaagcacaauaagacauuaccacauaacuauuagaauagcuaaaauuaagauauguguagaugggcuggagaaauguggcucagcaguuaagagcacuggccgcucuucugaaguucaauucccagcaaccacaugauggcucacaaccauugguacagcuauaguguacucauauacauaaaauuaauaaguaaaucuuuuuuuuaaagauguguguagacauagucaucaaauguuggcacagauacuaagagaaucuuucauauauuacugguggaaauauggggugguacaaucauaggaaaucuuuuguaguucuuuucuuuccccuuuucccaguuuaugguagccaaggaugaccuugaaccucugauccuccuguuucuacuucccauggguugggguuauaggcuugugccacuacacagaaguuauuuuuguuucuuuuauuggcaaaacaaauuuauucuuguagccauuuuaaauuuauuuauuuuauguuuaugaguauacugucccugucuucggacacuagaagaggucaugggauccuauuuacaaaugguugugagccaccacgugguugcugggaaucgaacucaggaucuuuggaagagcagucagugcucuaaaccucugagccaucucuccagcccacucuuguagccauuuuaaaccuuuaauuuuaaauuaaauuuuaguuuguauguguuugggcauaugugcuaugguauucuuguggggaucagaggggcaacuugcuggauggagucucuuuucucccuacuaugcaggucucuagacucaaacugacguccauuuagucaucuaacuggcuccuaguuuacuuuuuguuucucguuuuuguuuuuggccuuuuucagaugggguuucucuguguagccuuggcuguuuuggaacucacucuguaaucaggcuggccucugucuccugagugcuggaauuaaagacaugugcuauuaugcccuggcuucuuuucacuaguugaaauuagugcagcuguaaauaaguauaugcaaauauuuuaagacucugcuuucauuucuuuuuugucuguacccacaaauaugguuguuuuauuuuuugguacagguccccacuauauagccuuagcuggccuagaacucaccauguaugccagaaaagaaauguaccugucucucugcuucuugauuguugggauuaaagauguguacuacaucagcaagucaugucuuaauuuuuauuagcuuuauuuauuuauuuauuuauuuuguuuuguuuuguuuuucgagacaggguuucuuuguauagcucuggcuguccaggaacucacucuguagaccaggcuggccucgaacucagaaaucugccugccucugccucccgagugcugggacuaaaggugugcgccaccacgcccggcuaguauuauuuauuuuugaagaauauaaguuuucaguaaagcugagcaguagauacuauuuccaauaugcuuccuuucuuaggaguaaacagguucuuucaugaccuauaucaucuaccagaauauaguuaauauuuguuauuaagaauagcuuacaagaaguucaagauaacugcacagaugcagccgguguuuccaagcagccaccaagauggcugaaguggagaaguggaucuucugcaaauucaccugccgugguguggaucugggucaauugcuggacguguccuaugagagcaaauacaguuguacagugccuuccagaggcaguggaagcagcacuuacacuacucgagcauaugagaaagaccaaguaggaggugcuacccauggagaagccugaggugguaaaaaucuuccugagggacaagaucauccugccagagaugguacgcagcauggugggcuuauacaauggcaagaccuucaaccagguggagauuaaacaggugacaugcuacuacuuguuugaguucucuaauaucuacaugccuuuuaagcacagcuggccuguuauccugccaccuacuucugcuuuaucccccucaaguagcugaggcaaauaaagacucauguuuaguccuuggaggggaaaaaaagacuggcuuacagguggugauucaaguaguucaacagugacugauccuaauggaaaggccacaaauccugcuagcuacucaguuuacaaccuggcacuggagucuaggauuccuagagaguugcuggucuuuaguaaauguugggauccugaagaauagauuuuaaugccaaugaaggaauggaucuaaaacagguuagaugaaggucaaugaagucaagcaggcaaaaagcaaaaacuuaccuuaugugacauuuuauguggggcauaagauuuaggguggaucuucccacuuaaaaaaaugaucaagaaaauuccucucaggcauguccugcugcuuguguuuuauucuauugcaaucaguugacaacccagaagaaucaucacagguuuacccuuugauuuuuagacccaugaguucuaacuuuaagaaaaacuauacuauauauuggagucaaagccuaucccaccaucaggagaacccuggucuuuuaugugugucuuuuuuuuuucggggggggggguuucgagacagaguuucucuguaugguccuggcuguccuggaacuuacuuuguagaccaggcuggccucgaacucagaaauccgccugccucugccucccgagugcugggacuaaaggcgugcgccaccacaccuggcuuauaugugugucuuuaaaaggccaucccacuguuuuaacaggccagcuguucaggauggugacaaacaugguaagaagugaauuauaugagauggccugccuacacuuuucuggcuggcugugaagugagcuucuuggucagaagcaaugcuauguggaauaccauggugguggauaaaauauucuauaauuccauggguuuaguuuugucaguuuuauaugccagaaggcaaaucaaaaaccagaauacaucguauuucacaaaggacaaaacauugcccuuuccacaauggaaauaguagucaaccugccacuugguugcuagcuggacacccaggggacuuaguguuggucucugcugcuggcagaucuggcacuuagcuguagugggagcaagguacaaccucagaacaccuaggauuguagagaucaugaagagaaguugaggcuucacacuauguggcagaguaccugaagacaaaaauuuagaugaggguauuggugaaagugcagcacaguugcaguggacaugccaacauuuuggagaugccuauacugugagaugaccaggauagcagcagcuauggaguggagccagucugagccuacaagaaaagcugcaugugcuguggaugacagagcuggauaaaugcugcugccaaggaccuuugaagcucaguggauccugaguggguccuaaacaucaagcagugacucuacacuguuggacuucgauuugauuugauuuguaaccgcccugauucugaccucuuaaaguauguaacuuauuuuuuauuuuuaugugagccuaaaguugagauauuuugaaguuuuagagugacuuuggauauuuuaaagagacugaauuuaaaguuugaauuuuuuuuuuuuguuuguuuguuuuguuuuucgagacaggguuucucuguguagccuggcuguccuggaacucacuuuguagaccaggcuggccucgaacucagaaaucugcuugccucuaccuuccgagugcugggauuaauggugagugccaccacgcccggccuaaaguuugaauguuuuguuuuguuuuugugacaggguuucucuguguaacccuggcuguucugaaacuugcucuguagaccuggcuggccucgagcucagagaucagccugccuccaccuccuaagugcugguauuaaaggugugugugcaaccacuauaguguuaccuucauugauuuuauuuuauuuuauuuuauuuuauuuuauuuuauuuuauuuuauuuuuugaagugggucugucuauauaggcuauccugaucuggggcuuguuuauauuccauguugccuucaaaacuugugcucuuucugccccagcugcugagacuauagcuaugugucaccuugucccacucagcuaucucuguacucacauacugggaacaggaaucuaucuaucuaucuaucuaucuaucuaucuaucuaucuauccauccauccauccauccaucaaucagaguuuuuguaacagccuugcugcccuagaacucacucugcaggcucagcuguucucagacucacagagaucugcuugucuuugccuccugagugcugggauuaaaggcagaugccaucaccucacaagccugugguuuuuuuuuuuuuuuuuuuuggguuuuucgagacaggguuucucuguauagcccuggcuguccugguacucacuuuguagaccaggcuggccucgaacucagaaaucugccugccucugucucccgagugcugggauuaaaggcgugcgccaccacgcccggcugccuguguauuuuuauuuuguacuuugggauaaagucuguguugagaguuuuccagggauugaagaguugggucacaugaugguaaaggcuugguaaaauaaguguugcucuuuuuacuauauuacccucuucugacuauuuuuugucaguauauuauauagacuccuuucugaaggcuuagauuuuuuucaaaaccuacuauaucuuuaucauaaaugcuucaaccucucuucuaacccaccaacuagagguaggggaaaggguguuguggaccugauuagaaguaguuccuuggggugauuccacucuucgauguuaggauaucagcaguccauuucaauaguaaacaccauacaugaaucaguaguggcagugugauccagcagaaacagcaaggcucugccaaauuggcacaagucaggaaaguggccagaaugagcuggaauaccacaacaagacccuuucuguguuucuaagaccagcagaguauugcaagaguguguagcaaagcaagaguguucucacugugagguccuauuuauauccuuucuaaacaucaugcaccaaacucuuaaaaagaaauuagagggcuggagagauagcucagugguuaagagcaccaacugcucuuccaaaggucaugaguucaaaucccagcaaccacaugguggcucacaaccauccguaacaagaucugacucccucuucuggugugucugaagacaguguauuuauauauaauaaauaaauaaaucuuuaaaaaaaaaagaguuuguuuauugcauguguauauggugugggugugcgugugugcaagggcauacacauauaugcuuauacauaagcuuacauguguucauuucuuccacuguggguuuagcgaucaaacucugccaggcauguguggcaugucaggacagcuaggaaacucuguuucaaaaaugaaaacgggaaacaacaaaagccaaaagccaaaagccaaaauaccugaaguauaugcccugcccuaucccugucuugauugguauacucccuuuuccucuuagccuuccucaaacuggaauacuuucacuuacuguguguauuauuccaggcagcccucagagacuauuuaugggucaaguaauaaauaacauuggaguaaaaagugagguauucugacugguuuccuuuaaaaugguucuuuuauaauuucauuuguaaaaugugccagauaaaaaguuauuuuuuucuguaggaaggguaagacaauacucugaagauaaugugguuauauuauuuuagaguuauuugaguagauaacauugacacugaaauuuaauuaaauauuuucuucagucuuggggggcauaauuuuuacaaauaguuuaaauuggagaauuaacaaugccuaaagugaaauauucugugaauccuuuauuacuucaaaauguuauuuuaaauuuuuuuuuaaaaagauuuauuauuuuaaacuguuuuuuauuuauuuguuuuaaguguguuuauuuuuuauuuuauguguguuaguguuuugccugcauguauguguguguguguguguguguguguguguguguguguguguguguuuuggauccccagagcuggaguuauagacaguuuugaacugccuuguggguucugggaauuuuuuuuuuauacuuuuuauuagguauuuuccucauuuacauuuccaaugcuaucccaaaagucccccauacccucccucccauuccccuacccacccacucccacuuuuuugcccuggcguuccccuguacuggggcauauaaaguuugcaaauccaaugggccucucuuuccagugauggccgacuaggccaucuuuugauacauaugcagcuagagucaagagcucaaggguacuaguuaguucauaauguuguucuaccuauaggguugcagaucccuuuagcuccuuggguacuuucucuagcuccuccauugggggcccugugauccauccaauagcugacugugagcaaacacuucuguguuugcuaggcuccugcauagucucacaagagacagcuauaucuggguccuuucagcaaaaucuugcucuaguauaugcaauggugucagcgauuggaagcugauuaugggauggaacccugcauauggcaggcucuagaugguccauccuuuugacacagcuccaaacuuugucucuguaacuccuuccauggguguuuuguucccaauucuaagaaggggcaaaguguccacacuuuggucuucauucuucuugaguuucaugcguuuagcaaauuguaucucauaucuuggguauccuaaguuucugggcuaauauccacuuaucagugaguacauauugugugaguucuuuugugauuggguuaccucacucaggaugauacccuccagguccauccauuggccuaggaauuucauaaauucauucuuuuuaauagcugaguaguacuccauuguguaaauguaccacauuuucuguauccauuccucuguugaggggcaucuggguccuuuccugcuucuggcuauuauaaauaaggcugcuaugaacauaguggagcauguguccuucuuaccgguuggaacaucuucuggauauaugcccaggagagguauugcaggauccuccgguaguacuauaugcaguuuucugaggaaccuccagacugauuuccagagugguuguacaagcuugcaaucccaccaacaauggaggaguguuccucuuucuccacauccucgccagcaucugcugucaccugaauuuuugaucuuagccauucugacugguaugagguggaaucucaggguuguuuugauuugcauuucucugaugauuaaggaugcugaacauuuuuucaggugcuucucagccauucgguauuccucaggugagaauucuuuguuuagcucugagccccauuuuuuaaugggguuauuugauuuucuggaguccaccuucuugaguucuuuauauauauuggauauuaguccccuaucugauuuaggauagguaaagauccuuucccaaucuuuugguggccuuuuugucuuauugacggugucuuuugcuugggugcugggaauuaagguuagguccucuggaagagcaguuaguacucuuaacucguagccaucucuccaacuccauaugugugaguguuaaugggugguuuugccugcauguauguuuuuugugcuauauucauacuuaguugucagcagaggucagaaggcauuggaucucuuggaacugaaguugcagguguuugugagccaccauguuaguccugggaaccaaaucugguuuccucuguaaaaacagcaagugcugccaacagcuaaagcaucuccagcuucuucuuauuuuuauuuaucucucuugguuuuucaagacaggguuucuguguagccuggagguccuggaacuugcuuuauagaccauguuggccucaaagucagagaucccacuucuucuccuucccaacugccaggauuaaaggugugugccaccacuuacagcuuuuacuuuuuuuuuuuuuuuuuuuuuuaagacaggguuuguuugugaagaccuggcuguccagaagcuagcucuguacaccagacuggcuuugaagucacagaaaugcaccugacacugcuuccccagcauugggauuaaaggagugggccaccacccccuggcucagcuauuauuuuuauuuacgugaauguguauaauuauauuuaugugaauucauguauaugugcuugccagguauaugcauaccugcagaggccagaagagggugucugauucucuuuagcugaaauuacagguggaauuaccacuuuacaaggguucugggaacuaaacacagguucuggagagcagcaugugcucuuaaccacucagcuuucuuuccagccuacuuuuagguaaaauuuaacuccauugagaguuuucuaaauuaguuaucuuaacaauguuauauugaacuuuuccuugccuaucuguccuuuauuacuagaaugacaauuaugcuuuuguuuaguacagaagacagucaaccuuuguaauuacuauaaaauaauauaguagagagaguuggguaaaauauugcuguggcauuugagguaggacaaaacaguaaaguugaaaugacccauggcacuuaaguguugcaggguauuugaucacacuguaaacccccaaagacuuuguuauuuaccuaaaagaccuuguuguggugugucucagcccuugcacacaccucuacuccaagagcuaaauaaagucaguccuaggucaugaggcagggagcaaguaaucagcccacagggagugaacauaguaagcaggaaggagggucuuuaaguugaaggguauuuaagacaguguggagaaggagaaagcuuuuucuuuuuuucuucugggacacugguugaagaggaaugucaauugaguguuuuucuuuucuacacacacacacacacacacacacacacacacacacacacacaaaagugagguuuaggcaggguuuuguuuuauuuuuccagaagaauaaaagcaaaacccugucccaacccucaccuggggauacuuaaaagugguccagcacacuugggugguagagauggaucagcagccaaugcagaacacuuaaguucuugaaacuucccuuguuaauccuaagacuucauuagggcuuucaagaagauguuuacccuacguuuacuuuuaaguaggucaguuagauuauauauauauaacugcuuuauagauccuuggcagugaaucaguuugagauuucuugcugccauauucagcuuugccaagauaaguuuagcuuuuuuuuccuuuuuauccuucccucucuccccccuuuuuccccccagagaauuggccaaaggcuuuaacuaauccauauucuuguaaaccaagaauuuuuuuguagucuagggaucuguggauguguuuggauaccgacuguagucugaacaucauuuaauuacuuucaucaauauuguccacauuuuuuuaaauuuauuuuuuuaauuagguauuuucuucauuuacauuucaaaugcuaucccaaaagucccccauacccucccuccuuguccacauguuuaagaagguauuacuuuaaaaggaugggagaaaugguucaauaguuaaggguauuuacauuacauagaggaccccacauuugcaguacccaugugguagggagggaggaucccuacaugugggagggaggcucacaacuguaacuccauuucaaggaaauggaaaccugaugcccucuucugggcuacacuggcaccaauaugaucugugacauacuauuuuaaaaguauuaauuuaaaaauuagcuuucaaaguaauaggcuuucuuacaacauuuuuaauacauauuuaguuuuggcuaauucucccccauaucucuacuaacuugucugcuccuaucucuauuugcuuucauaucuuauguguccuauuggcucucaucuugcucucauuuaaauacacauauuuaacaauuagaaacuaagaucugcauaugagagaaaauguacuauuugucuuucugugucuggguuaacucaguauacuuuuauuuucucuauuuuccuguaaaaucuauauuucauuuuuauuacagcugaauacaaauccauaaaaauauggaaagcuucaugaauuucuaucacucuaacaaaauaucuguuugaaacaaucgcaguccauaugcuuuugguggagagacaaaaggauaguuuuugaaaacuacuugcuuauuucaucccuguuuauuacccucuuguggcaacacuuuauguauguuuuggguucucuuauacuccuccccagcagacagaaagcuguguaccuaaccugccauaagguaccuguauaaauugggugguaguggcacaugcuuuuaauucuagcacucagaaggcagaggcaggaaaaucuugaguuugaagccagcucgucuacggagcaaguuuuagggaagccagggcuacacugagauguccugucuuuaaacaaaacaaaagguguggauacaaaauuauccucuggcaugugcacgccugcauguacauguaccgcaggcacuucuggugcugcugaggccugaagaaggcaucagaucuucuggaauuggagaugguugugagcugucaaguggaucuugacaaucaaaccuggguccucaggaggagcagccaguacucuuuuauugaugaacuaccuucccagccucagaacccuuuaaaaauuuacuugacauuuacaaguguuuugucugcuuauauuaaaugauuuugugcaaccuaugugggugguaggaagagaaccugcguccucugcaagaacagcuaguucucuuuaauaacugagccaaauuucccacccaaaaaagugaccuuuagaaacucuauguagccuaggcuguucuugaagucuuuccuaucuuccugccugccuuacccuccuuaguucuaggauuucagacaugagccaccacucccaacuuaguaucuaucccauuucuuuuaauuuucauuaucacucucuaguccuaucucucagucaugaauauucuuuauuauauauguauaugaucauguguaugucauaguuuauaugaucauuagaaaggauuauaaaugaacauugugaacuugacagcgauucaugaucgccaugugaaaaagcugcaugaaugauuauauauuugaaguuauuaccagagugguauuugauaaguauaugauaacugggguuaagauuauauuuguagcuggguggugguggcgcacaccuuuagucccagcacucgggaggcagaggcaggcagauuucugaguuugaggccagccuggucuacaaagugaguuccaggacagccagggcuauacagagaaacccugucucgaaaaacgaaaaaaaaaaaaaaaaagauuauauuuguagggcuggagagauggcucagcuguuaaagacuaggcucacaaacaaaaauauaagauuauauuuguagcuuuguaucuguguuccugaacuuugguuuauuuaauuucaaaguacuuggaauuacuuuaagacauugcuuuaaaaaaaaaagauauugcuauauauaauaaguuuuacuuagaacaggaagggaauaaucacuaaguuaguugagcagaauuuagaaaguuuucuguggguuugaaugaugauuuucuaaaaauuaauagaaugauguauuaggguaaugucuuaccagccugaaguugaauaucuagucauagguaaccuaauacacauagccuuguauugaaucuuuuuaauugacacuagguguagccuuggcuguccuggaacucccucuguagaccaggcuguccucaaacuaaagaguuccaccugcuucugccuugcauuguguuuuuccugcauauaugucuguaugaggguguuggauacccugaaacugaaguuacagacaguuaugagcugccacgggaguucugggaauugaaccuauaucuucuggaugagcagccagcguuuuuaacugcugagucaucucuucagcaccuuguauugauugucugaauguaucuauguaucuguguaugugugaguuugauccccugaacccauuuggugauagggaggagagacuuuauuccugcaaguuguccucugacugugguauacugcacacguacaagcacacauaaaaauaauguaauugaaaguaaaauuaaaaguuguauugacaagcaauucugaauaccguauugcugaaauaucaguaauaaguguuagaacuccuuuaguaaaacuuguucaaaaaguacaguugaguuauucagcauuuuuaaugcagauuaugugaagagucaucuuuauuuugugguuuguuauauucuuccucugccuuuuucauuuugagucccugaaaucuguucuauauuuacuugugugucuacauacuaaaaccaucucugaaucaugcuuugaagaucagcaagagauacuccgcuguaugaugagaggugacuauuagaggcauaaacaagucuuaguaaauuaggagauguuuguuucagcaguagcaauguaaucccaaacgcuuguuggugcuaugacugaagaaauuuuuauuuacuguguauuuauuguacauuguuacagauuaggacuuugugcuuccugggcaacugcucugucacugaacuauauuuccaggccugccuacuuaauucuuuaaaucucuuuuuaagaguucaagagagggcuggagaaauggcucagugguuaagagcaccgacuucucuuccagagguccugaguugaauuuccagcaaccauaugguggcuuacaaccaucuguaauaggaucugaugcccuuuucuggggugucugaagacagcaacaguguguguguguguguguguguguguguguguguguauacauacacauauacauauauauguauaugaggccagccugauucacauaggaaguuccacgacagcuggggcugcauaaagagacccugucucaaaaaccaaaacaaaugaaagaacccuacuuuaucuccauuuuuuauuguaaaaugacaguugaauagaauuaaaauccaaauuaagcaacccuuaaacuuauaaggcuugcuagacuuuggucgacuuagauugaaauuguucaugcuuuauauuuuuaaaugucauccuuacuaaauauuauggaguauaucuaaugauaugcccaauuauuuuuuaauuuuaggauuuuauuauaauauacgauaucaugauaaaauauugcaaauaaaaauuaaaaauuauauaacaagaugaaccagacacaauguuuauauaauucagugaacuauacaguuuaauuuaaaaggaaaguaaggaaaauaaagggauggacacuaaauacucuugggggccagaacguaauucuuuuccuuuuuuaaaaaauuuaaaauagggucuaacuauauauccuuagcugccuggucugguauagagaccaucagccuuugucugccucuugucucugugucccaagggcuggaauuaaaggcauguaccauuaaaccuggcacuuuauuauuguauuugugucuggcuguuuagaauugucacuuuaccugucuccucuggaugccuagauugugucagauuguguaagacauuuuuuuggggggacauuuuuuuggggggggagauuuauuuuugguuauaucuacauguaaaugucuuuuuuuguuguuguuuuguuuuguguuuucgagacaggguuucucuguauagcccuggcuguccuggaacucacucuguagaccaggcuggccucgaacucagaaauccgccugccucugccucccaagugcugggauuauaggcgugagccaccaccgccuggcucuuaugcaaauguuuuacaggccagaaagauggugucagauccucuggagcuggaguuacacagacucuugugaacaaccuugacaugggugcugggaauagaacucagguucuuugggagaacagcaaaugccucaugucccuuuaauaauaauuguuuguaaacugauuuaauuuuuaaaagaagauuuauuuauucauuuuauguauguggguacucuguagcuguauagaugguugagagccuucaugugguuguugggaauugaauuuuaggaccucugcuugcuccggucaacuccacucguucagucccugcuugcuccagcccaaagauuuguuuauuauuauacauaaguacacuguaacugacuucagacauaccauaagagggugucaaaucucauuacagaugguugugagccaccaugugguugcugggauuugaacccaggaccuuuggaagagcagucagugcucuuacccgcugagccaucucaccagcuccugauuuaauuuuuuuaaugaguguguuugcaaguugaagguugaucuuuaguauccauauuaagugcaucuaacaaagcauaucugaguuuugaauugugguaauuuuuggaucuuccuuagucuagauggcaugauggcugcagaaagaaaaaaaguuuuaccuuguuuuccaaguuaaaguauuuuccucugaguuuugccugucauuucccuacccccuuaaucugggauagucuuauuagaaugggguagauuagcuuuuuaugcaaagcugucuuauuagcugggauguuuauauuguuggagaaauggcuuaguggauaagagcacuuguuacucuuguaaaggaccugguuuugguucccagcauccaaaugggggauaaaagguguguaacuccaauuucagaggaucugaugcccucuucuggccucuugugggcaaauguaggcauuuggugaacagacauaaaagcaggcaaaacacccaauacacauacuucuccucucccuuuccccccacccucuucaaaaacaaaaaagaaacaauuucaagagaauggguuuuacaagguacaacaauauauugauuuuuuuuuuuuguucccacagaaagaaauaguacuaccuggaacaaugauucuaaguccuggaaguauuuagaacaccuugucauaguaaauaaucaaugaucacucuacuggcagcuugaaagacuucauauugggcagauuacacugagacaauaugggcagauaaaagaauaauuccugggauuugaagcacaaugacuuuuagaauuauuauuaauuaauaacaaugaaguuaauaacagcacaacacccuuaaacaucuuaagauguuuuagaaucaaguuauuugagggcuuaggaaagaaccaaguguuuggguguauguguuuauguucauguguguguaggcagaauucagugucagguuagguaucuucaucugucacuuaauaccuuauuagcacacuccccaccccacuuugggggacgacgacaaugucucauuuaguagcccuagcuguccugaacucaguauguucaaguaccaguuggcuuugaacucagaaauagauccaccuuucuaggccuccugaggguuggcauuaacggugugagccacuaugccuaguucauuuuacuuuuuaacuauuuacuuuuaugcuguaugugugaguguuuugccugcuugugugccucuaugaaccacuccugugccucgugccuaggagccagaaaacagguguuguauucucuggauuaaauuauagcagcuguuuuggggguucaaccuagguucccugaaagaguagccagcacuccuaauucgaauucucucuuccacuuucuuuuuugcuguuucuuaaccuccucuuccuuuuuuggggggguggguggguggguggggguuuguugaagcaggaauucucuguagcccugacuggccuggaccuuccuuucuuuguuguagacuagacaggucuugaacucagagacccaaaugccucugugaaccgagugcugggauuaaaggcauguaccacauacccaacuuaaaaaaauuuuuuuuuuacuguuuuuuuuauuuuuaagaugguguuuucuacugaaccuggagcuugcugauuaugauuagcuagaaaaguuagccagccacugcagggauucuacuguuuccauuuguuacagguauuacaggaguacucugccacacccagguuuuacauugagugcugggauucugaacuaagaucggaaucauuuaauagucugaagcaucacauuaacucagcucaaaagcauucuuuuuuucccaagacugcuggauaaccagguacaguagcuucuuacccaaagguuugcuuucagauguugcauuuaccugaaauaaagcucaguuaugaaaguuaauggacaauuccagagcagacuauuuuugaguuuuaaauuguuuacuauucuauuaggaugaacucccaacuuguccaguucuacuuacccauaauacaaaccauccuuuuauuugguguauucauacuguagccuggagucacuuaaguuauaaugcuucccuuucccuguguucaaauaacccuucacuuaauaaugacagaaagcuuaagagugugaugcuggcaacucaaagaccugccagauacuucauuugagcaaaaaguuuguaugucugcuuuuguuuauaugaguacacuauagcugucuucagacacuccagaagagggcaucagaucucauuacagaugguugugagccaccaugugguugcugggaauugaacuccggaccucuggaagaggucuuaaccucugagccauccucuccagcccauuuuuuguuuguuuguuuguuuguuuuugcuuugcuuuucuuucuuuccuuuuuuguuuuuuuguuuuguuuuguuuuugauuuaaaaaaaaagcuguuacugggugguggcagcagcaacaugugacuuuaaucucagcacuugagggagaagcaaucggauuucugaguucaaggucagccugguuuacagaagcaaguuccagggcagccugggacacacagagaaauccuaucuugaaaaacaaaaaccaaacuaacaaaaagcuuuagccuuaauuaggaaaggaaaaccguaugcuuagguuguuuggaugcaugguugggaacuaacaauuacucaguuugugaaacugugaaaaaggaagagaggacucauggugguuuguauuuuacacugcaaaaaauuuccuaguggcauucacacacaucacaaacacacacuaauuucgauuuaggaaauuaagaaaauauuucuuauauuauuccuugauuggguuucuuguuauacuuguuauuucuuauuaauuccucacauuaacagaucuauuuuacuuuugaauaguaauuuggcccugccucaaguguuaguguguuuuagaaacccaguggaguucuaacauuuguuuuccuuaguuuuguuuuaauccuaauaaucauuauuuuuuuuuccccagagguagcuacucuagagacaaaagcccuggggcuaucuguugcaguugaagagaaauuuaccaguggaaucccccucccccuccugcaaaaauaaaaguuugaaaaacaguaguaaaauuaucuacuuuuccuaaguaggccaaggggguuugcccuuguuauagucuugauaucuuaagucauaggaucauguaaaauuuagacuugcuagccuuaaacuucugauaaauaaaaugaaaucuuuagaucuaaauccaaguuuaacaaauaacuugagugcauacuucuaaaaauagcaacauuuuaaugaacagcauaaaauucuugcuagcauaagagagauaauaagccagacaauuaaguuaaaaggucuaaccuauuagugaugagugcccuucagggaaaguaagauuggugauguggauagguugggggugacauguugauugucugagggacuagcuuucuagguggagagaauaacaagcacagaagccuugaagugggcagaggggcuuuuauacagccuggggcacauggaagccuaggaaagagucuuguuauuagucagugagaguguuggcuuuuacuuugagugagcuaccauuagagauauuuccauauagaagugauacaauuacacacaggagugacauuuucacagguucauucuuugacuuacuugcacugaguauaugaacugcugcaggacaggauaaugguagaaauagagaaaagauagaucaguugagaagugaaugaauucuggauauauuuucuaaauuuaguuaucaggauuuauugguagagauuuguuguggugggguggggaaugucuuaagaaugauuuuaagguuuuuuuauuuuuaaauuaugugugugcauagcuauguuugaauaucuguauaugugugcaggugccuaaaaaagcuggaaguauuuagauucccuggagcuggaguuaaaggcaguuguaaauuaccuuauguaagugcuggucagacucuggucagaucuucugcaagagcaguauguacuuuuaagcacugagccaucucuugcucgaauuauaagguuuaugagcaaaugaaaggauuaaacugacauuauuuaacauggaaaagaacaaggauagcuagcuuaucaguagcuuaguuucaaauuugcuaaguucaaauuggcaauuagaguuaaaaaggagcaaguuaguuugguugggguuucagugaaauccagauuuggcuuagagauauaaacaggaccauuguuaacacuugcucacacuagcgcacacccucucuuugaggcuaaaugguucaauaaggaaauaaguaguauacacaaagaacuuaagucuuugugcacuacuagccuuuuaagagucacagaaacugauggaggauaggaaauagucagugagggaaacagaacagaauuaaccuugguuggucuguaagucaaacgaagaaaguuucacagaggucggguaagguagggugacgacguugccacuggagaugaauguuacuuugaaggaggcaguuucagugaagugggccaaaguuuggucugagcuugagagaauaagaggaaagugaguauaggaaaugaaaacaacucuucaaauuguaccucaaaggaaaaaaggaagcaccugaaguuaugauguuuaguuuuuguuugguaaaauuguagaauuguuagcauauuuaauacugagauugaauuuaguggagaaggaaugagugacacagaagggaacuggaaguuuugaagcagugucuuugagaaaauuaaguugggguucuaaucacugccugugugcuuuauuagcuaaaaauaugaucaguucaucugaagcaacaagaaagaugguggugugguuaguauaugagagucaggaagauuaaauauguagaauauggaaacaauuuaggacaugaauagggacuuuucaugagcauuagucaauauuuguuuuucccccaagauuuauuuuuaugggacuagagauuaauaguuaagagggagccgggcggugguggcgcacgucuuuaaucccagcacuugggaggcagagacaggcggauuucugaguucgaggccagccuggucuacaaagugaguuccaggacagccagggcuacacagagaaacccugucucgaaaaaccaaaagaguuaagagggcuugcuucuuuuggacucuagcaccagggcuaggcaguucagaacucagucccaagagaucuggcaccuucuucucuccuccuuggauaucugcauauacauguugugguuaugcacauaaguaaaaauaauacaaauacauuuuaaaauauuuauauuauuuuguuuguaucugcccacccacaggggucagaauaaggcacuugcugcucuuuacugcugagccauucuuccucuuuguuaaucauuauuuguaaagucauuauuguugaacacaagaauuaauuagugauuucuucaguuacuacagcuaucauuuggagagauaacuguaggaauugguguuugaaauugugaaaguuucuauguauugcuugugaaacuacaaugugauuccuauagcuaguuuauuuuacucacccuuguaauacucugggguauucauucaagucaggugaaugaguucagaauuucuagguaagucaucuuuucuuucccaagguguuagccaccacagguuccaccuaccagacuauuaaagcacaucccacaaagaaagaguuucauaguuuuaaucugaaacaagaugauuuuuuuuuuuuuuuuuuuuuuuuuuuuuuugguuuuucaagacaggauuucucuguauagcucuggcuguccuggaacucacuuuguagaccaggcuggccucaaacucagaaauccaucugccucagccucccaagugcugggauuaaaggcguacuagccugaaacaagaugauuuuuaaggccuugaaggauguuuaguucuucaauaucuagauuaagguucuuacaaugaaauuguaacuguauaguaacuguguaauagaaaguugaguuccuuaucaguauuggguagaaguagcagaaaauuacauauaagucaagguaauuauaguuguaggacugauuguaaagcugggguagaucacaugaguuuuguagaguuggaaacaggaauuacuugggaagccuaucuagauccucccugaccuugaauaugugcauucaugucuauuuuaaaauaggauacagaaaauuagggacucgagucuuggcucaauaauuaugagugcuuacuauucuuucagaggacuggaauucaguuugccaacacccucaugagauggcuuaaaacugucuguaugucuagauugaggggauuugguaccuucuucuagauucucuggggacuuguacacucauugccccauucccauaauuaaacaccauaaaaauaaguuuuuaggagacuggagagauggcuuaguuguucagagcacugacuaugaccuagccucauucccaguaccaccuauaggacagcucacaacugucuguaagucuggucccaggggaucugacacccuuuuauggucuccucuggcaccagacaugcauguauuauuccgacauacaugcaggcaaaacacucuuagacauaaaauaaaaauuuuaaaugucuuuuuaaaaaugcagaaaauuaaacuaaguaucaguuuaguguaugaccucagaacauauuguagagagauagugguuaauggaggaucagaucuuagugaguuucuauuggguuaugggaaagcagugacaggugugagguagauuuguauagaaggucuagggucaaacacucuuuuagggacauggggaaguuggaaacuuaaagaggacgauuagagaagaauuggauucgaaucaaaggccaauaacuuaaaaguacuuaaauugguuugaaaugcuauuugagggaccaauggaucaguagauaaagguacuugccaccaagccuugcagaguuugaaucauagcuuggaacccucauuguagaaggagggaacuaacuuccacaaguuguccucugaccuccauacacucaaagugguauguucacagguggacacaaguaaauauauauaauuuaaacaaacaaugcuuaauaaaauguaguauuuuaagcauacucacggaacuaaauuauuuuaaugaauuaugcuuuccaaaauacuucauuaaugaaauagucaacauuugaaaacaguauuuauuauaaaugaguuaaguggauccuguagucuacaaaaacauuaguauaagggaagggcuaugaggaagauaaaaaaauuacaaugccaguauuaaugaggagacuacauuuguagaagauauuucagguaacugcgcccuuuuagguaggaaagagcaguaucugucuguacaggauauaaauaauucaauuuaaaauuaaauacaaauaaaagaaaaauuucaaagcagauuacauacuucaaucccccagugagcucuuagaaguuuguagguuaguuagcacuugagaggcagaaggaaauggauaucuuaguucgaggcuagccuggucuacauuuccaaguuuuaagcuagccaggaaugugcaguaaccuuuucucaaaaggggaaagaugagagugaagcacaaacauauaaaauguacuguaauaaaauuauggagaacaugcuugaaaaguccaggaacauagaaauauaaaaaguuuuaaguauagaaggaaauacugugaauaaaauguuauuaaagaauuguaggaacuucagcauuaauguuucucuguucuauuuccugacugugauagacacuguaugaccagcugccucagagucuugccacugugucuuccucaccuuugacucuuuuuuuuuuuaaaagauuuauuuuauguauaugaguacacaccagacacaccagaagagggcaucagaucucauuacagaugguugugagccaccaugugguugcugggaauagaacucaggaccucuggaagaguaauuagugcuuuucaccgcugagcccucucuccagcccucaccuuagauucuugacacugacuuuuuuuuccuuaauggaugcuauccccucaaacugugaaucaaagcaaauauuuucuuccuccaaaaaaaagauugcaauaucacaaggguagccacacuuuaagacagucauuaaaaaaguuuuaaaauaaauauuuuuuuaaagcuaaaugagggcagggaccaaauagcaaagugaaaauggaccacaggcaugaagagguuuuuguuuguuuguuuguuuguuuguuuuuagaggugauagauggguggggacagguucucaaaauauguagcccucgcuuagcugaaacuuucugugcagaccagguuggucuaaaauuuacaaauggcuagcugccugucuuugcugugcuacaauuaaguauguguugcuacccugcccaacaaaccuacuuuugccuaggcuaucuggccagcuugcuucuuugaccugccugucuccgcuccacauucagguuucagguacacuuggcccuugccuggcuuuuuuguuggcguuggggacuuaaaacacagguucucauguuugcacaucagaucucuuacugacuguuuucccauucuacucacagaauauuuaaagaggggugucugucugucugucugucugucugugucaguuuucuguugcugugaagaaauaccauuaccauggcaacucuuuauaaagacaagcauuuaauuggagcuuuuuuagucuauuguugucauggugggaagcaugucugcaggcaggcagguagacauaaugcuggaguuguugagaguucuauauguggauuggcaggaauggaaagacacugggucugguuugagcauuugaaacuucaaagcccacucccuagugacacacuuccucuaacaagaccacacuuauuuccaaaaggccuugaacuuaggggcucaugguuuuuuuuuuuuuuuuuuggccaggguggaagucagcaagcuccagugauuuuuuuuuuuuuuuaagauuuauuuauuacauguaaguacacuguagcugccuucagacucuccagaauagggugucagaucuuguuauagaugguugugagcccccaaugugguugcugggauuugaacucaggaccuuuggaagggcagucggugcucuuagccacugagccgucccuccagcucccagugauuguuuugaggcugggauaaguuacacgugugugcaggauaccuggcuugcuaugugggugacucugaucugaauuucuagcucucaugauucaguaaacagccuuaaacacuccacccuuacaauaucaaauuauuagaguaauaaguugauguuuguauuuucuaucuaauuaauuuaugaaauagagucucauauugcucagacuggcuuucaacucacuauguagcuaaugaugaugaacuaaccuaaacaacaaaaaaccccacuuucuuacuuuuuugagacagaauuucucugaguugcccugguuguccuggaauucacucaagaccaggcuggccuuacagagaucuaccugucuccuccuccugaguccugggaucaaaggugugcaccacucaaccuaguuuuuuuuccccuucauguuuugguguuuugucugcauguauguaugugaggguaucagauucuccgggaacuggaucuacagacagcugugugggugcugggaaccgaaccuggguccuuuggaagaggaaaccagugcucucaaauauugagccaucucuccagcuccuuuauuguuuuuaaacacugagccuuacuauguaagauugguuggcuugggacuuguuuuguuagaccaagauggccccaaagagaucagccuacuuaugccuccugagcacuaggauuaaagaugugugccaucauauguugcuuuuaauuacauauuuauuuuguguaggucuguguguaugugagcuuuuguguaccaugggcacauguguaguggaaaucaguucuaccauguggguucuugguuuugcacucagguuccaagguuuagcaauaaaacacccuuaccugccuagacuucucacuggccucagcucccaguuguuagaauuauggaggcaucuguucucuaagcaauuuaagacauuuuaaaauuccuuuauuccguuuuuuagccuuuuuauugucuaacauuuaauugaaugcucaguacuuaauuuuaauucaugaucaguugaaaguacuuagauuaugggccuuaaaaaauguuggaaguuuugccauguuguaucccuggcuggccuugaacucuggaucuauuugcuuccuucuagagaucuggcauaagagguguuggcaaccaugucuggcuagauuuugaucacuagaaaaagugacucugucuuuuggcucucaauguuguuucauuuuuaauuuaaugaguucuaaaaguguuuauaucugccugauacacuuuugucuaaccuuuuacuuuuaacuucucaaagucaccuuuuuagguuugucucauguagacuccguauauaguuggaucaagguuaguuauuuuuggacccaguuuaagaugcuuuuacuuguucacauaaugugaauuugguuuuacuucuguaauaauauuagucguuuuuuguuguuguugccuguguuucugcuugauuuucaucaucuuuuuguuuuguuuuguuuuguuuuguuuuuugagacaggguuucucuguauagucuuggcuguccuggaacucacucuguagaccaggcuggccucgaacucagaaauccgccugucucugccucccaagugcugggauuaaaggugugcgcuaccaccgcccgacuucaucaucuuuuuuuuuuuuuuuuuacaauagauuuuuuuuauacuaguuuaacucuuuuuuuuuuuuuuuuuuaagauuuauuuauuuauuauauguaaguucacuguagcugucuucagacacuccagaagagggcaucagaucuuguuacagaugguugcgagccaccaugugguugcugggauuugaacuccggaccuucggaagagcagucgggugcucuuacccacugagccaucucaccagccccucaucaucuuuuaaaauuacuuuuuaauuugcucucaucauucuucucaucuuacaaaaauacuuuauuucauuuuguuuaggauaccaucaauuuaaaauguuuuauuaucuuguaauaaagccaacauguaauaaacugcuaacauggauaaauguugucaaaccaugacaucaucaguuguaauauggaugcugauuucagauaagcuaaauugugaaauugagugcauuuuagaacuuuugaacauuaacgaaccuuuguaguuuguaguugaccugugguuguuacuguaaagcuaaagccuuaauacacuuuagucuauuuaucaaguaucuguucugagaacagcugcuuuugaaggcaauaguuucagcauucuuuuuuuuuuuuuuuuuugguuuuuuugagacaggguuuuucucuguagccuuggcuguccuggaacucacucuguagaccaggcuggccucagaaaucccccugccuuugccuccccagugcugggauuaaagggcgugcaccaccacguccggcuuagucucagcauucuuauguuuaaaaacacuauucauggcuuucaaagugaaaggaugcuuugucugguuacagaauuucgagcuacauucccuuuccuuuaaaacccagcagccuguuccccuaucuuuugguguauaggguugcuagagagaagucuggggccagccugacuuuuuucccuguguaggugaccuacuucugccugaguauuggcagauuucuuucuuuauccuugaaguucaguaacuucaucagaauguaucucgcucuuggugugauucucuauuacauuuuccuguuaaugguaagccaucucaaucugugggcucaggaaaguuucuuagauaucuuuuaauaugcuuuaauuuugggauuucuuucuuaagcauuaguuauauaauugcucaucuacauuucugguucuauuucauuauuuacuaaaugcuuccuuuguuauguucugauguauguuauuuucuugauaaucuuuccuaaguuuauucucuucagcaucaggucugcuauuuuaaugugggguuguuuuguuuguuucauuuugccaguggcuucacuacuucauucaguuuuauuauguaugucugugagcagacuuuucaauuuaccuucuaucuacaaaugcuuuuacuacuuguaauggcaaaaggugaaacuguuuuguuuuugagaagauggguucaaaacaguugcagaguagccaugucaaaaucuguuguucucuggaacacaaagacaaaugauuuugaucaagucuuugugucagauacuguguuuuguuaaugacuugagauuugguaaacccuuaauuauaauucuuucugaagauguauaaaccgcuugcacauaguagaauucugauuguuauguauguuucuguguaucaagaaaggaugguuaauuacuuuuuacuuaugaugauuaauuacuuuuuauuuaugauuaauuucuuuuuuacuuauagucauugaaagucauuaaagguuauuuuuuauaucauaaauuaccaugcagagcagaugaaauucuuugaaguuaugacugauguauucucugucauucauguguaccacaaugaaaaauucuuuuguaagaauuucuccagaguaccaauuucuucuuuguguuuauuggagggggugagggagacugaagaugguagacaaugugcuccugaucuuuauucagacuugaaugcauugggucugugacuaguuguuguuaaugugugagauuauuacucugacuuggaauaaaaaaggccauuucacuuguuaguggagcagguccucccagaacagguuuguguuaauuuucucuguuucugucuucuucccucugaggugcagauauacuucucagaauuucuuaaggauucuaaacuuuuuuacuuaguuaucaauauuguggcuguuuccugugauguuacuuuuuuuuuuuuuuagccaaccauuagcuugucaaacacuuauugucauagauaauagauccugggguuuuaguaaauagaaauucauguuccuuuagaacuaacauucuaggugaaguaaaggaguuaaacaugauuaauaaaauacaauguagucgaauacuaaguggaaaguaaaaguuuacguuuccuaagaacaugggaguuaaacauuaaaguuagggugacauuugauuuaaggaugcucagcaagggagugaaugugugaaggguaccacaagugcagcaucuguaaaggggauguagaugugaggguugcaggaaagugagagagugaguagcugaacccagagacagaagguuggagugggauacugguaaauucugaaggacuuuuuaaggcccucaccaagugaguucaggucaccauaugaauagcaacaugauuuagauuuauaggggucugucuggcugcuggauugagccguagaaacaguaaggcaggcuagguggugguggaagucuucaauccuagcacucaggaaagcagagguaggcagaucucugugaguuugaggucagcauggucuacagaacaaauucuagaacagccagaguuacacacagaaaccccgucucaaaaaaauaauaaacaaaacaaaauaacaggaagguauuuuggcuaggaucucaauauacacauuuaagcaaauguuuuauaccaaaauguuacuuuuacuaacaauacucuuauuuuuuccuuucuguuaggagaaaggaauucuggucaaguuaugguagauuuguuugaugacuccacaccuuauaggugacuaacacugucaaauaaguuauagcccugacuuaagaagcaaaguuaugguuguauauucaaacaaaaugaucaaaauguaaaauuacaaagaauaaaagcuuaaaaaucaaauaccuaacauucuacuaauaaacugcuacuaaagaguuguugcugcucccuagggacaacugcuuucauaaaacauuuuugguucagauuuccuggggauuuaacuccaugcuucuaaauaauauguuuauagugucuauuuuuugguuuaucaacuuuagacauucucucuugacuucuugcuaugacagauguuuucagucccacuucucacuacugaccuuccucguucaucggucacugacuuggcgccucucugggguucugcccagaagauuuagccuuccuccuucgccucagccccucugugaguauuuuacucccuacacuugcugaccaguucauguucuuccaucugucuucauccuucagaaccaugggcaaacgauguaguuuuugaaaaaaaaauuaagaauauuuacuggcuuagguucauauuggcacuuuggaacucuugaauaauagacuagaauauuaggccaaaguuuuuguuauuguuguuuuuuaauguauauucuuuaagaauuuuaguuuuuguuuugcuauuaaaauguuuugaagauuuauuauuuuauguacacgaguguuuugcuuaaauguaugucuguguaccuucugugugcauggaguugaaggaagucagaagaggcugucagaugaccuggaauugaauuacagaugauuguuagccacugugccagugcugggaacugaacccaaguucucugcaagagcagcaagugaucuuggcaacugagccaucucugcaaccccacuuuuuguuuuuuaaagagauagaugauauauuuguaauauuuuauccuucgaacaacuaaauuuugucaugucaucaucuauucuuucaaauuauacuaaauagguauguauuuuuuuucauauccugguacuauaauauuccuuucauuuugaguuuuuaaaauuacuugaauuauuacugaauuuuuccagugaaaaauauuuugauauuauccgguuauuucucuucuaggaauagccauugcuaacucaagaagauaggcuucacauuuuuugauuggccuggcagugguggcacaugccuuuaaucccagcacuugggaggcagaggcaggucaauuuuugaguucgaggccagccuggucuacagagugaguuccaggacagccagggcuacacagagaaacccugucuugacgccacccccuccccgcccccccccaaaaaaaaaaaaaaaguuuugauuguuuuuagaaaaguuucacaggacagcucccuuugcuucuguuuucccaccugugccucuuauggucagggaacaguacagugaauuuagaacaagaucuuagacauugcuguaucuuuuguuaguuaauauuuguuaauucacuggauacuuauuauuaugcuuacuggaucauucaauucagggaaugcuuuauacgcaaaguauuaaaguacuuuucauagauacaccaauauguugagagaguauccuauaauuuacuuguuuaauuaaaaauauauauuuauuuacuuuuacuuaaaauuuaauuuacaaaauguguuucuaaguuugcuuagcauuguuaugcucuagcuuuguuucuuagcagggcagccagaguaaccaccacuauuaauauauauauucuuuuuuuuuaaagauuuauuuauuauuauauguaaguacacuguagcugucuuuagacacaccagaagagggagucagaucuuguuacgggugguugugagccaccaugucguugcugggauuugaacucuggaccuucggaagagcauucgggugcucuuacccgcugagccaucucaccagccccauauauauauucuaauggaggccuugaguuccucacucuguaaagaauggcuuacaaguuaggggaauuuaauguuuggauacaugugaaguuauuucugcuuucaaugucuuuaucaaugagauuaaaaugaacuuuucauguagggagaagucccacagaagccacaggaggaacucacauagauauauucacauaaauaaaaagaaagucuuugcucaggcuggcccaaaacuuacuuugguuuggagaucuuucuguauuagcuuccuuccugagugcugagauuacaggcaugaaccacuacccuaacuuuuaaaaaucauuuuuauggggggcucagaauugaccagaaagcaaaccaaccuacaagaauauuuaaauuaaaagucagugaugaagcagaaaugacucagaagacacaauaucagcaaaacccaccuagaagggugacagcucauaaaaacuguaaaccugggucucacuguacaaccugauggcaguucagcauuuuggaguguccuuucuauacccugccuccccacauccccuguccccucgucccucuccccgccccuggccgcaguuuagcugguuucugccucuuuuagguaacucagaauuugugagaguaacuuucagcagucuuuacuucauauauaugcuugggaaaagagggaacuagugaaucuaaugaguuucagggacuucuugaagguguuuugaguaguuuacucucagaauuuaaggagcuucccugcuacauacaauguuucaccuuccuauaaaugucuugccuuaaaccauaccaaguucucuguaggaggaaacuguaaggcaacaugaaaacgucaggaguccagaucagaagaggaugaauaggauugauugagauacaguaaaauuuuagagauuugguuuucaaagaaauuugguuacaccccaugaaagaauagaggcccagaaaguccuuuucuuuuuaaagaaaaguuguagugaaaauguuuccuuucuuacucucacaugauuuauggugugaccuguucaaauucuuagacuauauuuauuuccacauguguucccacuagaagacuuuguaaauuuuuuguugaucuauuaucuucauccauguauuaguuuucuuuugcuguaauaaaauaccuugguuaaacgcagcuuagagaaggaggaauuuauuuugacuaugguuccaggaagaguauaaugucaagguuguugggcuguggaacauaggagcacaugaguaaaacaggaaucaccccuuagugaugcgcuucuuucagcaaggugagauccauaaaguuuuuguaacaucuucaaaauggcaacaacagcuggugaccaaguauucauauacaugaaucugugggugacauuuaguuuaaaccaccccaauguguuuauuguguaucuguaugugucauguggugguuagaggacaacuuguggaaguugauacucuccuucuacuauguaaugguuucagggcuugaauucagauccucaggcuuggugggagccuacugagccaucucacuaccccaaacucaccguuuuuguuuuuguuuuuaaagauuuauauauguguguguguguacauacauauauauguauguauauguguguguguauauacacauacauauauauguauguauauauguguguguauauacacauacauauauguauguauauauguguauauauacacauauauauguauguauauauguguguauauacacacauguauguguguauauacauauacacacacacauauacauauauaugcacacuguagcugucuucagacacaucagaagagaguaucagaucccauuacacgugguuguaagcuaccaugugguugcugggaauugaacuaaagacuucuagaagagcagucagugcacuuaauugcugagccaucucuccagcuuacccaaauucauuuuuaaauauuuucauguuuaguaauuguuuucuguaguuagcuggggaagucuauugcaguuuugcuaacuguauaaacuccuuuaucacugacuuuuaauuuaaauauucuuguagguuuguuuguuuugugguaccagggauugaacuauguauguccuuaaacaugcuaggcaaguuugcaagagauagagggguauucugucuuuccccuuucuuuuuuucuuccucuuuucuuguuucucccuccucuuucuuuuaaggcaaaggucucaguaaaauugccaagacuggcuuugaauucacucuguagaccaguuauucuccuucaagcuuguuacuugcugggauuauaggucuuucuauaugcuacaguguuuacuuguagguuucuaaaaguuaauuauauauuaagaauuauuuguugauaaugaggguauguauguaaguauguauaccauguguaggccuagugucuaaggaaaccagaaaagagcauuggguuccuggcauuggaguuacagaugauugugagccuccgugugugugcuguguguaugcaagagcagcaaggaccaaugugccaucuguccagucccccauauguauuauuguaaaaauaucuuaaguaaggcuggggaugaugguaugucccuuuaaucccagcauuucaggggcagagacugguggaucucuugaguucaaggccagcuagggaccuugucucaaaaauuuuuuuauuuaaaaaaaaauacguguacguguauguacacauaacauaccagugccuaugugugcgugugaaagccagagaacaaccucacauguugucuaaaggacauuugcuuugagauaggugaucagagagccacagggauucucuaguuuuggccucuucgaggcugggauuuacaacugugccauuuuguaacccugguaauucuuuguggguucugggaucaaacuuagguucuggugcuuauaagucaaguguggaaccauucucuuagccuucagguauaguuuuuaaucuucucaaauaauucauggcucgcuuugcaacuuaucuuuuauuuuaucuucuguaacuaugaagauucuucauucagugcucagcaguguccaugcugauuguggcuauaaaucuaugggacaaauuaccacuuguuuucagaaaauaugccacguguaaaucaucuucaccuucacuuuucucuugcauagaaacaaucuccuuuccccuacccccaagacaguguuuguuucucuguguagcccugguuguccuggaacucccucuguagaccaggcugaccuagaacugaagaggccuguuuuugccucccaagugcuaugaauagaggugugcgucacuaccucccagcugaguuuuuuuuuuuuuuaaauuuaaauuuauguguauggguguuuugccugugcaccaugaguacauuagcaugggcccacugagcuagcaucauaacaaucucaaugugugcuuauuuagggcuuuguucauuguuaagcuguuugguuuucucacuugcacuaugaucacuucuauugucuucuuuccucuccccaacugcuuguuuccuuccacuccucaaauaguauuccuucuauauucaugauauacaaacacaugcaaauauacuuaugugcacauauacauacauauaaucuugagaggguuauaagacaaaacauuaaauauuuaucuuaguuuagcuuauuucacucaacauaugaugaguucuauuuccauuuauuaucuuucaugcuacauauuuaacuccuuuuuaaaaauguuaaaauuauuacuuuuuugaaaauguuacauuauuaugggugaguguuuguacauuuguacuacagagugccaguggaagucagagaacaacuuuguugacuuggcuuucuuccuccaccuucauguugauucugcuuauuaaauuugcuguuaggcuuguaugacaaguacuuugcccuuuaagccacuguauccuuuauagcugaauaaaauuccauuuuguaaacauaauuacauuuugucuucaucuauugauggacauuuaagcugacuuacauauuucauaguaaauagaucugcaguaaguauuuauugugugugcagguacuuuuguguaaugcuguuuuggauucuguuugguauauacauaggauugauguaggauuguguauaggacagucuauuuuugggguuaugaagaaccaacauacuucauccauaaugguccacauauauuuuuaucuccacauucccuugucuuaaacuuuauuuuugcucuuuuauuuuguuucaugugcuuuccuaggccuccugccuguacucacuguuuuuacaugaugucuuauuuucuuugaagcuucuuaauggugagagggccuagaacaccuuucaguaaagauuauacugauugcaugcauguauaccauuucugaaugggcagaauucucccuuuuauuacuaggaagugcauaagggauaaaauaaaucaggauuugaaucacagaaguauauuacuaccaucaccuuagguaaagauuugaaaacaaauuuaaaacaugauagagggauauaccagaaagugaaucaauaugccccuauauauucauuacuuuccuuguggcugugaccaauaaccugacagaagcagauuaaagaaaaguucauuuuguuuggaucauaguuuguuugcuugcuugcgcucucucucucucucucucucucucccucccucccucccucccucccucccucccucccuccuucgauuccuccacccaccacucaccuaauugcucaugguuuuaaagacuauaguucuuuauggucaggaaggcauaguguuauggcaggaagauagaucauacuccuggagcuagcuccucauagccuaauggaucaggauucagagcauuugggccagagccagaaauuacuaucaccuuaaagccuugucucacuagcccacuucugguaguuaggccacaguccucggguuuucacaacuucccaaaacaguaacaccagcugguggccaaaugcucaaacacaugagcauacaugauguuucauauauuuuaaauauaauagaguguaucauagcugguucaauacugucuugcuugauaugccuuguauuggaacugguauggccugagcuuagcuuagauuauuuucucccauacgccuaggucuaagaaguaguggaggauuuuggagugggauggugugaugguuugaaacaggguuucucucuguagcucuggcuguucuggaacuuguucuguacagcgggcuagcuuugaacucagagaucugccugccucugccuuaaaggcauguaccaccacaccugacuugauuuuuuuuuaauaggcuuauuuuauguaugauuguauugccugaguauauguaacuuaccacccuugcccagaagagguuguuggaucucuuagagcuuuaguuauagaugguugugagcugccacaugggugcuagaacugaaccucugaguucuugcaagaaucgcaaguguccuuagauguagaaccaucucuccagcucccaaugcuguuuuuuucuuucucucuuuuuuaaaagaaugauuuuacauuauauauaugaguguuuugccuauugagucauuguuccagcucccucaacagugcuuuaaaauacauauauuuauauuuguuugaguguuugguuugcauacugucucuuuguguuuuuaugaauauucuauaguuacaugaaaauagauuacuacuuagucauauaaauauuuuuacuuuauuauucaaggugauguauuucuguauaggugacuguuauucugaccuauauaacuugaguuuucaugucaugcuuaaccaaaaaauccagccaaauuauuuuggugcucaucaauuuaauuuuuagauaaaagcaauauuuuuguacuugacuaaucaucaaucuaugcaguuauauugaaccaauccacauauacauguauauacauauacacauauacauauauauauauauacacgcauauauauacacacacauaugaauuuuaucuuuuaaauuuuuuauuuguaugacugauuugccugcauauacuuuuguacauugugugcauaccuggugcccacagagucuagaagaggguaucagaucucugaaauuuguaguuacagauggcuaugagccacaauuugguugcuggaaccaaaccuagguaccuuuuuuuuuuuucauuauagauauuuucuuuauuuacauuuuaaauguuauucccuuuccuaguuuccccucugaaaauccccuauccuuuccccccucccccugcuccccaaccuacccacucccauuccuggcccuggcauuucccuauacucggacauagaaccuucacaggaccaagggccucuccuccuauugaugaccuacuaggccauccucuguuacauaugcagcuagagccaaaagucccuccauguguuuucuuugauugguaaaccuagguaccuuuacaagcaaaaaaauauuuugaacugcugagcaaucaugugauaauauauuuaguuuuagauguuuguguggacucaguaauuauuauuuguguuucuuauuacaaaauucauuuucagaaguauaagaagcaggccagagaguugggucauuggguaaggguuccuguccccaagccugaccaccugaauucagucuauaugggagacuauaagggagaaccaaguccucuaacuuucacagguacaguguggugcagugcacaugcacacacuauaaauaauguaaaaaaaaaaaaaagaggaaaauuuaggaaacgaguccuaagguucauucacaauuucugucuucaucuuaguuugauuucuucgucuucuucacucuuuguaucacacuuggccuuagaauucuguaguuuugucacuuaucaacuaucugaauuguuaguggagaaaucugaggccaacuugauucuucugcccacauuuuuuuuuuuuuuaacuugauuuccuucucuuuggcugcccauguuauugcuuuaaguuuaguacuucuugcucaaauguuuuauuuauucuauauuuuuauuuucuuguguuauaugacuuauaaccacugagacaucucucuagcuucaauuuuuauaguuaguuauuuuuauuuuuuaaacuacauuuuaaaaguaaacuuauauagagucuuauugucagcauuuugagauauagguaaaggaggcaguuucacaccgucaaccucagcagccuaacauguaaaacucuuugagaaaagaguuuuaggaaaauugacucaggccaaaccagcauuuauggauuugaauugaaaagaaucaggacuagacagcauauuaugaaguagaguuuaguaaacauuuuaauacagguuuaagcauguguuaauagaugccuuguagguuuacaaaugguaaggaaaaaacgucuucccucaggaauauuggaaguuaggauauuuuuacuguaaacaggggaagagaacucauagcaacucucauuagaaacauaguuuggaugauguuuggagcuggcuaguauuuuucuuaaaaggugauagagaagauauaggcuuguucuugagauucuaaagaacauuguuauuuccuagacuauaggaaggcaauggauaauuaacauuuuuuguauccuaagaugggacacaauuuugugucuucuuucagugaugaggaaacagcucugucaguaaauugcuuguuacaaagcuaggaggaucccaguuuagauuccuugcaggaacuuaaagacugagugccugucuuuaagucugugcuugaagggcccggguggagcccuggagcucauuggcuagccagcuuagccaaaucagugagcucaauguucagugagagacccugucucaaaauuaaaaccaccagcuguuggccucuggcuuccagacucaagcauuuuuaugcgcacacaucuuauuuuuauguuucauaauacuacuauggguuuuaucuuacuuuauggauaagaaaaaugaaacuuggaaaaaaagagaugacuuaauuugguaaggcuaaggagaauugaaaugcaaacccaguucugacauauauacugcauaugguauucuguucccaggaauuucugcugcaucaaauuuaagcagagaaguaugcugaugcuguuauauuuaagcacaagcuacaacauacaaagggcaucaggauaugucuagacaaacucaucaguguauauuuagaguauaagagucauuucaguuuguagggagagauaaagaaugagaauuuagaugacuucaacaacagaacagcuuuauuuaaccugagaaugauauaucagguucugguacaccauggucauauuguaggugguagaaugucauuguuaauucuaaggaauauuggaaagccuuucagauaugguaugacuuuuuugucugucugcuccauguuccaaauuuuuuugguuaggaagucagcucgcuguagccuaugacucaauguaaagagaaauauucuuuuuugggggggcggggguugagacaggauuucucuggguagcacuggcuguuggcuguccuggaacucacucuguagaccaugcuggccuugaacucagaaaucugccugccucugccucccaagugcugggauuaaaggcgugugugccaucacucccggcucaagaaaaauauucuuauuguaagcaguuuuaauguugauuagaaaucuauaaagauuauuagauugauggaucuuuaaaaagaucuauaguagaaauguaauaaaaucuuugcaguuguuuguugguauauauauauauauauguauauaucaccuuauuaguuacuuuucuauuacugugauaaagcaucaugaccaaggcuguuuauaaaagaaaguguuuaaaugggcuuacaguuccagaggauuaggguccgugaugguugaguaaaggcaugguggcaggaacaccugaaaacagcaagcaggagacacagugcuaauuucaaagcucacugcugguagcacaccucuuccguuaaggccacaccuccuaauccuucccaaacaguuccacaaacugggaaccaaguauucgaacaugagccccugagggccguucucauucaaaccaccaguaguauuuuucuaauauugauuuauuaaugaagguugaggaaaugauuguuuuuaauaguuacaguaauuauaaaacacaccucgucuguuucucaacacuauuauaguggauguguagcaauuccugugcuagagugguaacauuauuuugauaaaucauauuuuacuuaagagaaucuacacaauauuuagauaaaagauuuaucgguuaccuuaacaguuuaaagaaucaggcaugaugguacacuucuguaauuccaguugagguagaauuauaaaaucaaggcuagccuggacuacauagugagacuuuccuucagaaaaccagaaacaugccaaaauggaaaggggaaaaaauucaaagaggaucugcuguaaagaugggacucuaacuuugggguuaugaugcaugccuuuaacccuagugcugggccacuagggaggcagagggaggcuauccagggacauacagugagacccugucuaaaaaaccagaauguuuauuucuuuuuuuuuuuuuuuuuuuuuuuaagauuuauuuauuuauuauauguaaguacacuguagcagccuucagacacaccagaagagggagucagaucucauuauggauggcuuugagccaccaugugguugcugggauuugaacuccagaccuuuggaagagcagucgggugcucuuacccacugagccaucucaccagccccgaauguuuauuucuaucaucaucaucaucaucaucaucucaauauuuuacuuguuuauugagacgguuuuucugcauggcccugacuguccuagaacuuguucuguagaccaggcuggcccugaucucagagauucgcucacucaccucugccucccaagugcugagauuaaaggcauguggcaccacugucuagcaaauauuuauuucuuaauaucuguuaucuagucagauuucauauauucaguugagucauaaacaucucuguccucuuuaauguauagauucuauagaaaauuuguuuacaauuccaggcccuguccuuauaauuucucacauguagcuucugcuaguuauacuuacuacauggauucucuuaacauguuucucucuguguuuauauuugacucuugacuaugagcuugaauaggcucaguuuugcuaggugagauuaccucaaaaauaaugacuuuuauguuuuaaagauuugguuggcuuauuuauuuuacauagaaacuuuaaaaauguagacaaagcgacaaagugacauuucggaaacuuuucagcugauguauuuuuauuuuuuaagccagaggauggucuuacuuaaaaagaaacaaaacaaaaccccaaaacccagagaaggcaaacuuuaaauuucugcagcuucuuaaacuagaaagauaaagaggaggaagagagaaagccauaucuuuugaguuagaaaaaguuaaauuugaguaauuuagaaaauuggacaugcucaauuuagccauuccacaggggcuccauaaacaacugccuaacuggaguuuuuuuuagagagagauguuauuugauaacauaauauuaguucaggguuugauaauacgaugcaaggaaaaccagauauuaguucuucuacuuucuuugguuuucaaaauaauguauugcuugcacagagugggcaaagaauggggugaugagaugguucuguagaaaagaugauguuaccaagccugcugaccugagauugauucuuuacaugguggaagaaaaaaaaaaaauauauauauauauauaucuccccauuucucuguggcuuuggccauccuggaacucauucuguagaccaggcuagccuugauuucacagauaauuugucugccucugccuccugagugcuggcauuaaaggcuguggaauaaaacucaaaccaaaaugacaaaauggugugcuaguauauaauauuacagacaguuuugauuguuuuuuuauguuacucauguauauaaacacauuugucuaccccuuaugguuauuauucauacuaauauucaacucauaacauuuuuagccagugcggcuucuguuaaguuggcuguugaguucuuuaaacaagaccacaguacuaucugauagcuuuuguuuuauugaguauugagaagagccuaacacauuuuuuccuuuaugccuuagacuuagaaucugucauuucuuuacaaagcccuacuucccuguuagcuguaaauuuguauuagaagaccauauuguggauccuaggaauguucaucauauugagguggcuguuucucugaacauuuuuaguguacaagccuaguuuuuaaaaaauauuuuaugaauuuaauuugacccuaauaauucauguuuguucacuuuucauauguucucaucuuuguagagacaggucagagacuauacacuauuaugcuuacucuuaguuuuuguggguucaugccucuaccccugucccaaauuaguugaucauuucucagaacauggucuaacucuauagccuggacugcaagagaagauccuauuuaaaacaacagcagcaauaaccacagccauuagagugucaugucuguagccuuagcaaagagacuagaggguaaggccaaccagucuacauaaaaguuucaaaucuacuaagaagagaucaugucuaaaaaaauugaaaaaucaaccaaauaaaacugcuugcuugaauuucaauugccuguggcuauggcuacuauaauuuucuaucuacuacaaccuuagagaaacaauuuccacuuguacuuuuccaucuuauuuucucuuaacauaguuagugugguucauguagauuuauagauuuaucuuuacugcuuauguugaggacaguuuuggcuccuuuuuuuuuuuuuuaaccuaauugccuuaauuuggauagcuuuuccauucuguagaaaugcgaacuugucauuguuggcuguuaaacauauucuuaguuuuccugcuuuccucuuuggcaaaaacccuaauauauucugaguauguuucucagugguagaauacuugccuagcauaugcagaguucaaaguacagucuauaacucugcaaagacaacuccucucccaacauauauaacauauaugugcuguagaaauuuagaauuaaauaagauuuccccuuaccuuucaaacagguaucuccucuuguguuuccuauuuuaauacauuugugucauuuuaggaacuaagaugagacauauauguucaaauguaauaaacaacauauauacacauaauaguagauaaauguaucuauguucacaguauuauacaaccacuaaccuuuucuaguuucaaaaccauuucaccacuucgucaagugucuuauauacccacuaaauauucacaccuacuuuagauaucagcaucuugauaguguaggcaagagcuggucucuacuuauuugcuuugcuguggccucuuggguguuaguauuauuguaaguaugcaucaacaugcuuaauacagcuuuuaaaguaugacuguuuucuuuuuaacuauguauacauuugugugucuguauauggguuugugcacuugaggcuagaagauggcauugacuucuuuagagcuggaguuacaccugauguggguguugggaaucaaacucaaguccucugcaacugcuauaucaucuuuuaaaaaaagauuuauuuauuuuauguauaugaguaaaauguagcugucuucagucaccagaagagggcaucagaucccauuauaaauaguugugaaccaccauguaguugcuggggauugaaaucaggaucucuggaagagcagucagugcuuuuaacugaugagccagcucccugcuauacugucuuuuauguacugagccaucuauccaacuucuaagacuguuuuuugaacauuuaaaucucccaagcucacccuauuuuuuuuugaaaauguauuaagaacaaacgcucuccaauucuucuacggguuaucauugucccguguaugaaguugaaacuuaauauggcuaacaaagaaagggucuuuacuuucuagcuuuugccauuuugucuuguuucauuugugucucuuuguucagucauagguccaguucuucauuaucuacaauaauagucucuaagucuuucuuccccauuucccuuccucccuccaaggcagggucucauuauuagucauggucauuuugcaacucaacucaccucugcuucccauguucugggauaaaaugugugugcccugcugugcuucccuccccccacccacuucuuuuaaacuuaugagacuagacaucacaagauagacuuggcuggccucagaguugugguguucuuccugccuuuuuuaguuauuaaagauuguucuaugccuucuuuuguacuucuuuuccucccauuccuuguacuaguuuuagauuaccuauuacacauuguccuuacguauuuuucugaaacagucaaaugcuaaguaauacaguacaggcugcaacuauaaugaauagaauuuuuaguagaaaucaagauuauuuaguaaauuauuuaaaaaaggucucagagaugggaggguaguacuugagcuagaucucaaaaaucauucaugaaaacaugauaauggucuuaaaacuacugagcuuacuuacuuaucaaaauuuagcuagacuucugcuggaaaaugcaacaaugagauaauugggauggcucaguuaagugcucuagguagacgcuugagaccuaaguuuagagcccuacacucauauaaaaacuugguacagaaacacauauuuauagccccaguauuggaggggacagguuuauacuaguggcccacuacuagaaaguguaacugaaucgguuggaaaugagauaacuaauguagaaaccuauuacccauaauucuuacaccuucaucacaccaaauucccaucaacacuaaaguguauauguguauucuuuucuaguagccagucacacaguuuggaaucagugaaaggcauguguauaagcauaguaagauuaaaauacaaaucauaucuuaaugguaucuuaaaaaucuacuuaaaagaaaaacaagccugauauuuuaagauauaguacugauuuuuguuugcuuugccuauuagauuuauaaaaucuuguguucaaaauccaagaaaagaaguucuuuguguuaaaaauacaauuucuuuauuuuuacauuuuuggucuuuuugugggcauguugugguauauauuaauuacuuuauuguuacuuugacaaaauaacugaucaaaacagcuucaggaagaaguguucauuuuaguuuacgguuggucaacuauguaguucgucaugccugggaaggugugauagcugcagugugacagcaguaaaaucaugggaggggguaugagucuugguauucugcuucacaauccuuauagaaugguuccaaccacauugcaaauuaaacuguuucgaagcacccucauauaugcucaagaggugugucucccaaguaauuucaaguucaaguaaguugacaaaugaagauggaccagauagcacuauaugaaauuguagugcugaacuaaaaccacuuuugguugcucagaguuaaugcuuccacaguuaccagcauacucuguguggcauuacacuugcuuucaugguuagauugccugucuugaggaugauggcaagcacuguaugagaaucauguacucauuuagauuucaggcaaguccuuucugaacugcucuuaaacaugauuuguccucacucacugcccaguuugaaccagucagcccucagcucucuugacaaauaaaauaauugauaauuuuuuuggugauuguuguuguguauaucacuaucacgauucuuaugcugacuucaaagaugauaguauauuaaaauuauuaaauuauauaguaugcauagauacuucuaaugucaguuauacuuccuuaaaacucauucgaucugcccauuacaaagacauccuuauuauucagcccaucucucuaaacucuuaaggaugugcucuuccuaacuuguuguuggaugacacuucguuggcuuucguuucccuaccuuacuaguuccuugucucuguucuuauuuucugcccucaucauccauucuccauggcagaacacuguuuagaagagaaaaaucuuaggauaucaucacuaauucuguaggcaccaguuauucuuagauaacuauuccuguugcauaguugaauuuaccucaaggcaucauggcaaauagacagauguuagcguaaguaagaguuaauagaacuuagcaauuccaaugcaaaagugcuuuugguuguuuauaaaggaauuguccuaaugacuauagaaaacuugcuguuuuugauuugauuugaguuuugguuuucuuucaacuaaaaucucuugugagauugagccucauuugcauuuugauggccucucauaaaaccuacccagaaugcuaagagcuuguucggaucccagaguagauagauguaagaagacacaccaauuacaucuggauagguugauguaaccauggcuuccuuguuguauggaaauguuguagucgugaggcagcaucuuaauaguuuucauaguuuauggcuuauguguggucauucuguaauuuaccuguuggagaaaaacuauuuuaaaguuuuuauugaaauguucuuuuuccacagaacucaacaaaaauccaguggaaggcuuuucagcagguuuaauagacgacaaugaucucuaucguugggaaguccuuauuauugguccuccagauacacuuuaguaaguauauuggaauugacaucuugaaauaaguuacuucuucaacuaaaauuaaaacuuaauuuugaaaauugaaaaacaauuuuaaaggagcaaacaaaaugguuauaucuaguaucaucucgauuugaucauguguagagccuuuguguuaugcuugaagcucuaaugucuaaaaccuguuuuaaaaaaguuagcuucagaaauuuagauuaucuugcugcuggaauaaaucuguuaugaaaagcuuuuucuggugagguuauauguaaacaacuccccucccccccaaacacacacacacacacacacacacacacacacacacacacaggguuuuucuguauagcccuggcugucccagagcucucucuagaccaggugggccucagacuucgagaucugcaugcuucugguccccgagucuugggauuuaagaugugugcugugugcuacuacugccuggcuguaaauaauuuacauacauacauacauacauacauauucuagaauuuaggagauuaauuuuugcaaacuuggagaagagaaaauuucaucucugauuauaugucuauguugcuuuugugggauuauguucaugggaaugaaggugcacuaggaggccauagguguuggauccccuggagcuggaguaacaucugauuauaagccauuugauaugaguauugagaaucaaauucaaguucuuuagaggcucuuaaccgcugagccauugcuccagccaaaagagaaaaaaguccuauggaauuuagagagguguuucagcaguuaagaguacugagcgguucccuauggaaaugauuuuccuucucauguuuaccaugccuugaucccaaaggaaauaccauaauuaaggaagaaaguuuuacuguuuuuuuuaaacacuacuuuuaaaaaaugauuuauuuuucuuuuauguucauuaguguuuugacuucauguaggucugugugaggguguuugaucuccuggaacuggaguuacagacaggugucagcugcuaugugggcccugggaauugaacucagguccccuggaagaguagcuagugcucuuaacugcuuagccaccucuccagccccaguuuuacuguucuuaaugccuuauuauuuauuaaagaauaagacugcaaauuuuuucuuuuuaaaaacaguucuuuuuaauuuaaugaaaucaguuaaugucuauguaugaggguguuuugcaugcauauauguguacuguguuugucugguaucugaggagguggauagcaugggaaccucuagaacuagaguuacagaugucugugacccauccaccaugugggugcugggaauugaaccuagggccucuggaagaacagccagugcucuuaacugaugagacaucucucuagccuugagauuuuuacauagaauguauucuguauaguugugucuuaagacuuaagggaacuuucaaggucuauuuuaauaauuuuauaaccuggucuucacaaaacacaguuuauaauagcuuauaagacaguguuaggacaacugacuaccaguugaaaaugaggcaaaugagcuagagagugauaacagaccuagaucucuagaucugcaguucuuugggacugcauuuccuuguuguaagaccucccuccaccccccacccccacccgcagccuucaaguagcugauuuucuguuaucucaaacagcugguaaaaaauguauuuaaaaaauaauggagggcuggugaagaugacucguugguaaauguuugcuauagaaauucgaugauaauucccagaacccaugcaaaaaguuuaauguaguggccugcguuuguaaucccagcuauugaaagaugggagauagagacaggagaauuaauccaguuaucuuggaggaguaguaggcauuauggcagaaaugagagaagcugccucaaaaacaaauuggaaaaauagaggaaaugaaguuaaaacaaagcaauaugggaguucaugguuuacauagugggaaaacggugguucaugcuuuuuguuauacuuuuuagcaaucauaauuguugcucauauguuucuuugaaguauauuugcauuuaucaguuuugcaaguugauuuaggugaauuugaucauggcauggcauuaggauucuucaguagcugccaguagccacuggaaaccaguuuaaagauacucccucacagucauguuguuauuugagguaaauuucuuaaauuuugcaaaccauacuguuuaaguaaccuggucuaugaaccuaacacaguucuggucuguucuucauguuuauucuucuggauuuaaaauaguguuuguuuuuuucccuaggcacagugccucaaggggauaccauaggaacauucugaugauaggauucaauuuacccuuaguguagcuauaaaauaaugagaguuauucuccaaaaccaaguucuuguuuaagaauccaggcuuacgauuugacucuuaaggacucagugaauuuuuuaauccuuacaugcauuuguguuaagcauuaguugaucaaugaaaauaucacacacacuucucgguuuuuaaaagauagcuacucgagcuuguggugcaaacuuuuaauccuagcaccaugcagcagggcuacauagugagaucccgucucaaaauaaaguccagagguaagaccauuuuaguuaacaggucauucuuuuuacuaacaaacccauuuuacugccccccccccaccuuugugugugugugugucuccauaucucaaucucagcccuucuguuucuuuuuuaaggcuauuuguuuguguuuauuuaguuuuugagacagguguguguguguguguguguguguauguguguguguguguguguguuuguagcuauagcuauggcugucuucgaacucacucuguagaccagguuggccucaaacucagaaauuugccugcuucugucucuugggugcugagauuagaggcaugugugaccacugcccagcuuguuuuuauuaucuauaauuauguguacauauuguagaaauuuuaaaucccaauccagaguuucuacccaccuuugaucauucaguucuuggauaaaagacacacucaaccuuuacauuuguaauaagccuugaucagcuuuaagagcuggggagauagccgggugugguggcgcacgccuuuagucccagaacucaggaggcagaggcagguggauuucugaguucgaggccagccugguccacagagugaguuccaggacagccagggcuacacagagaaacccugucaagaacuggggagauaucuguccucuaugcuauuaauucuguuucccagccaauagucccauuauauaauuugacauguuuugucuggguugugcuuaacuccaacuagccaacuaacauggccauuauuucaugauucguuuaaccuguggcagcuucuccuucauucacuuccuucucucccuuucucgauguucuccucuguccuccagcccaggaacccugaccccugccuaugucugugggugugggcaucuuuauuuaccaaucagaaauaacuuggggucaaggacacauagcaucaauugacucuacuuuaggacucuguguucuuuggggcgaccgggucuugaggaaccaguauuauuagcauuagaauacaagcaacaucaagccaacccacugcauauacaggucuguguguagggauguguaugugaauggaguugcuucucagaggcugaacuucuagggucccucuggaucugugauuguaggugguugugagucaccugaccccucuaaaaggaucaguguugugggguucucauuguauguuucuaaaaguguuggcucuugaugugugaugugaauagcaggcauguuaguggcaacuuugaacuugcuacugagacagacacuggccacuuuauccagugcuuuucugaaaucuguaaccuuuguucagggaagaagagaacaggugccugggacaaguccugagaaaauagcuagaaaggugucaggacaaaggacagagaaaagacuuguaaauggaaguuuuaaaaaauguuccuuuugagggagauaggcacuaggacaauuuuauuagaguuugaaagacaaacccaagaucuggcaaacuaaaucuuaguagcuucuuagugaaggacaauggaggagagaaggaagaaggccaugcuauauauaagcuguucacauaggagguuaguuuacauggcuguggugggagguggggcgugggagcuuagaaaaaaaaaaaagaauaaggaaacacaaaauguugggggaagggcccaauguguuaaggcagugguucucaaccuguggggcauaaccccuugggguuguugaaugaugacccuuucauagaggucacauauuagaugucacccugcauaucauacuuacaauuaugauucauaacaauagcaacaauacuaugaaguagcagcaaaaaaauuauuuuaugguuggaggucacuguguuaagcaaagugugcuuagaaaagaaagauaaaggguuggagagguggcucagcaguuaagagcacugacugcucuuccagagguccugaguucaauucccagcaaccacaugguggcucaaaaccaucuguaaugagaucugaugccugcuauacaguguacucacauacauaaaauaaauaaaucuuuuggaaaaaaaaagauaaagaagacaaagcaaagcagacagacuuaaaugauguuuacaaggcuguuaauuauaauuaaguccuuuauagaauguucuuaaagaguacuaagugcaaggaagugaucuugaaguugucucaacaaugugaagaggauagagugauugaaaauaaguuagcauggauuugagugauaguuaaaucucagugauccaucagcauauaauggccugagguguuagcucagagaaaguauuaugccaaaauucugaaaaaauaugcuaugcuguuuugugauguauaacuaaccuucacuuacuuacuaaagaacacuccacauuauuuacagucuauguaaucagugcuuaguacauuuaaguuuuauuuuaagacugauaguugccagggcuguuauacagagaaacaucuugaaaaacgaaacaaaaagacugauaguuacugaguauuuauguagugugaugguuuguauaugcuugguccagggaguggcacuauuaggagauguggccuuguuggagugggugugucacuguggguaugggcuuaagacccucacccuagcugugugaaagucagucuucuacuagccaccuucagaugaagauauagaacucucagcuccuccuguaccuugccucucuggaugcugcuauguuccugccuugaugauaauggacugaaccucuaaaccuguaagccagccccaauuaaauguugccuuuuauaagacuugcuuuggucauggugccuguucacagcaguaaaacccuaacuaagacaugcuauuuuacccaucuucaccuagcauuuuuuuuccuuuuauuaaucuuguauccaauauugaauuuuucuagugcugccaagaauagauuuucuuagccaggugugguggugcauggcuuuaauaccagcauuuggaaggcagagacaagcugaucucugaauuugaggccagcauggucuaaagagagaauucuaggauagccagugcuauacagagaaacccuaucuugacccaagccccuuccuccaaguaacuucuuuuguguguaauguuuggaaagaaaggaccaagaucucuaggcaaguguuggacgacugacagacuuggagucccaguauaguuuuuuaaaaaaaucgaaaaggguucuugauauguaguuuggguuacuuuaaauugaauaggccuccugccucacacuuuucagugcuaaauuauaggcaugugccauacccaguuaagacuugugugauuuaauuuacaaaaauaguaaaaggagguuuugugccagaaauaugaccuugguuuuucaaauauucagcaguugcuuauauaacucuuuaacaucauguuaauuguuuuaauacuuuguacauggagaaauauuuuuacuucacugcuacuuuaauguuuuucucuucccuauagucacaucuuucuauguuugaaaaauaauaaauacagucuaucuacuuuguuauuuuuacccuaugcauuuuuuaguucuuuugugcuaacuucacuucuaaaguuuguauacucacagauuugcugccacuaagcaagguguuuucuagggugggagaagagcagguagaugguccuuagguaaaguagaggaauccauuaagaaaauggagaacuagcauaauuauuuugggaacuuuuagaaaaauagaaaaacaucugcuuuaaaauuuuagggcaacacuauuaaguaaguuugacaauuacuuauaaauaauuuagagggguaauggcaacuuuuuagcauaagaauuccagucagauauugugaagcuuuugaaugaauuaaaucaaccaaaaugaagugaccuuggaaaaauaaguugcagggauuuuguggaggcuguucuaaugcccuuuuacauacauucuuggcucuuuccuggauuuauagcuuucucaaauucuaucuacuuauuuucuacucuaauuauaaaaugcuuaucuuugaaacuaauuacuuucuuuuuaauucuugauaccugugcuacauuuuauguucaccuuuccaugggaaagaaaagagagcuuuaaaaaaaagacuuuaaaaaaauuguguucaugugucugaaugaguuauaugaacaucaugugggugcaggugccccuggaggcuagaagaaggcauuggauccccugaaauuggaggaauaggcagcugugagcugccacaugcggaugcugagaacugaaccuuugcaagagcaguaagugcucuuaaccucugugucauuucuccagccuuacaucauuccuucuccaugguuaugcuuuuuauuagcuuuauuuuuucuacuucuagcuaauuucugaugacuuauuauuuggaggcagggucucauguaucacaggcuagccuugaauaccuugcuauguauuagaggaggaccccuauuccuaguugucuuucugcuaguuccucccauugucuuaggaccuaguuuucuucccuuuuuaaaacccuuaauuuguauuauguacaaccuucuuuuaauccccccaccccuaaaaacaagagaaaagaucauucuuucucaggcugauacggucuuucuuauuuggcuuaggcuggccuugaacuuaagggaaucaccuugaguugccaggcauacacagacuucccauauuuaaauguuaauuuucucaucaaauuauccccuucauugugcacauucuuuaccauuuuuccauuuaaucuuuuauggacuguuucuuacugcuuacuucaaguguguuuuuuucuuuuuaugcucugaacccucagcuuaccucuuuacuauuuggaaauauuugauauuaauagcauggccugcaacucccccaccccaccccccaacacacacacacaauguguugauagacccugugcaugcagugccuauggaguucagaagagggugucugauagccaggaaccagaguuacagaugcuuguuaguuuccauguggguguugggaauugaagucuggucuucuggaauaucagucagucugaaaaacaauauuuauaauuaaaauuucaaucuguacugaaaugugcaaagcacaaaguuaaaagggucccauguuuuacauccuacaguuaaucauuguuacauguaauguguuguuccuguuguuauuauugcugcugucaucgucauuauuugauugauuuuuuuuuuuuuuuuuuuuuggugacaggauuucacuauguaucucuggcuguccuguaacucauucuggaaaccaggauggccaccaauuuagagccuggcuuuuuuuuuuuuuuuucccuuccccuuuugagauaggaacucugucauuuuuucuuuucuauauucuuuuuaaagauuuauuuaauuuauguuuaugaauacacuguagcugucuucacacauaccagagaauaucagauuccauuacagaugguugugaacucaggaccucaggaagagcagucagcgagugcucuuaaccgcugagccaucucucaaccccuucccccccuuuaaauauacauauauaacaauagcuccacucacagucccucaccacagcccucgcagcucauaaccacagugacuagagacucuccaaacuugagggaugaagagcagcauucuguugaguguuaacauuacacaugagcguaaacauaccagcacauagucagcagaauucgaaccagugcauggagaaaaggauuucaaauccauugccuuaaccacuugaccaugaccacagcuguguuucuauuuuuaugucagugugcaaacaucuuuccccaucuuuuaaaaauuacuuguuagugugagugugcauaaugugucugugggcaugugcuccacagcauagauaaagaggcaagaagacaaauuuguaguuuguucuguccauccagcuuuaaguggguuuuggugauagagcucaggggucaggcuuguaucucaagugccuuuguuuccugaaccaucuuaucagucuaauacacacccuuuugagauugggucuuguuguguaguucaggauaauguugaacuagauaucaggugcuagaauuccacgacacugucaccauuuaaucauuguucuaaggucaacuugguuuauuuuagcuguauggacaguuaguugugagcugccauuugggugcugggaaucaaaccuacauccucugcaagaauaagugcucuuaacaacugaauaaucucuguagucuucagcuaccauucauauauucaucugcgcagggauugcuauccacaguggacuggguccucccaugucagucaucaguuaugacagucuuucacagacauuaucacagacaaauaugacccagaaaauucuuuaauugaaguguucuccuuucaggugguucuagggucaaguagauaauaaaaacuaaccaggacacaacccauuuucagaguguuacuggguaguauauuagacagugcagacauagagcaucaguauugcaguauuucuacucugaaaagucaguaguauaaaaccucuuugggaaaucuuuuuaauuuauuacuguccuuuuaaugaaguuuuaauauaugaugaaaugaacaaacaauuagauaaaagaaguguggcaaucugaucccagagagggaaaucacaaaauauaugccuaaauuuuaagaugagaaagagauugauggguauggccagagcagagaagaaagaucauuugaaaccgauauagaaaauucaggaacuugagucaugcagacaagauuaaacuuccugaauuucauuugaagacauauacugaaaagacuuguaccauaucaccagugaucugaucuggacaccuguuuccaguguuccuuuuauuuuuacuaacuaccugagaguuuaacaaagcaguauuuauagugguauguuaaacugcauauuuguauucaggaaacuaauuuuuugucuaccuuuuuguuguuuuauuuuccguacccuuuuaugugucugagugacuuguaaagaguaacuuaaaugcaugaacuugguuuuucuuuuauuuuuuucagugaaggugguguuuuuaaggcucaucucacuuucccaaaagauuauccccuccggccuccuaaaaugaaauucauuacagagauuuggcacccaaauggugaguuuucuaauuuuauuuuuacauuugcaaauauaaugauuugucacuaaagauuucacagcuaccucaguaaaagugcuuagugauuuuauguuuguuuuuuugugugcauauggucucguaauugacucaauacaaagguccagccugccugcuuuugguaucuaucugucaguguucacaugcacagccacacacaggcauauguucauacauggaaaagaaauaauuuuuucaaauuaaugaacagauggaggcaaucauuuaauaauuccacuuaugaaauguguagaauaugcaacucugaagacucaaaguauauucaugguugcuuaggacuaauggagaguuugaaggggaagagggucaauauagauuauacaagauuuugugggcaggguugggguggggugaugaaaguuacuaaaauguaugugcuuugguuguauaacugagaaguauacuauauagaaguaauuggagcgcaugcuucaaauaguugaguaauguggugaguguuaaaguuauuauggauaucugguaagauuguuaagugaguuaaaagaagcuguugccauguaagcuugguaaucugaguugaucccugggacccaacagaggucggggucgcaccccacuaagucaugcuuuggccucugcacaugggcuguggcauauaugucuauagauacacauaauaauaauaauaauaauaauaauaauaauaauaauguaauuugaaaaaaugcuacauggcaaauaauaauuuguguagcuuaaauguauuucaguuuagacuucucucuccccaccccaccccaccccucucuuauugauggcuuuauuuguucauuguuuugguuuaggguuuuuugguuugguucuuucuuuuuuuuuuuuuugagacagguugucauuguagccuuggcuggccugaaauuauguguguagaucaggcuggcauuaaacucagaaauuauccugccuuugccugucgugugcuggaauuaaagauguguacuaccaugccuagcccucacacaggguuuucaaguggauuuaguauuaggaauaaagccauuuguaaagaacauugagaugaaaggggaaaaaaaaauaacaagacaaaacauuguauggggaauagagcauuuuggcaagauaaguguaaauauuaaguguauagcuagcuauggaguuaacaacaaacaucucacagagaacauaguugucauccaacauacucugggaaaacuuacuuaaaucagagaucacuagaauuuaaacaguauuaguauagaagaacuuuugucuugaguaagacagccaugauggcaucagaguguauuugugggcuacauaaaugacauauuucuuuaaaaguaugauuuggcaugauuccaguuuuggucauucaaccuaaaaugcauucuaccaacauuuaaugaugcacuugaagacaugauaauugaaauaugacaaauuuaaaagaacaaaacugauugugugauucugcuucuaugagaucuucaguaauuaaaauggggcauuuuuagauauugaagagguagggaaagugaagaguuuguauacacaauuugaucugaggaaaaugaguagugguuguaauuguguaucauugugauuauuuuuaauucuuaacugagaaaugguagaaauuauaauuuuauucuaugaauauauuacaauaaaaaugaaauucaugucaacaaauacaaaucuuaagagacagauggucucauuuugaaguggugugagaaauuaaaauauuuuaagauucuauagcuuuaaaucuaaaaugauucaaauuuaaaaugacuagugauuuuuguuucugagacaggguuucucuguguagcccuggcuguucuggaacucacucuguagaccggccuggccacuaauucuuagagaucuccugccucugccuccugagugcugggguuaaaagcaugcaccaucacugcucugccaaaugauuuuuuuaaaccguuuuauuuuaaaauuacuauugugguguuugcucauuaauguauguauguauguaugcaugcaugcauguauguauguauguaugugucugucugucagucagucagucagucaggucucaccaucuacccuuagcuggcauggaacuaaagagguccacuggcuucugcaucuuaaaggauuaaaggcacaggccaccacacuuauuauuaauuuguucuuuguguaugggugcuuugccugcauguagguggguccuuguaguauauguguaccugguaccugaagagcccaaaagugggcuuuguauacccuagcaccacaauuacagaagguugugcugccacauaggugcugggaaucaaacucaagugcucuggacgagcagccaauccucuuaacaauggaguaagauuacuccauuaauccucuuaacaauggaguaagauuacuccauuaaugauuuggggguuggggauggauacaaggucucauguauacgaagcuggccuuaaucuuguagcuaaggauguccuugaacuacuaaucuuucuguguucaccuuuugaguguugggcuuuuaaguaugugcugucaugacugguuuauaggaugcuggauauggggccaaggcaaugcauucugggaaaguccucuuuucucugagcuacuuauacccuucagcuccuauccuccaaaucuugaucuuaaguagauuccuucugauggaauuacguacaacuauucagucucauuuuuuuaaagaaaguuccuuauuuuguaaaaaguagggggggggauuuguggugaauguuacaauguuuaauacuguucuuccuuuuuuauuuguuaauuccauuuuguuggacuucacaagccaugggagugaguuaggaagagaaaccucaguuacaggaauauuuuuguauaaaucaucaaaagcauggucuuugauuacaugucaggaguaauucugcuuuacaguaggguuccuaaaaguacuuggauuguugauugggugauuuuauacccuucacauacaaacacccacccuuccuccugucuucccuuucuccuuuccgccuucuaucugacucucccuauguucuuugaccaugaguugggguaggaagauugcuaacagggacaguuaaaacucuuucaaaacaacaaccaaccaacaagcauacacauauguuauuacugauugaaaacuuuuuauacuaagaaaauguauuuacucuuguuuuuuaaacuucaagaaauaguauuuuuugacagaagaaauuuauugugaaagguuacuuuuauuaauagcggauacaauuauuugagcauguuuauagauuaacacuguaggauuuuuuugagaauauuuacuuuaggauaaaauagugcaaagugagauacaguuguuucuuuauccccuauaaaauuaaggauauuuuuguauuucuacuccagugacuguuacuauaugaagcuugcauuuaaaaugaauuuaugaaguagacuaugaguaucauuuauuuuaaagcuuuuauauuauuuuauuuuuuaaaagauuuauauauuuuauguuuaugaguguucugccugcauguauguauguauguaugcauguguaccacgugcccauggaugucagaagaagauguuggcuccucuggaaccagaguugcaggugguugugaauugucuugugggugcugggaauuuaacuuauguccucuguaagagcccugguguucuuaaccacuguuaagggguguuucuagccccuauuuuauuauuuuuaguauauggauauuuugcuuauauguaugucuguauaccagaugcaugccugguauccacagaggccagaagaggguguuagauuuucugggacuguaggguguaaacucucaugugaguacuuggaaucagccagugcuucuaaagacuuuuauuuauuuauuuauuuauuuauuuauuuauuuauuuauuuuauauaugugaauacacuauagcugucuucagacacaccagaagagggcaucagaucccauuacagaugguugugagccaccaugugguugcugggaauugaacucaggaccucuggaagagcagucagugcucuuaaccgcugagccagcucucuagccuacagccagugcuucuaaucacugagcuaucucuccaauguguaucuuucugugagucuguuaauuuucauuauuauaucacccucccccuuuaacauuuuuauuugcugaaccuugaccaucuuacuagaauuugagaggaagacagcuguaaaugcugagauuaaggaauuggagaacuagaagaaagaaggcauguccuuugaaucagggacagcagugaagguuguaauguuaaaaaauguaaaauauaguuaaauauagcuuauauuccuacuuaguuuuuuagguggcucuuguacauuugguaaaaucuauaacauucucaaaaguuaguagauuacauuuaggaaaucuccacguaaguaauauaauauuauauauauauauauauauauauauauauauauauauauguaucacauuuguaauagacuauauguaaccaaauuaaaacaauucuuauucuauaauuuuacaguugauaaaaauggugauguuugcauuucuauucuucaugagccuggggaggauaaauaugguuaugagaagccagaggaacgcugguuaccuauccauacuguggaaaccaucaugauuagugucauuucuaugcuggcagauccuaauggagacucaccugcaaauguagaugcugcgguaagguauuugccugauagcugcugcuucuguccuuuacucuuuuaaaacucaacuugaaacuuaauacauaugugcauuucuuuguccauauuuucauacaaauaaaaauuauuauauauacuggauuauuuuguacaguccauguauaauaaauuauuuugaaauauauaggauaaaugugguuaugaaaagccagauauuguauaauauguacugugccauagcaaauuugaacuaguuggcauguauuaauucccucauuaauuuuuauaguaagaacaauuaaaaucuacucuuuuucauuaguauucaaaauaguggauuucauuauguuaucauauauucauaaaauuaucuuguaguugucuugguuugaggacuuuauuuuuaacuuugaaaaaauaagaauuaaaaauugcuguugucccugcauucuuuuaaugguuauuuauuauaagaaagaaauauaggcuaaguauuuuugugagcauuuccugguaucuacuuguuuauuaaaaauugguuuuguuguaauuuaacuauguuguucaugcugguacuggugucauucaaggagacagccauuguuccuacucuuacagugugcaugcgagcgacagggggggagggguguggagggagaaagagaaagagagagaaauaaucuguguuuugauugacuuuugcuuguuuggggcuaggugccuuaucuauccuggcucuuucaagacagcccuggggaguggauccuccccagcaugugcuucuucagucccuaacucaguccucaagcccucuagcuacuuagccauuucacuacccacccuuuuucuauuuuaaaagagaauuuuuccaguagcugucauuagcauaagagcuuucuauuuguaguuccuagccuagugcuuuacaaaauuugcuuuuguaccucaucaacuuuuuggcagggauaguauuaggcucuggaccuagguccucauaugcucuagucaaagggcucucagcaccugagcuguauugaaaauacuauacggggcuggugagauggcucaguggguaagagcacccgacugcucuuccgaaggucuggaguucaaaucccagcaaccacaugguggcucaaaaccauccguaacaagaucugacucccucuucuggagugucugaagacagcuacaguguacuuacauauaauaaauaaaucuuuaaaaaaaaaaagaaaaagaaaauacuauucuaugccuuggaaaaaaauuguggaguuuuuaggauugauuuaaaaccagguuuaaaacaagcuaggcaaguaugcuacuacuaaguuacaacccuaucauagcauuuuaagauguauaaucacacccugucucggggaaaaaaaagauguauaauuacaaaaggaucauauuuauaauucaaauaggcaguuuugauuauaauagguuuauauaaaauaauuugauuuuaauuuuguaucugcagaaagaauggagggaagacagaaacggagaauuuaaaaggaaaguugcccgcuguguaagaaaaagccaagaaacugcuuuugagugauguuuauucaauaguuaguaacuucacuuauuucaggguaaguucauuuuaaaacugugcaacucuuuaacuuuuuugcucaaaugcuagccuuuuuuuuuuggagacaagguuucucugugcaacccuggcuauccuggaucucacucuguagaccaggcuggccucgaacucagaaauccgccugccucugccucccaagugcuggaaucaaaggugugcgccaucaugcccggcacuaauuuuuguagaucauuugauuuugcuauuugauuuguauauauuggcucaauuuuauucuuccaguuccguauacuguaguuugcugcuucucagagcuuuuuuuuuaucuuuuggagcacuuaaguauuuuuacguagauguucugaauuaaauaguuucauguuaauagucuccuuauuuucacugguaguaaugaaagauuuuuaacuuuuuauuuuuuaaaugcugcuggcaauuaaacccaguuccuggaaaaggguacccuaucacugagccuguauugaugguaaaauuucugguaacgaagaugucaguugguucuucauuucacccuuucuauuuaucuucauuuaccuuuuuaaaugggaacugaaguaucuuggacccucuuaugcugaauauuuuguauggugagcccgccccauagcccccccccccccccccaaaaaaaaaauaaagaucugaaagcuaguaaugagcccuugccuaguguucaggaaguccugaggucaguccuauucuagcuuuuuuguugcugugauaaaauaaccaacuuguugaguucuuaauuaggguuucuauugcugugauagcgaacuuugaucaaaacacaacuugaggguuggggauuuagcucagugguagagcgcuugccuaaaggcccuggguucgguccucagcucugggaaaaaaaaaaggaaagaaaaaaaaaaaagacaaaacacaacuugagauggaaaaggcguaauucauucuaacaacucuaaggucacaauccaucacugagggaagucaguacagaaauucaagguagggaacuuagaagcaggaauagaagcagaggucauggggagauugcucacugacuuguuccucauagcuugcucaguaugcuuucuuauuuauacaaauguccagggguggcaccaccuccucgcuuggcucaucuaaaucaauuauuaagaaaauaccguacagacuugcuugcaugaaaucuaauggaggcauuuucccaauugagauuucucuuaccaaauaacuccagcuucuguugaaaaacaaaaaacaaaagaaaacaaaaacaaaaacaaaaaaaacccaaaacaaaaaacaaugaaaauaccacaacagcuagaagaggguuuagaagaaagccaggcacucagaucaggaaucuggaggcaggaacauaaagcagaaacaauuaggaaugccaguucuggauugcuucccauaauugacucauccugcuuucuaauauaacccagaaccacaugccaagagguagcaccaucuacauugggcuaggcccucccuuaucaaucagucaagaagugucucacagaucaaucuguuugaagacaguuucuuaauucucaggugacucuagcacaguguuuuuuaaccuuccuaaugcuuccacacuuuaaauacaguuccucaauuuguggugauccccaccaugaaauuacuuuugguguuacuucauaacugggauuuugcugcuguucugaacuguaucugauaugugaccccugugcaaggguccuuugauccccagguugagaacugcugcacuccuuuaugacaaguugacaaaaacucucacaaagguccccagcaccacauaaaacaagcugguguggcacaugcuuguauugccaucaugguaagaggaccagaagcucaagguuuuaccuuuggguauguagcagauucaagaccagcgaggaauaugugagacacucaaaaacaucgaaaaaaaaaaucauauugcuaacaccauugaacaucuuucuuucuuuaacuggucuuuuauaucuuggugggacaagugggguaaaguuucucuuucauuauauaaucuguagggagucaaagaugauggacccccaucugacauagaaaagaacauaauguagaugagcugaucacauuuuuauuugauuucaguguugaggugaugaaaaacugaaaugucuguaguugugguaauauauaugcuuuuuuaccccagcucuuagacgcuaaggcuggaagagcagcagggcuaagauugaacucagggucuugugugugauauuguacccgugagcuacaucuccagcccauaacuuccucucuccuuccuugauuauuuucgucucucuucuuuggccuuccuuuacaguucuuugcuucuguucuuuuugugugauccauucuaagguaagguucuucuacuuuaggcucccaaggguuaguauuaccaguguauaccgcuuuaccuagguucuuuaguguauuuuuggucagaauuccaaaguuaaucaaaaugagaggauuugacaaaauaacauacuagaaauacugacaaaauuuuaugcaaacuggagugcaguuguggguggggaagaacaaguaauuugaaaacacauguccuaugguguaguuguagaagcucggaaagcuguaacauagcuauagagagacauagaagcuuguagcaccacaugcaaguuuuaaagacaccccaguagaauuuauaaauuauaagugcuacagugaaaaaugucauccagcagcuagaauauauaguauaguuagccacauaguuaugucucagaagcauaauuucaucuacucaucuagccacuuguacauguugcaugcaugggugcuugcguggguggaaaugguuuaauuuuguuuguuuuaaagagggugaaguggagccagacaugguguuauaggccuucaacucagcauuugggaggaagaggcaggcagaucucuugaaucugaggccagccuggucuacaaaguuaguugcaggacagccagggcuauacagagagacccuuucucaaaaaaaugagagggcagcaggggaggugggauugggcaggaggggggaggaagagagggagaaauggauaguagcuauuccucaguuuguuuuauuugaaugauagaacuuacuggaacaauuccugugagugagaagcuaccuauauuauuguguuuaagaacaaagcuuuuucuauuucuuuuucuauugaagaaauugaucugcuuuuuuguuguuguuccuuucaaaauguuguauaaacccauagaaaaugaacauuuuaguuuuaguaauaaaguaagcaggauacuuaugauuuuagaauauaacaucuccagauuguagauuaagaaauaagaaugagaacuggggagaugagauagcugaauuaauagagugcuugcuguguucaaacaugaacaccuagcauccaaaacguggcagcacucacucaccuuuuauucugguacugaggagaugaccaaaagcagaucauccuggagguuauuggccagccugccuagugaaaucaaugaacuccagguucagucagagacacuguaugaaaaaaauaaggugaagaagcugauaaccaugauuggauaaggaacuugcuccuaagccugacuaccagaggguccacucauaaaugggauuuuaaaaauccuugaaccuuauguuuugggguuuuguuuuuuguuuuuguuuguuuacuaggaaaucauuguuagcuguguaaucauauccuaauucucugcaguggggacuucaugugauguuuucauuuaucucaauuuguacaauuuguaaaacacuuaacacuacuuagcacacaguaagcauuucauaagauaguaggguuuuuguuguuguuguuguuuuuaaacauguguuucuuaaaauuuuuuuuuauuauuaauauaaauaauaguuuuauucagaaauguauuuguuguuuauaacuuuauuacauaauguuguuuguuuuguuguaggucuccaauugagaaacauggcacuguuuuuccugcacucuacccaccuauugcuggacuucuguuguaauaaguuggcaagcucuggcuggaacugggcugcaauaaaacaugccagucauuaaugcugacaagagccuaacaagugccaacuaaagaugauuacgcauuuugaauucuaaugaacuguuuuaacuuucaggaagaauuguaaagacauguacauagcacaacaugauccggauaauauauauacuguucauguacauccacaaacacaccuuguaccaaauaaugcuuucuuguaguagaauaagaaucguguaaauucuaaaagacuuuagcggguuuucuuuucccauucauuguuuuuuaucaguucaaaaagauuccuuaaagcaugucaggugaaaaccaauaaggaugaaaaguuuccauauaauuuccuuuaaaccauugagucuuucauuacauucuuuccauuuacuaaucuuuuauauuuucuuuguuuugucacaccccccuuuccuuuuaucucugauaucugccagaaaguucucaaaucauuuaguuaaaauacugaaauacuaguaaauuacuugaguuuuucacgaugacuucagaggaggggucaucacuaggugcuuuguccuuuuuguacuaugauucacccaucucuuggauuggauguagcaauaacauuuucuggcuguugagagcucuugauccuagucauuaucuccugagaacuuuaaaaauaaaauguaaaggcuguucuaaguucaucuuagugaaauuuauuccaaacaauacaaaaauccagauuugguuuuugcccuuaaguugucuaauauuaagguuggaugaauauagcaugcgcagcuacaggcuuucuacaucugggauugcuauuaaaaaugcuauuuguccuauuacccuucuccuuaguccauauuuguuucuucuuacagcagauuuuccucaccuauuguacaaagaaauugcgauguauauuuucauguaauuugauuuuggaauuuugucaccuuauguagugaguucuuccaaaauauaauuuuuuuccaauaauugucaaguuguuggcuuuuauuguauuaaaugaagguuauaguacugaauaccagagaagugcaguuuagaaaaaucucagguugauuccuuaugcaaacaaacuuaauacuugaaaaucucauggccauggcaguguacucucggguucugucuacagucuuuaaaucugaagguguuccagaggagaguccuuugcuagcugacauucagacucugucacugacauagugcacuuagaugugauuuuuguuugaguguaaauauguuuccuaagcaguuuuauaaaacaacuucggugauggguaaaauuaguacauuaaauguugaagacaggcuggccuaaacuccugucugguuuuagcugagaugggaaguuguguuugguauacaagagcuagagagcauaaaacaguacuugucacuugaugcuguuugagugcgagaauagguguggcucugcccuugggguuuggauaaaucuuuuggcagaagagggaaugaaaggauuccuguccgugucauaccuuucaacuuaugucuuuuuaaagcagaggggaaauggaucaagauguggcuaugacacagcaacauuuuaaaguuuucuuggaagcauuguaaaauccuauaaaccugaaaacccguaacuauggagcaacugugaacaccucaguuuuguuggagcccaauaaucuugaagagcuuuuagauagcuguuuuccaccccagacuagaagaguuauucuacagugcuacuguccuccuauaagggaccgucagaaauuguucccacagugguugcuuccacaaauguggaguuggauuuuugaucuauuguugugauucaagcagucuguugaauuaaaauccaggguuugaccgcucaacaaguaguaaauuaccuaguaacucagggacaacuauuucugaacuuauaaguggcacuguaauauacuuauuuaccuuuggauaaccuuguguuucuuugggcuagaucaaggacuacugggaagguaggagugguugccuuucuccugaagcucuuucccuucguuucccucauggugcccugaccauuugcuacacaugaaacgagccuaaauauuagggcuugcuuuucugucagaggugucaucugugccuuuccuaguguucaucugacaaugccucuacauuugacauaaacucauacucagguggcacuaaaccaggaggcauuucucccaguaauacaucaucauuaguguuaggcaauuauguuauagaaaaggucccaucacuaccccaaaauccugccaccuauguccacccaucagcuacucccacagaauuuuuuagauuauagaauuguuggcuguuaacuaauuugcucaaaguucuuguagaggauugcaaauuuuagucuguuuuuguaaugggauaauauugauggcuuuaugaccucagaguuuaaaauucacauggaauugauuuucuugucauuagaagguaaugcuugaacauuugauuuuucuauucugugauaccugggugucauacugucuaauggccuuuggucccaauugugaaauuuuauaugagcucauucauucucuacaaaccugcccccuuugggucuuggugccuauguaucauugucuggucucuaguugguggaauugcccuuuuuuguacugccacuucucaacauuuuugaaguuugacauaauguugcuucauuccaguuuuuuuuuuuuuuaguucuguaauuuguugacuguauuuaacuaugugagcuuuuuuuuuucugugauguuuacuguauuguaaagcaccuuaaucaugugaugggugcucuauaaaucaauaaaugaugacuuagaggcuguauuaugagcuauuuugguuuuagguuucaggucucaagcaaguugugggaugcuuuguauagaaacagcauauaauaccaaaugauacacacucagaaacuuugauggauccauaagcuuuauuuaaagaaggaauuugaaagcaagaguuaacuugacuuccagucugauaagaugcucuuuaaauuuccagugcauagucaaacaucauuuuauuguuuuaucagaguuucuguucauggugacuuagagguuugaaaugaacauuuggcagaacaauauuggggaucugucuugcuuaaacuagucugguucugccuuagagaucagcuaauucaugaggaaccuagacucagaugggaacuggaugaaaccaccuccccucuaaacaaauuggcaucccugccaagugugauuugacuaacacuuucucuuaaagauaauaguaucuacuugucuugaguucucagauaguucauaugcauuuagugguagaaacugauaacuaacuuaauauauugaugauuaugcacaucuauaaguuucuaguagcuguuuggccucuuccuuauaaacuggaagacuaugcagccagauaucuuagagcuaaauuagaaacaagaaacuuuaacucugauaaauauauuuggaauaaaauugcuauagaaggaccuggauguugcuccuguacucuguguacaaaucaugagguaaauaacaaguaguuuugcugcuucaaaugcaaaugaauagauuguugacuuuaguaguauguucuuucugcuaggcacucggcucccaaggaacuuuucuccuuaguccucaggaagauaaaggaggaacuaccucauucaauuuaaacuucauuuuucuggaagccugcagaacuugccagaguuuaguuugcagagaaaauuacuuuaugggugugguauuucugguuguuugguuacaggugugcaguccagcugucaagauaggauuggacuugcugaguugguaccuauacacugaccauuagugacacgaucacagacuugaauccuguucacauaagggaaguaaauuaaacagcuuucaauagccagacacaugcacagaaaguucuagacaagaagaaugacuuccugcagcagaaucuaaucgagaggcugagugaggguguuaucccagugucaaagggcuugccaaguauuuaaagccccagcuagcaccacaaacacacgaagggcuggggagauggcuccgcuugguaaaguuuuuaccauguaagcaugaggaccugaguucagaucuccauccagcgcagcaaugcuuaucuaaauuccagugcuggagaggcagauucagaaggcauuucuuggucugucaauccauauauuugagcuccaguuuuagugaaaaacuaucaaaaaaauacagugagcuggguguguugggguguaccaccuuuaauccuagcacuccagaggcagaggcgagugaaucucuuguguuugaggccagccugguccacagcaggaauuccaggacagcugaggcuacagacgcucucagaaaaaugagugaacuacaaaugagcaagguaccuugaccucuggccuccacaaacaug

SEQ ID NO: 6166 - RNA, 32621 nt, Mus musculus
cugguagaaacagacgacgcucuaggugauagcggugcuccucuguggucaucggcgacggcgcucuaggcggcgggagugaggggcgggcuuucgguggugcggccggcuggcagcuauggcggccguccgcggccugcgagugucugugaaggcggaggcccccgcugggccggcuuuggggcuuccgucgcccgagguggaguccgguuuggagcguggcgagccggagcccauggaaguggaagaaggcgagcuggaaaucgugccggugcggcgcucccuaaaggaacugcucccgguacgggcgagaggggcgggggcugaggaggucgccgggcgggugucccuggagagucagggaagguggcggacggcggcacuggcgcaaguccgggaacgcgggaaaggggcgcgagcgccgaaaggcgggggccgcgcaugacccggagagcgccagagagaaaggacgccggggcgcccggaaaugggugcagagagcgcuggagaggcgggggaucucggagagaguuggggacaccccucucgcugccccucgguggccccgaacggaaucagcuguguuugguuggagauaaaaaggagccgcgggcgggaacagaaccugaaucagcccucaaagaaaguguuaggugccgccggcauccaggucuccugguggguccuccuuccccggccgaguuggugucacuuaaaccagcucucuucgcuugggagggcuagaccugucaaacagcagacacucguguguugguauuguggaugaggguccucacguccccgcaccuucacugcgucuacucucgguggucccagcuucugacacacagugacauuugaucuuucuuuaaccacagugggucugaggaguguuuugccugugguuugguagucacaugccccuucuuaaagcuggucugaggccuggauagcucgguuuucacauacaacgugaacucccugcgcccccuccuuuaauuacaugauagcagcuugguuuuacauuugaaguuaugagugaaggcuaagguagugaugacaaaugacaauaccuuuggugacaacaucuauagguuauaguggauaguguauaggucagguguuauccauucagucaguuuaacauguuuauaucacacaccucucugugugcugguguaauccuaggugcuuaagagcgaacucccucuugguguugcccuaguaggggagacaaguaaauaguucccuuuuguauuaagugcuacaaaaacaaacacacacacacacacacacacacacacacacacacacacacacccuguuaauaggauaaaaagcacaguggccaggagggaugugaagcaguugguguguguugggaugcacaggaaagucccuugagauaguuagauucaacuugaaccccaaaugacaaaaaggggccgaccaugucaguuggaagggaguaauuccuagcggggaggacagcaagcucagaagucuuagagauggaaacaggauuguuuuguuggagaaauguuggauugucuuaagcacgagaacagaagucagaaagacagguauuguggaggaaagcaaggccuggagauugaaugcagaguccaggguaucagcugcaguccugagacuuuaguucuguuuuuauccccuccuuucuucauuguauuagccuguauuuuucccagagauccaggaccugaagcauucuccuggaggcauuugcgccaccuaguggccuuucgugggaaauguguccagucugguuuggggaguuaugugacuaucucauuuuugacauuuuuuucacaaaagacuuuagauuuucauuuauauagauacccugaguugacagaauuacuuaauguuaugaacaggcuccugccuggcgucuggaagccucucuguggagccucagagauagacuuccuccuaacaagaguuguuaaaauggagaagaguugcugaaaagaaugacuuccaaaagggccaguugccagguugccuuuucuguggauuuuucugucagaguuugucaucuuuccucuucuguuaggacacaagcagaagauaugaaaacaaggcuggcagcuucaucacugggaucgaugucaccuccaaggugagacagacugggcuauuguuugaucagcagauggaguuaaugaacuuggucuuuaccauuuacauucacacagcaguaaauaucuugccucauuuauucuuuuacugcugauauauaucucaucuauauaugauauguaucucauaguaucacauaucuacaucugucuacccaaggauguccuucuguauccagaagacauucaggcagcguuugugugugcucgucuccaugaaaagauaaucacuguccuuaguugccugugcucaauccuuuccaagaaagaguuugcacugggaaugcuuauuuuaauauuuauuuauuacuuaacauuuacuuauguuugauggggagcggguguuugugugaaagugugugugugcuguaacacuccugugaagucagaggacaccgucagguguugguucucaccucucaucuuuuuuuguuuuguuuuguuuuuuccgagacaggguuucucuguguggcccuggcuguccuggaacucacuuuguagaccagucuggccuggaacucagaaauccucugccucccaagugcugggauuaaaggcgugcaccacuaccaccuggguuuuuuuuuuuuuuuuuuuguuuuguuuuguuuuguuuuguuuucaucuuuuuuaauuuguuuuauuuuauuugaggcaagaucucucugcauagccuuggcuguccuggaacucacuauguagaucaggcugaacuugaacccacagagauccgccugccucugcacuucaggugcuaggaucaaaggcauaugccacugcaucuggcuucuuuuuuuguugguaguaguauuacgaaaauuauuuucaaguuugugugugagugauuugccugcauguaugucaguguaccacguugagaacgcgugugugaggcgcucaggagugggcuucaguucccuuacgacuggagcuucagauaguugugaguuguccuguggguacugagaaccaggccuggagcucugcaacaacagccaguggcuuuaucugcucggcugucucuccguccccuccugccuugaguuugagguauucucucaucucugccuccugucuccuguccugcuauacgaguguagagucacagcuaugugccagugucuggcuuuuacauggggauccagauucagguugucagguuuacauggcaagcacaagcacagccacagucacgccacgucccuggccuuggggcugcuuacuuggaugucauucgcacgcuuuaaaaacuguuaacagcacccagcauguaacugagcccuuaacgcauaucuauggaaacacuggcugucaaccuagaagaauaggguuuucuaguugucugccugucuaaccuuugagggccauaccaacugaguuauucccagcaucugacaauauugucuuuugcuaagugauugcuauuaccauuguaucaccuccauuauaauaccucagagugaagcuucuuaauuuccaugugauaaauugucaguacauugcuuuauuucaguucagacuuuuuuuuucuuaaagauuuauuuauuuuaugcauaugaguacucugucgacacaccagaagagggcaucagaucccauuacagauggcuagaagccaccaugugguugcugggaauugagcucaggaccucuggaagagcagucagugccaucucuccagccccagaccuuuucuuucuuccugauuuaaauguguacuguucaguuugaaacagauuuuucaauuucaguuauauuuuuuauuuuauauauguguaucaguguuuugccugcauauauuaggugcaccaugugcaugccuggugcccauggagguuagaagagggcaucagaucuucuggaccuggaguuacagacaacugugagcuacaccaugugcgugcugggaacugaacugucguccucuguaagagcccuaagugcuuuuaacugcugagccaucucuccagacccaauuuaugauguaaacaauaguauauauuuauauauuggaucuuuaaaaacaauaaauauaaguaugccauacauggcuuuuuauaguuucuccuucuccguuugugucagauacuuaaaggccaaaagaaagagccgagcaucuucuaguggagaaaauaguacaaagugaauguucucaguuucacuugagaagaagacuucuuucaacuugguauuauuuucuaauaugugaaacagauacuggggaaaagaauuuggcuaggagccgggcggugguggcgcacaccuuuaaucccagcacuugggaggcagaggcaggcaaauuucugaguucaaggccagccuguucuacagagugaguuccaggauagccagggcuacacagagaaauccugucuugaaaaaccaaaaaaaaaaaaaaaaaaaaaagaauuuggcuaggagauuuacuggcucagucaguaaagugcuugcuguggaagcauaagaauugagcucagaucccuagcacccauggguuuuuugcuuguuuguuuguuuuuuuaauucagagcaguguguuuguaucuguaaucgcagcauuaagaaagaccugcucccccauccucaaaugcacacaucuguuccuaccuauacacuaagcacauacacacaaauugaagagaguagauuguuguuugugcuaggaagacuucagugggggaaaaaaaugagccuaaccauuaggaaauaauagaagcaugcugcuuccucaugcccucaagcugguuuuagucaggccuucaguugcaguuacugaagggcccuugagagccaucagaaaaucauaauuggaccugaauuuauuuucaccuuuggaagaaauuuacaaaguuuuuccagcaguguuggugucuuugucacuuacaaaggaaaacaggcaauuccaugcacauaaggcuggaauagaggagacuauuuuugcucugguguuauuuuuaaauggggguguggcuuuuagggaguggaccauucaggcauacauaauguggaagagcauaauaggugugauuaccaugcccacagacaauguaaagugauaaugguaguugugggguuccuggaaauagcacuggaucagaucugcccuuagcuugaggagauauuuucugcaaaccuucuuccguuuuuuuguaucuucauuucugcacuaggaaaauugagaagguuagguuauuuguuuuaacuucuuggugugauuguuggugauacaugaaauaucagaaaacuuuauaaacaaguauucacugacuucuugacuuccuacuauguucuggguacagucauagguuuugauagaauggaaaugauuucagcaggguuacuguaugcuaugcauguccaguuuucugcaaaacacauucaagguugcuuauugugauuuauuugaagguugcagcauguuuaugauuuaacuuuccucguccucccuuucccuauuugccucuuuuuuaauuuucuaggaagcaauugaaaagaaagaacagcgagccaagcgcuuccacuuucgagcagaaguaaaucuugcccagagaaauguagccuuggaccgagacaugaugaagaaagguacaguguguuugggggagauuuuucauccugguucaagagugacuuucccugccguuguuucacgaucuuucuggcuuuguccuguauguccggucgucauccaaauacccaagaggaagggguucuaacaucaccuuuguaaaugugagacgcugucagauaguucucgguuagagcuagaagaguggaacagaagacagggucagggaggcugugucagaggggagccgugcauccuuaccucggaaccugcuccucugcuuucauccuagugauguuaguuagcuguuccuugccuuuaagaagaguggacgggcuucacucugaagcuuucuuuuagggcacuuggagcucuuuuggagcagcugggauuuuuauugguaauaaugcaugguacaugcaggccucucaguacuuauucucaaagagaccuaaaucaacuguagccuauuuuauuaagguauuuuucucccuagaacuuauagcaaggcaguugauaguggugggcuuuuuuucuuucuuuguggugcuagguguaacucugagacucacucaugcuaaucaagucaagucaccacaucccagcccaauuacuacuuuucuguuugcuugcuugaggcagcgucucauggagcucagacugauuucaaacugaagaugauuuuaaacucauggucuuccugcuucuaccucccaaguucuaagauucuaggggugcaccaugacucucuagcaaagcaguuuuuaaaaggagcgcucaauagagugagccuacagccuacauccuucucacugccuucuucuguaaguccaugaacaccccgacaguccucucugugcauuuguaaauauugguguuuaugaagggcucaggaggcagccuucugacugcguguugaagcucuggugcugugugagucucuuuagccugacugaugaaagcggaaggaagcccaggaaccugcugggugaggggagguggcuacuguuuguugagacugugcuuucuuagggcacugcguuaggcacauguuuguuucucacagcaagucucugaggaauauauuuuuuuauaauuacuuuacaaaggaagaaacagguuguagaaguuuaaugaguugcucagagcuaaugaaaaacucaggauucuaaccuauaucugucuaacuuuaaagacuuaaaccuuacuuuaaaaaaauuguuuuaguguguguaauuuuagucaacaauugcuuauaagaagagcaaucagaaucuuccguuucugccaaguuuuuguuuuagguagaaucucacauagcucauggacucugauccuccugccucugacucccaaguucugaguuuauugguaugugccaccauacucagcuaugcagauauuucauuuucaaggcaguauguuugccuggacaucgguuggggaauauugcucauuuuauagugcaaccugaauacaagccuaaggcaagauggccuaagauaaaauugugggcagaugcaguuggauaaguccuagagguaacuauuguuuuuguaucuccugaguaguuuaauguggagucaggauugggaaccauuggguuugaacaaagguucugaagcccauuuaccuggauucaaauucuuuuugucgcucuguaaccuuggacaaaauuagacagaacugucaggagucugucaacauguugcagcucuuagauuggugcuuuggcacauaguagguaucuaguggauguuaguuaucuggcguucuucuaaguagucaccugagcaaaccagcuucagagaggggaacugaaaugaguaucuucauacccacagcuauaccagcugucaacuaauuuuuuuuucuuauuaauaucaacaauaauaacacuuguuaaaugcuuacugaguaacgguugcucugcuacauggcuaauuuguccuuuagcaauccccugggggaugagaaaaucaaagugcugagagggagugaaaaacuugcaggacugcacuugaaggcuggacugacuagaagccgguguuuuuauuuugcuagcauucagggacacagcuuggcacaggcuacaucuaguaugcaucaacagggauuugcuacuuuuggaugucuauauaguagauugcuaaauagcuuugguccucaugucuccaggaucagagcuuuuaugguuggaagggaccuucuagauuauuuagaccagcucccuuccuaauacuucaggccuuuugucuuccagagaagguauacaaaucauuauggggcaggcagcuuugucuuaggacacuugccuguguggaacauugcucucuacgaguuucugucugguaaccagguugcuuugugacuccuaggaaaaccacuguuaaguacuuuccucuuucauacagugauggcuauagaaauacgaccucaggggcuggagagauggauggcucagagguuaaaagcacuggcugcucuuccagagguccugaguucaauucccagcaaccacauggugucucacaaccaucucuauagugagaucugguacccucuucuggccuacaugcaggcagaauguuguauacaugauaaaauaaaucuuaaaaaagaaagagagagagaaagaaaaagagaacuacagccucacugcccuucuuuucuaucuuuugagacaaaguguuaggauagcccagguggccuaaagcuuagguaguccucuugccuucuaaguacuggguuacuagugugagccaucucguuugguccugaccaacuuucuuuuguuugacgugucuuucuggucccccgucucucugggguuucuacauguccuuucuuaggugcuguguagacucuggauaugguaucuguguugaacagcaggcuuguugguccuuguccucucucuugugccaaccagggcaguggaccugucuucagcacagaaguuuccugaacguguggcucuuauccuaccugcugagugcugugcuaggguugcgggguugcaucaucacaccugguugauacaucacuguaucuucaccuugagucuguauaguuucuuuuuucuugauccaguugucagcugaguuguacaguguauuuccaucugcagagggacagcugcaccgauuuccugggcugugcacauugacucucauggcacaccauccacaguauccuuugaauuguguugauuuaguaaucuugucaaaaaaaaaaaaaaaucccagaacaugagucuaguguggcuuuuuucuuaguaaacccaugcuguuuccuguaggaaagauuuggugucuuaagggaucauagcugcugccuacuaaauuucagacugacgaagagcuuuguagucuguagcuugaauuuccuucucaucucugcaucagcgugggugggguuaacccuucucaaggcuucaagguaccucucucucuuucccuguucuacagagguggagauuauugccugauucugaagucagcauguugggauguaacuggacuagaagaucugagucucuggaaaugaucuugguucucuguugcuuuucauuuguguuguggugcugggauuaaaggcuugugccgcuacucccagcuagcugucagcacuuuuuuuguuugguuggcuuugguuuuauuugagauaggguucuuuguguaguucuggcuguccuggaacucagagaugcgccugccucuccuuccugagcgcugggauuaaaggccuugugcugucaguacauuugauaggccugcucauguuguucuggagucaugguccuugucacggcaagcuauugcagugugccagccgugaucacccugugauuauguuugcuucuagucucucuggcugugggcauugucucucuuuucugucuccagcauacugccuccugacaguucuacaucagcauuuucugucacugaaaguuucccuuugucccuggaauugacccccuuucgcucccgggcuugcaugcuagguugugcucaccuaaaugcuccuaugauuuucauagagccuucuuaaacuguuacuguauuugguuuuaguuauccuaagcugagggcuggggguugacuuuuuuggggguuuucugaaaucuccucuccucaagacuugaacuuguguccuacucuguugcuggucaucuuccuucccugucggagaauccaagauggugcccugagugccuggcuugagagcaacacugaguaaauacacaguucacuugccguaagucuggccaccuucuuaggcuuguuuuauuuugugucauugccagcaagguaagggccuuucccuuuggccuccuuccaugagauccugauuuuaacaaaguucuuaucucugggggcccuugcuucugccgaguugguuuucuuuugagagcaaaccacgugcacaugccagauaagugcuuucucgcugagcuccaucccuaguccuuguuuucuuauuuugagucagggucaggauggcuuugaacuuggaguccuuuggcaucagccuccuuaguaguuggaauuaaggccugugacaccagucugguuuuugaccugcuucuuuugaagaaaauuguccauugucaauggacacugacugcucuuccagaggucugaguucaaaucccagcaaccacaugguggcccacaaccacccguaaugagaucugaugcccucuuccagggugucugaaaacagcuucaguguacuuacauauaauaaauaaauaaaucuuaaagaaaagcgggaggggaggaugaaaaaggaaaaaaaaaaaaagaguacugacuguucuuccagagguccugaguuuaauucccaccacaugguggcucacaaccaucuguaaagguaucugaugccuucuucuggcaugcagguauacauucagauaaugcauuuauauauguaaaaauaaaucuuuuuuagagaguaaauauauaaaaauaaaaaauuuacaugaaaaaauaauauuuuucggccaucaguggagaggcccauuggucuugcaaacuuuauacgccucaguacaggggaacaccaggggggaguagugggggaggguuuggggggcuucugggguagcauuggaaauguaaaugaagaaaauaccuaauuaaaaaaaauaauaaaaaaaagauuuacaauaugaguuaaaagaauggaaaaaaauauuuuaugccagcaguuuuaauuaucaugauggaauaucauuucaaaacaguuucaaagggcuggugauguaacucagaaguaguaugcuugcuuagcaugcacuugacagggcccauaauauggaacaaauaaaauaaauaauaauuuuucuuuauucuuauacuaagaaaaguaauacuuuuuuuaaaauuuauuuucucauguauuacauacuggccucaguuucugcucccugcuccccugccaguccuucucccccgccuuccaucugggauucacucaggcaggccucccauggauaucaaccacacgugguauaucaaguugcaguaagacuaggcacccuccuccucauauuaagacugaaugaagcaacccaguaggaggaaaagggucccaaaagcaggcaaaagagucaaagacacucccucuuccacugugagucccacaagaagaccaagguacagaacaguaacaugugcagaaggccuaggucugacccaugcagucccccugauugucaguucaaucucugugagcccaggcuaguucauucuauggguuuguugugguguccuugaccccccugcauccuacaguccuucuucugcaggauuccucagguuuugccuaauguuuggcugugggucucuguaucuguuucuaucaguugcugggugaagcuucucugaugguaauuaugcuaggcuccugucugcaaguauaacagacugauuaggaauuguuucacugaccuuuuuuuuuuuuuuuguggcuggucauguuugguucuaugcugggucucugggcuauccagcuucuggauccuggcccuccaggcaguguggagugggugugggucucaagcuggacccuuucauccuucuuuuguguuuaaacuauuuguuuuuaaucuguaggcuuucuuuuaguauugugauaucuguuaguauacacuacgauguggugauacugaguuuuguuaccuuuuucaugugccugacucauuugauuuuaucagaugaacaaauaaguauucucccuaacacccagacuuuucccucuuucaucacugggaguuguuugcuuuuucuuuugagacaagugucucacugugcaguccuagcuggcccagaucucacuguauaaaccagacuggucaugaacuuagagcuccaccugccucugcuucuccagugcugggauuaaaggcguguaaugugccaccacgccuggcucugucuuguuuuuuguuacauucuguggaaccaucucuugacucaccauagccuucuaaaaucuuagauuucaguuuuuggcucaaggaacuaaaaagaauauagacucaccuuauacaagguguccuagaacucuuguucagagcaaccuucugccuuugccuucccggugcuggaguuacagaugggguacuaccaauaucaccaugcuuggcauagccccacauuuccuuuucucaaaucucugccuccugaaugcugagaguaaggccuacaccaucauacagaggccauauugccuauuuuuaaauuggauuuuuuuuucuuuuuaaagauuuauuuauuuuaauguauguaagaacacugucacuguccucagacacaccagaagagggcaucagaucccauuacagaugguugugagccaccaugugguugcugggaauugaacucaggaccucuagaagagcagucagugcucuuaacugcugagccaucucuagaagagcagucagugcucuuaaccguugagccaucucuccagccaccuuguuucagauuuuacaagcccuuuuuuuuuuuuuaaauauuuugcuuuguauuuaugaguguuuugccugcguguuugucuguguuccauguacauggagucccugagagcaaaucugaguacccugcaagaagaacaaaguuuucuuagcucccgagccaucugucaauccccuaagcauuucucaggugugcccaaccuaugcucuguugcauagcugcaugugccucagaauaacugaauguaccacaacacaaagcuauaaacuuuauaaauacaugauaagaguuuggacguaugaguuuucuguuuuguuuuguuucauaacuugauuacaugguucuccaacaugaacucugugauggauccuguugcaguauuggaagauuaggcauggcucuguacauuuugaguuaguaacuagccugcugaccugcuucuaccaucuaggcucaaccuacucaaaucuagucugggaccuucaaggugguacugucggugucaguguaaauugggauagcuguauggaggaaaauacuauguguuccuuuaaaaauuaagcaguagggagcuggagagauagcucagugguuaagagcacugacugcucuuccagagguccugaguucaauuccuagcaaccaugugguggcucacaaccaucuguaaugggaucugaugcccucuucugggugucugauggcagcuacagugugcucauauaaaauaaauaaaccuuaaaaaaaaaaaaagaagcaguaggacuaccauagaacccaguacaccacuucugagcagauagccaaagaaaagcaggauuugaagagguaucugcacaccugugcauuuuguuguuuauuguagcacuacucacauagccgggacaggaagcaaaguuaaaugcucauuucuggugcuagggauuaaagcugaggccuuacacaugcuaaguaagccccaucucugagcuacaucugccccacaagcugauggaugauuaagaaaguguaguacguacucccauggaauacucuucagcuauaaaaagcaaaguccuggcguugugcccgcaugguagaaguagaaauugguauaaggcuaaguggaacaagccugccacagauaaacaguagcacaugauuccauaugaacuuuaaaauacaagagcucaguagcaggugacagucagauccugcauaccagacugggagaaaaggaaggauagaguguuggagauaguugaucaauggcuguaguuacaguuuggaguaagaaggucugguuguggaacugcaugggaggguaauuauagagaaugauuuuguaauauauaucucaaacaucuaaaggaaaggaguucgaauguuuauaccagaaaugaaucauagauguuugcuguacuuuuuguuuuugagacaagaccuuacccuauagccgaggcuuuucuuaaacucacuauguagcucaaguuagcuuugaauucuuggugaucuuccugcuucagccuuuugaaugcuaggaucacuggccugagccagcacagcaugcacuguuuucauguaucaguuaaaagaaaaacaugcagccgggcagagguggugcacgccuuuaaucccagcacuugggaggcagaggcagacagaucucugaguuugaggccagccugggcuacacagagaaacccugucucgaaaaacaaacaaacaaacaaaaaaacagaaaagaaagaaaaagaaaaacaugcuucggaguacugagagcagaauugccagacuugcuugagaacaggaagggagguuauaagacccuaguuuucuaugggaugucuuauuugcauagauuuaaaaauuaauacuacuuguccagauuguuaggccucugucaucuccauacacgcacacgccaggcuuugucaaaugcauccuccagcgccccuccugcuccacuccuccccacugcucgugguccacagccccuucacgauuagucucugccugaggucuuuaaaggaauuaaacagaaccagguuguagauauauaaagauuuacaaauucuuuuuuuuuauuggguauuuacuucauuuacauuuccaaugcuaucccaaaagucccccacaugcuccccacuccuacuucuuggcccuggcguuccccuguacugaggcauauaaaguuugcacagccacugauggccgacuaggccaucuucugacucauaugcagcuagagacacgagcucccgggcgggggguggggggggguacugguuaguucauauuguuguuccaccuauaggauugcagaucccuuuagcuccuuggguaauuucucuagcuccuccauugggggcccugugauccauccaauagcuggcugugagcauccacuucuguguuugcuaggccccggcauaaucucacaagagacagcuauaucuggguccuuucagcaaaauucuuaaugacauauuuacauauuuuacaguuaauaagguuaaauaugauaaucuacuugaaguauuucauggaaacauucagauggcauggcuuucaacuuuuuuucaccagauguaacaguucuuuucaauguauugugaaugggaucaggcuuuuuccuauagcuacuaagguguuuaaugcuacauaaugauguauuuauuugugaaugugugcaugcuguagugugcauauaggggugugagaauaacuuucgggguuaguuucuuaccuuccaccuuguugaggcaggaucucuuucuucugugcuauguucuccaggccagcugacccaugagcugugucucugcuuucaucuguagagucugggguuacagaugcauuccacugcaucuugcucuuaauguggagucuaggguuggaacucaguuccucaggcuuauguugcagccagcccuuuaacugcugggccaucucccaggccucaggaacuguugguaugugaggagccgcccucacauuugccauuauaagauggcgcugacagcuguguucuaagugguaaacauaaucugcacacgugcaggggcaguuuucccgccauguguucugccuuucucgugaugacaacugggccgaugggcugcagccaaucagggaguaauacguccuaggcggaggauaauucuccuuaaaagggacgggguuuugccauucuuucucuugcuuucuuguucuuguucuuuuucuugcucucuugcucucuugcuuucuuguucuuguucuuuuuccugcacucuugcucuugcucucuggcuccugaagauguaagcaauaaagcuuuugccgcagaagauuccgguuuguugcguucuuccuggccggccgugaaugcuuguaagauugguaacuuuuuuuuuuucauucaguauguuuuagaaucucugguauauaaucucucucucucucucucucuauauauauauauauauauauauaaccuguguguuauauuuuaugcauaauuugaauaaaccauaaguuauuuaauauggguaagcuauaacuuauuacccucauggcugcuggauuauuagaaauagaccugcccugaacauugcuaugugagcuccuuugugaacucacauguguguuaggauugaggcgagaauugagauguuuuaggauaugugcuagaguacauucugauacccuuuggaguacccuugucuaugcuaccccuagcaggagaagcaacucuucccauguagccuauguaucaugcaaaagacaaaaucugcucaguaucuuuuucauugguuuuuagucagggucucacuauguugccuuggcuggccaggaacucacagugaucugccugccugucuccugaaugcuaggauugagggugucuacuuccacacccagcuugauauugucuuaauaugaacuucccaucucuucuuuuuguuuuguuuugguuugguuuugguuuuuuguuuuuuguuuuucgagacuggguuucucuguguagcccuggcuguccuggaacucacuuuguagaccaggcuggccucaaacucagaaaucucuucauaauuuuaccugucuguauaaauuguuuuacaccuuuuguucauuuuugaagguuuuuuuuuuugugauuuguaggauguccuuuuucuuuuggguguauaucuuugggggagggaggacaggacaguacaguuugagaaaggccccaauacugugaacagcccuaugcagcaguauauuuguuuauuuguuggugcuaaccccuuccucuaucugaguccuaccugacuauucugcaucccaucauuugcuuauugcaggucaauauaaacauuuaagaagucgacccuacccucuuguucuguguucuuuugaaauuauuacuguuucaguuucuuccucuucuagaaucauuaucuaaaccaugguaaaaaauucuuagcaagcuguaaauagcagguaggaaaauucugugucuuguuuuuuagcaauucccaaggugagacuggagacaaucuacauuuguggaguggaugaaaugagcacccaggauaucuucuccuauuuuaaggaauauccuccagcucacauugagugguuggaugacaccuccuguaaguauaccuacauuuucgguguaguaugcuuucguuuaugauuuuuaaggaguucuugcuauuuugauagugaauaauuauugcccaaacugccuaugcuuaacuuuuguccuuagccuaggagaaaaaaguucacaagucuuagucuagccccaccuggcguagcacugggaauucgcuagccuuugccugccacacgcuaggauuguaagugugugcugccacauuuggcuucaggcaguuccuugcucagaauaguuauugguggaauuggguuugggaauguagcucuggaggacauucaugagacauuugccaccauugucugcuuuuuucaugagcugguuuugauauugaccaacagccuuuguagccaguuaggcuguggcagugaaccugaugccaaaucugcucucaggaaguuacacucgggugugcugaugcucuaucguaggcaaugugguuuggcuggacgagaugacggccacacgagcucucaucaauaugaguucucugccagcccaggauaagaugagaagcagagaugccagugaagacaagucgucggagaagaacaagaaagguaacugcgcacaaagagggcccuugccgcccugugcaccgaucuguucagggccuugaguagauagagcauugugaauacugccucaccagaugccgcccugugcaccgaucuguucagggccuugaguagauagagcauugugaauacugccucaccagaugccgcccugugcaccgaucuguucagggccuugaguagauagagcauugugaauacugccucaccagaugucgcccugugcaccgaucuguucagggccuugaguagauagagcauugugaauacugccucaccagaugccgcccugugcaccgaucuguucagggccuugaguagauagagcauugugaauacugccucaccagaugccgcccugugcaccgaucuguucagggccuugaguagauagagcauugugaauacugccucaccagaugccgcccugugcaccgaucuguucagggccuugaguagauagagcauugugaauacugccucaccagaugccgcccugugcaccgaucuguucagggccuugaguagauagagcauugugaauacugccucaccagaugccgcccugugcaccgaucuguucagggccuugaguagauagagcauugugaauacugccucaccagaugucgcccugugcaccgaucuguucagggccuugaguagauagagcauugugaauacugccucaccagaugucgcccugugcaccgaucuguucagggccuugaguagauagagcauugugaauacugccucaccagaugucgcccugugcaccgaucuguucagggccuugaguagauagagcauugugaauacugccucaccagauguuucugagguaaacuaugauacuugggucuaucaguuaauaggaauagggaacacugggcuuuuuaaacuuuacgaguuuaugaugggguuacauuaagguuccucuugucccucacacuccauuuuagacaagcaggaagacaguucagaugacgacgagacugaagaaggagaaguggaagaugagaauucaagugauguagagguuaguaauagggcaaagauaucuaagguuuuauuggaaaaaaauaaugcuuacugucuuuuuaaaugucagauguaaagacuuaguaagcuauguucauguagccuuuuaguuuguguggauguaacaguucauuuuggagucuuagaauaguguucauauuuguguagaagagaaaauggguuuaauaagaaacacuuugaaguguuaucuaaaaaacaaguaguguuugucagaaauguuggagaguguucauuugaaauauuuggguuagagguggggggcuugcacauguuaggcaagugcugugcuucugaucugugcccucagcuaaguauauucauuucauguugaauuauuuaaaugguaaguguuuacuauauaccaaauucugggaacaaacuaucaggguuuuuuuuuuuuuuuaaaggcccuugccucacuggaggcugcauuuuagaggggaggacagauacacaguugcugcuaggagacacagugagcacucugaagacuguaaagggugaagggagagagauuaagggcugcagggauaguacauguugugcuugcaggggaccugaguuacacuuccagcauccaugugggauggcuuacgacugcuugucauacucacuacaggguagccaacuuuguucuguccucuguagacagaacucaugugcacauaacuccacacagacacuuuccugugcacauaauuuuuaaaaaguguucauaauaaaggagauagaaaaugauggggacuauuuuuuaggcgaguuagucaaggaaacccugacuucagagucgccguaggaauagaugcugugacacugaugggcagaaggcuucuuaaugggaacugcacagaaaaaguaugaaaaaugcuggaguuuuauguugaaaguguucuccuuuuuuuuuuuuuuugucuuuuaaguuggacacguugucucagguagaagaagagucucuguuacgaaaugaucuucguccagcuaacaaacuugcuaaaggaaauagacuauucaugagauuugcuacaaaagguaaacuugaucuuugguauugauuuuuggucagaaugaugaaauuacugaguaaaacuuagcuguugacuagaagcgaguucaaauaaugccaaagcuccuuuuaaacaaauaauuuaugaaaaagcagcuuacugacugagggggaauuucauuuacauuuguguuuguuagugugucuuuauuucacuguuagccugcaugccugugaugcacuugggucccauuuaauccuccucuuguucacacauccccuuccuuccccuuuugaccuccccuuuuacuuaacucuggaauuccacauauaaaaacaaacagggugcuuuguuuuuguuuuucaaagcaggguagcccugcucuguguaucccuggcuguccugaaacuggcucuguaagccaggcuggccugaaacucaaggaucuaccugucucugccucccaagugcugggauuaaaugugugagccaccguaucuggcuuaacacuuuguuuuuaugaaguaaauuuuauuaaaguaggagauuuguuggagccauaggugcugggcacuggaacaagggccauuggcagugcucaggaugcccucuaacaugcagagcccaccucugaagugcugcuauggaugaagauuuaguuagggguguacugaugagauccagggcuuuaucucagagauaucaucaugucuguggcaagagaguugacuuugaaaugaaugagauucccucagcacacacugaagucuaccacuguguccauccuggucguccuaguagguaacaaaguaguaaaggugcucuuucaguuccacugucaccacacuugaaucccccuggaaucacuggcucagggacucuaccaccacggccuaggccaguaucuaggaaguugguagaagucugguuuugcagaaacuccggaaccagagcugugugugcgguaccuuugccuuuggugucuuugggcugguuugaggugagaugaaguugaguagccuaggcaccucaguguaguagcaagugaauaccaaggauccccuuccucccacugggagagcccauuaucuaccaugucuaccugucugaugaaguucucaugucuugucauagaggaugcucaccuucacuagugccagcaaguaagccaguauuuugugcugaauaacagauaaaugaguauugcagugcugagcuuggucugucacaacuuccuagggaccaggaacacauguaggaauccacugauggucacagcaguguugcccaccggugugucuaccacagugccauaucaggguagcuuugcuguccuaucucuacauaauuucugugccucuauauuccagcagaagaaaugagcuugcugguaucuuaucucaguagaagaugccacugugugucccaauuugggacagugccacggggcuacuggaaggucuuuugggggcugaugaaaugggcuguugcuaauaaugucuugguaacuauggaagugcagguacucuacaguagcuguaaaagugguauauagcuuuuauaaaacuaucaaaguaguauauucauggauuauauagucuuucuuucuuuuuuuuuuuuuuuguuuguuuguuuguuuuuuccgagacaggguuucucuguguagccuuggcuguccuggaacucacucuguagaccaggcuggacucgaacucagagauccgccugccucugccucccaagugcugggauuaaaggcgugugccaccacgcccggcuauauggucuuucuauugcuauauugcaaacuuaccgucagcuugggcuacaugaaacccugccucaaaauacaaacaucuaaaaucaacuagucaauauuaucuucacucucacaggaaacccuaaguaacuguucuauuaacuuuagaugacaaaaaggaacuuggagcagccagaagaagucaauacuacaugaaguauggaaauccaaauuauggaggcaugaaaggaauucuuagcaauucauggugaguccaaaaccuuaaaauauaauggcuguuugucugguuuuguuaacacauaauaggcuucauuaugacauaaauguacauguagaaaaugcauuuucauaguuugauguuggccucuccuguccccacccacuccuuuccaacuagcucccuucuaccuugccagcucucuugugugugugagugacccauugaguuuuguuaggguuuuuacaggagcauggguaucuuaacaguagucacugaagaaaaucucucccucccccucaacuacaaauugcauauaaaucauggggcccugugugucccucccuauuccaugacggguugaugagcuuagucuuauguaguuuugugcagguauucacagcugaguugaggagugcuguauucgugccauacccaggaagucaguguugaccccaugucgcccuucuccagcucuuaauucuuucuggcccuuccuccacaguguuucuugaggcugggggugacauagaugucuguuuaugguuaggcacgcaggaguuuuuuauucugugcauuuugucaguuucaaguuucugucuucacugaugaccccugcaaaauguuuuuuuuugugggguggggugggggguuaaaacaacagugucucauguaacccaggcaagucucggacucuuauguggcuaggcagaaccuuggacuccugauccucuugccuccaccucccaaguguugggacuacagacaugugccaccaagcaugauuugaacacugcuugagcugcuuuucauccuuaguugguguucuguggcggaaugucagaaccagcauggacugaaggcuguggggacaagcucgugauucuuagcugugcaaugauaugagaacgccgcuuuggcaccuaacgcugccguuguggagcuggagugaaguggaucucagcauccuuccuauugguuucugauggugugcuuauuuuggcaauauugcaggaagcgaagauaucauucccgucgcauucagcgggaugugaucaagaagagagcccugauuggggaugacguuggcuugacgucguauaaacaccgacauuccgguaguugccugcucagcucuuggguagacacacacguuuggcucucaaaaucguauuuuuauucuuaacauagucuuuuaagguuccaaacuuuaucauccucucuuccuugcccccacccucugccaacauagaggaaaguaagucaagucgugguuaauuuuaaauugcccaugcaggaggucacaugauuuuauaaaacugaucuuuaaaaagaccauauauuacagagagaaaauuaaaauaaaaauuucuuaggaacuuaauuuuuccacuauuaaugucagcaacagcguggaaacaaccucaucaaauggagccuuuguucucccuuuccagugaugugauuggcugcugugcugaguguuuuacacauuagcucuugcauaugacugcugccaagacaugggacauuaugaccugaggcuuuuuucuuucucucucucuuguaucuuuauuauaaaggaaccauuuucauuaugauuucuaaaagauugaauuuuauuuugacauguauagucuucuacuuuauauagaacuagguaagucaguauacaaacaauauaaugugcacaggugccaaugucauugggaugagacaggaagagguggaauauauauucuuuuacuaauggauguauacacaauuguuucuuugaauucugcauauuaguuauacauauagcuucuguuaugcuuuuccaauuucaguuacuuuaagacauugcuagcugggugugugccacacgccuuuaauccucgcacucaggaggcagaggccagaggagcucugugaguuccaggacagccuggucuucagaagcuacacagagaaacccugucuugaaaaacaaacaaaaaagauauuguaaccuucucuuuaugccacuaagucaacuauccuaauacaguaacugauuucauuuuacauguaucuuauugucuacuuucaaaaaauuuaauuauuguaaguguauaccuuauauuuguuuuucccgcuuaacggcaagcauuauuucauguuuuuuuuuuuuuaaaaaagauuuuaucuuuaauuauuuguggcuagggcuugggguguugguuuguguagugccuguggcggccaggagagggugucagguucccuuggagcuugagguacaagccauugacucugguucucugcaagagaagugggcauuuuuuaaccacugagccaucuuucuagucuccuagcccauaaacuuuagaguuaauguugauuuuuauuuuuaagaguuaucaugugacaugaaguuauacugaacauugaguuacugcauauaaaacaucuggucuuacuguuuucaucaacugaucaguauguaaccuugcuguacccauuuuucuguuuaaagacaguugacuuaauauguacuauuaauuaauuggcauugaguucacagcugagggcacuauaacucaugcuugaacgaggcuuauuuaguauaggucuuuucucuuuuuuuuuuuuuucgagacaggguuucucuguguagcccuggcugaccuggaacucacucuguagaccaggcuguccucgaacucagaaauccgccugccucugccucccacgugcugggauuaaaggcgugcgccaccacacccggcugguauuuucuucaugaggugugccaccauccuuuuacaccagacaacauuucacuauauuuaauggaggcccuuuuuuuuuuuuuuucuauaacccugauguccuggaacacacuguuguagaccagacuggccuugaacucucagagauccaccagccucugccuuagugcuggaaucaaaggcauaagccauuacacccagcuugggaaaccauuuuuaagcagugaaaguagcaggugaaagcacacacgaaaaaagugugaaaacacagcaccuaguagauugacaagaaccuugcuaacacugaguaaugaauaagaaggugguguugcuguggccuuggccaggaagaacacaucugaccacucaggugucagucugcaagugucuucagauguucuuaacaguagcuugaguguugauuuaagagucacaaauaaaucugacagauuuauaaauauaaaacucaugaauaaugaagagugcucauguuguaccugaguuuaugcuacuaugcucaugcuguagccagucucuuugauaaacaggugaauaagauggcguccaggugacacuuguaggcagcacuaucucagggcgcauccuuuccuucuaccaauggagaguagaaaucauacuuguuaauuuagccuuuuuuaguacuaaccuuuuggguuacauuucuucaggauuagugaauguuccugaggaacccauugaggaagaggaggaggaggaggaggaagaggaggaccaggacauggaugccgaugacagagucgugguggaguaccaugaggagcucccaggucucaagcagccccgugagcggagccugucuaggcgauccagugcgagcagcucagacucagaugagauggacuaugaucuggaacugaagaugauuucuacucccuccccaaagaaaagcaugaaaaugaccauguaugcagaugaaguagagucccaacugaaaaguauuagguaaaauuauuuuccucuuuuuaguccguguuaacuuuaaaugugcuuauuuauuuauuuugucaauacugaggauugagcccaggaagaugucuuguguacauacgagguaaacacucuccuacugagauguauucuuacuccauaauuuucuuuuuugaggauuuugagacaagacagcauuggcuauccuggaacuaacucuguagaucaggcuggccucaaauucacagaucugccugccucugucuuccaagugcuggaauuaacgucaugcaccacuguacguggcuuugauuuucuuuuuuuaauuuuaauuuuauauguaucacuguuuugccuacaugagcuuuaauuuuauauguaucaguguucaugcuguacccucgaaggucauaaaaggccaucagaucccuuuggaacuguaauuacagaugauugugagcugucacgugggugcugagauucacgcccugguccugugcaauaguagccaguacuuuuaacaugcuuaacucuuuuuuuuuuuuaagauuauuuuauguaucugaguacaccauuguucucuucagacacacaccagaagagggcaucagaucccauuacagaugguugugagccaccaugugguugcugggaauugaacucaggaccucuggaagagcagucagugcucuuaaccacugaaccaucucuccagcccaugcuuaacucuuaaaagccaugcuuucacccccuauaguuuuauuuuuaaaugguaauuacaaauauaacucuucacgugauaaucauuuuuauucuaguuuccauucuuguaccaugaguguugaacacaaguggucaggcuuggaagcauguauccuuaccuacagagccaucuugcuagccuuauuuauuuauuuauuuauuuauuuaagauuggguuucacugcagagcccagaauauuuauuuauuuauuuauuuaagauuggguuucacugcagagcccaggcuggcuuuguauuugcauacuuccuucccugacauccuuccugcugggauuacagguguacaccacaccuaaugccuuuucauaguuacugacauuucuauuaauauugcccuagcuaaauagaucccuccaagucugccuugccauagaaaauaauccauguauuuaaaaaucuguauguguugcuagauuuccuucuuaggccuuugcccacauuacggcuugugacucauaccuucaccaggccuaggugcuacucuucucaauguuuguggaccucugaaauagagaacauaguuacuuuaaugagaggauucaguaaguauagauuuuauuuaaaucuuuuauaaaaauuuaaauuugagcugggcguguuggugcacaccuuuaaucccagcacuugggaggcagaagcaggcggauuucugagguucgaggccauccuggucuacagugugauuuccaggacagccagggcuacacagagaaacccugucucgaaaaaaaucaaacaaacaaaaaaacaaaaaaaaaauuaaauuugaagaaacuugaaaauuugaggcagggucucacuaaaccaaguaugcuggauuuaaaugugcugaguaacauauccagcaugugaaguugugagcagccugcagccugccuuaguguccaggucgcugagacugcaggccuuuauggcuuuguucacaugucugugcuuaguuuuuauagaacuaagaaagaauucuagcagaguaaugcucucucccaugaggagggucucaucuguaccugugugagcagaguuucagccucuuugcagcugucugcuuaauguuugcuuacccuuggugaagggagcaucaguuauguguucuaugauaaaguguacaggcaucauguggaaaccacccugucuaagucugcagucuaguuaauggucaccaucuuuucauagcauguugaucguagugagcuauuacagugguaguuguaagucagugacggucaucuuaaacugaguuuuucugaaguaggagacuuuuuugcaucuuuccucgcaguugaaguugguuacuuaugaucucucugcuuuuucccccccuuaaaggaaucccaugagggcagauaguauauccacaagcaauauaaaaaaccgaauugguaacaaauugccuccugagaaauuugcagauguccgucaucucuuagaugaaaagaggcagcauuccuguccacggccagcagucagcaguacuaaaccagguauuguucuucccucuuuugugcuccugacucccuuuuuguaagccccuugaguggcuugguuccaucccagauuacucuaacguuuccagccccucaguaugcaaguggccaagcucucugcccuguagaggaaagaaaaaguccaagaucuggcagcaaaaucccacaaaucccaggccacccuggaaaguaucccaccacuaccaccaaggaaaccuauauaaagucuggguccugcucaguucuuugcucucaagcagagguagccacccuccuguauccuucccaauaaauguauggugagagauuuguugugcagggugacuuugugguauucauuggcuucuaacugccacuauacuuuccccucagaguuaauccugaugcuugugagcaccugagagcagaugggcccaggguagguucuucugaacucaauuaacuguuccucuucuuguaccuacaucuuuaguuaggcguccaugagaaaauaaauaaagucggauuuugcaacaaaacuacuuuucaguauuuuuuguuugaaauaauaaauaaauacuaaauaauaauaaauaaguaauauuacuucccugggauauuuuauaccccaaaccaauaaaguugggugguuagaaacaugguugagugugaacuagaguguauaugugagcaaacccuaaugaagcaauauaagcgugugcuuauggcuagggcuggcaugugcaagucuuuggggaggcugcaacagcugccacagagcugcugagacgauucgagccgguuuuugaagaaagcagcuuuagaguguagucuugggaggacuaggacacagcugacaaacuaucuuuggagggaggaaauaauaugauucuuauuuuaagaggugauuuugaaggauuagaauauagugggcauagaagacaaaguaaaaagggcuaaacuuuuuagggacaaugacgucagaaggggugagaauggaacccugggaaggaggaggauggaagagaagcaacugaagaggcucagccugagcucuugugaggaguuuacuugagaagucaagaguaggcucaaggcugaugaacauguggcugcugucgcugcugcguguuaggggaaaccucaggcccagcggcucugugacggacuuggaagagagcacacuuaauuuaggacacagcuccuuuauccuuggccuguugccagucucauuacacuuguugguuaaauguaguaaguuuauugagaacuacuuguguuuucaaggauuguggcuugcaguauuguuagcuggaaaaugugauguguuacuuaguuuugcuugauucuggcaaaaaagaaaaaaagaagaaaaagaagaagacugcuucaggcacucagcugguagccccuacauccaaguuuuaaguuuucuuaagagaagcaagaccaguuaugaacagaaccaaccggcuucuagaagccuucugaugcugggugcugugccuucacuaugggagauuugggaucaggucucuagagagcuguacugauuaguuuguuugguuggugccucugccucuugaggucugggauuaaagacauuuaccaucaccaucugguggcuggccagacuuuuuuuuuuuuuaaucagcuuaagaguuauggaggagggaaccuuaacugagaaaaugccccugccggauuaguuuguagagaagccuauggugcauuuuccugauugccgauuacugugggagggagggcucagacacugugggcaguaccuccccugcacuguugguccaggaauaaggaagcgggcugagcaaauucgagaagcaagccaguaagcggcacuccucuguggcugugcaucagcuccugccuccagguuccugcucugugagcuucugcccucacugcuuuugaugaguuguuauauagagagugagugaaauaaaccuuuccuccccagguugcuuuugaucgugguauuuugucacagcaguggcagccauggcuaagacaaaagccuaguucauugguacugagguaaaacacguaugcuugguaacagguauacuuuuucucuuuuggcagauauucgccagcgguuaggaaaaagaccguauucuccagagaaggcuuuuaguaguaaccaggugguucggagagagcccucuucagauguacauaguaggcuagguguucccaggcaagauguuaaaggccucuacucugauacucgggagaggaaaucaggugaguaacacuucacagugauggaagggaaggaguggagaccagugguuauagcauaagaaguagguaggucuguguuuguucccucuucaguuagcaugacuuccuuugucuacaucagcaucagcaccaugccuacaggaaaguucaggaaggagaaaggagaagcuauacauccuugcugcuuuuuaguuucacauuauuuaguuucuuuguucacacauauaucuaguuuuuuuuuauguagccuuuuuuucuauaacucuuccauuuugcuuuacucuucauaaguaaauuaaaccuuuaauuaucuuguaguauauguauaucaccacauucuaaacacaugcuucuuuguaagguuuuaauaaaacacuucuuuugggggauuuuuuuuauguuuugcuuacauguuugucuguguacuguguacaugucuggugcccuuggaggugggaagagggcauuggauccccuggaaguggaguuauggacuguuguaagguaccauguggguguuggaaacauaaccagguccucugcaagaacaaguacgcuuaaccaauaaggccuucagccaauacauaaacacacuuuaaaaauguauagcugaaaaccugagaauugcucauaguaaaacagacccguucaguuugcagaaugugagaguuggcgguuucuuggcagacugagggguacacagccugggagagaggcaagugucuaguuugugccugguauggggacaccagccuugagcugugagcaucucccaucgagucucaggcuguccacuuacagacuggcaccaagcaccucucccgauguuuccugcagagcagguguuggcaguguccuuacuuccacagaacuacuugguacucggcaucgacugccaacugaagugucuucucaccccaacaggugguuuguggacucgcuuaggaucuacacccaagaccaaagaaaagaacacgaagaaaguggaucacagggcaucuggugcugaggaagaugacucggagcuucagagagcauggggugcucugaucaaggagaaagaagagucucgccagaagaagagucggcuggauagcuugccuucgcuccagauugaagucagccgggaaaguagcucugguucagaggcagaguccugaugcccuggccuuggcaacugcccuuaaaucugacauucuuacauaagguggggcgugcagugggaaccucccuugcaggagcuggcgcccuuuccuccuaccugcacccugaacacuugcuguccuaguaggacagcuuaagagugugaugaguuuugaaggaagggugucucugucuugugcugcagaguuacaguucuggguccucaagucuuccccaccaccccacaagcuuuacccuuggaguuaaaggcaacccuccagauuuuguagacauuuucuuaauauuuuuaacauugugucuuuuaaaagcaauguuuuacacagucauccaaagagccgagaacugaacuucucauuguugccuuggcccugacagaucuugccagcacccuguuccaagaaaagucaguucucaggugcuuacuggacagucuuugagggggaagaugagggaagcugccagcucagccuuccagggccuuagugugguggcuaagucucucagaccugaccugagacccucccgaguagauaugcuugcagcagcagucagcaguggcuuccauuccucccggggggagucuuuuagagccuuuugcuggcugguagccugguguaaagaccaaguucagugcuguaggacuucuagggacaaacaacugugacuucuggauuuggaguugauuucugugcuuagggguggggucuuggguugauguugaacaauuuuuaagucuguauuauguuuaaaaacuauuaaugacuuaaaaguuuaaauuuuuaauuuuuauauguggauauuccuccuguuggcuaaggggaagcucaaguggugucuuuuguguuguuaaauauacauuauauacuuuggaagaaggcaaagaaaggagugucauuauuuugaaugguaccaauuguauggucuguuguacuugaguucaacuugcuuuguggccacuguaggaaagaaacugcuguccaucugugaugggcucuuguuuauucccacuuuucuagaaaugauacccugagaauucacucuuugugucucugacuuauuauugaagacuuauucaaaacuagcaaauaagacaguaguuucagaaaauguaaguuuauguuuauucuccuuucaaaugauuuuaccauggaaagggaguaaguagauuauuuggcuucucaucugacuuuacuuuauaguauuuaauacuguauugcucuac

SEQ ID NO: 6167 - RNA, 941 nt, Mus musculus
aaugauaauaaauaaucagacugccaucccucaguucauccuccugggccugcccauccucccagagcagcagcaaauguucuaugcccuguuccuggccauguaccucaccacuguccuggggaaccucaucaucaucauccucauucgacuggacucccaucuccacacacccauguacuuguuucucagcaacuuguccuucucugaucucugcuuuuccucugucacaaugcccaaauugcugcagaacauucagagccaggacccauccaucuccuaugccgggugccugacacaaauguacuuuuucaugguuuuugcaaacacagagaauguucuucuuguggucauggccuaugaccgcuauguggccaucugcuucccucuucauuacaccagcaucaugagcccuaagcucugugugucucugguggugcucaccuggguauuuaccguucuguauuccauguuacacacccuacucuuggcaagauugucauucugugaggacaauguaaucacccacuuuuucugugacauaucugcccugcucaaguuggccugcucugacacuuauauuaaugaacuaaugauauuuaucuugggaacacuugauacuguggugccauucuuacucauuguuguuuccuauguacaaauugucugcuccauucuaaaguuuucaacuaaacagggcauagccaaggucuuuuccaccuguggcucccaccugucuguggucucacuguucuaugggacaauuauuggugucuacuuaugcccaucagcuaauaacucuacuguaaaggagauugucauggcucugauguacacaguggugacucccaugcugaauccauucaucuacagucugagaaacagagauauaaaagaggcccugaucagaguccuauguaagaagcaaauccccuuauaau

SEQ ID NO: 6168 - RNA, 1014 nt, Mus musculus
uguggaagggaccuugagaccucuucaagcugcuggccgucucccugugaguacccuccagagggcagccugcacaucaggguuccugagacuguagaugaguggguucagcauaggguugaugacaguguugaaaaucccaauagcuuuguccuuaucugaaaauuugguggaacccagucucauguaguuaaacaugccugugccauagaacauggcaaccacagugaggugagagcugcauguggagaaagcuuucuuucugccuucagcagagcgaauucgcagaacugcagcugccacauggauauaagagauaaaaaugagugccauagggguuccugccauuaugaaacccacuccaaagagcagcagcucauugagcuggguacuggagcaggacagcuggaagagcugaggcaggucacaguagaagugauugauuacauuugggccacagaagugaaguguggauauggcuacugugugugucagugcauugcuaaaggcacaagcccaggacauagccaccaagauccucuguauaguguaguucauucgggugcuguaagugaggggcuggcagauggccaggaagcggucauaagccauggcugucaacaggaaacagucaaccccagccagcagauggaagaagaagagcugugugaggcagucuccauauggaauuguaugcuuuuggaccaagagccgaaccaacauggagggaauagugacacugaugcaccccacauccaucacugacagauuccccaggaagaaguacaugggagugugcaguuuggguuccaccaagacagcugccaggaugcucagguuaccuccaacuguugucauguaagccaagaggaagaguaugaagacaaguggccacagcucuggugucuccaccaaacccagaagaaugaauucaguaauagugguuccauugauucuaggcuuugucugcaugaguuccuuuaaagaagcaugcaaggaggaaaaaccacagga

SEQ ID NO: 6169 - RNA, 51015 nt, Mus musculus
uagucuguccagucacggcgcggauuggcugcgcaagauggcggcgcgcuuggagcguagcaucugcguuuccaggagcuuggcugugugaguggugugggcuuggugauugcgggccuguccgcacuccguccgccugcuccauuggccugcgaggugcgugguucaaaaaucucuuauccgguugcgcacaaggaucgccuaagaagcggcucaccugcuuuucuccuccgguucucggauccuugggggcuuaccgcugggucagaagccggggacccgggcgggugugcgcgaaggccggcgguaggugggaggagcuggaggagagauggccucgucccucgccuaggccaaugcuuagagagcgcugaaacccaggggaagaagguguggaugagccggggaaguggcggaggagaagucaaguuugugaggugggggcgugaagagaaaacggaaguguuggggucuaggugggagacaucuguugaguuuucuguuccuccuaaaaacuuaaaaaaaacaaacccacaaaacaguuuguagguguagguguuuugccagccuggacgucugugcagcacgugcacagugcaggcagaggccagaagaggguugugucauggcacuaggugagcagccauacgggugcugggaaucgagcccugguccuuuggaagaccagcuggugcucuugaacgcuggucugucucuauugccuccauaguuugacaucauaaaagccaaauuuagaguauccuauaagcuucaguuuuagaagaaaugaugugugaagagauaaaggccaagagaaacccaggaaacaugaaguuuuaaagaggaaagaaggcuggccuagaggucuuuuggguuuuggacucgcuccgaugagccuuuuuuuguuauuguugagacucaacugggcugcccauucagaaagagaaugcugugugugucucacacagauggaaaguauuucauaguuauuuccuuuauuuucuuugguguugaugacugagcccaggccuugcacgugcuagacacaugcucugucacucggagcuagaucuccuggugacuucauauucuucccagucaaccaacaguugagugccuccccuuacaggcccuauuuugaguauugggguacagcagggaacaaauauguucccucaugaaguuuacugguagggaagguuuuuuuuuuaauuaaagcaaauguguggggaaugccaagugaguaaauuucaaagacagaaggugggcgggaggcuggagagauggcucagugguuaagagcacugacucuucuuccugagguccugaguucaauucccagcacccacaugguggcucaugaccaucuguaauggggucuuaugcccucuucugcugugucugaagacagcuacaguguacucauauacaaaaaauaaauaaaagcuuaaaaaaaagaaaaauaaagugugcguuccagucacugaauguuuuagugacuugcucaagaagauauaaauaagauggcauuugaccaaaggcuuaaagguggggauauguucagugucuguacacuucacuggggaguguaagccaugccaccugagcggcagcaagugccaguccagugugguggugcaagcuggaaucacagcacucagaggacaugggauucuagacuacuagccuugccuacagaguggguucccagugagccugggcuacuggagaccuugucuaacagcaagaacaaaaagacaaguacagcuaguccugaggcacuugauugggcaauggcucuuaggccagugugggaggaacagaguaaacuggugcuagcagacauucacuuaacuuugaggaaugggguggauaggcagauagaaauccagaaguuagucaucucggguguagcaguccuugauagagcacaugugagauacuguguuaaauucccaguugaaaaaaauuuuuuuaacaaaaguuaaagaaucaaacggagugacuuuguugaguaugucuguuaugaccugaauggauaguguagaaaaaugaacggaauuggccaagguuguaauugaacuugggucacauguucagaguacgugccuguaaacucuguccucuuuaaugugcugcagaguccuagugcaucaguaucucuuggacuuguuagagaagggccuacuuuuuguccggcauuacauggaagaaaaccauuacccucugauauucuuggggccuggggacugcccuugguuuaugcuuuuuacuccuaugucuguaaggggcauuugaauauuagggaauuaaaacugcuauauagugagcgucuaccauuuuguauguguguguguguaauccuggagacugaacccagggccuugagcauugugggcaagugcucugcuaauagcaauauccccuuaaggggugggccagcaaacuggacuuacuuugcugcuauuuguguguguuuguuucugaggcagggucucgcauuguagccagacuggcuguguaacccagacuuguuacaagcuucugcugauccugccucugcuucuccaguaccgguguuaccagcaugaguguuuucccccagcgcggcccccccuccccugugcuuuuggcacuaaauaugcugguuuccucuuuaucuuucuuacaucucuucuucccucucuuuaaagauggcucuaagcaaaucaaugcaugcaagaaauagauacaaggacaaaccaccugacuucgcauaucuggcaucuaaauauccagauuuuaagcagcauauucagauaaaucugaaugggagaguaagguagguaacuccuuaguuauuaaucugugucauucgaguauggucuggauggaugugauguggcaggaggcaagcugaaguagcagaagaccugaauguagccauauacaucucaugagaagucucacgugacuuuggacaaauggauuauccaccuugggggucgauauuuuacaucuaacaaaugagaaaauuggaaagucucuuaauggcuaacuuccugcuucugcaacagagacgccaguguaacccaggcuaggacugugcuuugugugauucaaugcuuggugaaugucacagucaccgacauugaggacagugcuaaccagaaugcuaaaacuucugccaaggauguagcuuaguugaugcaguugaccuggcauuuauggagcccuaucuauagccaugaauaaaccaggugugguggagcacacagcugugaugccagcccuugggagguggaggcaggaggaucaguucaagggaauccuuggcuacauacugaguuugagucuauccuggguuauuugagacuuucaaaaccaaagaaggcagaaauuaugauaauauaagaaugugagaaaauaaguguuauaccugagauuacagaugcacauaagaccaugccaggcuugucaacaaguaaucuuaacccaccccaacaucuuucuucagucuuuugcuucaguuguguaucagcugacuuccugcuacuguagcaaauagcaaucaucuuaggaagagagaaggcugcacuggcucagaguguuggcgauugugcucuaagagaaagugacuuuguugcugagguaguguauccugacuagaagugucucaggaacaguucauaacuuaggcauggggaaccagaagagaagggacagaauccuagccccuuuggaggcaugcccuuaaugacugaaaacacaagguccuaaugcuuccuaauugugcgaagcuggggacuaaaccuuuguuuuuuucaaucuuuugaguucaaggccagcuuggucuacagagugaguuccaugacauagcuucaugaaugcuguacugaaacccuaucucaaaaaaauaaaaacaaaaaagcaaacaaacaaaaaagcaauucauaguucugaguguuuauauugggguucuggcaucagcaguuauuuauguauuuaaauuugguauuuaugacuaaagaagaguccucaggagcuggagagaugguucaaugguuggagcacuggcugcuuuuuccagaagaccuggguuggaaucccaacaccuguauguugguucacaauugucuguaaacccaccucuggcacugcauggguguaguuuagacauacaugcagacaaaauguccauacauaaaauaaaggaauaguccugugucagggaaaguuauucuugcauuuaucuguauguugguggugaguaggcuuugugcuugccauauugaagucagaggacaacuugccagaaguuggucucuccuuccacuuggcuuccuggcauggaacugagaucuuuuuggucagguuugguggcaaacuccuuuaucuuucugccaccuuaaaauucagucuuuuauuuuauuuuauuuuuuaaaauauuuuuauauggauggguguuuugcuuacaaauaugucugcaccacaugugugucuggcacccauggcagucagaagagcaucuggcaucagauccucuuaacuagaguuucagacaguugugagcugccaugugggugcuaagaguugaaccagggucccucuggaggagaagccaaugcucuuuuuuuuuuuaaauagauuuauuuauuauuauauauacauacacuguugcugucuucagacacaccagaaggguugucagaucucauuaugggugguugugagccaccaugugguugugcugggauuugaacccaggaccuucaguagagcagucagugcucuuaccugcugagccaucucgccagccucgaagccaaugcucuuaaccacugagccauuucuccagccccccuuaaugguuuguaugauuuuacccguuuuuaaugcuauugugaauagagcuuauuauauguauuaguaaagcuuacuuuuggguggcaacugcauuguuuucuauguauaagccccucucuuaucugccgucauuaggcuaccucaguagcuguccauuugacaccaaauggagaaaaucacugacauacaugacuuuuacugcuuuguauaacuguuuguuuuagaguugauuauuaaguguguauauaugauggaaguuguauguggaaguucagaggacagcuugguggaauugguucucuccuuccaucuuuguguguacuggggagcaaacccaggucgucagguacuucacccaaggaguuguuuucuggccccagaucuuuuaaguuagcugugucugugucauuuuucccuucucucaugagacaaagucucuguguaccccuggcuguccugaaacuuaguacaaacuguagaccaggcuggcuuccaacucagagaucuuccugccucugccuccugagugcuagauuaaaggaaugugccaccauuaccuggcuagcuugccauuuaauuguguuaaagaaagugugccuuugaugaggcugguauuccuuuuagcaccucuaauaacgacagacuucacaccagugcuguugucucuuacgagcacuuaaaauucaaaauuaguagcuuugcuuuccaaauuucuuccuauggauuuuccaguuucaguucuucaaaacugauuauagaaaaagccucccaccuccauuaggcagguggugacagaggcaggcaaaucucugaguucaagaucagccuggucuacagaacgaguuuuaggacagccagggcuacacagagaaacacugucuucaaaagccaaaaaagggaaggaaggaaggcagcccuccuucuucauaggauaguguaucgaucaugggcuccuuauauugcuuaauaaacucaguagauggcuuuaauuuuuuuuuuugccuuaaauaugcucccacauaacuaguuuuuacaauugaaucuggguugaaaagaauguuuuuuucauuucuucagauucugcccugacaacaucaacauacauagucauguauguauaauguauacaaauccccuccaaacuaaucagagugagugccuuacuauuugccucacugugugugugugugugugugugugugugugugugugugugugugugugagagagucuucuuuacuucguaaaucuuuuucacucuguaugggggaagaggagaaggggcguuuggacuugcuguguagcccaggcuaguauuaaacuagcaauuauucugccccagugucuuggauccugaaauuacauauguaucuguccauucuuacucauuuauucacucacucauucauucacuuauuuauuuuagcccugacugguuucaaauucacagagaccugccugccucugccauugccuccuaaguaguggauuaaaaguaugugccaucaugcccagcuuacccucuguacauaagcaaaucauauggucagaauugaauuuaaagagauaacauuuucuuuuucauuuguuuuaugugugcacgugccugaccuuacuguacaugugugugcuaugugugugcaggagccucaaaggucagaauagggcauuggaucccuagguacuggaguaaguuauagaugauugugagccaccagcauggaauugaaccuggguccucuacaaggagagcuagugcucuuaacugcugagccaucucucuaggucauaaacagauaccuucuaagaacauuguagagaauggauugcagaguauuaagguaacuagacaaaaugauuuuaguaucccagauuaaguauauuagugggcuaucuaggugaaggcaauaaaugaaacucacagagauucccaaguacaacuagcuauaugugguagaaauuaggaagagaagagccagguguggagcuugagggaaggugguagugccauuaacaagaguauagaccaagggauaagcugauuuuaggaagauauuuucaguugggcauauaggaucugagggccuuggacuaccuguguagaauauuuaauaggcaguggacaaugaguucaaagaaagaggcacagugauugugggaucguuguuucugaaggcggaagagaagugaagcaggaguacaguguauaggaaacggaugcaguggguauggagaacugugcagagauguggauauaucugagaguaauugagaaguaacagacagaaagaaaggaaagacagcaaagaacauugaggggccggagaguugacugguggauaaaggggccugaggaccugagugugauugccaguguuccacaugguggaaggagaguaagcucccaagcucccacagauugccuuuugaccuccacaugaacacuguggcacaugcacacaaucaauauuuaaaagcauuauguagcauuuuaauuauuuauacauguaauucuucauauugaggagccugaaaacaguugcuuaauuugugauguaggcuuaaauuauaaaggguuuuaugcuugugaggcaagcauucugccacugagcuauuccccaauccuggggaacauaccucugugugugugugugugugugugugugugugugugugugugugugagagagagagagagagagagagagagagagagagaauauuuuagguguuuuguuuucaagauagaauuuccggugugcauuguuguucugugcugcagcucccucaaagucaagcagugugaaguacugacagugaguguuucacauuuucucauggaaaucuguccguuuguauuacacuuugaauuggacuuuuaguuuuuucuuccuuuuuggagacugauuuucucuguguagcccuggcuguucuugaaccccgucugcagagaccugguucaagaccuucuuaugcuuucugagugcugggccuaaaggcaugcaacaccaccaccuggcucaaaguugaucuaaaaguaaauuauuuaugggacuggagaguuugcuucagugguuaagagcacuuuacugcucuuacagaggacuuggauuugguucccagcaccuacuugguagcuuacaacagucuaacuaauuucagaugaucuaauacccccuuuuggugucugagggcacuguauacaugugguacagucaugccugcaggaaaacacccauacacacaaaacaaaaaaaauuuuguaaacuaagaguauuuauuaucuuuaaucauuugugugugugccuguacuugagugcagucaggugccaugggaugugugaagaucagacaggaacuagugggagucuguuuacccuuucuagcauguggguucugggguucaaacucaaauucuuaggcuuggcagcaccugacuuuauauacugagccaucuugccagucguaguguuuauuuuacaauagauauaaagaacguccucccuggcagugggcagagagacaccuuguuggugguguugcucuuaccagucagcggcaggacagacagugguccuucacucuuccuagcuugaugccucacuugguggccaagcuguuucaugccuggggcacauaaauuaaaaaaaaaaaaaacuuucacagaggaaagcaaauaugcguguaaaaagaagacauggcuguuguuaacguuuuuucuuaaguuuauauacuguuguauaugaguguguauguguguguggcauggugcauauguguaggucacagaacuuugaggaguugaccaacuccucuguggcauccagggauuggaucaggcuuguguggccagcuuuuacucuaucuccggugaauggggagcugaggauagggcacucagggaaacuguuuucucuaaaaauaaccauauuugcuuuugguuaucugauauauuuacuuaccguuuuaauuuuuauuaguguacaugugugugaugugugaguguuugcaggggauucuguggcauggacacauuuaucuauuuaucuaucuaucuaucuaucuaucuaucuaucuaucuaucuauuuauuuagguuuuuuugagacaggguuucucuguguagcccuggcuguccuggaacucacuuuguagaccaggcuggccuugaacucagaaauccaccugccucuaccucccgagugcugggacuaaaggcaugcgccaccaugccuggcggacggacacuuuuuuuaaaggcaagaggauaaacacauacacuggagacaggcuugcuuuuuaaaugucuacuaccuuuguaaauuuuuguuuaauuuuauuuuuuaugcuuauaccuguguguaugucucuaugccacauguguucuggugucacuggaggacagaagagagcucagaucuccuggaacuggaguuucagacaguugugaacugccaucugggugcugggacucaaacccaggugcuuggaagagcauccagugcucuuagcuacugagcugucuccagccccuccagaggacagcagaugagggucaguucuuuucccccccaucacugauugugugaaauugaacuaggucaucaggcuugugugacagaugcuuucaccugcugagcuaucuugcuggacaguuuuuacaggaaaaagaacacacaguuuauuauaugcuucaugcguaggacugucaguuuggccuaugcagaagggaucugcuauguguagguauagggcugagauggccacuguugacgauaugauccuugucucugcucuuuccuauaucccucacugcuuuguuauaaugauaucagacugcugcaauuuaauuuuagguuuuguuuuucauaguacccaacuccauagcaacagccugcuguuugugugagcucuguuaguugaucuugaacauaggugagauuaaaaacaaauuuuuguuuuuaaaccaaagacugacagugaagguggguuguaacuggucaccaguguucuagcaucucgucgaugauccagugauggagaacaguguugcagcagggcugacagcuuugauguucauugacacauuugagcucagcuucuuugguauuagaauuauuguuaggucauccuuguagaguggaaaugcguauucucaaacucauuucuagagaugauaacaaauaaaguacuguagccagguaggaaucauucuggggaagccaggagcccguugacaauaggcuguuuugugaagcugcauguguuaaagaaacaagaaagacuggugggaugaauaaaugcuaauuuucacgugagagcuaauuuuaguuccugggccucccugugaucuuggagaugagaauaaaaaagaacuugccugugcucaggauuugcagugucccagggugcuaacgugaccuagauauuuaagcagugaaguugugugacucgacuuugcccuacaaaauauuuccaacacuuggacuaaugucugccuuuucuuagaacuaaaaaaggaacacucaguuuuguuaauagagucuuagagucagcuuucauaguuuccacuuacucccuucacuagucuucucucugcuucauauacagugauuuuggugauagguucugugcuuucauuuauuagacuggggguggggggggggagagagagagagagagagagagagagagagagagagagagagaguguguguguguguguguguguguguguguauaggauugcuguuggaggcagucuugcucuauaccucucccugcuucacauucacccugaaguucuggauggcuuugaccuggcaaagaucuuucugucucugacucauaauugagaaagcagguauauccuuccaugccugacaguagauuuugugcaguugaagaucaaacccagcguuccugugcacacuccgugaacgcuguaccauggagcuauacauaccuaacccagcauauuuguauugcagggggaggucagagagacaggggcacuuuuuaauaauuuaauuuuuuugaaauuauauaaaauaucaucauuucccucuuuccuuucccaugcaccucuuguucucccgcaacuucauggcuucuuucucuuuaauagugguugauguuguuuuuggugguggugguggugguggugguguggugguggaugugugugugguauuuuugagacagaacuucauggacuucugauccuccugccuucuccucccaagugcuuagauuauggggauucaccaccaugcccaauuuaaugugguccuaggagucagucuaacccaggguuuuguacauaauauuuucacuucuacuuuuuuuuuccuuugcaacaggcagggucucacuauguagcuuugccuggccuguaccuuacuauggaucagguugaccucaaacucaagagaucugcccaccucugccuccccaguugaugggauuaaagguaugugccacugugccuguuagaaaauggaaaauuuuaaauacaccauuuagacgucuuagugggaaaaauuacagaaagucaucaguucuagauaguauaauggucauauggccuguguggaaaaagggugggauugagaagcuaggccagucaguaaagugcuugcugcacaaacauggugaccuuaguuuccuucccaguaccauugugaaagccuggugcacugguguauuccuauaauccuagugcuggagaggcagagagggaagauuccuggugcuugaacucuagguuucuggugaaccuggaagagugguagccauagcucuauauauggcauagugcuauaucagagcauggucccuuacuggcugcucagccaugaacuaaguuuguuucuguccacagauauaaagaccuugugucauuugauuauuuaauguuucuuucccugaauuguuauuuugaaagcuauuccugguaaauucccuagauuuguaacucuggauuuucacaacugggcugcagguaucauugagaaguuguaaggcaguaauuaaguuacuguuuaugcucuugagaaaaugcuuucaaacuuuguuuugggaggagcuucuagguuauuagguuccuuuaauuucuaaacuucuacauuugagaauuuaagacuuuacacauaguaugauaggauauuagauuaggcaauguauuggaauaggauaugaauguuuauuauuuuacuugaauauagauuucuuugguguguaggauugaauuuuauuuuuauuuuugguuuuucaagacaggguuuuuuuucugagacaggguuucucuguguagcucugccuguccuggaucccacucuguagaccaggcuggccuugaacucagaaauccgccugccucugccucccgaguacugggacuaaaggugugugucacuacuccccaauuguauuucugucauugaagacgaugacauuagcccacccuuuuaaugaacuugguugguuccauaggaguaaaauagaauauuuuguuaaguuuuuuuuguuuuuguuuuuagagauaaggucucuuuuacaugcucuggcugggcucuggaacucaguauguagaccaggcuggccucaaaccuaacaggccuguuucugccuccuaaguagggagaguaaaggugugugccaccacgcuuggcuguuacuauuccugaacacuauuaugcugguuuuguuguuguuuuuuuuuuuuuuuuuaaggcaguuucccuguguacuuuugacuguacuggaauucacucuguagaccaggcuggccucgaacucagagauucaccugccucugccucccaagugcuggaaucaaagguguucccaaaaugaccuggccauuucuucccccauuuuugaguguguuuuugaagaauauguuagugucaaugauguugaugauagcuuuaaaaaaaaaaagcaaaccagcauuuguaaaacacuuaauauguaucaagagcugcauucuuuucagagucucuuacauggcacugauguuggaacuccugccuuaacagcugagaaaagugccagccaggucauggcuuguccagaguuuagcuaagacagagaccagacaggacuuggagcagaggcccucuuaaccccugugcugcauguacagaugcagucuuucugguugauaacuacacugcuucucauaggcugugaagucucagguaccccuguguaucugcuguugugcugaauguuaaaugucacuuuacaugcgugauuucuuuaggaaauucaaaugggcauuggguccuugguguaacugcuugauauggcaaaagugcuagcuaguguaccuagugguguauauuaaucaguuuuguguucuuuuucucuacuccucagucuuaauuuuaaagaccccgaagcagucagagcucugacuuguacucuccugagagaggacuuuggacuuucuauugauauuccuuuggagagacuaauucccacaguccccuugagacuuaacuauauucacuggguagaagauuugauuggucaccaggauucggacaaaacuacucuccgaagaggaauugacauagguaggugguucuuacuuccauagguuuugcauucucaacucucccuaagcucuucuagcauuaacugggaaagcagcuuuuauuuggugcacauggaaguuucugucauugguuucuuuugagaggggauguccagguaaguuagggagcaaggagguuagagaagcguggaaggaagaaaagguccugguuuacuuagcuuucaacuuuuuaccuuagcaucuguguugguugggcauugucuacucuguuauuaaacaacuuuuaauuaaacaacaacuucuuguuguuguuauuauguuuugagacuuuguagccaugcaacuagcucuguagaucagagcuggcuucaaacacacagagaucuugccucucugccuacugagugcuaggauuauaggauuuaaaggcaugcacaucauacccaguucuaaggcgcaccuccccacacuguuuuauuuauuuauuuacuuauuuacuuuuaauuuauuuuuuguuuuuuuugagacaggguuucucuguguagcccuggcuguacuggaacucacuuuguagaccaggcuggccucgaacucagaaauccacuugccucugccucccaagugcugggauuaaaaggcgugugccaccauugccuggcuauguuguuguugcuguuuuuuuuaaagauuuaguuauauauuuuauguauaugaauacacuauagcuguauagaugguugugagccuucaugugguuguugggauuugaacuuggaagagcagucuuaccugcugaaccauaucaccagcccuucugguuuuuuuuuuuguuuguuuguuuuuuugucuuuuuuuuuuuugagacauccugacuguccuggaacuagcuguguagaguaggccauugcucugccucugcucccaaaugcugggauuacaggugcaugacagcuugcuuugucauaaauacuuaaagucuuggcuuggccuaacagaguuuccauugucuggucuuuacccugcucucuaagcccuacuuauguguuguuguuucuuuuguuuuccacacuugucuuguagaccaccaggccuuuuuguauguuauuucccauguuucaagcuucuuucaucuugaucuuguuuguucccauuaauacuacacuugucauggcaagucugcuuucucugaccuuaaaaccuaagaaagguuacuuucuuaguuaugauacaugguuaauauuuuuuaauuugucacuagacuacaaacuauaauuacaauagucucuccaggccuagcaaaguuguuggauaaauucauuauuuauauaauauauacuguagcugucuucagacacaccagaagagggcaucauaucucauuacagaugguugugggccaccaugugguugcugggaauugaacucaaaagcucuggaagagcagucagugaucuuaaccacugagccaucucgccagccucaaggcauuauucuuuuuaacauucaaaucuaaauacuuggugugaguuaagcacuggccaccugauggaguucaguuaaagcccuuaccuuuauauucaugguggaagauggccgauguguccuaggaaggcagaugccaacuugaccagugugguggcagguguuugugacccuggaacuugcguuauggcagugggaggauagcagguuguaggccagugcuggccugggcuaugcagugagaucagaacuagggaaggaggugggggaaagggacucuagacuauuagguacuaauugcauuuuaauuaugccccaaacccacuaaaguagcacuuggggauacacgagguuaauggauuuuaguucuucacaaggggcaaagcuugcugaaaucauagucuuucuaauuaggguucuauauaaauucuucccccagacucucaucagguugcucuaauucugugacuaugcuuuccauuuuuauuuaucauuauaaggauuauuacccacuuaacaugucauuuggcuuucugaagauaucagaauuucagaaaucaaguuuuugucuuuagaauugagggacaguguuagaaggguaagagaugggucuuugaccuggauauuuucccuuugcaauaaggaaggguuuguuguuguuguuguuguuguuguuguuaauuuuccaaagcacucuaaaugacucuaguuuccuggaaugcccaggcccaaauaauugugacucuuggggagcuggcuauccucuuccuuccgcgcaccucccaaauccccaauggaauguuugcaugacagcaucagggccaggagacaaugccauggcuggcaaagagguuaaguaaugcaguguuuacuuuggucucuguuucuuguugagaguaggucaugaggaagugauggggccugagggcuucaggaagccccuccagauccugcagagccacaacggaaucaggagaagcagccaggagaaacccuggcuuuccuucccuuggauguacucacuggaaucuaauugauccagauuuguuagugauugugaaagcaucaucuggggcuggagcgaggcagacaaguccacgguuaggggcucgacaugcagauuuaggaacaaaugcuggcuguugaagcugauuuuuuuuccccuccaugaagcauugacuucucaguaugucuuuuguaccugugcuagggcugguuaguguuugacaugacugacauucuccacaaccacagggaacuggggacacgcacgcacgcacgcacgcacgcacgcacgcacgcacgcacgcacgcaugccuguuuagcuuuuugaaacugaacugugucugucugcauguuuuguuuguuuucccccuugaaacagggucucacaaucagucuugcugccucugcuucccaaguguuagaauuacaggugugggccacuacauugauuugcuguggaacacugguguuuuaacagguaccauuguauugaagaaauuacaucuuacaugggauguaaagacuuuuaugaguaaauuaaauuuuagaaaauaaaguguuuuggccacuuuggguuaauauccuguuuuccugggccuucaguuauccacacuucauuuuacacacagcauacaagaguaggugauaaagguuucuguccucuaggaaaguuguucucugaguuaugugugaaaugggcagugagcccagcagccgcuugugaguuaagcuguggaaaccugaaagaauucuuaugaagaaaagggguuuuuauuguucucaccuuccccucucauaugggaugugcucugaauuuuuauuuucuagguacuggggcauccugcaucuaucccuuacuuggagcaaccuuaaauggcugguauuuccuggcaacagaaguggaugauauguguuucaauuaugccaagaaaaauguagagcagaauaaccuaucugaucucauuaaagguugguuccucuaaauaaauaguccuucaagcuucauuauuaaaaggucuuuaauagcuagguggugguggcgcacgccuuuaauuccagcacuugagaggcagaggcaggcagauuucugaguuccaggacagccagggcuacacagagaaaccuugucuugaaaaucaaaaaacaaaaacaaaaacaaaaccugucuuuaauauaacaugcauugcuauuauuaucaucuucugugggacuuuuuguuuguuugagacagagucucacuuucuaggccagguugaccaugaacucauagagauccaccugccucuucuucccaaguaaugggauuaaauguguguaccaccauggcccagccucagacauuuuuuuucaaaugcaguuuuucucucuaaucuaugccaugaaguauagauugcccugagauuugggauucuugcauaaaucauguggcugaguucuuugcuccaucuagauagaagucauugguagauaagguuauuguuaggcaaggaggaucaggcugugaguugggcagcuuuuguuugccucccaaguuuggcaguagugaaggggagcaguagguauguccucuagugucccucucagguucuucagcuggcuuucagagauccuuagucuauccucaccagccauugugacaagucauaguccaguggucugcugacagcguaacacgacuugacagcucucuagaacuugcagaccagggcuugcuugcauuugcauuuuuauguaaccuagagucacauaaaaauuucucaggcaccgguggucaugagugguaaaauccuaagaaaucuggccuagauuucaucaaggauggugguagcacaauacaugucugauauaaauuguuuuaaccagcucugccuguggcuaugccugcagagcugaggcaacuacugauaguuguaauuuugucaaugcaucaguggaacacaguucaggguggcuggugcugauuaagucaucaugguaacuagggagagccaguagcuguuacuugaguuacauuaucuuauuuccugaccucuuugguuguuugcuggaaaaugaacaacaggaagguaacugucugcauaaauuuaagguaggucuaguguaguggcacagguuaucuuggccacuugggaaacugcgguaugagaaucuauaaaguucaccaggucuaugacuugaguucaaaaucaguuugugcacuuagugagacccugccucaaaauuaaaagggcuagggauuuaguuccuugguagagcacuugccuugcauuugugagguucaauccgaaguacuacaaacaaaacagaaguuuuaaugacuuaguagcacuaauacugacuuuaaacuauguuuuaacaguacaucacaucuguccauugugcuagagagggagaguucccuuccugucucauucaaccaggaacuccaucuaaacuuuagaaucagcuuguuaguagcuaaaauuugggagugguuuuuaugucuugucuugguuugguuuucuuucucuuuuuccuuucaucaguuccuuuguguuagggaggcugggcacacagcugcaauaguguguguguagagguuagagaacucauagaagugguccucucuccaccagagggauggguuaguccucugguuuguguuuccaggugagguugacacucugcaaucugccuccaugguguuugcauucugaacaccucuuguguuuuuuguuuuuguuuuuguuuuuguucuuuguuuguuuuuuucuuuuuuuccuagugcucauucacugagugcauuuuuaugauaacccuaaacagugcugaaucuugugauagagacaguacauuucacuuagaugaguuucagugaguuagcaguaucuuugaauuuucaauaaaagcacuguguauguauugguauuuaaccugcauuuauguauguaccacauguguaccuaguguccaaggaggccagaagauugggucagaucuccuacagacaguagugcuuugccaugggggugcugggaauugaacucuaacccucuggaaaaacagccaguguucuuaaccuaggcacaccccccccaauuauuuauuuauuuauuuauuuugagacauguuucauuguguagccuuagcuagccugggaauaucuguguggaccuggcuaguuucaaacuugagagaucugucuugauuagaggcuugugccacuacaccugaccaauaauguauauuaaaucaauuaagccaaacacaccaaagaugagguuauauguccaagaggcuugcagaaguuguacuuguucuuuacuucccauaggaauuugucuuugcuaguucaguguucauggcaacuuuauagaccaucgcuaccaugaauaaugaaaaauagguauuggcaaaguuuugugucugagagugggugcacaugugcaugugccuuuggaagccuccagaagucugcaucagaguguucuucaaucauuuucuacguuauuauuuuaaaauaguuuaugugugaguguaugucucugcacccccuagcagaggccaaaagaaggugccagucagggcuggagagauggcucagcagauaagagcacugacugcucuuccagagguucugaauucaaaucccagcaaccacaugguggcucacaaccaccuguuaugagaucugaugcccucuucuggugcgucugaagucaguuacgguguacuuauguaugauaaauaaaucuuuuaaaaaaagaagaagaagaagaagaagaaggugccagucaguuccccugugauugaaguuauugguggguguuagcugaauuaauucucuuaaccauuaagacauaucuucaguuccuucauuguauuuuuugagacggggucuuacugugaaccuggagcucaaaugauucagcaggauugccuggccagcaagccucagggggauccuuucuuucucuguuucccuaguguugagguuacagggguaugcuaucaugcccagguuuuauguaggugcuagggcucaaauucaaggccuuaggguuauaugucaagcacuugacugacucgagucauggcccaaaucucugggcacaaauuuuuuuugggaggcaccuuucuauucuuuauuuuaaaaaaauaacauauagcuagcuagcugggguggugguauacuccuuuaaucccagcucuagggcagcagagacaaguagaucucugccaguuugaggccagccugcuuuacagagugagacugucucaaagaaagaaaagaaaagaaaggaaaggaaaagaagagaaaagaaaagaaaccaacaauaacaacaacaaaaaaaauagggucuagggagcuggagagauggcucagcaguuaagagcacugauuccucuucuagagcuccugaguucaauucccagcaaccacaugguggcucauaaccaucuuuaauagauucugaugcccucuuuggugugucugaagacaucaaccguguacucauauaaauuaaguaaauaaagcuuuaaaaaaaaaauauagggucuaagucuguaauucaggcuggucuugauuucucuaucuugcuuccuccuaugagugcucagauuauagcuacgugccaccacuaccugcuaaauuauaauauuucaauuuuaguguauagauauaugguagaacuaguccaacucuccuucaugguuuauggccauccaauauuaacaguuuuuaauuuuguaaaaaaaauuuuuaugucaaugaguauuuugccugcauaugugucugugcaccacauacauaccuggugccuucagaugucagaaggagguauuggcauuuuuuggaacugcaguuucagaugguugugaaccaucauguagguacagugagcuuaacauggguccuggaagagcaacaugugcucuucugcucccuagcuccuuguaagugauguuuuuguuuuuguuuucgagacaggguuucuccguauagcccuggcuguccuggaacucacucuguggaccaggcuggccucgaacucagaaauccgccugccucugccucccaagugcugggauuaaaggcgugcgccaccaugcccaacauagugauuuuuuaaaaguuggauuauuuuaguuuuuagcagaaugaacauaaauuuauuguagaaaaguuagaacucucaagaguaggaggaauuucaggagagaaaccucuuguuuuauuaagcugcauuuuacuauggcucuuuaggaaagagcuaacacuuuuuccagcaguguuagcacaaguuguucagagcagcacugauaaacuugaugcgucuccauugcugcaggucugccucucacugggaaggagugaaggaauuuuacacacaggcuugccgucauuuuccuucuugguuguguauuguuuugugcacuuauuuaaagacauuacaaaauaaguaguaacuaacaggccuugucaucucccuaguggugaaagugccgcagaagacacuccugauggaugcgcuuaaggaagagucugagauagucuaugacuucuguaugugcaacccucccuuuuuugccaaccaauuggaagccaagguacaguaccuuuaaaguuaccaaaugcuuagcuagcuuuuacaucauugcagagauaagaacaaaaggcaggguuuuuguuuuuuuuuuuuuuagagucuguauaauuuaaaaugcuguugguuugaggcauuugugaauccaguacagauagacuucccaguucaacaguuaauuucuguagcugagaaguucaguuauuaaggcuuccggagcaaugugguuaaggaauuuauacuaucauaaaagccuaggcuuuuguuuuuaauuuccucuggucuaauugucuuuuucuuuucuuuuuaaauuuauuauaugugaguacacuguagcugucuucagacacaccagaagagggcaucagaucccauuacagaugguugugagccaccaugugggugcugggaacugaacucaggaccucuggaagagcagucggugcucuuaaccuuugagccaucucgccagccccucuaauuuccucuuggcucuagccugccccucugcuauuuuuucuuaggcuuaaaacuuuuuuuugagacaggauuucucuguguaucccuuguuguccuagagcucacucuguagaucaggcuggguaggacuugugcuaccacugcccagcuaaaaccauuuuuaaacuuuaaauuuauuauuuaugugucugaguguuuugcccgagugaauguuuguacacaucaugugccaggaaccuucagggacuagcccuugggucucauggcugugagccaccauaugggugcugggaguggaacccggguucuuuggaagggcagccuguauucuuaacuacugaggcaucucuccagcgucuaaacuuugaacuuuuaaacuuggacugagcuuguuagucuaggaacaaaaauugguauuuuuugucacuuaauaguaaauaaauagcugagugucgaaaauguuuuucuggggcuggagagaugucucagugguuaagagcacugacugcucuuccagagguccugacuucaguucucagcaaccacaugguggcucacuaucuguaauggaauccaaugucugaagagagugacaguguauucacaugcauaaaauaaguaaaucuaauugaaaauguauuugccuuuagauaaugaacaaaaucuauuggauaaaauaaacugguguggagaccuguaauucccaguacauuggagggugaggcagaaggauugcaaauccuagacuauuucgaauuuaguaaguuuaaaccugucugaagcaacuuagugagacccugucucagaauuugaaagagaaggccaggaauguaucucagugguagaguguuugccuaguaugugaacggcccuagcuucaaaccuuagcacuguaacacccaaaacauaauauauuuaaaaauucaguguggagacuagcaagaugccucagcagugaaggcagaggauguggguucuguucccagcacucacauggcagcucacagccuguuuaucacaucaguuccagggagucugacccccucuucuggccucugggcaucaguggugcacauaugugagugcaaacacuuacacacauaacauguuuuuuagaaaguuacuaauuuuuuuaugcagggucucacaauucaggcugcugaaauucacagaauuuuuuuucuuuucuucuucuucuucuuuuuuuuuuuuuuuuugguuuuucgagacaggguuucucuguauagcccuggcuguccuggaacucucuuuguagaccaagcuggccucgaacucagaaauccgccugucucugccucccaagugcugggauuaaaggugugugccacuacugccuagcucauaaaauuucaaguacugugauuaugccaucaugcucauccccaaauaaauaaaucuucaaaauaaauuuauuuugacaaagccaggaauuugagcagcaauuuauuggaaauacuaacauuccuuauuagaaaauuauuuaacaauuuaaauaauugaaaaguuagcuuuuguguaaauuuaugaaaaaauaacccugucuacaguaacauuuuauuuauuuauuuauuuauuuauuuauuuauuuauuuacuguaaguacacuguagcugacuucagacaauccagaagagggcgucagaucuuguuacagaugguugugagccaccaugugguugcugggauuuugaacuccagaccuucggaagagcagucgggugcucuuacccacugagccaucucaccagcccuacaguaacauuuauuaaaaauguuguuugccuccauucaaaagauauggauagggcuuuggcuucuuaaagugccugucugacaugccagacauuuucuacauuggcugcugcuucugcuccagcuccagugugaguuccugagcacuucucagcaucugcagcugagcugugcuacccuagugagugugcaguguguuucagacacuccaggcugugcugcugagcaucuuuccuugugcacacuuaguggcccuuugcccguuuuccaugggaugauuucauuccguuaccuugccucacuuuuccccuuucuggguaaggguccagucagcuccuuacaguucuacacugagcuaauuaccagccugggaccuugcacauucuggguaagcccugugccacucacccuccacuuugccaauuuuuaaauugcguuauuuuagccgggcgugguggcgcacgccuuuaaucccagcacuagggaggcagaggcacguggauuucugaauucaaggccagccuggucuacaaagugaguuccaggacugccagggcuauacagagaaacccugucuggaaaaacaaaaacaaaacaaacaaacauaaauuggguuauuuuucuuccuacuaaguuucaaggaccaccuccccuacccccaaucccuggcuguccuggaacucucuguagaucaggcugcccaaaaacuuacagagauccucuuuccucuaccucuaaguccugggauuaacggcaugcaccaccauugccuggcuauuuuaaagauucucuauauucauauccuagacccaagucccuuuaauuguaaugauuugcaaacauuuucucauccugugguuuaucuacaguuuuccaugguuuauccuuuauaaugaaacuguuuuuaguuuugaugaaauacaauuuaucuauuuuguguuaugcuuuuugguguuauaucuaagaaaccaugggcuaauccaaguuaaugaaaauuuacuuuuauguuuucuucuugagaguuuuauagauuaagcucuuagauuuaggucauugaugcauuggaguuaauuuuuuuuuauaugaagugauguaaggauggauuaaauacuuaaauaugagaaagagaaccauauaaguauuagaagaaaacauaaguaaauauuuaucuaaucuuuggguagauuuccuggccaugguaucaagacagaaagcauaaaggaaaagcaacagauugggcuauauaaaagguaaauguuuuuauauuuaauccccagggccuugcgcaugcuaggcaagugcuuugucaccaagcuacagcucccacuggcuguguguucuuuuaaaucuuuaguguagcacaauaacaaauagauuacauucaaagacaguggcuuuuguuguuguuguucaggguguaaauucccggaauucucgaagaccuccaccuaguucuguaaacaccgggggcaucacagagauuauggcagaaggaggugagcuagaauuugucaaaaggaucauccaugacaguuuacagcucaaaaaaagguuacgguaaguacgaauuuugucucaugugauccuaaagaaaugauguugcuuuaaggaaaaguaaucacuguaauugaaaaauaaguagauaacauccaaagacuguacagauaaaagggagacagagcccagaugggcauauugcucccauuaguguggccugugauggaacaaaauccacucaaauauggcuuuugauuagaaaacagauggauuugaaucugucccaugaaccagaacccguuugcugccuaguccuuggagcaguugagguucuuggacucuguuuccugaaccaugacagacgugaggacauugagcugucaggaacuucaugacgagaaacagacuaccagccaucucagaaaacggcuagggcuguucuguuuuaaaagcuaauuauuuuggacaacacaccugucauuaaagaguguuagauucucacacaggacagcuugucucuuguaacuuuccacucugccacaugcuguuaauauuguagauaaugugugugguaauuaaaauauaaagagugcucaacccuaggauugaguuuuaugaaacagaaaguguuuuauuuuugugugucauaaaagcauaauaaaauuuacuauccaauaauuguagaagguuuauaucaggaagaggccauguuguggggaaugagcucaaggccucacuauggcaggcacagcacauauugaguuaccucacagccucauauuagcccauuuuuuuaaacuuguagguauauuuugccuguacguguauauauguguaccaaauaagugucuggugccugaggaggacagaaaagauuguuggaucccuuggaguagaguagaguuacaaaugcugugagcucaugugggugcuggaaauugaacccugauccucuagaagagcagucagugcucucaaacacugccccagcagauuagcaaguuuuuuguuuuuguuuuuguuuuuguuuuguuuuguuaaauauuuauuuauuacauguacacuguagcugucuucagacacuccagaagaggucgucagaucucguuacggaugguugugagccaccaugugguugcugagauuugaacucaggaccuuuggaagagcaguuaguguucuuaacugcugagccaucucuccaguccccagauuaucaaguuuuaaagucuauaguuuaguagugcuaaggauguucacaucuucagaccucucaguaguuuuguuuucauuguuuguuuugagucagagucucucucuauagcccuggcuguccuggaacuuacuauguagaccaggcuggccucuaacucauaagggaucugccugccucugccucccaaaugaugagaucagcauaguucuccacuauacagggccagaacccuugguuuuccaaggcuguaccugcaccucuuaagcagucccuguucccucccucauacagcuccagccacugucagguaacucaucugcaugaagccgggcagugcuugucuuuucuggcuggcuucuuucacuuagcauguuuucaugcuucauccaucuuguaacaucuguucucuuccuuuugaaaaaaggcaaauauuuuuguguaauuuuuguugcuguauucuguuuuuguuuguuugcgacaagcacuuuauguagaucucugacugguacuugcugguuuacagccuagcaaguaagcaccaacugcccaguucagggagagagccuuccucaggucuaguggaguaugacagaggacacugcacgcaucuccucuucugacuccuucaugggugccuaggaacccaccuccaggcuugcacaaauacaaacaugagucagucucuaaaaagaaauguucugccucucacacaucacagaagcccuugucuuaacauuaauguuuugcuucaauugauuucauuaaagacauauuagaguauauugaaagagaaaggcucaggcuaaacagccuugaggaaagucuugaagaaguaaauuuaaagaaagucagcagagcauguuugaagaagaaauaaauauaugagcguugugcucuagcuguggcauguaaccauaucaccauuucaucaccugcuggcuuuuguuucuucucucucuuuuucagaaauuguaucucauuuauguaguuuuuggcugcccuggaguuugcugucuagaccaagcuggccucuaauuuacagagaucugacugccucuuccuuaucaguauuaggaguggagucaucuaccaccaugucuggccauguguugacuuuugggagauugggccaaccaggaaaaagggggaaacuggagaugguucucuuaggcuacaauuuaauggggaggaagcuguuacuuuuucaggagaccuuuaaauuauacauuuaucuccacagacuuucaucugaacuacaaaaauaaguuuuaggcagugacguacaggccacaggcauguguuucauaagucuggguuuucugacucguucuucucugagcuuuugcugagguugacuaaggguuacugggggugcggggggggggggcguggccuuuuaagccaaugaaacugucuuugaguuuuaaaacaaauuuuaaaggaacauucuaaggaguagaaagcuauuuauuauauucuaggucugcuuauaucuggcucuacugcagccccaaaguugaauaagauguguaaaauuggcugagaaaagccauugugucucuggauaguuggccauuugggaaaauauuaccacuuacaauugauguagaaaguguucaguucucugcaguuaggacuuaggcagaguugucaccaucaucguugucaucaucguuauguuaaaucacuagugacucagcuuuuagacugcugcaaaagguguguauucugaggcucuaugaaaauaugagauugaagacagguaucuuagcuaguugugggguacaugccuuguaaucccagcauuuggaaagcagagggaaaaggaucagggguucaaggccuuacuacaugagacucuaccuugaaagaaaaaaaagagagagaaagaaaaaucucuuacauaucuucccuuguaugcaucuaaagcauuuuuuuucuuaaguugggcuuaauguugaaagcguuuguuccuccuuuagaagacucagggucaucccagcacccaccugguggcucgcaaccuucgguaacuccagaaagacaccaggcauguacgugaugcacauaauagucaggcaaaacaccuguacuuaagaucguuuaaaauuuuaaauguuauuguuuuucuucuuauuucugaagacauacagaaauucagaaggcuaaagucaugcucaguaacaauuuaguuggagccaccauauuuuguucugcaguugaggaacuugaaggguaaaguuaaacagugcguuuuacuuccaaggcaaauuuucugauacauuuuaguggccuguacugcaguucuguuucagaacugacaacaguugcagcauguagccauccugggcugcuucauauuggaagggggaauauaagaguuuauuuuuagccaugacaauuuagaauugaugucagcuuagugauggaguuugagauaaagcagaucucggcugcucuggugacuggaggccauugcuccagcacucuacucaugugcacuaagggguuacacucagccauuuucauuccaagccuuugcuuguaacauucuuuuuuuauuauaacuuaaguuuaaaaauuggcuuaaauuucuaacuauccuuucuccauugaaaugagucacaguucuucaaauuucuuacuguuuuuccaugggucagucuuuaaaaugacagcauuuuuuucaaauaauugauuacagagugggucaaaauaaacacaaggcuauaauaucuugcaaaguaagaaugaauguccccaaaugacauauauuagaaggacauaagaccuaauccaagccaaauuauguucuaaugaauaacuccauaaacagugaagcuaggaaggucaucguuuuguaguugucacaguaauaauugaucucugggagaaaccaacauugggaaauuugaagagcuggguauugccuggggacucuagcucagugguauaguaaguaugaagcaucuuuuguacauagguuuaauccuaagcauugaaaaacagcaaagaacaggguauuuacauaguaucucuccuuagaguacugacuuucaaagagugggaaauuuaaagugcagaagccacaaggacuguccccacccaugagcuccuggucugauaucccuagaaggacacaggagaaccuguguuucccucacaacaaaaacagguacuccaaaacuaauucacuuccugacaugaaaguaaugcaugaucaaggaaccauuucagauuaaagagacuaaggagacaugacagacaacugaaaugcacagccacgcacuggaguguguauacagggaagauugggguaauauuccaggccaggucauaauaucaugggaauauuauauuuucucuaguuuugaucuuugcucuguguuguuaccaaaaggaaaguccguuaucuguaaacuguacaugccaaaauguacaguucagcaauguuucaaagccaccucccaaauagguuagaaaagauacagagcauggggacuuguuagugggugaaccugggugaaggguguaggagagucacuuguauuaaucuugcaacucuaaccggccagaaauuauuucaaaauaguuuuucuugaaacuuggcgucucagaggaauugggaaaugcuguaaugagcagagcacugcuccaugauuaaaagcuguaauggguucauggucucucggggggccagagcuuccuuuguuccuuuuuguuccacuugcauuuugaugaguugucacaggguaucucuugagguuauagcagcauuuagugguuaggcucguuuacauaugaagcuagaaaggggugguuauaugugucuuugagacaauuuucaaguaucagggcagcuuuugaacucauuauuuaguggaugauuacuuugaauuucugauucuccugccucuaccucccaagguaugcaccauuuuguccauggcuuuguuugugcuacgcaagcaccuuccccugugcccccuuuuuuugagacagacucauauaaucuaugauugagacugacuugauucugaugcuacccuuccugagugcuggggguaauuuauagcuuugcaccauacccagccuguacaucuucuucuuuuuuuuuauggaucuuuuuuuuuuuuuaaagauuuauuuauuuacuauauguaaguacauuguaccugucuucagacacuccagaagagggagucagaucucguuacagaugguugugagccaccaugugguugcugggauuugaacucuggaccuucggaagagcaguugggugcucuuacccacugagccaucucaccagcccuguacuucuucuuuaaauguacuuaauaaaagaacuugggcugggaagagauugaguuuaaacuuggcuuuaguugguacaagaaccauuugagucaccuacuucuagaguuuaagaagugucuucugaagaauuuguaucuaguuaugagauuguauaguaaaaguuguuuuuaaauauuuuuuguagugccgggcuugguggcgcacgccuuuaaucccagcauuugggaggcagaggcagguggauuucuaaguuugaggccagccuggucuacaaagugaguucccggacagccaggacuauacagagaaacccugucucgaaaaaaaaaaaaaauuguauucaggcuagggauguggguaaauugauagaguguuugucuggcaugcaaaaauuugugggcucagucccaacccacaagcacugaacauacccagcauagugguaccugcuuguaauccuaacacuggggugagaugggggugaggcagagggucagaaguucaaagucauccaggcuacacagaaagauggaggguagccggaacuagacucucaaucucucuugcuucucacccacuuccccacuucuguguuucccuuucaugucuauauauucugugaugacuuaacucuuucauacauccuuuuuuuuuugguugauuuuuuuucuuuucuuuuuuuaaagaauuuuuuauuuuauguauaugaguacacuguagcugucuucagacacaccagaagagggcauuggaucccauuacagaugguugugagcuaccaugugguugcuggaaauugaacucaggaccuuaugaagaacaguuagugcuuuuaccugcugagccaucucuccaggcuucauugauuuuuuuuuuuuuuaaucuaauauuauuucuuuucuuuuugaauuuuauuuuuuaauuugcuuuucggaucuugacugcuuugucuuuuguuuguuuguuuguuuuugauauuuuucgagacaggguuucucuguauagcccuggcuguccuggaacucacuuuguagaucaggcuggcuucgaacaaagaaaucugccugccucugccucccgagugcugggauuaaaggcgugcaccaccacgcccggcugacugcuuuugucuuaacucucaucucuguccuauaaaaucagcagaauuguugggcuauauuugaauaucccuucccuauacugcaguuggaaauacgcuuggagcaguaagcucugacagccaugguuguaggacuuaccuucuauaauuucuuuccuucauuuguacacagaguuucgucacuuucaacaaaagaggcaguugccaugcuguccacuccuuuauuggcugaagugcagucuuauauccuuucuguauuucccagacuauuuagaauaaucauaucuuucaggugagaaaaucucaccuguuuuucucuacaugccuucagggucuauguuagagacccuguuagagcaguucagaacacaaguucuggaaggauucuauguuuucuuaauguagugccuaggguauuuauauuccuuuuaguuauauuucagagauuuauuuauuuuuauuuugaguuuuugccuguguauauguguguauaccaugugugugcagugccugugaaaaccagaauaaggagucacugaauugggaguuauagaugguugugagcuaccauuugggagcuggaauacugauccuggguccucugcaagaccaaauguaguaagcacuggagaacugagcugcuuauuuauuuauuuauuuauuuauuuagaugacuagguuucacugugcaccauuggcuaaccuggucuacauugugaguuccaggacagccagggugauuaagggcaaacauugacccaaaaaacaaucugaaaacaaaaaaaggaugugugcuauucauaucccaccuauaaguaguuuguuuuuuauuaauuuuuuuuaauccuuugugcacacauguggugccauggugagugugugaaagucagucucucuuuccaccauggcauccgguuauugaaugcaagucuuuuuuuauggggccauuuugccagucaacauagguuuuaaaguugccuuggguucccccugugcccauauuugucuaauuugugcaauuuuuguuauuuguaacuuaaacucaauauuuguuuacuucuguucucaacgcuuauaaccagucuccauuuguuuugcugcuuuuucaaggugguauagcuguaugcugggaaagaaaugcagucuggcuccacugaaggaagagcuuagaauccaagggguaaggccaugucauuaccauucagauguguccucuuaggucgaaauuuggguauagcagcuuucuuuauacccuaaagcuaaauguguuuuaaauuuuuuuacauguuuuuuuuuuuuuguaugaauguaucgucuacagguaagugugcaccuucaaaggucagaagaggccaagcccucuucuggagcuauggauaguugugaucuacccugugagcucugugaaucaggcuggguccucuacaagagcaagaauugcuccuaauugcugagccaucucucucuggccaauauuucuuguuaaggauauuaaaagcuacaaaguaaucccuauuucuuuaugaaaucuaguacugaaaguugcuuuuggcaggacuuugguuggcucuuguccuuaaaaaaguaauuaaaggccaggcgugguguauuuuauaugccuuuaaucccagcacucaggaagcagagcaggugguuuguguuugaggccauccugauauccauagcaaguuccagacaagccagggcuaaaaaugagauuguaucucaaaacaacaguaaacaaaggcuuccgaguggugaauacuugucugacgugcuugagguuggggcuguuuacaugugugaccccagcacuugguagagaaaagcaagagagccacaaguuggaggccaguuuggggccacauagccagccaaguccucugucaaagaaauaaagaggggcuggagagauggcucagcaguuaagagcacugacugcucuuccaaggucccgaguucaaaucccagcaaccccauaguggcucacagccaucuguaaugagaucugaugcccucuucuggugugucugaagacagcuacaguguacuuacauauaauaaauaaacaaacaaacaaacaaacaaacaaacgucugaagacagcuacaguguucuuacauauaaucaaucaaucaaucuuaaaaaaaaaaaacaaaagaaagaaaacuacuuaaauaauuuuauacugucuccagaaaacuguuuauuguuugaauuuaucuauaaauuuuaauauuuuaugagagguaaaaguucuguaaagagauuauguguuaccaggcagcuauauauacugcauuuaaaaaaaaaaauaacguuuguuaacaaaagagcaacaggaguuagcagccagaaacacgaguagagaggcuuuagugugaagauggguguggugucauccauuaguauugucaguacucaggagguugaggcgggaauaucgggaguucagggcauccuuagcuaccugagaccuucucuuaaaccaaacagaacuuccauguaagaugcuguguuugcugguuucagguuccuaaagucaccuucacagaguuuugucagggucggacaaugagaugggccuuagcuuggaguuuuuaugaugaugucacaguaccgguaaguaaagauuugccuuggcguuuccauaugccuguugugugauaagcuucgguagaccauacauacagucugauucugugguguucuguuuuccucaaguuuuauccagauguuuaugguaaaugaaaaguauuuguaaauaagaguaauccuagcauuuauuaguuagaaguuaaucauugucuuaguuuggguuuuacuguuguaaacagacaccaugaucaaggcuacuuuuauaaggacaacauuuaauuggggcuggcuuauagauagguucagagguucaguccguuaucaucaaggugggagcauagcaaugcccaggcaggcauggugcagcaguugcugagaguucaacaucuuguuccaaaggcagucagaagaagacugacuuccaggcagcccagacgaggguacccauguccacaguaacacacucaaucuugauagugccucuugauagugccacuuccugggccaagcauauucaaaccaucauagucccacuccuuggcccccauagaugcuuucaaacaugagucuaugggggcuauaccuagcauaaugcaaaauacauuuaacccaacuucaaaauguuuccauaguuuguaacagucugaacaauguuaaaauuucaaagccucuucugagagccauccaaucacuuaacuguaauccccaaagaaagaugggaaaccagcugggcuguugucagacuccaaacucugcaucuccaugucugaucuccuagucuuguuucaucuuuguuuucuucuuuuuuuggggggugggugggguugagacaggguuucucuauauaguccuggcuguccuggaacucacuuuguagaccaggcuggccucgaacucagaaaucugccugccucugccuccugagugcugggauuaaaggcgugcuccaccaugccuggccuguuguaacuuuuuuauugggggggcuugaacccagugucucgaucauagugggcaaaugcuguacccuuacgcuauacucccagcucuguggcuauguccuuuucguguguaacacuuugggauugugcuaaucucaguaaaaggcucugguucauguuucauaauuaccauuagaaaguguauguagguagcaugugccaguagucccaaggagccagccucagacagagagagcagcugggauuguggcucaguagguaagagugcuuucugcuuuuccagaguggaguucagaucuuaaaccccacaucugacaggucacaacaccagaaacuacagcuccaggggcuccaguacccuccuggucuccauauguaccugccugagugugugcaugugcacagaugagugcauguguguaugcucacaugugcacaugcacacacacaaacacacacaaaagccacucauuuuuaagauuuauuuaguuuauguauaugaguggacuaucugcaugaacaccugcaugccagaagagggcaucauauuccauuauagauggucaugaguuaccaugugguugcugggaauugaacucaggaccucuggaagagcagucagugcuccuaaauguuuagccaucucuccagcucaaaagccacaucuuuauuuauuauuuauuuuauaagauugguucccaaauuucucucucucucucucucucucucucucucucucucucucacacacacacacgcacacgcacacgcacacgcacacagacugagugguuucugagccucccugggaagugaugguaagcagcaccugucuguucuuauaugucccugcaagaguggucugcuuuuuguugccuggagccacacauucuaaccuuugcucagcuauucagcucuucucaugguguguauggaggcuaguagggguucuugcaggucucuauccgggucuguauagcaggcuuguuuugggagugucucuucuaaggauuuggccauucuugucuucagagguauccaaaauguuguugucuuugagauucuguugcuauagacaaagagguagaugugugugggagcacagagggacgauuugcauaugcuuccauguuucugaacauaugaagugcgauuugaagcugagccaacaacuaguuguacugcaggauugaaauugcuccuauagaguguccuuucuauggaagccuggguuugcuuccagauuuuuggcagggcaccuaaagcuuaguguuugauuugaucacuaauuaaaaagaugccucugcuuuccauagcuccacccuccuucaaauauuauccuauuguuuucuagacuacuaggaucugaacagcagaugguucaaaucauuagcagugccccaaacuguccccauacagacacaaacagcugugggaaaucgaagcagcaccugcuuccaagagugucugcauuuuuuuuuuuucagagacagggcuucucuguauagccuuggcuguccuggaacucacuuuguagaccaggcuggccucgaacuuagaaauccgccugccucugccucccaaguucugggauuaaaggugugcuccaccaucacccagcgagagugucugcuuaaccugcagcccacauuuuugacacagcuggaacaagcucaaaaugggcucugauacuccccgaagcagcucagggacauauuccuuugcccucuuugauugagggagucaucacagaugcuaguguugaagggcaagugucuuuuugcaaagucagcgucuaucuaucuaucuaucuaucuaucuaucuaucuaucuaucaucugucugucugcuugcuuagaaaaggaaaccaugaacagccuuucuccuuuucaugguaucuuauagccuugcaguuucuagccaucaaagaaugccacucaauaaaggccugagauuccuuccuugcuacacaguauuuuucccuccacaccacugccaucaccccuaagcugcuaauaaugcauuccccaguguucuauuagaugcacugaaacugcugggugucuauguguggcaguuucugauuuguaguaacccagcaacaguuucucagcacuggcgcucaugaucaacgauggccuuuccccaggguagauccagguuacucaggagauuucggguugaccuuccucuugguuccccugccuugugggaagcucaccugacacuccuuucuugaucuuguuagggagcgggcaggaggagaaugcucuuucagucuggagaggaagacauggaguagaccugguuaagcagaaacacugaccuacuuccccaucuccagccugccguuuagcgugaugugcaaguuccuaugguaacuugugauuucucuuaucuuaggccucuuaacuuguuucuguuggugcugaaugcugaaaauucuaauucaagcaauucaagugcuaacacuaagcccacugcuguugucuggacucauuuuagcaacaaaaagacagugcuaauguugguagaauuuuugugucaacauuucugacugaugaggacauggggaagcaguguaaggcuguucuccauagaauggcugacaagucccuuuuagagccccuuuccccaggucucuaauucugcaagguggggcauuagcucuauuuugccuucaggaaguuugauguuggugaaggauacgguagagagugacacauaguuguaguaaacuguguacuguugauaugaacauugcccaggaagcaauacugguuuauaaaguauucacagggcugggggagucaagugcucagugguugcaagugcuuauuguucucucagaggaccuggguuagguucccagcacccauguaacagcucacaaacaccuguacguuucauuguagggaaacccacaccuuuuagucgccaugggcaccagcaugcauauagaaagaaguacaugcauacaugcaaggcauuucccuuagccugggcuaccccauauagcuuauuaacaaggcuuuuaugauuagauggaaugauuuaaaauaaaaauuuguggguuuuuuuuuuguguuuucuggcuauacucuauagauuuuguuuuguuuuaggauuuauuuuuaacuauguguguugggaguuauguguacaaaagggaaugugcccacaaaggccagaggaaucagauacccaggagcagggguuacaggcaguugugagccuuuuaagguagggaguugaacuccucagaaagaguagcaucuccucuuaacuccucagccaucucuacagcccuggugguuuugguuuuuagguuuguuuuuguuuuuuaauugagacauagucucacuaugcagccucggauggccuggcuugcuauguuaaacaggcugaccuugccuccugagugcuaggauuaaaggcauacaccaaguucgcuuuagauuuucuuucuuagaaaaauguuuuuauuuauugagauuagagagguagcucagcaguuaacaccacgacuguuuuucccaagauuugacuccuaacauccaaaugaggcggcucacaacugucuuuauaauuccauuuucuaaugcucugacauccucuggccccaaagcaccugcauacaugugguaacacauaaauucacauagacauacccacacaaaucuuuaacauuauauauguguguguguauacauauguauauauauuguuggugagcacaugcauguauauguauauggggucagaggaaaacuuguuggagccaguccucucuuccaacuugagcuccccccccccuuuaccccauagucaggcuuguggagcgcuaccuguacuugcugaaucaacuagacaggccccuucauagauuuucuuuuuuaauggauuaugguucuuguggucucacagcucacaccacugagaacacauccuuucuaugucucuuuuuuagaaauauuauuuaauauauauaaauacaauguagcugucuucagauauaccagaagagggcaucagaucccucuucugauacagauggugagccaccaugugguuucugggaauugaacucaggaccucuggaagagcagcuacugcucuuaaccacugaaccaucucuccaacuccuucccccucuuuuaaauaauuuauuuaauuuuauuuuaugugcauugguguaagauugucagaucucuuggaacuagaguuacaaucaguugccaugugguugcugggaauugauccuggcuccucugaaagggaacacaguccucuuagcugcugagccaucuugcccagccccuucauagauuuuucaagacagauauuugaaggauucuaagcacaugucucaggguugacagcuggaauuugggggugaacaucaauuugggagcuggagagauggaucagcaguuaagagcacugacuagaggagcuagagaaaguagccaaggagcuaaagggaucugcaacccuauagguggaacaacauuaugaacuaaccaguaccccggagcucuugacucuagcugcauauguaucaaaagauggccuaaucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaaugggaaaaaaaaaaaaaaaagcacugacuacucuuccagaaguccugaguucaauucccagcaaccacaugauuguggggcauugggcuaauacacagacaggcugguauccauccagucaagcugagauguugaacuccgggacccgguggugauaauucaccuacaugggacagaaggaguucucucaugucuccuggacccuggcuccugucaaaguuaccgcccccucagcccccacaagagaagaguggucauuagucauguaggcaaugccccaagcuucugaccuucaggcuagacuccuccccaguuaccuagcaacagaaaagauagcagcauacuuuaagaggagcuguuuggcuccuccucacucucacuccucuccucuuugucuucuccucuccucucucuuccucucucucccucuuacucuguagcuuuucuucucucuuucucuuucccccuucucuccucuuggccauggcuggucucucucucuuuuaccuuuucucuuucccccaucuuucuauaauaaaguucuaaaaccauagacagucucugcucaucaaggcccgcugcacagacucucuccugugugggaaccucucucccucagcccucucucccauaacccaggggcaacaggguguuccccccaaccccccguuaagggcugccccuuguccacccccugucgaguagggucagugacuuagaugcccacccauggcccaguguaaaguguccggcagcccucccgugucugccugcccagagcauagguggaacucuggccagaugugggcuauccucccuccuccucuuuccccugccccuacuuuuuaguucccacacaugguaacucauaccaucuguaaugggauuugaugcccucuucuggugugucugaagauagcuauaguguacucauauaaauaaaauaaauuaauaaaucuuuaaauaaaaacaucaauuugguauuuuaugcuucauuuuuaaaaauuuauuuauuuauuauaugugaguacacuguagcugucuucagacacaccagaagagggcgucagauuucauuacagaugguugugaaccgccaugugguugcugggauuugaacucagguccucuggaagagcagucagugcuuuuaacggcugagccaucucuccagcccagguuucauuuuuuuuauaugugguuuuuguuuuguuuuuguuuuuguuuguuuuaaaaucagauuuuagcuaugaaauuuauugauggaauauuguuguuaagaaauaguuugggaagugauuguacgcuuuaguguuuauauguaaggguuggguuuuuuuuauuucuuguuugguuuuuaccuauuuauuuaaggguaggagucucauuguuguugaucuggcuggccuggaucgggugugguguuucuccuuccucuccuugguucugagauuccggcaugugcuuccacaccaaacguuaaaaugguuugugaucucgaaccguaccaggcuccauaauaggcuauaaaacagauggaaugguuagggaacugagcaaagaaaucagaaccuuuuuaguuccuuuuagguuuguggcggaguacaacaaaccugagacagugccuguaaggacugucuaggcauaagugcugaggugacugauagggguaagagcauucagaaagacacagggaagacuaaucugcucagacaucacuucagagaggaagauucgcccaucuguuucuuugucaguuuguccuaaggaagacguuguugaauguuuaauggaacagcuuaagacauacaucgaggccuugcccuguguguagcacaucgcaugguuuuggaagguuugcggugcugcauauaguuuuuauuuaaauacacguagcauccucuuuuuauuaaaccaggaaacaguucuauggagagugguaccaguaccuggaggcugcacaaagucaaaccacagucuaauuuucuagcccaaaccuuaagcacuuggauauuuuacuuaccuagauucuugccuuuuccugagccuccugugccauaaccucccugggcagccuuuagucagagucuugcuuaggaauauuccaguagucucuccucugagagaaucagagucacccuaagucuaacauucugaucagagcuccugagcaggccauguacacauguucagugauagaaugcuuuccuagcaugacggaaucuggguuccaccccucacaucacuguaguaauaauaacaacaacgacuauuauuauuauuacuucuauagauaugaaauucaggauauagguacagaauuuauggaguagauacagaagaguuuauauuugcuauaguagagcagaguggaacaguuuggcccugucucagccuccuuguaaggucccaauuuucucuuucucauaguaguugccucuguggagguuuuguuuuuguuuuuguuuuguuuuguuuuuuuaauuagcauauaccucauggccccuuaauugauugaugcugucuaauaagguagucaggagaauugagaauuugagaccagucugggcuaugugagauccugcuucagaaacagcaacaacaaaaucauuucauuugggaaaauaacuuuuuuuuauuaguuucuuuuaaaaagguauaaaauugcagggcagugguggcgcacucuaaucccagcacucaggaggcagaggcaggcggauuuuuaguucaaggccagcauggucuacagagugaguuccagguuagccagggcuacacaaagaaacccucuguggggugugugugugaaauuuucuuagugccagagaccuaugagguugaguuuaacuaucaauuucuuuuuucuuuuuuguuuuucaagacaggguuucucuguguagcccuggcuauccuagagcucacucuguaaaccagacuggccucgaacucagaaauccaccugcuuuugccuccaaagugcuugggacuaacggugugugccaccacauuuggguggaacuuaaucucuuucaauuucuaagaauaauggaguucacucuuagcguucaaagaguuagagcagagcagcuccccuauagcagaggagaaauggcaggaucuucacguaagaucacuuaggacaaaagauaucugucugaaaagaugguauauggcuguccuuuuugccauucucguuguguguugaguaggcuguuaggaugccgugaaguacaguggaaaaucccacuuuugucccucaucaucccaugugccacugucuuucuucuccccggcuuacuagaaaccuuguuucaaguuccuugugugcuuggcucuuaguauccaguaggaacccucccugucucuucugcuggguaauggagugacaguguugcugucuucaugcugcuaugaacuccccucaucuugucugaaaccuaaaggacuagggaucagccucuuagucuacuguuucucaaggguaguuucuucuacacggguucagccauuugggguuuuucuucuuugugcugcuuuuguuuuuauuuugagacaggauucaagguauauaguucuggccagccuaaaacuugugauuuugucucaucuuccugaggcuuccauuccaggugcauuugaguauuuuuguuacugccucccccaucucuacuucaucccccugaagccugccucccccgccccccccucugucucucucugggguauguguaguuuuuggaaacagggcuuuucuguguaucccuggcuguccugaaacacacuccguagaccaaacuggacucgaacucagaaguccccugcccuugcuucugcaaugcuggaauuaaagacaugugccaccaccaccgagcuuaucugaaaccuugcauuaguuuauucuaguauagagaaguaacagcucuggggauauuguucaguaauaggguacauacauaugcaaggcccuggguuugauccauaguacuugucuguccccaauugccaaaaaagaaauugaaagauuguuucuuagaaaaauguuucuaacaucaccuuacaugcuuccuagcauagaagccacuggcuauuuuugagugucuuugguguggggucacugguuaaugugacaaagcuucaccaaguacuuggguguauguacagggccuguugguguugccagggagaacuggagcuggggccagcacaguucccaggggcucuggaucacagggaaaggccuuccaccugcuucucucuuugaacuuccccuuaguauccucuccuggucacucuguaccuuucuuaauuuuuaaauguuuuuacuuuauugauuagcacaaaucuguauguuaaaaauaugucuggcaaccacccccagucuuuaauuagggaagacaggcaguuggaucucugugaguucuaggccagccaaaacaacauaguaaaacaacacugcccucuccccccaaaaaagggauauuagauauuuucuuuauuuacauuucaaauguuguccccuuucccaguuucucucugaaaauccccuauucccuucccgcucccuuucucccccucccccugcuccacaacccacccacuccugcuuccuggcccuggcauuccccuauacuggggcauagaaccuucacaagaccaagggccucucuucccauugauggccgacuaggccauccucugcugcauaugcaucuagagacacaagucccaccauguguuuucuuugauuggugguuuggucccagggagcucuggggguucugguugguucauauuguuguucuuccuauugggcugcaaacccuuucagcuccauguguguauucuuagcuaaauguaacuuaagaguaccauguaggaaauuuuaacuuuaaagaaauaauuuaauuacuguagugucacuucugauauuuuaaguggaacuugagucccucuaguggguggauuuuaaucugcuuaagcccuagguagaaaguuugaaggugcuuuggauucccauggcccuaacuuucuuucuuuuuuuuuuuuuuuucuuucuugguuuuuguuuuugguuuugguuuuuuuuuuuuuuuuuggguuuuuugagacaggguuucucuguguagcccuggcuguccuggaacucacucuuuagaccaggcuggccucggacucagaaaucugccugccucugccuccuaagugcugggauuaaaggcaugcgucaucaccacuuggcuggcccuagcuuucaaguguaauguucucauugguacugguauccuucgugcccagcuuacaggcaguacauggucuggacccaacuucuuccacucaucugauucccaucauucuuggccugugugguuuuuuuguuuuuguuuguuuuaaagaggauucuugggauucaggugugcaucuuaaggcuuguauuaccuacauuuuacaaacugggcuaucacccuugccuguguguaguucauuagggacaugcuuggggcaccacagcuagaaaaggugauuuaguguggagaaugucuauacugauaacuggaauauagcaaaggugauagguuuuggaguuugaaucccaaccugccauuauuaauggugcgacucugagcuauaaugacauagcuugccuuuuuuuguaaagugcaggaagugguaaaguuuucucccagagcuggcuucagcaucagaaagaacauguacauaggccuuuguguuucacacccugugguugggaacagaaacccgaaaugucccugcucacguccacgguagugcacuuuauuaauuguugggauaacuuucuucuuuuuucuuucagucaccuccaaguaaacgaagaaaauuagaaaagccaaggaaacccauuacuuuuguaguguuggagucugugaugaaagaauugucucucaaagcuucaucuuugggcuccgagacagcggaaggcauagugguuguaacaacauggauagaaaagauccugacugaucugaaggugcguggccuuuaccaucgugaugggggggagggguauuuguuuuuuauugaaggaauuuauuaaguagugacaggugauuuccuauaaaauucugguuuuucuuccacauaaggugcaacauaagcgaauucccuguggaagagaagaaguuagccuuuuccugacagccauagaaaacucuuggauucauuuaaggcggaagagaagagagcgagugaggcagcugcgggaggugccucgggcuccugaggacgucaucuuagccuuggaagagagaaaguccacucccaaagagcugaguaguggccaagacguggcccacagcccccaagagagugcccugugugggcuugaugugccgggcggcgaggcugcugcugauggaggccauugccucagccagaaguuacugugccaggaggagacucccgaggccacggaggaugaaagggaugaggaaaggggagggauggaggccauggaaaguuguaaaggcuccagcaauggagcccaggacggagaggcuucugagaagggggaucgccuggauggggcggccggacgcuaccuguuuaaguguuuagucaacauuaagaaggaagcuggcgaugccgugguugaaaugcauuggguugagggccagaauagggauuugaugaaccagcuuugcacuuacguacguaaccaaauuuugaggcuuguugcuaguuaauucuuaauuucuuccucaguuagaaaagugauguauggggcuagggauaugaugcaaugaccuuaugugcuuaguauccagaaguuacccuguguugagucccuuacaucuaacaucauuacaaggaaaaaaaaaacccauauuauaaaauagcuugcuuuggagguagagccuauugggaggccagcagaauuucaccacugguccaugagugacaccauguggaaucuucuuuaaaaaacacaaauuuaguuggaugugcucuguggcacuuguaaccccacuacuuggaggcaaaggcaggaagauggcuauggguguaagggcagccugugcuacagagacagacacucgucuaaauaaaaagaaggaaaaaggaaagcagcaguggauccauuuuuaacccuugcccucuucacagcagcuaaaccuaggaggagcagaucaucgcagccaaaggccagaggggcucugguggcaucuggugugggucagggcugccuagaaagugucugucaccaaggguugcuuggugacaagggcaacaguguucuccaguggagguccugcucauggcugccuucaagauaucugcuuucucaaggaaacagaauugagcgagcugguucccagaaaggagcuagccuguugauaggugacgagagugucagggagagucaucuuagucgagccaaggagagggccugucuggggaacacacaggaagcugcacguucaucgcccaccacuauucugacauugccuauuucagaaccagaguugaauaagcaaaacucugagauguagcugaggcacaauaaaguguacccaccaacccaccgacagcauuguuuuguaacaauuguacugccuuuuuuuuuaaaugugaaauggaaucuuuugguuuuuaauauaagacuuaauaauugaaaacuauugauccuguuugaauccuggaauuggggaaauacuuucuuggguuuaaguuggguagaugguugaugugacaaaugaggaacuaaguaaggucuauguguacuaggugggguguagggggucacugguagaacguucaucaauguuuguaggccccgaguuccauccucagaacaauagaaaacagguauuggugugguguagacuggaaucuucuauguugacaguuaauuguugaccaaauccugcuuuuuugguggcugcccuugucacucucuuacugcucaucugcuaacauuggacaauacugugcccagaguaaccauaugugaaacacauuucuaaugggaaugccaggguucugcagaucucuuuggagaagucucagcuuuguucuucugugucucagaaacagucuguuguacuggauucuugacuugcugccuaggguucauagggacaaacugguaucgcuccugauacagugccugagcucuucggcauccauaaaguaguuaagcuccauuuucagagguggcuauacuuuuuggcaaagguauaaggaaauguaaauagugcagugggguugaaagcugggaaagaacauuuuagccauggucuuccagagaugcuaggagcauguuuucuucccacaacccuucccccuggagaucugaucuaugacauugugaucagaaaccaacuuaggaaaaaaacacuguucuagacaauuuauccauccauuggacagcaugaagaaaccaauaucauaaacuguuccaagauugaauucacggccuuagauugccuacauccaguaauuaugucuauuugggaguauguguaugugagugcaggugcuugcagaggcaucagauccccuggagcugaaguuccaggcaacugugagcuaccugguaugggugcugggaaccaaacuugggucucugcaagaauaauucauacucuuagccaacuagccaucucccuagccccuguuguugcuuuugagacagggucucauguauccucagacaugauguguaucugagguugaauuuaacauccuuuucuuccaguaucuguauccuuugugcuggaauuacaagucagaguuaugugguacuaaugcuccagugaaccugggacuucugugugcuaggcaaauguucucccaacugagcugcauccucagucgucaaaucuaguuuccuuaaugaaauccugggaucucugagcucaguggcaguuaagugccagagaaccuggcagauauuuaauaaauaauaaauguuuguuucaucauagguuagcagauguucaaugauuuugaaacagaaauggcuagaggugcaauuguaguagaacauuugccuagcaugcacagggcccugaauucaauccuuagcacugcagaacacacaaguuaccuaggagauuggccuucuagcggcuaauaguauuuucauguuuucuccuggucuuucuguagguguaugugguuauuuugaguuguauuauuuuguuuaauuuucuguuguacuuuuuguuuagcuuagauuuuuuucauguuuuuauaauuauguauuuuuuuuacacauuuugcccauuuaaaaugcccuuccagcacaguauugacuuuugauuaugucuaguuguuagagaacacucuuuguuacuggaguuagauaaguugaaucugcaucuguguuucguuccuaggguugagacucuaauggagaaggcuguauagaugcuaagauaauguuccuagaauuugaaaacguuugacaagagcaguaucgcuauggucuuuaaaaaaaacuagagcuaugaguaucuuugcauuuuugauugccuuuuuuucuuacauugucuaaugagaugacauuguuuuguuucauuucucaagacaagcuuucucuguagccuugacucuccugaaacucacucuguagacuaggcuggccuugaacucacagacaucucagugcuggaauuaaagguaugugccgccaccaccuggcaacauugaagacauuuuaaagggacaucugagggucuggucauauaugugcuuuauaauugaagagaaguuuuuuaaagaaaugaguuaagugcugugguauagaaugacucucugcuuaagugucuagagucaaguuuguguuggugcugguggauugauaugaaauuaaaucuuugugguauuaucuuaaauucuauucuggucccuggaauuggcuucugaucuccugauagcuaaagugggaacagaagcugaacuuguuuuccagugagaacuaaagugcuuuuguuuagaaucugcuggguuuugucagugugguuccuucaccccaucugugcucaguuguuccuacauuagagcuuugcuguacuuugagaccaaguuggcaacucugaggaggacuuugugcuaaccuuaaguguucaggucgauuaguuaauuuuagaaaacaaacccuuccauuucaugauggaaaucaaagcugcugugguccaauaggaguaacuggccagguguggaaagaugugaaagucccaugcaaaggcagcccaaggccauuuuguuuuauuuuguuuggguuuugaaacagggucucauucauucaggcuggccucgaacuuuugagguagccaaggcaggcacuuaacuccugguucuccugccaccacuugcgcaguuucugggcuuacagauguugccaucuuaugugguuuuaugugguucuggggauuuaacccaugccuuuguuaguguagggcaaguccuguacagccugagccucaucccuuaucagagaagggaguaaaugcuggcugugaugaccuccuuguaagcucagcauguggggaguggaaggcaggcugaggucagaguugcucuugccuccauugugaguucagggcagagggaguugugugagagagaugcugucugucuucauagcuuucuuaacuugcagcacuuuucuucuggaaccacacgggggcaccuucagauccuuuaaucaugauccugaacuuuacugugagaguggaucaaguuauauccauaucuguggaauuuucuuuaaauauccaguuguauccagagaaguacuuauguaagcagguauauuuucaca

SEQ ID NO: 6170 - RNA, 2243 nt, Mus musculus
guggcugcugaaagcaacagaagcuucaagaccuuccguaacuuacccuaauguuauugacugagccaaggcacagaagcaggauuugaacucagguccaagaagcuaaaggcugggcucuagcaccaaauauagaaaugcuaugacaaauaauucauauaaggaaaaaaugcauuuuuaagucuguuuccuccaccucuacguuauuacauggcacagggaagccagaacaaacacgguuuucccacccucacaguucagcacuuaaaguaguaucauuuacuugccuaugucagugagugagaucuaguaagugaaauuaguuacuucuuaacuuaugccaccaaaucuucacagagccuuguauuuggcaguaauguagauaauuaaguagcuaaugaaaccauaaaaucagugucuggugaaagcacguuggaccagaaucaaugugaaauaagugauaauuagguaaugccucuucaacaguacauaauuauauaauaauagaaggagguuuuguucuguuuuaaacacuauaguuccaaauauuuuacuauggagcuacacaaaacccauacauaugcuuuguaagcuugccauugaagguaggauugacacaagaucaucaaguucuuuuccuaggaaggcaagagaaacuguagguuugagagccacaggggccuuggagucuagaaggaaagccagguauucccagcugggggacuuggcuagaugcuguagcuacuagacccccagaggaggugacagcuuguuuugcuaauuguucaaaagagcagccuaccuggagagcgggacccucuagggaugguaguuuccugaugaugcagaaagagcagguguagacacaacacaacaagagaaccuguauggggcuguuuucagaagaagguagaguggaaaauggugccaucagcaguucaggggagauuaaacaaugauaccucagagaacaaagcagaggcaaccuuccccuccaagacacuuccuccaagacuggccaccacaucuccagccuuucacuuaucaaguuuucauauuuaagauuuaggaaaugaguaagcuacaauuccaucacucaagugaaauuucauuucguuguguuuguaugcauaugcauuuuaaacaacugugggaucagucauuguacaguauacuucuauaacauauuuagcaguauauuguaaugucuccccccccccccuuucugaguauaaggcuaauagucuguuuuaggaaagcuguggaaaucagaaugaccaguacccacccugcccgaggccagccacugccacuucugucccagcaaaaagccugcucguuauaugcuccaguguguuuugaacacaccgcacuaagcugguuguuccuaguuggaaauguugauugucaugaaaaaggauuuccuuguuguaaaaaaacauuuuaccauauguccuugaaaguuuuaauguaguuuuuugaggguuaaauuugccuggaguuuccaaggcagagaguuccacccccuuacuuugcccacuggaaagggucugggguaacauacacuuccaugaacgauuggcugguuuugccauaccuuugauagugauaggaugcugauuuuuaauuucaguugggccugacugucugcaucuguaaguguuagugcccuuggaggccggaaauggaaugagcugcaggacaugcaugcuaggaacuaaacucaguccugugcaaaaguagcucucucugcaccaucucuccagccccagagagcuauucuaaaaagauuaucaauuggaaaaaaaaaaugugucauguuugaaucuuauuauggaacugaccagugucgucuucagcugugucuguuguuauuucacggauagaucuuaaaauguuagcuuuaugucuguuaacuauugaaaaugucuuuugcaaggauuccuuccacuugugauuucuucccccuccucuuuguaaugaugguuucauuuuuacaguuaagauuuucuagggauaaucaaauccaucaaacugugucuuuauauuugcuuuugugaguagaauccuccauugcucuggaguagaaaaauguuugccuauuuuccauuauagggguuuuauccuuucuuuauacaacauuugacaaucuauaggauaaugguauuuauuuuaaggaucuguuuaauagugcaguuaucacagagugucuucagaaauggccaauaaagugccauguaaag

SEQ ID NO: 6171 - RNA, 869 nt, Mus musculus
uggcaugugcuuguuaaaugaauguuaccuaguguaucccugagcauagcugucuaaugucccuuauuuauagauggcucuuucccuuuggccuuguuuuaauuaugacuggugaaaaguuaccuaaaacuaaucaagauaccaagucaaggcuaaaaggauggggcgucuccuagaauaguaugaauagugugaauauguguguauugagcuccacacccguucccacaucccauuguggucagggaagucauuuccuagagcacuggagcuguaaguguguggcucugucgggaugaaugguacgaggacaggaacucagcacagacaagggaggaaggcuugcuauggaaugagcaguaggcauugaggaauagcacaagacagaaggaaggcguuggaaaucugcaugaaaaagugauagaagauccuguugcccuccugacccagacauccucagcagcuagaaaagacacaacaggacuugaguacguuuuagaagauggcuggcucugggaucauucuccaacccagcgaagcuuuugcugaaacaucaaacuagacuuucccuugagugaaugugcuugccaacuuaugcccuggcuccacccauuggaacaggaaacuaaaacagcccucccauucauuucccucuucugugccucccucuaggugucucaccuccccacuguccacuccugaacuuccagaaaccuugguugaugagaaaaaucugguggccauuuuuaggcuccuaaaggcaauaacaggccuugcaaaugccuuucuaaauccuugguuuugccuaacaucuccugacugcuguccccaugugaccuaaauaaacaugaucaugugaagccuguaag

SEQ ID NO: 6172 - RNA, 4943 nt, Mus musculus
cuucgagccauuucaguuauugucguaggcaaaacaaagccuucaaguguccgggguuuuaaacaggguccaggagcgggagggcucgugaucugcugguccuccgagguuccuaagagucacgaaugcaaacacaaaugccgagggaucagagaaaauguuugcaagagaagcugcccagaugugaggcagcggugucaggggcugaagucugugugaagugccagcccugauugaguugccacaggaauucaggcccaggcuuugccuggccuccaagaagucugggguuuuguguguauugguguguuagcguuuuuugugggugugguuguuuguaggaguggguggagggcagagaucaccucagaucaagcuguucuucggggccacccaucuuguuugugggggaccgggucucuucaccaggacccagaguuuaccgaugaagcuagguuggcuggccagcagaccccagauggagccaucuccccagcuggauccgggcuucccuuccucucucugucuuguauuuuggagauuugugugugcaugcauggugggggagggugguuauuuguuuguuuuugagauaggccuucacuauggagcccucgcuggccugaaucucacagcgaagacuagccucaaacugacuaauucuuuuccgcuucugccucccaagugcuggaacuaauugcauggaccagcacaaccauuguauuuaguggcuuguuaugaaauucacaucagcaacccagauuccguauuuuaaaaucaagcauccugagcuggcaugaugacucagucuugccguguaaagcugaugaccuguguucagcagucagaaccuggugggaggggagaagugacuguaguuguccucugaucccccgcacagugugugacaugcaugugcucacacucaaacgucacauauacacaaaauaauaaauaagugugaccuacgaaaaacgaaauucaacauucugagaauacaacacagagauauacuaguuggauacaugcugaggaaugaaaguaagaaauuacaagaaguccuuguuuucuguaauuaaacuguuaugucucuguaagagcagaaaacagggccgggcaugguggcgcacgccuuuaaucccagcacucgggaggcagaggcagguggauuucugaguucgaggccagccuggucuauagagugaguuccaggacagccagggcuauacagagaaaccccgucucgaaaaaccacaaaaaaaaaaaaaaaaaaaaaaaaaaaaaaagagcagaaaacauuguacaguacaaacaaggagguucauaacacaaggaaucuuagaucugaaauucaguaccacaggcagcauggcugguaugguaugaugugugcacaaggcuguucagaaccaaagcugugguggaaugguggcugcagcaccccugaaugccaccagaaacaaccaggauuccuuauaugcuugguuguauuugugugugugugugugugaguaugaagauggauggauggauagaaggauagggaugggggcauuuacuagaguggcuacuggcuauguccaacaauagcugucuauuagcagaaaguccaagagccuaguagguccauggggcuggauaucucaacuggucuucagaaucccaaagaagcaggcuccagugucagugaaggacuggacuugccagggacacuaagagcaggcaggcaaagagcaaaagcuuucuucuuccaugcccucuauagagccaccagaagguguggcucagauuaaagguggaucuuccuaccucugaaggucuagauuaaacagcagucuuccagccaggugguagugggccugcuguacagaauguacagaaugaguucaaggucagcuaaggcuacacagagaaacccugucuauaaauaccaauguguacaugccuuuaaucccagcacuugggaggcagaggcagguggauuucugaguucgaggccagccuggucuacaaagugaguuccaggacagccagggcuacacagagaaacccugucucgaaaaaaacaaaccaaaaaaaaaaaaaagaaaacaauguggaggggugggggagaagaaaagaaaacaaucccucacagguguaccuagccacuuggguuuuaguuaaucccagauauagucaaguucacaaccaagagcagucaucacggguuggugagauggcuuagugaguaaaaguacccgacugcucuuccaaagguccagaguucaaaucccagcaaccacaugguggcucacaaccauccguaaugagaucugacgcccucuucuggugugucugaagacagcuagaguguacuuacauauaauaaauaaauaaaucugaaaaauaaaaaaagagcagucaucacgguuggacagagagcaacuuguggaagucaguucuuuuuuucuaccgugugaggccuggggaucaaacugcgaucggcuggcguaagcacccuugccuaugagccaucuuacaacccagaacauuuaguuuuugaauuaauuuugaucauuacauguuuuauuauucccagagguuuugugacacccucccacauucauucacgcaccccacacaaggucacaucccucacgcagcccacaggagguuacgucucacaguuuacagauuaaaaaucugccacagcacauuuaggagcugagguccacagugugacaaaggagcacccagcuuaggguugcuguaggagagauggcucaguggcuaagaguauuggcugcucuuccuagaggaccuggguucaauucccagcacccacauggcagcucacaacuuucuuuaacuccaguuccaggugaucugacacccucacacagacuuacauguaggcaaaacaccaaugcacauaaaauaaaauaauccuuaaaauuuuuuuuaaaaauuuaggagcugggcguaguggcugcgcucucucucucucucgauuuauuuauuuauuuauuuauuuauuuaauaugaauacacuacagcugucuucagacacagagaaggcuuuggaucucauuacagauguuugugagccacuaugugguugcugggaauugaacucaggaccucugggagagcagucagugcucuuaaccgcugagccaucucacuagcucccaagcauuggcugcucuuguaguuuuauucccaacacccacaucaggucaggugguucacaaaccacguguagcuccaguuccaagggauccaacccccucuucuggccugucacaugcacauguucagaugcgugcacacacauaugcacauaauuaaaaagaauaaucuuuuuaaaaagaagggguauggagauggcuccgcagguaaaaacacuugccacucaaggaugugaguucaauccccaggaaaggggugagaacugggcuuacaaggcuguccucugaccuucauacaugcuugcgcgcacaacacacacacacauuuaauuuaauuuuuuuuuaaaaagaguuuaggccgggcgugguggcgcaugccuuuacucccagcacucgggaggcagaggcaggcggauuucugaguucgaggccagccuggucuacaaagugagcuccaggacagccagggcuauacagagaaacccugucuugaaaaaccaaaaaaaaaaaaaaagaguuuaaagccugacaagccugacuggaagauggcuuaguggguaaaacugcuuacugccaaaccuuaugaccuaaguuguaucccuagaacacacauggucgaaggaaaugaccaccuccacugccccuggccccacaugguagauuguacaugugcacguugguauacaugcauguucacacacacacacuaaauaagugauuuaaaacauuuuaaagccaagugguuguggcacaugccuuuagucccagcacucaggagauagaggcaggcaggcuucucugaguucaaggccagccuggucuacagagagaauucuaggacagcuaugguuacacagagagaccccaucucaaacaaacaaaagacuuccugcugggcuggagcucagaguauacuugcuuagcauaucugagauucuggguccaaucgcuaguugaaacaaauaacgcuuuuuuuuuguauuuucucuguggcuuugccaacauuucuuccaccucccagccuuuacccccauugauugguaucuccugccaccuccuuccauggugggaggaaggugcucguaguauguauaaacagagcacucagagucagcagcaaauagcaaguuaucucaaguugugccuugaaccuacaucugaaauaauaaugugcuuauaugcauaguucuucucuuaccaucaacugauuugaggucauugaagcaccaacccuugaaacuauauguuucucugaaccugaccucccucuacaacaguaucuuucuaguugaguacuaggauuuaaaacaaacaaacaaacaaggccccacugaguauccauggcuggccugaaacucaauauauagacuaggcuaacuuuaaagucagagaucugccugcuucugccuggaauaaaaggugugcaccaccaugccuggcucuagaguuguuucugggguuuuuuuuuuuuugguguauggugugugugugugugugugugugugugugugugugugugucugucugucugucugucuguugucugugugucuguguagcuggggguugaaccuugaucuugaagcaggcuagacaagcaucuacccuagagcucuacccucagcccugugaaucuuacuuaaccuuagguggcugagagaggauuuugacuuugaagagcaggucucacaccagcugcauuguggguggggccgggccagccugucuucucaaucagcugcuuuccuaggccgaccugaggguugcuug

SEQ ID NO: 6173 - RNA, 12509 nt, Mus musculus
cguuccacagcagcuuuucuuugaccgcguccucugcgcugcccauggugcggcagguggcgggcagguggcaccgaguggccccccgagcccccggugcgcccucaccgccuccgcgccucccgacucagcgccccacacgcgaggcggaguccccgcccgcugcgcuccccgccugcagccgccgcagccacugcccggugcucagcuccgcagccaucuuccgagccccgcagacgucaggcagcaggcccggccccuucccacugccggcagggagggggugugugcgccgcaacuggggaggugggggggggggucaagggcgggugcggacgccugggggcgucggggccgggcgcgcgccgcagggacgguugucauggcgacuggccggcucccgccccgagggcgcgaacccgcauugugagcgcugggaagucagccgcuccggccugcgccgcgcagcgggcggacuuugggaaugugcuugugucugggcaaaccucaaccaccgugaccgcucccgacuucuggccccugggagaggagcuauacggagccagggucucggcucugcgucacugugguucgaaccugguccugucacuccuccggauccuguggaguguucauauauuacuugcagcucagucgcaaagcuugcaggaggaaagcaaggacccgacugugagcuccuaagaacaggugcccgagcgcaaggggaagucuucgcccuccuccgggucgccgacauccgcuuugguucaucuugcagauuugugggaagaggggggcgcgaguuggaauaagagacauuccagagccggugacacgagccccuucuaagugcuucgcguuggaaauuagaguaauagaggaaaggaaaggccacucagguacaaaugucaccccuuuguacaguucacugggaccgcagagagcggcgugcaauagucuacgugaaaagacuuuuauuucuucccacgugaugcaacugaagcgugcaaaaauggaaagaugggcgcaaaauugaccuccuaauccagagccggagccgggagacuccugccggcauccuccaucucucagcagaggacugcagcgugggaaaaggcaccacgacgucucugcggacacucagggcgcugcgcuugcaggcuggcggcaaaaaaccucgcgagaggucgcggaagugcuaagccugaaguccguccccagggccggaaacgcucggguccgcccggaaguagaguucacuuggugcacacguggacugcagaauggcggcucaccgcuccgggccgcugaagcagcagaauaaagcucauaaaggcgggcggcaucacggcgguggguccgcacaacgggacagcaaaggugaguagacaggagggagaggggcugcuuagccgguacccgugcccacaccgagacuagacuugggacccuugcccaaggcucuuaagcggcgcaggaagguucuuguugguugauuugacugagaggagaagagcagccacuuccgaucugccuuccaggccggguaggaccgaaaauccucugcaagaagcugaagaggcagcucagccgaauagaccagaggcaucgcgccagccagcuccgaaagcaaaagagggagucggugaguagaagcggggguggggaagcuuaugguuugagauugguaaagucucaaacuagaaaaugggacacggaaaugggccgaaaacggagguaaacccagaguaccuucaggcaguguucauuuuagaacgaggcccugccaaacuccuugacagcacauccauacacguggcuuuuuacgagagaaugcuugguccuuccucaucuuuauuuauacgggcuugcucuuuugcaaaucaugauuauuuuaaacaaagggucucacuguguagcccaggcuggccuagaacucagauccuccuaccucugccuucugaguguuaaguuaaaaggcuugggccaccacaccuggcuccucugauguuuucuuuuuucuuuucuuuuuuuuuuuuuuuggggggggguggugguguuuccgagacaggguuucucuguguagcccuggcugucccggaacucacucuguagaccaggcuggccucaaacucagaaaugagugcugggauuaaaggcgugcgccagcuccgcccggccugcucugaucuuuucuaauguuuuacguuacauaaaauuaccuugguacuuuuacaaagcaacagaaaggggaguaguucugcccugggguuacagcaccuguauauuugaagauagaauagugaagcaaaugauugagguauucuuggaucuuuguguugcuagguucuggccgagaagaggcagcugggcagcaaggaugguccuccacaucaggugcugguggugccucugcacagcaggauuucccuuccagaggcauuuaaacugcuucagaaugaagacuugggaacgguguauuugagugaacggggaagcacccagaguuuuaugcuucugugcccuagcuugaaacaucgaugguuuuucacauaugcaagaccagguuagaguguccgauacuuuucucucauuguguuuaaguaguugucucucuugaauauagugugcuaacuaucuuuuuuuuuuuuuuauggugucuuuuguauacaggggaucugcauacucuguuagacauggcuaaagucgcugauaccauucuguuccuccuggacccacuagaaggcugggacaguacgggggauuauugccugucuugccuuuuugcucagggccuucccaccuauaguaagugugcuguauuggauaccagcaaagaaaacagcucuggucuagucaugcaggcacaguguuuaagauuaaguuuaggaguaaaucaauggguuguauucugcuggugugggcuauacuugguaaacauuuucauauauuuuacucuuuuuauuuauuuauuuauuugagacaacaagaguuucuuuugggcggcccugacuauccuagaacugguccuguagaccagauuggcccugaucuuucagggauccgcccgcccccgucuucugugcaccgcccaguugguuuuauauuauuaaagugaguuuuucuuccugggcugucgugugcccggugggggaauagaaaguuaacacucacggugacauuucguuguuggcucaguguugcguuucccagugaucucugggaccacggcagagcugaccgcuggguugucugggaacuggaaaggauuuucaaguggucaaacaaugacuuccugcgcucuucucuccuuucagcacuagcuguccagggccuuucuggcuucccaccaaagaaacaaauagaugcccgaaagaagcuaaguaaaaugguggagaaacgcuucccugaagacaaacuucugcuccuagacacgcagcaggaaucaggaaugcuacuuagacaguuggcuaaccagaagcaacggcaucuugcuuuucgggaucggcgagcuuacuuguuugcccauguugcugacuucgugccuagugaggagagugacuuagugggcaccuugaaaaucucaggcuauguucgugggaggacucugaauguaaauagcuugcugcauaucguuggacacggugauuuccaaaugaaucaaauagaugcuccuguggauccguucccuuuaaauccuagagugauuaaaucccagaagaaaccaaacauggcaauggagguaagauugggguuuucauuucugggagucgaaccccggccaagccagcccuccacuacuugccuacauuucuugcccgcgauuguuuucaacuuuuuuacugaauuuauuuugguaugcuggagagugguacaucacugguguucaaggucugguucucuccuaccuuguggacccacccugguuuuuaaauuucaaagcagauaguuugcaugcugaggccagugaggagacuacugcuaguuugaaaugucaggcaguagacauucagacacaugcugguuaaguguauuuaucugguauuucuacauacuuugcacaguuggcagauguggccucuugucucagaacuuaauuugaauuaggaaaaaaaauucaaauacuugugaauuuaaaaauuacaguaguuaagguucagaccugcuguggaaauucagaggacacuagcugguugcacaggagagaucagaguuagccaaguguguggaagguuugaaugacuuaguucagcagagcugaagggauuauguugggacuuagauccuacaucuagucauagaguggagcaguguccaccacacuuggacuucuggcuuucuuugaacuuuuaaaaggcuggaccucacuauguagcaguggcuuagaccaggcuugcuucaaauuuuacagaggucagccuuccucuccaguugaguguugauaaaaggcguugcccacucuucugaagagagcaccuugauugaacggugguguaguaaacaggagagugucaggauuaguaacaaccucccagguuaguaggagagcagagcaagugcuaggcgauggccguuuggaaagugauugucugguuaacuggugggucuuucagaugagugucugauaggcucuuaccugcuuuugggucuuagguuuguguuacagaugcugcuccugacauggaagaagaccuuaagguucugaugaaggcagacccugaucaccaggagucuuuacaaacagaggcuauuccagauccuauggaaggagagcagaccuggcccacugaggaagagcuggaugaggcagauggucagugacagcaagcucgucaccuuccugacuuuaauucuguaugcucuuuaccuggucgacggucacaugcuucuagggcuggaugaggaagugacugaaguuuaaauaccgaauggcugcacuaagcaaacacugaguacagcucuguuuccucuagaaaucaccccaggcuugucucuuuacauaauaaaugacauuaggcccacugcaggguuuauuuagcugugucuuugucuuaaaugugaggcggcuggguuaaaauuggaagaagucuauguucucguguagcugcugucuuucauguugguagcagugccugcauagguaagaauacuaaaaauuguuuguacuuuucagacuuacugaagcaacgguccagagugguaaagaaggucccuaaaggaacauccaguuaccaggcugaguggauucuggaugaaggugaugaaagugauggggaagguggugaauaugaugauauacaacacgaagguuucauggaagaggagucucagguaagaaaauuggccacugggccacuuauguauauggcuccaaaaccaaggcuguacuguaaagucagcugcuguaacuaagggggaaaauguguaucauuugagguugggaaaauggcacauuggguaaagagcacuugccacauaagcuuuaggacuugcauuugaauccccaggacccauaagaagccagaagucgugguguaauucugugaacucgggcucuguggcaagauuuguaguagaggcaggauaucuggaacacugaggccaaguuaacaaacaagauccaggcagugguggcgcacgccuuuaaucccaguacuugggaggcagaggauuucugaguucaaggccagccugggcuacacagaaaaacccugucucaaaaaacaaaauaaaagauccugucugaaggcagaaggugaggaaagacaaccagaguugagcuuugaccucuacaggcgugccuguacucaaauaaacauagucucgcccuacauuuuuauauuuauauugguugcagauagguggcuaaaaaaauuuauuagaucuuuguuuaauuccuuuuggggcagaaaucaguggauucugcugauuuuuuuuuuuuuuuaaauuuuaaagaagaugaacuuacuagcccauacgugaccuuguacucauagcaauccuucuaaucuuuccagaacuaggaucauuugugacaccaagccugauugcuauuuuguuuagcuuuuaauuuuauuuuauuuuuuuuaaauguugggacauuuuauuacuguugcauagguuuuuuuguuuguuuguuuuuauucuuuucaugcacccacuguauuaacucuugagcucacuguguagcagagaaggaccuugaauuacuuacucucuugccucuaccuccccagugcuuggauuauagagguacucuagcguacuuaguuuuggaaguggugcuaggaaugcaucgacucccagggcuucuucacaaaugucuggugagcauaucaccagcugaaccacgcucccacacacauuguuuuuagguauugggggggggcuuuuugagggagguguuugagacugggucacauguugcucuuugaacucucucacacacccccagccucccaaaugcugugaugagagaugccuaucauuaugcccaucuugcaugcuugcuugugucuauaugugugguagucaggaagcuuacuggagucauuucucccuuuccacuauuugaauuucauggauauaauucggguuuagaaauagauuaucaggguuggaaacaagcauccuuacguuuucagccaucuuauaggugcuaugauuuucauuuuuggggacguagucuuuuauguaucucagggugaccuugaacccagcuguugaugcuguaggcaugugaagucugcccagcuuuaggcucuaaccaagagcuucaugugugcuagcuaggaaagcacucuuaacaauuggcuacauucccugcccuuuugggguuuuuuucuuucuuucuuuuuuuuuuuuugagaccaucuuagucucacccaagcugcuaucaaacucauagugaaucaccugccuuagcuuccucaauguuaaauaaguauguuucauauugcacauuuuuaauucuccauuuuacaggaugggaguggugaggaagaggaggaagaaugugaaacuaugacucucggggagucugugcgugacgaucuauacgaugagaaaguagaugcagaggacgaggagagaauguuggagaaauauaaacaagaaagacuggaagaaauguuuccagaugaaauggauaccccccgugauguagcugcuagaauucgguuagucaacaagugauuucaaacaaguuuuauuuaaaaccaauaacagaagucugugagcagaaagcaaauagagaaaaacacuguucuuguccuugaaggaaggacuaacaugcuauaugagaaguagcaacauacuaucaagguuuagaauuguucagagggcccuagaaagagagacaugaagguuaauuagcagauaauccuugugggaguaaaugcgcagaaaaaauucuuuuggaaaguaagaguguauauuuugaaagaaagcuuguaaaagcaagaaaauguaaggcucuaauguaaggcagguugaagagccauauuccugacagguacuuguaaguacuugucaccuuugaaaagccuggguugauucugaaauacuuguuagaagcuguuguagaacaugguuuuugcuaaagcuauuagucuggagauugugugaaggauaggcucucaugcagaccaggccagccuugauccuuugccacuauguuucaagagcugagaauguaggugugccuuuccaugcccaguucuagccuauuagaccauuuuggugccuuaguuucuugagacaguuuaggcugauguggaaccaugauccugccccggcauccccagugcuuaguugugcuaugcuggggauugaacccugggcccacgugcauacuagauaagcauuauaccagugaguuacaucccuaguaagaguacuuugaaaaaccuagagccuuaacuaaccauuuuacaagugaggugaguuuuauguaguacuaaaccucuugcuuucuuuaaaacuuccguucuagauuucagaaauauagaggccucaagaguuuccggacaucuccuugggauccuaaagaaaaccuuccuagagauuaugcucggauauuucaguuucagaauuuuguuaauacuagaaaaagaauuuuuaaagagauugaggaaaaagaagcugaaggagcugagguaccugccuucugcccaccuucuaaguuguucuuguuugguaucaugcugcuuguuugggaguauggagcagucagagaugaguagccgagguugaaucugggugguugaugcgucuaugagugucagucuugagagaugaggcuuagcacauaccuggagaaagguuucaucauuaucggcacccugugacuauugugcuuucuccuggcaggugggcugguaugucacacuccauguuucugaugucccugucucagugguugaguauuucaggcaaggagcgcccuugauugcauuuucuuugcuaccuuaugaacagaagguaaaucaguguuuuaugggaaauggagagguacaaauaccuuucccaaguguacaacacuuugcucauugggaugagagccuaccuuuuugauugaggaauuaagauagagaagucaaugauggucaugcccaagaugucugaaccugucugaagcaucuuuuugauguagucuaugugguucugagacuucucuaaauguguuuuucagaucaaaauggggguuagcaguuguaaaugucuaugcccauguauagaucucuucucuagguagccuauagucauguauacugggagugggaaggcuggcauaaagguugaagaagcuugaaugguuguggcugggaggguaugugguggugagguggcucuuuaauauuacuauggaacagugcugacacaugugcacggaagcaccgaugaggccuaaaucaccaugaugucaguugguggauacaaaggacuuguuaguagcauggucaguucuuagagugacugauguuggcuugcuuugccuuucagguuaggcuguuguaugccuagacugugaaguuuuuucuuguuugguccucagaugucuguauugaacaugguggugagccggaacccuggcaacacggaaccugugaaggcgaaagaagaauugaucuuccacuguggguucaggcgcuuccgagcuucgccuuuguucucucagcacacagcagguaagcacagacagcugcuggagccuugccaccucuucuuuguggucgaaagucucugagauuagaaauauuuugaguacucugacuuaggagccaauaauguuuuuauucaaaaugucugaaccugucugaagcaucccagugaugcaaaauguuguacugaggcuucucugcuaugaguauuguuccagaguagguauuaaaucccaguguagcuucaggaguaggaauauguguugccugcucacuuggggcuuuugccuuucagugacaggagacaagauggugacagcuucacuggugcucuggguacauucucuuaccaucguguguuuguaaacaaaaguuuuauugaagagauggcguaucuuguugcacugagcuggguccucccaccuuccccucuuaguguuacuguuauuacuugcuuguuuaaguaacuuguguguagcugucuuguuuuacuuucuauuuuuauuuuauuugguaauugagagacuaggucuuaauauguugcccaagcuggccuugaccuucagaaugcuugggguauugagguggagggggggggguacacuaccaugcccagcuggcaacuuuguuacagaggcacacugacauaccugagugagugaaauauaaaguaacauggacuaguugcugaaccugaggaccuacagucagcgagugcccugacccccaugguggagcagagaacuguccucugacuucuaugcauauaugcccccacacccccaaauaaaugagauguauuacaaggcuuuuuauuguuuugagaaaguaaggugaacaguuucccuacuagcuuacucuccuacacccagcacagaagcagucaucucacagccauguucacugacacggaaaaagcccgagaguuaguaguauagagaaaccaaaaaugaacugggaacuuuagcccuugauggcagaagguacacagcaacuucaaggccagcaugcaguacugagcuccucucaaaacuaagcagacaggagccuguagaggacccagguuggauucccagcauccacauugucaauguggagagaggcaccugcauucagaugcauacacauuaauaaaaauacaaacacugaggauaugcugugggucuauggcagagcacuuaguguggacacagcccuggguuucaucuccauugcugaaaguuuaaaggguggggccacauguugcagcaguacagcuuuugacacuugcauugcuuaugguaucucacaaggccuuuugcuuuucuauuuacuuauuuugcacccuuauuauggaagcugauaaacauaaauuucaaagauuccugacugcugaugcugccuucguggugacaguguuugcgccaaucacguucccuccugcaucugugcugcuuuucaagcagagaagaaaugguauguuggauuugggauguaaauaccgaacauacaaguacccacuagcaccauaacucuucuguacuuaggcauggggucuugcuguauuaaggaauacugguguuuuguuuguuuuaaauaccaguuuuagccucauugaggguguaagcccagagugauacaucaguuguuaccuguuggcauacuuaaguacacacuaaucaauauauucaauauauguaaggugggugugagggacuggcucauuauaaaugucuuuuaguggucuuccuuugccucgggaaaguagcauaguaguggauggaugggcccuuaaaguagacuagagcuacggacuuggccuuagauugacagugcucucuuucucaggaaugcacagccucaucgcuacaggccaucuguuuucaguggacccagacaggauggucauaaagagagugguucuaaguggucauccuuuuaaaauauuuaccaagauggcaguagugcgguacauguucuucaacagagguaggugugagaaggagaguggugggaagauggccuugcggcugugugggcaaauguuugacuuuguuuuuccauucuaagaggaugugaugugguuuaagccuguggaacugagaaccaaguggggccgccggggacauaucaaagagccucuagguaagagccugggauucccagggguuggcuaucggagacugugggcuguaaguucacugcuuggacguguccacuuuauuuugaccaauuaucuguuuaacuuuuagguacccauggccauaugaagugcaguuuugaugggaagcugaaaucucaggacacaguauuaaugaaucucuauaagcgaguauuucccaaguggacuuaugacccauauguaccagagccaguaccuuggguuaaaagugacaucucuucaacagugucugaaguagacauggaguaagagacucaguuggguucugucucuacugcaaccaaccaaaacuccaguguuggagucuggguugugaccaggcagcuugugcucuguauuucaguuguccaugucucugcuaaguacagaauuuacaugauuacuuacacuuucuucauuaggauuuugaacauaauuuuuaaagggaagauggaaacaaaauuuucaucuagagacaaucuugccugaauuuaaacagaaaccgucugguaaggagcuggccguucagccugccccacccaguucagggagguuaggucuacauuccccccacugaguacaaugcagacguucuuuacuucuggagagacuguuuggaaaugcugagacagcacugcagccagugccacgccagcagucggcucaaugagcaguuucauucucccccacaccagcuggguugcauacuguuggcacagaaaggagcaaggguuaaugaaacaagaaacggagccggagucuaguagguuacauucgaaaaaugaaguagacauuuggguuuguugugauaaguaugugaucuacugucaggguucuguuaacaaugccugagucuuaccuugauuucaucuucggugacagugaagacaucauccacaaggucucuuauaauaggccagguauucaagccaaugcuggauuugacaccaucugcuaugguuucuggaggaugaagauugggggucaguucuccuuucaguuuagacugguagcagucaucugcauucgagggcucagcagcguauaccuucacacuagguuucagggccuggggaaggaaggcacauguuacaauacagccuuugucuacguaaaggaggcagagaguuaaagauguguuacccuuggugaucagaauggaaacaagaccuugaagcacuuuaauaaaaguuguaucugauaacugg

SEQ ID NO: 6174 - RNA, 998 nt, Mus musculus
aagugggcuccuggugcugcuugugcgcucccucagugcggacccagugccucuuuugugaagcggcagcugaggagacuccggcgcucgccauggccgacgagaaacccaaggaaggagucaagacugagaacaacgaucauauuaauuugaagguggcgggacaggaugguucuguggugcaguuuaagauuaagaggcaaacaccacuuaguaaacuaaugaaagcccauugugaacggcaggguuugucaaugaggcagaucagauuccgguuugaugggcagccaaucaacgaaacagacacaccugcacaguuggaaauggaggaugaagauacgacugauguguuccagcagcagacuggaggugucuacuaaaaagggagccugcuacuuuacuccagaauuuuguuauagaccaagaauacauucucaauuagaaagccacaauuuggucccaccacauccugacuacuacaguauaguuuucucucuucuuucauuucccuguccccauuucuuuauuguacauaaaguaacugguguaugugcacacgcauagugcucucucuuucuuuuccuuuuuuaaacuaaaugaccuguucugguugacaugagauggagauggucuggggaaaaauacuggguuugugaaaauacccccuucuccacuaguggcaugcucauucagcucuuaucuuuauauuccaguaaauuauuuugcucucauuguuuuaacaaaagaacccaacaacaccaaauccuugcauaccuuguucgauuggagaacuuuaauguuuuucauuuaucauuguaaaaccaaggacaauuuuauaacuuuuuuguacguagcuguuacauguagggcaaucugucuuuaaguagggauaaauuacucuugaacaaaaugauccuagauaguuuucccuucaagucaagcgucuuguuguuuaaauaaacuucuuguuuaaaauggaaaaaaaaaaggauuauaag

SEQ ID NO: 6175 - RNA, 842 nt, Mus musculus
ugggcagagagcagaggacgcagacaggcauaauugcucauuauaaacucugucccgucagugaucaaugagcuggacggccucgccaaagggcaggagacagaccaccgggcugggggcuaugcccguguggugcaagaaaaggcccgaaaauccauugaguuccucgaacggagauuugagagucgggacuccugccugcgggccuugaccagccguggcaaugaacuugaaucuaucgccuuccgaagugaggacauuacuggacagcuggugagaccccccagagagaaguccauuauuagaaauguuccugagcuggguagugauggcacacaccuuuaaucccagaacucaugggaggcagaggcagguggaucucugugagcucaaggcuagccugaucuacagagcuaguucuaggacagccagggcuacacagagaaacccugucuuguggggugggggagaagguguucccaaaaggaagaaguaaaagaagcccuuugaaccugggcagcuaaaggguagccaacaucaaggcccaggaggggagaguuccuugcucuuugaaucacugaagacagacucagccaagcagagccaaagcaugucugaauaggacucuaggacauagcccuggaaguaccucugccucugcauggcgcccccuccugcccaguggugcuuuucacacugucuuucuccaggguaacaacgaugaccugauccucucuugcugccugcacuacugcaaagacaaggcuaaggauuacaugcccaccagcaaagguacagcuuggccucuccuugagccauccaucccucugcccugauuucuc

SEQ ID NO: 6176 - RNA, 842 nt, Mus musculus
gagaaaucagggcagagggauggauggcucaaggagaggccaagcuguaccuuugcuggugggcauguaauccuuagccuugucuuugcaguagugcaggcagcaagagaggaucaggucaucguuguuacccuggagaaagacagugugaaaagcaccacugggcaggagggggcgccaugcagaggcagagguacuuccagggcuauguccuagaguccuauucagacaugcuuuggcucugcuuggcugagucugucuucagugauucaaagagcaaggaacucuccccuccugggccuugauguuggcuacccuuuagcugcccagguucaaagggcuucuuuuacuucuuccuuuugggaacaccuucucccccaccccacaagacaggguuucucuguguagcccuggcuguccuagaacuagcucuguagaucaggcuagccuugagcucacagagauccaccugccucugccucccaugaguucugggauuaaaggugugugccaucacuacccagcucaggaacauuucuaauaauggacuucucucuggggggucucaccagcuguccaguaauguccucacuucggaaggcgauagauucaaguucauugccacggcuggucaaggcccgcaggcaggagucccgacucucaaaucuccguucgaggaacucaauggauuuucgggccuuuucuugcaccacacgggcauagcccccagcccgguggucugucuccugcccuuuggcgaggccguccagcucauugaucacugacgggacagaguuuauaaugagcaauuaugccugucugcguccucugcucucugccca

SEQ ID NO: 6177 - RNA, 3383 nt, Mus musculus
uuacucccaaacagaaucccacugccaucauggggaccgccccuaucaaaauuacaucagcaacggcugguguaaucaaaccccauuugucagugugaauucuuagcagauuaacuugucagauucacagagaaaccgucaccaaauguuuauguguaaacgauguugaauuuuaaaaucauguggauuauggcggauggggccugacaagaugacagucucugguuucuaacaaagugaaguuaccagugucaaaacagaggauguuuauuguuaaaaaugucucaaaguauccacagaaaccccugcagaccccugccagcaaugcugggccuuuguuggcugaccuaaggccuaggacucuucuggugugaagcccagagcaggaaugguggaguugcagacagacucagacaacagcugggaaccccauguagcaccccacaccacuaccccaccacacacucacauuccaggcccaggcaacagaaggaaggcucuuagaccucccuuaaucacgaggcguguucuucacccucuacacacagcccugucugucguccucuucucccuuuccucaccaccaucagcccccugagccucucccucuucauccccagauuccucccuaggcugaaagccaacucucagccucccugccuggagcuggcaaggccagcauuacucaggucagacauggauguuugcaaucccccagcccgccaacccuagccauccccaaacaccacaggacauuuccugugccuuugcuuucugccagaccuccaccaggaaaugccagggcagggcugagagauagaccugccacccaagcagucaugcccagggccuagagugucacuugagugauuccugggccccauuuuaaguuuucuccuguacauuagucagacacaggaaaaaucugcuguaagaauuaucuaaaaagaugaaggcuaucuguacugguacagaaaaauguuguaaguauauaaaauaugaguaaagaagggguggcuaaugugaucucaguguuaccggaggaagcuagccuauguacgugaguguauuuacaaaagugcguaaggaacucaagaaggcacagagcuacauggagcaugagacagcugcaggacaguccccucugcugcucguuacccuguguacugauagaugcucacagaucacucuuuuaauagauccuuugaccauagccacaggccccuuuagcaagccucuccugagagcaucccagagcuaaccccuucccccacauucguaagaucuguuccuacuuucuauucaccuuuguauuuuuuaaccuuuggauacauaaaacauuaacacacacaucccaccuuuagaaggagagacuuuguuagaaugagggugagggcaguuaauaggaaucuagggccagggguauaguuaggagucugcuuccuauuaguucugagucuuuggaagacaggucugcaguuugaguacucucaggcaccaggcacaagagucccgugugaggaguucauagccccagcacagcuccuaccuagcuugacccucuaagcaucaggggaauggugcucugagccuggaaagaacuugccccuccacaaccacauucuccccaagacaggagauuguauuugacacuucuauccucagcugagcccaucugauuucugugccaacagaggagccaauccgccuguuacgggaggugguguugcugaccgaugaucggaaccuucguguaaaggcgcugacaaggaaugugccugugagggacaucccagccuuccuuacgugggcccaggugggcugaggggaccacacuggggcccacccccauggagccauuccugagaggccgccaggcgcccaguguaacacggaagauguccacgugccugagcuaccaauccacccagacaauaaaccauccucuuccaaccucacgccguggccgugcugugggggagccgcuccucacagagcccucccaagggucaggcggaaacugcugggacccuccugggcugccaagauuuagcagggaggugacuggcuacagugacaacagguggacaagccgaguaggccaccaagcucccacccuuuuucccucuaucuggucccagggcuggagggaggccuacucaccccgaggacccagccacucuguagugguaaggggcagagauucuaaaguuuccauuagaugcaaggaaacugaucaaccccucagucugcacagucucuguccugaaugucugagaggcuucagcugucaggaagggugcccaggugucuccaucucccugaggcccagaugcccuguggacccacgcugacuucugucuguaacagcaacagcagcccucgcccuucaacacacacgcacgcacucacacagcacaugugcacauguuucucuuccuguccacaucuugcacuuugcccuuguuuuccuuuugggcagucaugggccuaagggaagggccaucuggucuugggcccgugcguccugaguggcccuccaccagcacaugcucccauccuuggccuuccuuucacugcaguacccucuuggggaaauuuccucagacucuucuuugcugccuuccuuuucuaguuggccccuuucaucaccccaaacccccuaaacuuccuccccucaguuccuugugggacuucucguucugaaucuuaccccuaccaccugugacaggaaccaaauaaagccuucccagcuguccuuccuucccaacccgucacaccucugagaagucuccuagcugggagagcugaaccccaagguagaggugccaggguguugagcccguuucuggcuuugucauuguacuucuuuacccagaagaggggacauggggcccuuuagccuuugaggguuuugguucuuuuagguuuuuuguuuuuguuuuuugcugccucuguuuacaaccucacuuggaggcucccgaccaggaaugaauuccuucagucuagcaaagagguagaggaggauugagaaggcugucucaggcuaagcaggggaucacacaacccaccucaggaggagcagugcuucaccaagggugcucugcccuucucaggcccaggacagugcccaggacucagcucagaagcucucuugauuguaaggcgcaggcaggcuacuuccuuugagguccccuccucuggcugugagggucauuggcuggggguugggggauugggaauggaagaauaccuuucuucuuucugucccacuuggaacccugguuuuguuuccuuaauaaauuuuuaguuaugaaauauaauugaccucugcuggucuauuuuuugggacuggggaggggcggcugguuugggccuguaca

SEQ ID NO: 6178 - RNA, 5161 nt, Mus musculus
caguguguaggagccgcggccgcaugaaugagccgccgcacgaguacuacgcgcgccuauaaaagcggcggcgccggccgggcugcgggaggcaagccggcacuggugcgacgcggcccgacagguaaggaccaccaacagucggagaugggcagaugcgcggacgccaugggaaggcgaggaggggaccggaggggcggcggguuggagggggacuccggagugaggauggggggcagagugggagggacgaagguuccuuucagcuugguggaccaggggccggcggcugacccaacccuaugcagcaccugccggcacccaaaugcagacgcagacacuauggagaaacaucaagcggagagccgagcccccgaccccauuucccgaggcugagcagcuccugcgccauccuuucaagaaaguggggagaaggugcuggcgucucaggagacgcgcccccucauuucuccccuguccgcagagcggugacucagccuagauggccccgacugacugagccagggcgcccacgacagacagacgcacaccucggcccugcggcuuucuugggacccccguccugcaugcuccacacacgccccuucccugucccgucccuucccguccggucccgucccgucccaucggacugucccacugagcucaggacuucccgccucugcaagcggagcuguccucucaggaccaggcgggggcggggcuucgaucaggccgccccgcccuacccccaccgcuccccaccgccggaaaugccuccccgcugggacaucuuugacgucacaggacucugacgucacggucgcgugucuguccgcgcgcgcuugggaggaggugggggggccugagaagcagcagcacucucaacugcgggcgacgggauauccccgcccgggcagcgcgccggcaccuuggcucuagacugcuuacugcccgggccgccuucaguaacagucuccagucacggccaccgacgccuggccccgccccaggaccgccgacccccggccccuccacgccucccugcgccgcuguccgcggugcugaugcagugcaagcgccucccucgggcacgccuguucaaggucccuguggguugcggugggcgcaggccccgcagacacucgcgccacccccgccgcccgcggugcugacgucagccugcaagccccgcccccgcgucuccagggcaaccguggcuuucgauuguuacugugggaaccggagguaacagucuacagccauggucgccccgcagcacgcccacgcuccccaccacucccgaguucugccagccuggguuugggcagauacagagcaagaggaggcggggcggcgacgcaacauucgaugugucugcggagguggcaagaggugugcucagaaaggcggccuuucaggcugcugugcaucuaccucggugcagaagcaagauccgcggagugucugaacauccuccucagagacucuccugucuuccuagucgagguaucgcugccuaagguggcgagaaaaugggugguucugcgauaaggauucuuaucucaugaguggugaaccgaugggaucaggaguccugugagaaggaagaagucacuuuugccagcagaaagcugaagggggaggagaaggaaguuuuaucacaccuuucuuccagaaaacccuaggugagcagguagaggggaaagggcaaagaaucccuuuccugauagagccauaacucugucccccaacuuucuccugggccaucauuaaaaggguccuuaacacagcaagaagcuggcaggcuagugaaauucaccuggccccuaauucauugucugaagguaucagccagcagucuucccucaacuggucuguaaguaaugcaucccaacuugagaucuucaaacgugcccccaaaaggaguacaaccacagagacugcacguaaauacucucuguggcuagggcuguugagagacucugucugauaggguagaaauccugaguguaaucaagaugcagaaaacaaauagcagggauaauuugaaaagaggacagccggacagugguggcgcacgccuuuauucccagcacucgggaggcagagacaggcagauuucugaguucgaggccagccuggucuacaaagugaguuccaggacagccagggcuauacagagaagcccugucgucucgaaaaaaaccaaaaaaaaaaaaaaaaaaaaaaaaaaaaaaaaaaagaaaaaagaaaaaaagaaaagaggaccuuuugcagauggaacccaucagaagaugugguuagaagguugacuauauaaugcuuugaguguucguuguccuagaaaacauuuaguguaaaccaugccuucuuucccaacuuuacacauuagaaagcagaagcccagguugggcauuuagccuauagagagcgguaguuuuugcuugcuuuuuacuggacagcagaaagaccaaccaaaaccaggagcugcaguguauaccugcagucccaguugcucaggagccuagacaauaaauaugagauaaauaugagauucgugucucaaaggggggggggaugaugacaacagacaagaauauggggcuuuugagucugaaucauccaauuuugaguaagguacuuagccuuucugugccuguuuccucaauuguaagacucaguuauuagguuaaugacaguacuuuuucaugaaauuagacaauggggggggggggggacaggggugcugggcauagagcucaguaguaggucugugcuuagcaugccuaagguccuggguuugaucccagcaccaaaaauaaaugaguuaggcuaugguagagcaugcucugaauaccagaucuugggagacagagauaaguggauuucugugaguucaaggauaaccagaacuuccgugagacccccgucucaaaaauaaguuagaugacaggcuucuauuugucucauugucugguauaguuaauucucaauaaauguuauuucuaccucuggaccuuauccgccugggcuguacauaaauguuagagcauugauuccucggggggagggggcuucuuuuucuccccagaggguuuugagucccacuagaggcucuuuccuaauaccacauauuuaccagagacuuaaaauucuacccaagacuguaguuugcaaauagcuacaucaggaaugaccaggggcagacaaauaggucuauaguuuucucuaggaacuccagguuuaacaaguguuccuuguguagguggcccccagggaugugcaugugguaguucauuccgcauggugggaaguaacucuccacuuguugggacucggaacuguucugauucuugggagggcucuucacuucagacaugggcccuucuguguguuccaccuaauagagcucugcuugaacccucuccucccuuuuuccugguagagccagggccuacagaccacucacaugaaccuuugccuuuauuuauagggcuaccaaguacaggucauccugucccccagcuuggagcugacacagggggcugccuaugacugccaguggucugaguacuaacuugcaaacccaccaauuaguuacagaaaagcaaauagaccaaaggguuuauaaaauuccacguguucaaucuccuuuugucaaggaagcaaucacuguaaggcaagaacaaggcacagagaccaaucccccacccaagcuguuaaaaagggaucucaaaucaguacaugggacuuugggguauaauuccagucuauccuuucgugaaauuuuaaaauguuuaguguguaugagauggcauguguuagcuagcagucagugccuuuaaccugcugagccaucucacugucuuuugguggaaaucuugagcccuaaagaagccagaggccuuuguaacugagucagacuucuauguaaguggaguucggggcaagagaauacauggcaaggcucugccuuggucaucuaacagagguuacagagagcguuccuguguagcccucucuguccuggaacuccaucuguagacuaggauaagcucagucucagaucugccugucucugccagugcugggaugaaaggcacgugccaccacuaacugguuguuuuuagacuagacuguccucuaccucugccugcauguaccaccauggccauugggucauugacuuuuuaaacacauaucauguacaacccugggaccugggacuagagccucuggaacuaagagcuauagauguuugugagcuacauuguggaugcuggagcccgaaccuggguccuuugaaaaagcagcccauguccuuaaccacagaaccauuucucugauguauaccuugaaacacuugugugucaagaacauauaacucuggguauaagaaugacuugggaguaacuggccaacuccaacuccugcucagugacuaagcucccuagaagauauuguggugugggacuagguaaguaccuugugauaucuuggaaaaacugucuuucagaggcagaagucagaaagcagcgugccuauguguguggcaagauugggcacuggaagugagaagaaaaauggcaagaaguuaagcugagcaggcuacuuaagcuuuggcuuucucaacauaucaauaauuagcaucaucaauuaugaauagcaguaaucucagaaacccugaagauggcuucauuaggaaaaggcagguuacucugugcugucuuuggccucuacccaacauaugguacuacccaagucuucaagcucagaguucagagggggauggaacaguuauggaagagaaagcaauggccaagccagggaccaggauguaggaaaccuaaaagcagauggagccaagcagagccuugccaaguguuuucuuuccccaaacuccucaaacguaaaacuuucugauucuaagugaccaagauaucuagcuucuucagucugggacuuaaacuuccacaaaaggauggugacauggcucagcagguagaggcaugacuugccaagucaaaugaucagagcucagaaagaacccacaugguugaaucaacuccccgcacuuauccucugaucuccacaagucugcacccauacacacaauaagccgaauuuaaagauacaaaacaauaaaugacuuccacca

SEQ ID NO: 6179 - RNA, 57275 nt, Mus musculus
cgcggcaggcagagcacgugacucuuccgaggccggguucgaggccuaguggcgggauggcgggacgugagggcggggcgcugggucgcagugcgccugugucagcgcggugcuacugaguuguucccccgccagcugucggaacuuugcccgcccaguccuuuggcggacagacagaauggcaacccagggaacagucggagcucuccccugguaacugcugcuaaauauagucaaagcagugaccuggguacuucuucacgcagugcgugcccggcgccggugccaggcccagagcuuggcacugugggauaaacaagguaaaucagacucagucuccgcccucuugaguuccaccugagaguuguggccgcaaggaacccagccucaaggaugguagacgcgauaugggccacacauguggagcuccagagugggggucaaaaaucaaucaggcuuucgagaggcgaugcgguuugaacugaguuaaaguguguguagaaauuugucagguggauuccagugaggauagugauguuccuaaaagcccaaauggccuaugcaaaaguauuggagagccuggcgugcuggcuggcucugaucuguuuguaaucccagccuuugggauguagaagcagcaaaaguucaaggucacccuuaacaccguugaguucgaggucaaccugaacuaaaugagacccugaaaaaucaaaauuugggacccaggcgugguggcauucgagguaaaagcaggcagaucucugaguucgaagccagccaggcuaacauaagauccggucucaaaaaaaaaaaguaauaaaaauaaaaagggagagaggcuauaugaacugaaagaaagaccuggagaucaaaacagaaaacugagccgucuaagaaaugaaaauauuuaacuucauaguugcuggaguaagaagucuggaaaacuuugggcaacuaagguaaacaggucuagaaagacuggaauaguagccaucuacugguauuuugaucucuguuuguacaaccacaaccuacuauaguuucucaaacaguuccaaagaauaugucugggugaauugguaccacaccacagauuaacucuccuucagcauaucaacagcuauagaaaaccccagaagaaaugauuuugguugcgugucacuugguaggaugaaaucucgauuuucuagaacuaugcauuaauagaaagcugaaucuucauguucugacuuuacagagcugcggcagcauggaucuaccgguggaugaauggaaguccuaccuacuuaagaagugggcuucacucccgaagucugugcaggacacaauuucuacagcagagacuuugagcgacaucuuccuuccuucuucuucccuucuucaguaagugaauggaaacuucagggaaauuuuggucuggaaaauguucugccuugucauuuggucugaauaucucuuuuuuauaggagagaguagcuuuauauuuuuuauaguauggggcauuuagcaguuacuguugguuuucacguuucucccuagucugugauuauagaauggguaggcauaacugcuuuccucuuuugguauguguuauacuuaaguaauuuaguaucuugcugucgucccagugcugucacucaaaggauauggugcagguuguguagcugcccauagaagcucauucaguacuaauagugagaaagaacccuagcaauuguuuaguugagacccagaaauuuucaaauucuauggacugcauucacuggugagauagacauuuuauaucacaaccuaguaaauguauacauagguagaagucucauuuacucagcaaaucuuauuuuuuaauuuuuaauuaucugaaauuaaaauauaauuacaucauuucccuacuuccugccuccaaccuucccauguaccccuucccacuuugcuuugcucucucuuaaauucauggccucucuuuuuaaguuguguguguguauguguguauuccuaaaugcaaucugcccauccauaugauguuacuugugcguauauggcuucaggacugaccaguuuguuuuggauaaccagcuuggguggggcuugaaggguagaggaguguucccuggggaagacuaccccccccccaacauuccuuaguugcuuagaguucuuugucuaacguuggaccccuguaagaauuuuuuccccuuucagguuaaccuauauaaauaagacuuucaggccuuguucuugagacuucagaggucuagaaaugucccugacauuucuaggagaugcagucucaccucugacuuucuucuuccucugguucuuggaaucuuuccacccccucuuccuccauguuccccgagccuugggugcaagagugcugagcaccacaugaucacauguucaguaaauauuagugcucuguggcagucaagaacauuaaucccugcagucuggaggcagaggcaaaaagauuguuucagcagcacauauacuaaaaauuggaacaaaaccagucaaagaaccacacucaccaggaaaggaugugaauguggaugcaccgagcagggucaggcaauagcagcgagguagccacgcccgcuuaggcuucugacccaccggacugugaggaucauaacuggcuguuguuuggagcugcucagcuuggguaguuuguugaacagaaguagaaaacucguuggcagaggcuugagugugaugugagcugauuauaucuucaaagagagaugaucaaacuaagccugcaggauaaagccauccaacuguauguuuuucuccuaggaccacagcuaaggauggcuuuuuaccagauaaaaguuugcaguugauuuuaagauaaagagcacuggccaugaacccuaauuaaacaaaaaaggacuuuuuuuuucuuuuuuuaaacaaagaaggccagugagcuggcacaggaaguaaaaugcuugccuuccaaagauacaagccugaccaccuacuguguaagccugaccaccuacugugcaagcuugaugacuugaguucaaucucuaggacccacacaaagguggaagcagaaauccaauuccacacacaugcuguggaauaugaauaaacacaaaaacacuaauaauuaauaaaaauaauaacaauaaucuaaaaaagaaacuaaucccacugcugccauuaguaaacuuacauuacaaaaaaaauacacucuguuauauuuuuuaguuuugucaaaagguuuuagaaaucucugcuauaaugaauaacuauaauuaauauccacuucuuggcuuucaaagccuaaguacucuaguuuucuacacggaaaguuugcugagcccugauuuuucuuuuuaaugauuuucaauuuaaaucucuuuuuacuucuguguauguguguguaccaugugcaugcauguacaugugcaguuuacacaugguggucagaggacggcuuuggagaguagguccuuugcuucuaccucguggguucuaggcuuaaccuuagaucaucagucauggcaggaagugccaccagagccgaucagucucacugguccugagcccugcuuuaaagaacugcuugucugcugugucaaggauaggcagcagaaggagccaggguagaagcagagaagcaguaaccucaauaagaaaauggacucaggccagcgugaguguagucaggggaggaagaagcauuuggacucugagguacauuuaauggcaauucuuuuuuuuuuuuuuuuuagauuuauuuauuuaauauaugugaguacacuguagcugucuucagacacaccagaagagguaaucagaucccauuacagaugguugugagccaccaugugguugcugggauuugaacucagaaccuucagaagagcagucggugcucuuaaccucugagccaucucaccagcccuaauggcaauucuugagaugagagguguuguguuguggagugugagagguaaaacugacccuagggagaagggaggagggugacauugccaaaucugggaaccgcagauggggaaaggagucacacuccguguuugaguugcacgugccccaaugguaaugucuaacuauguuuggaauuuaagagagaggccuaggauagagaaacaaaccuggggcguuuagagccagaaacugacuaagccuccaagcaagaguguguggcugcuuaccgcaugugcugugcugugacaauaugcccucugcuugccucauuuugaaaugcuaaucagaacccacuaaauuaauuucaugacccacugaaucaugaccugcaacuugaaaaaagcugaaaaaugucuaaagcggucuacagcaucuguggauuccccucacagaauuccaaaaaugguugggaacugaugaaaauauggcuaauaggcagacuuuggcuagauaaguuauucugguuuacuaacagaaacaugugguaaauaaacaggaaucaauugacuauuugguacauuggcaggaacaguuaauuaaagagggguguuaauguguaauagacgaguuccuagccuggugugguggcacacgccuuuaaucccagcacuugggaagcagaggcaggcagauuucuuaguucgaggccagccuggucuacaaagugaguuccaggacagucagggcuacacagagaaacccugucucaaaaaaccaaccaaacaaacaagcaaacaaaaaauagaggaguuccuucagauucuagccugggcuuucuucccuguacucuuuguauuuucagcugaggcacuuacauucagaacaaugacaucaguuuucucuggaaugucucuaaaacggaauucaaguccuaacuucuuuucugagucucaaauugauaaaucuaucauauccagaaacaaacacaugauuuuaccaucaaaaucagauucacuuccaguggucccuauccuagugaauuauaacagccuuagguucaguuccaaagcuggcaguuaugggccuguucuaaguuucauuucuauugcugcgauaaaauaucuuagcauaaagcaacuuggaagaggaaaagguuuguuugccuugcaauuccagggugcaguucauguuucccaggaagccaagacagccaucacaucuacggucaagaacagacagagaauaaacacguggauccuggcuugcuugccugcuugcucucaucaagcuuucuccucuuauacuucagaagacuucuguucagggcguguugcugcucacaauggacuugaucuuuccaugucaauuaacaaucaggauaaucccuuaugagcaugcccuuagcccacccagucacugagacucuuccucagacgauucuugguuaugucaaguugaugauugaaguuaaucaucacagagcuauucuguauugaaaaaccaaaugugugagccaggccugguggcacaugcuuacauugccagcgugcagaaggaucagaaguucaaggugauuuacaguggugaguuugagaccauagacuacaugagaccuuguaaggaaaggaaagggaaggaaagagaaaaaaaaaagcaaacuaacucauuauguucccacccccagccauuuuguagaaccucuucaugaacuguaccaacauuuguccaguuacaauucugaaacuggcugauuuuuuucuuuucccuugcacucuguaauaaaucuauuuuuuuauuauuuauuuacacuuuuugcaguggguauugaugccauauuucuucacauuugguaaaugggacgucugcuuccugauagaauaugauaggugacagcaagcaauacuccuaaggcaacucaaaauauucuaccauaacaaacacauuuuaaagacuucagacugcagcaaggucuagauagacuaaaauuucuggaaggaaagacugcuucuuagcagucguuagccauuuucuuuccuggggauaaacugcaggccaaggaugaggaugagcccagcaaagugaccacccuagagaaaacaaaagucagcagaacucuuggcaguugguuaggucuggugugauggauugacaaauggacaaauucaaagcccaaauacaaagucaguuuuccccaguucucaggaaugaaaagucaacuaaaaaggcagaauagaucugcaguccugcaguggugaggagcaaaaucucacagccagaagggacacugcagcaaacacaagugaucuccuuugucaagacauuugccagauguugaaugucugugauaugacagcuacagauccaaguccagaaccucuuaagaccaaaaccuggagaccuaaagaaaaaaagaguucuuuguaggcucucaaaggaaagcucaggaggaccauuugcaaggagcaguaaagaaccggcuguaccugccucagcuucacuaggcuagcagaaggaaacuugcuacguaaacaugaagacuuugaguucaaccccugguacccacauguauuagaauucucuaaggaaauagagcugauagaaugaauuuacgguuuugguuuuguugaaacagguuuucucuguguagcccuggcuggccuggaauucacucuauagaccaggccucgaaaucagagaucugccugccucugccucuugcgugcugggaguagaggugugugccacacacccagaugaauauguguauuaaaaugggauuggcuuacauaguauugucuggguaguccaacaguggcuugucugaauagguugcgaaucuaguagcggcugaguccaugaggcucaaugucccagcugggccagucugcauugaggacuccuggagagcugcuggucuucagucuaggauggaagcuugaagaauuugcuuguauuaucagcaaaggaauaccucaccaacagauuuauaauccaaacacaggcugagacaggaccaucaagaguucaaggccaugggcuggugcgauggcucagcauuuuacauuaugagauggccagaagucuuuggggauuaggguggaauaccauuauuugaauauaauuuaucaccccaaaggcacuuggugcauccaaccuuuaagaggugacuggaucaggaacuugguggaaacuuucaugaugcuauaacucuugaauucugcauaacuacaaaaccagucacaaaaugauaaugccaaguaccacagccaugcugagcaguaguuuagccuuuuuagacauuggcuacuacagaagugaccucugaaugccugagcaguuaggaaggcugaaaugaauccaggauaaacaacuuucugggcagcucugagagcaguguacccuggugcucauuucuccaggggaaguuuucuaaguauuuauacaucccugagcacucggaaggcuauugcugauuccagaacuguccuuaaaggaacauuuuugguauuguccuuacuacaaaguacucuuuuggguuuuuguugugguuguuacuguuauuguugcuuaauugauuuuuguguuuuaaggcagguuuacacuauguagcccugucuagccuacugcuugcuaugcgaucucaaacuaauaauccuccugccucagccucuggagugcuggauuauaggcaugcaugaccaugugcagcuguagacuucuuucuuuuuauuauauauauuuucuuauuugugggaggcauauguguggaggucagaggguaacuuguagaaauugguccucucccauuauguguguccccagagauaagcuacaguugucaauauuuuugggaaggacuuucauauguugagccaucucacuagcuccaauuuugcaguuugguuuggacugaggagagcuguuuggcuauuugaggucauggggauuaaacccaaagccucagaaaugcuuuuuuaugguuugguuuuguuuguuuugaaacaggcuccuacgauguagcucuggcuaaucuagaauuguauagcccaggcuugccuugaacucacagagaugaaccugcuucccucuuacgagugauggaauuaaaggugugcagcucuccuggccagcguuaagcuuuuaaacaacuguguucuccuuguccacauccuggaacacacuccuauugagauguguuccuuguauuuuuauccccuacaaacuggugguuugauacuugguuccuaucugguaguguucuuuuaauaaacuguagauccuuuaagauguagggccugacggacagagguaggucaguggugguaggccuguaagacuguaggcagcucucuguuuccuguccaccacacaaugaacacuuguccuuucccacacccuccugccagcagguugagcuguuccaucuugucuucccugaauuugcugagggaaacccccugaacccaugaggcagaauacauuuuuccucugaaguaguuuugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucaugcaccuagugguguagaggagaaucgacgaccagccaaauuuuuuacaggcuuauauaguaaaacucaaggggggagagcugggcagggaaaguacaaguuuacaucacuaggggguucugucaggggacaagggguucugccaagggaaucuacguaacuaaggggucauguccuauuauuuggcaauguacccgguucauuuugcgguuguuuuaggaggcccuuaucucaaaaauguucuaggaacaguuuuuaguugggaggguucgaacucuagggugaggaguucaggaaugcauucuggggugaagaguucaggaguguuccgggaacaaucucuagaugggaggggucggguucuggggugaagaagaguucaguaaaaauuuuuauucuucauuccccacuucuuuuaggagauagcucuaaucuuagagcgaguuuucaaccuccugaaggacccgauauuguugccuuaguaccauaaccuggacugcguuuauccuuuuucuaauaaaagcuacuaacuuauuaaggaugcagggcccaaaaguaagcaaaagcauaaguguaauuaaagguccugcuauaguggagaggagaguggugagccaaggggacuuauuaaaccagcuuucaaaccaucuuuguuggcuuuuucuuucucuuuuacguauaucuaggcguucucuaaguuuagccauagaaucuuugauuacuccugaauggucaacauaaaaacaacauucuucuuuuaaggcagcacagaguccucuuuuuuuaaggaauaauaagucuaauucccuucuauuuugcagcaccacuucggacagggaaguuaaagauucuucuaauuugguuauagacuguucuauaguucuaagaucaauauccauaacugcacguaguucuucauaguauugggggggucuuaauuaaggcagcgguuccuguaccuacuccagcugcuacucccaauccuaauagaacugccaaaguuaagguaacggguucucuuuuucagcggacccgauguucaaauuuaucuaaaaaagaacuauuaucaugauacaagagucugggaauaagcugaaccaaaaugcagaaaucuuuggaacuauuaaaaacagacauagacacacaaggagugagaccgguauugcaagcccacacugugucuaggggaggcaccagauacugaccgcuuuugcuagacuggauguucugggucugauuacagaggugcccuuuauccugagguacccggcccagacaaagcccucuuccugaaacugcugcuagagucaacuuucuguuuuuuccccaaaggcauugagaaugaucugaaguaguauuauaaguccugaucugagcuauuccuuuauaauaaggggggcuagaggcauagcauaaccagcaugauugagucauauuaggguuaguucuauuuagaacuaaaaaagcuccuuggacuagacugaccagacgguccucuguuccuaggggcgguggggaagccaagguaggcuuuaugaggagaguauuaguuccuagggaggguaccacuguguugggcuguggaguugguggagcugguacagucgggaccuuugggggagccaguacgacuggggggcccuguuuuauaaggaccuuguugggcccuacgagugucacugccgggucucucacugucaaucugaucgugaaaaugaacccaggaucucuuaguggaauguauacucgccaaccccaccuauuuccuuuaagccaacuuagacgguguuguuuuccguucucggugaaccuuauacguaggggguuacaguauuuaucuuugcaugguccugagggugcucuguuuuuaaaagcgcacccacucucuugauauuuauagggguuucuuucuccuucguuugacuuaucauagccacuaccucguuuuaccgugauuaggucccauuuagaggagggcuuccaguaagcaucuccugucguuucacauguccauuuaccacaaaaguaaucugaugcccccccgcauuuuuguugaagccuuuugcucugacccugaccagggcaaacauaaaaaugugcagcucuaagauuagcucgguagaacugccccgaacacccauaugugcucccuaucccauuugggacacaccgcuccucaggggguggguugcuaagaucaguaugaucugagaggucccaauugggggauccugccgcuaacuuacagaugucaggcgugagaucaggccaccaaauccagaggggauggacugcagugguugcccauacaauguuuuccuuuucauuaagcaccucccaggacuguugaauuggagcaugaggguuaagguucccuaggucuagaguggcgccugcggcgcagacgaagcuuaagaggauugucagugacugccacuguccaauugucgucgugguuuucuucaucuugacuggcggcccucuugacgugggaggcguggauccaggaggcgauuccgucaacuuuuaccgcaguagggguugucaguaacaccaaauagggucccuuccaccguggcucaaggcuaccgguucgaugccgucugaccaagacuuugucuccaacucggaacccgugggguacugcgguggucccugggguauaggcugcuuucaguuggucccaaaucuggguccuaaucacuuuuagggccuuuaaaugaauaagcaaagaggaggguaagacagggucagagucggaaacuaauguuccaccagcuuccauuaaggggggagguccuccauacagaacuucaaaaggagugagcccgaaacgaccagggguguuugagcgcaagaggaaggagagccacccagucuuuucugccggucucaauggcuaauuuagucaaggucucuuuuaagguccuauuuaucuucucuaccuguccugagcuuugagggcgguaagcacaguguaauuuccaaucgaugcccaacugaguggccaagcccugacuuaccugggcaacaaaggcugguccauugucggacccgauuaccuuagggauuucaaaucuuggcaggauuucuucaaggaucuucuuggccacaaucugggcagucucuguuuuagugggaaaugccucaacccauccugaaaaggugucuacaaauacuaacagauacuuguuaccauacauuucagguuuaacuucaguaaagucuaccucccaauacacuccaggauggucuccccguugucucuuuccagguucucuguaggcuuuaguugcauuagugaaugcacaugguuugcaggagucuauaaucuuuugagccacugacuucagguuggggacuugguaucgggaauuuuuaauuagucucaucauuuuuucaacucccaggugggugaauugguguaguccuuuuacaaauuuuauuccuucuucgggaguuaauucuauuuuucuuucaaaaaaaguaugggaggggaucacuggucuaccauagcucuuuuauguuauaccucccauccucagggcuuuugggcggaucaccuuuuucaguuaagaucauggccccuugagcaacuuguuuugccacuaagucugccauucgguugcccuuggccaccaaguuuucuccuuuuugguggccggggcaguggaugauggcuaccuuuuuaggugcauguauggcuucuaacagggccagaauuuuuucuuuguuuuuaaugucuuuaccagccgaggucaauagcccucgcugccuguagauggccccauggaugugugcgguagcaaaagcauaucggcugucaguguagauauuaacgaucuuaccuuuagccucucggagggcuuguauaagcgcuauaaguucagccuuuugugccgauguuccuucaggcaaagcgcuugcccaaauuaccuuuuucccgucuaccaccgcagcuccagccuuuugcuuccccucuaucaggaaacugcugccguccguguaccaacugggagcucuaggccaggguuggucagucaggucacuucuggucccaguuucuucagcgaggauguccauacauugauguacugggacggaaucauuuguuagagggagaaggguagcuggguugaggauggcagggggcgcaaagguuacacgcucauuuagcagcaggcucugauagugugucauucgggcauuugucaucuuaucugucagguggcugucgcacgauacuuucuaaggcaugaggggcuacaacggucaccugcugucccauugucaguuugucagcaucuuugaucagcagggcuacugcugcaauagcuuucagacaugugggccauccacuagcaacaggaucuaauuuuuuugacaaauaggcuacaggucuuuuucagggucccagugcuugugucaauacuccccuggcuacacccgcucucucguccacauauaggacgaaaggcuuagucaagucugguaaugcuagcgugggggcagucauuagagacgacuugauagccucaaaagcucuuugguguucuucuuuccacuugaaaggaaccccuuccuuagucaaaggauauagaggugcugcuaggguugcaaagccuggaauccagagucuacaaaagccagcaguccccagaaacucacguaccugccgugggguaguuggcgaugggaucaucauaacagucuuuuuccgggccucugugagccaucuuuugcccccucggaggguauaccccaggaagguuaccucaguuugacagauuugugccuuuuuagccgaaacucgauaccccaagucacucaguucugugaggagccucucaguucccuggugacacagcuccuucgaggccgccgcgaccaagagaucaucuacauacuguaguaggguaagcugaggguuucgagcgcgaaaaggcgcaagaucccgauggagggccucgucaaacagggugggggaauuuuugaaccccugugguagccuaguccaaguuaguugaccagucuguccgcccucugggucccuccauuuaaaagcaaacaggagcugacucuuagggugcaaacgcaggcaaaagaaggcaucuuuuaagucuaggacuguauaccauguucucucaggugggagagagcuuaauaaauuguacggguucgggacuguggggugaauguccaggacccuuuuguuaaccucccggaggucuuguaccgggcgauagucauuggucccugguuuuugaaccggcagaagugguguauuccagggggacugacaggccacuaaaacuccuuggcccagcaaccucuggauaugaggccggaugccuuuucuagcuuccuugcucaugggguauuguuuuaccgaaauggggguggcaucagcuuuaaguucuaccacaaccggaggcacuuguuuagccaaccccauuccugcuuguucugcccagacauuggggaacgcaguuagccaaccugaagagacugcauuuuuggguuguucuucaugcaaccgguacucuuuuucuguguugaggacaaggcaggcaacaggggccuuuccccagcuuacuugugggccuucugaaguaaauuggacuugagccuuuaguuugguuagcagaucgcgccccaagaggggagcagggcacucagguaucaccagaaaggagugggucacuauauuuuugucuaucugaagagcucguuuggucguccagggguaaaauuuacuaccaguggcuccaauuaccauggucuuuuuggagccuagcuugccuaggggguuagugaguacugaauguucugcuccggugucuaucaggaaguugacgggaguccccuccacggacaaaguuacccuaggcucagggagggggucugagccccgacuucccuaaucaucuucuaggguuaggaccuuggaucgcucccgcuuuuuagggcaaucucuagcccaguguccuuucucuuugcaauaggcgcauuggucuuuuuccagugguaucuuuuugccaccuugcgguuucacugcccuguugcccaggagcccuauuuuaccuuuuccugacugucuaucauucacaacugcggccaaaauuuuacucagauuucucuccugacggcgaucccgucuauuuucccucuccucuauuucuuucuucucucucuccugccucucuucuucuguuucccucuuaugauagacuuuuucugcuucuuuuacuaaaucuuggagcguaugaucuuggagccccuccagccuuugcagcuuuuucuuaaugucgggagcggacugaccaaugaaggccauggcuacagcggcucucugccccucugacaaggggucaaaagggguguaucuccuauaugccuccauuagacgcucaaggaagacugagggugguucagucugccccugcaagaccucucuuaccuuagccaaauuggugggccgucuagcggcuccucugagaccugccacuagaguccggcgauagacaaggaggcguccccuaccuuccgcgguguuguagucccaguuggggcgguucaaggggaaagccucguccacgagguuagggagggcagugggugugccguccucucccagaacauuuuuucucgccucuaugaggauucuuuuucuuucuucuguuguaaaaagaaccugcaaaagcugcugacaaucaucccaaguggguugaugggagaacauaagugacucaaggagcccaguaaguccagagggguucucugagaagggagggugguuaguuuuucaauuauauaaaucagaagaggaaaaaggccaguacuguaaaggaaugagaucauuagguccuggugcuggcccucucacaugugcucugaguggcaaggcaacuguugagucuggccccccuuccuccccggggcuucggccucggcgacuccgagucucccccgccggucccugagccccucucgcuauuggucccugugguggggcagcugcagguggcuguuggggcaggggguaagggggagguugggagucuauccagaggaggucgucaaucucuggauagaucuuggggggugcugaugggccagacuuuccggcugcaucagacugggcaaccgcgaccgucaguuucgaagaguuugggguccaaggcuugacccacggaggugggaauuggacgagauucugccaggucacaauguaggggaucugaucagggugacccccuuccuccugaaaaacaauucgccugacggcagcgauuagugacaagucaaaagcacccucagguggccagccuacucuaaacguuggccacucggaggcgcaaaaggucugccacggacccuuucugacuuccaccgacugguugugggcucugacccgcaccuccuuccaaugcuccagagucagagaaaggggaguggacacagauugucccauuucuagaaaaacaguagacacaacaagagcggacacgagacuaagacaaaaaagaaaccagaaacggcggcgacucugcgucgaccacaagcaacucaaagaaucagauggccuuucuaaggccggccgauugagacccucugcacgaggugggacucgaacccacgaucucgugaccaaacgcgaggugggacuugaacccacggucucgcaacaaaacgcgaggugggacucgaacccacgaucucgcaacugggcacgaggugggacucaaacccacgaucucgcaaccccaaauggucucuuggccuccaaagggguccaccaggcgucccugguccuccccuguuuuuccugggacgucucccagggugaacggacgguggacaccuggacacgucuauccuuauccaccccgcguucccucucggagcgcggucucacugagcauccgcaaaaccgaaacugcgaucgcaccaaacuuagaaacagaacacaaacaucagaccaaaacagaacaaagaaccuuaccucuaagugggucuaggaccucuggguggucgcgcuguuucccggccaaugcaccaaaaugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucaugcaccuagugguguagaggagaaucgacgaccagccaaauuuuucauaggcuuauauaguaaaacucaaggggggagagcugggcagggaaaguacaaguuuacaucacuaggggguucugucaagggacaagggguucugccaagggaaucuacguaacuaaggggucauguccuauuauuuggcaauguacccgguucauuuugagguuguuuuaggaggcccuuaucucaaaaauguucuuggaacaguuuuuaguugggaggguucgaacucuagggugaggaguucaggaaagcauucuggggugaagaguucaggaguguuccgggaacaaucucuagaugggaggggucggguucuggggugaagaagaguucaguaaaaauuuuuauucuucaguuuccauaagguauuuuggucauagcaacauaaaaagcuaacuauaaaaacuaaguuguauaugaagaaaccuccuucugccaaaacuguccuuucuacucugcuuuuuuguucccaauucuuaauauaaauccagcuaaacguagcuaguaacaguccaaccacagccuuggcugccuuaaaauucacuccaguguauuaauccaucgcucagcccuccacagucucaaggcauggcaaaauguagucgaguccuuugucacagugucacaggaaugacucuaauccaacucccaagaaaaugcuuauucccaucugaaaccucaagagcacauccuuaacucucugcauucucuucaccacauggcagccagcugucucaggauauuugaucguauugugaacccuaagauucuguuauuuauggagaaaaagaaacuauuucuagcuagaguuggcucagccuuauuagcacacaucuuuacucucacuggcugaaaaagagacacacccuuaguacucaccuuuaauuugaaacaaugaagguaaaguugguuuguagaggaggcacuccugcuugaaagugaugucuaauugaguggcagacaaagugaagaaucagagaaagguuugacaggauaggaucugcccaacccucaggagaagagagaggaaagggaagcuacguaagggagacacaggugguaccggagaagagagugcagcacaggauacaggagagcuguggagagcagugcaguagagcugagagggagaguagagcggcacagagggggaggaggaggcagguuuaccgggagagcuuuacagagaaggauggaagagagaacaaacuagacacaguaaagacagaacaagcaagagagugugaaggagacaagagauuagaaaagauugcuagaguuaguuugagaccaagcagagcaauucagaggccaagagaaaagacagauugugaauaaaaucaucggggagaggaguuugagccggaacagggggacugaaucagccagcuagaguucagaaagaacaggaaacggugaucucagcagcaaguccuaaaggcuggaacauucuaggcuuggauuagauuguauggaagcuagaagcuuccagggcuaggccuagguuagcugauggagccaguaagccuccaagaugacaguuacaucagucaaauaaauacuuuuacagccaggaagcggagaaagggaaggaucaaggaugagguagccucuccaaggacaugccucuggugacaaacuuccuccaguuaggccucaccuuguuucugccuccuggaaguguugccuucagauuauuaaucuaucaguuggucaauccauugauuagaucagagcauuccugauuuaguuacuuccuaagaguaugaacucugcauugaaccuccaacucaggaauuuugggggaacuuuucauuuauaaaccauagcacucugcugguucuuuucaaagauauacagucaaagaguuuucuauucuuuuuauguguuuauguauguuuuacauaaauacacuauauauuuuuuucuuuauucucuauucaauuucauugugugcguuguucugcaggggcuuuucauccucacaccuuaaucuucuuaauagucgugugauagaacgagaauaguauaaaugugucccaauuuguuguucuuuuuccuacugaugagcuauuaaguacuuuuuguuguuguuugguuuuguuucacuguugcaaauacugcuucaguaaacaaucuuuauguguguuuuugagcacaugcuuaagaaguucagacagacucuuagagaauugcuccacccaugguuauaggcaucuuaagaugaauagauacuaccauaugcauucagaaagccuuugucagcuuagcauaagcaaugccugagaggucuccaacauuccaagcagcuguccuuccuuggguucaguccccagaaccacuaaauaugaaaaacaaaggcaaaaagggcugggguuuaaucuauagcuuucugaucacaagggaaauaguauuccuuuucugucauuacagcucauuuguguuuccucuguaaguucaauuugcguccuuuguccauuuuguuagugguucaucuuacaucuaccuauaagucuggcuguuugaauauuugauauacuguacuauguaugcuacugaucuuucugguuuuuaaaaaucuuuuaagauuuaauggugucuuucauuauacagucauauguauauguauacauccauauccacagguucugcaaaccuagauucauuugaccuuagaugaaaaauauuaaucagggaaaagaaucccggcaacuccucagaagcuaaacuugaauugcaucacacuguacugaguccauguguaggcacaccguuauaacuuccugcuugacacacaugcucuauccagcacucugugucgucugagcauuauucucugcaucugauuuuguuuuuaauuuuuugugucugaauauuuuaucugcauauguuguuauguaccguguguaucagguauccaugggggcuggggaaaguugacagaucacccaggacuggaguuacagaguauugugagccacaacauggggcuugggaauugaaccuaggugcucuuaacccccuuauucucuacauuuauuacagcauuugugauacauguaaguagcccuaaaaugcaucuguacuagacauguaagcucuuuugucuuguccuuaggcacugaaccauaugacauaacaacuacguauaugguauuuauguuaccuuagguauuauaaguaacauauagggccaaugguagagaucucaccuaacauauguaaaagccuggucuuagucucuagcaccaucacccccccacacacacacauguuguauagacauguuguaaagaauaaacaaggauguacauauuacaugcaaauacuaaaccauauuuuauagggacuuaagcacuggcaaauuguguguguguguuugugugaauucacacaagcauaucuguuauuugggcuggguuguguuuuuuuaguguauuuuuuagauuuauuuuauguaugucuguguaucacaugugugucuggugcccacagaugccagaaaaggacuuuagacccccuggaacuggaguuacagauuauuguggguaccaggaacugaacccagguccucugcaagaggaacaacugcucuuaacugaucggucuuucuagucucuugguugguugguugguugguugguuggcuggguuuuuguuugucugugcuuguguuuguuuuuuguuuuuguuuucuauguaaaccuguuccagaacuugcuauguaaaacaggcugagcuugaagccauagucauccugccucucccucucuaguacauaaacuauauguagguauauaucaccauacccaccuuccgcguuuguuuaagauaagguuuugcuauauaguccuugcuggucuaguauuugucauuuagcccaggcugaccucaaacucauagccauccuccucccucagccucaaacacugggauuacuagugugcaccacauggcuggcuugucauuuucccuuauuguuagcauucuguugaagcuuugccucacaguuaccuggcaacagccaggcaugcuugacucacuauaaaagggccugcuugcccccuccucucucucuguuccucucuugcuuuugccuucccacuccugcucuguccucuugucccuccccccccccccaccacaugcuuauggcuggccuauacucaucuacuguucuacucucuuucucugccuuucucuguuucuacuacccucuuaacuucccuccccagacccuuaguaaacucuauuuuauacuauaccauuguguggcuggucccucggggaaaggaugccucagcaugggcccaccgaggcacccccuuccccacaccucagcucaccuccauauaacauauccccccucuauuuaucuuuuuauaaacacaucgcuuacagcuucugaauuauaugucuugcuuauuagaucuauucuacaucaagauuauagaaguguauuuucuucuaaugcuuuuggauaguuuuauacuuucaacuuuuuaauccauccaaaauguuuucuagcuuauuaacauauaauuaauagauuaaaauuaaguauaucuaagguguuaucuuagucaauguucuacugcuuuaaugagacaccauggacaaggcaacccuuauuuauaaaagaaaacauuuaucugcggcuugcuuacaguuuuagaggcuuuaguccauuaucaucauggcagggagugugguggcaugaaggcaagcauggugccagagaaggagcugagaacuuuacauccugacccacagcaggggagggagggagggagggagggagggagggagggagggagggagggagagagggagagagggagggagagagagagagaaagagagagagagagagagagacuccuucaacaaggcuccaccuccuaauccuucucaaacaguuccauucccuggugacuaaguagugaaguccauucucucucaaaccacaaugugauauuacaauaugcauacacaucugaaauuaguauuuauaugauuggucaguuuuugucaacuugacacauaccuagacauacgagagauguaaucugaauugaggaauugccuuuaucagaugaaauguggggccauuuucuugauucuguugcuguaagagagccuauaccuaggcaggugauccuaaguauaagaaagguagcugucuaagccugggcauaagccuguaggccaccuuccuccauguuccugcuccaguuccugccuccagauuccagcuuaaugaacuccuaucaugacuucacucaaugauauacauuuaucaggacucguaaggcaaauaacucuuuccuccccagguugcuuuuaucacuguuuuauuacaacaacagagaacaaacuaggaugguaauuuaccuuuuauuuauuuauuuuugagccagacaauuuucuacaguguuuauuaaacgacccaucuucuucccagaugccguucuuacugaaaauuaaguuacugcuuacuuuuuaaauuuguuucuagauucugugugccaaaacaaagaguuuuaauuacuaugacuucauucauuuuauaauucuuggaguuucagguuaacagaaacccaccucaaauuugaaauuuguaacuaugaaaauacuaacauuuuuaaaagcagauauguauuuggaggcuuggaguaugccgggaaacuucauauuucuucaacaaccaacagacuuugcauuugguaaugcuauacccauucuuagcccaggauacauucauagauuacuaaccccauagaaggagaccuuccuucuggagaguuucauugaaaaguucgaggaagucuuuauuuucuuuuucaagagaggguaacacuauguagcuagcccuggcuguucuggaacucacucuguagaucuggcugaccuugaacucauggaggucuuccugcuucugucuccugagugccugggugggggguggggugggggagguaaagcuguuggccacuauguccagccuugggaauagaguagccuaaccuugaucucccucauagcccuuuggucaaagauccucaguuucgacuuugauuacccagacuuccuguuucucucauggaacaguuucccccugagauuuacuaguggaagaaaggcacucaaaaagcagggagcccucguacaaaugagacuuccuagcuauauaauuaggccgagaugcacacauccacagucauuacccuucuucagagccuuugucaugucaaguguauuucgcccaugugaacuuuagaacuggcuuguuguguuucauaaaaaguguaguugggcucuugauugggauuguguuaaauuuauagauucauuuagggagagcugacaacuuuacaguauuaaauguuuucauccgcggaaaagguugucuugccacuuacuugggcuuucuuuuaugcccuuaaguaaagguuuauaguuuucuuuauaucagucuugcacauuuccuguuagauuuauuuuugcuuguaagguuuccuugguugguauuguguauaaacauuuucucccaauuacauaccauaauugaugguuaggaguauaaauaaaagguagaauuuuaaaauugcuguaugaaugacugcuuugcuauaauucaacaucuuuucauuuuuaugccaaucuacuugacauguuuagguuaaaugaugauaucuguacagaguaauccucugauccaguauuugcacaucuuacuuucuaacguccauagcauagauacacaucuuauacuguugaguacauauauauuuaagguauuuaccauagucuuauaauaugcagcgugcuuugguucaagacaguugcccuguguuccucaacauuaacauuuuuuucaucacaaauacacauugaccuuuaucaaauuuuuaaaacuaucuugagagaaaugaccauuuuucuuaaucuguuaauguaaaauuuuuauaaaaauaguuauaaauaauauuagccuacauauuucuucuguucucuuuuucaacucuuagaaucagaguaugguagucucagacuaaaccaggagcuuccuaucuguuucucuguucuuaagucacuuauauaauguaaggaugcuguguauaucugccagcuaggccuuauauacaaaaggcacccaucacaaccuucuaaaacagucuuaccacuuagagaccauguucaaacauaugggccuuugagguaauugccacauucaagcuauaauauuguuaucuaagggaauaucuucacuucuagcagaugccuaaaaauaucuaaagguaaacacugguaauugcuguguuuguugaugcugcucuuccuccuccuccuccuccucuuccuccucuucuuccuccuccucuucuuccuccuccugcuucuccuuuucuucauccuccuuucuuuucuuauuuuugaggcaugauuucaccauguagcccuagguaacccguaacuuacuauguauguagaccaggcuagccucugucuccugagugcucauauuaaagguguguaucaccauauccagcaacacuugcuuugagaugguuagaggaaaaaaaaauauacguaaauaaagauggaugccaauuacuaaauuguuacuuccagucaaacuuuguaccuagucuaaggccaaaauagggauuuuuuuucuacuuugcaaguuggcuccauuaagaggcuuuucuucucuuggucucacuagauaggaaggagagagaggagggaaggagagaaagcgguugaggagugggagguagugugaccgagaauacccaguaggcucauauauuuaaauauuuggucccuaguugauagaacuguuuagaaagauuaggaagcaugucuuaggggcuuugagguuucaaaauuuaaugcuagacccagucuuucaagggagggggcggucugucucucucugccugcugcaugcagagcucucagcuacuacucuagugucaagccugugugcuuccugccucaaugaucauaaauuaacuguaagcaagccuccaauuaaaugcuuucuuuuauaguuaccgugaucauggugucucuucacagaaauaguaaccuguggugauuuuaauaugccuggaccagggaguggcacuuuuaggaggaauggccuuguuaagaggaagugugucucugugggggugggcaaugagacccucguccuaaccaugugagaaccacucuucuccuauuggccuucagaugaagauguagaacucucagauccaccugcaccaugucugccuggaagcugccuuuguucccaccuugcugccccaauuaaauguuguacuuauaagaauuguuuuuggggggcuggagagauggcucagcaguuaagaguacugacugcucuuccagagguccugaguucaauucccagcaaccacaugguggcucacaaccaucuguaaugggaucugaugccaccuucuggugugucagaagacaggacaguauacccacauacauuaaauaaauaaauaaauaaauaaauaaauucuuuuuaaaaaagaauugcuuuggucauggugucuguucacagcaguaaaacccuaacauaacccugacuaagacaacaagugaggaaggguguugugugacacucuggaucucugaaagcucaccucagcaugaagcuugugaaagcgagaaaccuagagucacugcacaaccuccaggcagcucagugggcuggagaaugaaugccucuuggagccaggccagugggucugagccucuuccgugcagcagcugagcugaccugacaguaucucuucccaauccuuacagcuucuauaugcguagggaaggagggaccuagugccuccagucaguuucacucacuuacuagagcugcugaguauguacuuccuguguuuaacaagcuucccuguaggaugaacuauuucaccuccauggagcauccuauguuuaaggaacuucccaccauguuuuccucugaagaaauugcuacacaucagagguugagacucaaggaaagagaaauuuagcucuucguauacuaguagcaagccauauagaaaagaaugaaguuagacuuuuguacacuauacaaaauuaagugaaacagacaugacaaacuuaaagagcuaaaacuauaaaucucuugaaagaaacucuucaugacuggauuuggcagugauuacgggaugugucaauagcauggccauuaaaagaagaaauaaacugaauuuuagucagauuaaacuguugagaaucaaaagaguaucaaaagaauaaaaacagcccagaauggaagcccccaaaauggaagcaaauacuuguuaaucauuuucaucaggguauuaauaugcagagcuaaugaagaacucccacaacucaacaacaauuuuuuaaaacuccaauuaaaaaaacaagcaaauaacuugaaucaacaucgccaaagaagaugauacacaaacagccaauaaacauaugaaacgaugccuucccacauuaaugaucagagaaaugcaaaucaacacugagauaagauaccacuucacagucauuaggcagcuguuacucaaaaacaaaaacagaaaugguggugaagauguguagaagugggaacccuucucguagccagugggaauguaaaaugauacaaccauuguggaaaauugcuugaaaguuagagaauuauuguauggugcaguaaucccacuucuggguuuauaccccaaagaauugaaagcaggaugugagcagauacuugcacaccaguguucauagcagcauuuuccacaguaaucagaaguggaaaacacauuuucuuggugucuuauugcugugaagagacaccaugaccauggcaacucuuaaaacucucauuucaauggggcugacuuccaguuucagaaaguuaguucauugucgucauugguggcaugcagggccagagcagccucuggcugaggaaugagcugaggugaaacagaguuggaugaagacuaaagacugaugaucccuggccuuguaaucuuacugcuuauguguuaaguugcuuaguucucuagcucaaggacaucuugcuggccaagcaagaggccuaggacuugcuaacgcuuugugaaccagagagaaaagaaaaagaagaaaggaugaauucaagcacacacauagacauacaggcacacacauucugucuggggggcccaaccucucacuugucucaucaacuucccaaguguucaugcauacuuauauacauacacauauaccuaccuacacauguauguauauacauacauauagauaaacauacauacauacauacacacacacacauauuuauuuggguggauggagcagagcccagaugccacaccuuauuucuuucucucuguccuucuauaccuuuauagacacaaguucuuuagaaaauuaucucauagauaaaauuuauaaaaaggaaaguuacaguagaauguugauaguuaauuucaaagcaguguuuuauucuuuaagcucaaaacaacaguuuauccauggucuuguucaucauaucacacacuuguggcuucauccuuggaccugaucuagaaugaauauuuuuccuugaucacaaauuugucccaagcaugucucuuuuugguguaguugugaaagcucauuguauucuuuauuaugcagccuuuacuuacuuuucuuuuuguuuuguuuuucaagacaggguuucucuguguagcccuggcuguccuggaacucacucuguagaccaggcuguccucgaacucagaaauccgccuaucucugccuccgaagugcuaggauuaaaggcaucugccaccacugcccagccacauucuauucuugauucugacguuauuacaucuuucuggcaaaccaacuaaacuaucuccuaaagcuuucuuccuaaaauuauuuaaaucaaaucaggaauuuuauaaaaucauuuauucaucuaaacagcauuaauuugugaaaguucaucuuuauguugaucugcaggaaauaugcccaauaggaugggcuaaagcucaggagucauuauacuaaauaacagugacaagaaaaggcaugucguaauuaagcagcaauccugggaugaagucucuuggaaccuucccucucagagcucgccucucaaaagccaugcaaaaaacaguggaccaucucuggaaaaguugcuugccugcccuuagccuuuccuagaugacuccuaacaaugcagacaggcaugacgcuggagaaguggcugagagguucauauccaugucuguacauagucuucuguauuaacuguugucuccaaggcuuauuacucucuccgucugcuaaccuaggccuagcccuggaagcgucuagccuccaugcagucuaaucuaggucuaagauguuuuuagccucugagauuugcugcugaguaagcucaucuuuucuaguucuuucuggauucuguuggcuaguuuaacucagcuguugcugcucaaacuccuuuccaagcuaacugauucaauuugacuucucucaguuucugacuaaaaugcucugcuuagccuauuaacauuggcaaucuguccuaaucuccuggcuccuucucauucucuggcuuguucugucuucaccuguucuagcucugcaaccugucucuguacaaaugcccuggugaaaaccccuccucccucucccucugccaugcucccucuuaugcugccucucuuuccucucugcucugugacagcagaucuuucucuaauucaucacucuuaauuaaacgucacuuucaaacaugggugcuucuuuuuauaaacuaacuuuaccuucauuguuugggauuaaagguguguauuaagggcaugucugaauuccagccagaucacauagaccuagaaugucuuuggaugugaucagagcaaccuuguugcugggaccucaaagugacacaauuccugcaacaaggccacuccuacuccaauaaggccacaccuucaauucccucucuaguacugcuacucaaugacuaagcauucaacuguagaagccuaugggggcuauuuuuauuuaaaccacuacacacaugaaugccuacaaauacgugaauggauagugaaauauuauucagccauuuuuuuaaacagugaaauucugugacaugcaauaaauuaaaccucaaaaacuuuuuguuguuguuguuuuuugguuuuugguuugguuuuuuuuuugggggggguuggauuuuuggcuuuuuguuuguuuguuuguuuguuuuguuuugguuuuuuuugguuuuuugagacaggguuucucuguauagcccuggcuguccuggaacucacuuuguagaccaggcuggcaucgaacucagaaauuugccugccucugccucccgagugcugggacuaaaggcgugugccaccacaccuggcccuccuugaaaacuuuuuaucaagugaaauaagccaaacagacaaauaugcucuauccagcaaggcuugguucuggaaacgugaagaaagcagacauguguacuguuaggcuaggcugugcucucacugauggacagugucuacugugcuguaaccuggaaacucagcucauucauuguguacagcuuaaguaggcaggguagcuugguggacagucucugaagaggaacaaucugggguuacagucauccagaggagaaagcugugaucucuaguuuuuagacagacuaucagcauccucacaggaccagaggaaggcuuugccaauucccaugggucugaaguacagacaugucaacagaacacauucguucaggacuucauccacucccccacaauauuauaugguccuuuuguuuuuugagguuuauuuuuuguuugguuuuugcccggcauaugaucuuuuuauauaaggaccuauaguagggccagcaggauggcucugugguaaaggcacuugccaugcaagucuaacaaccugagcuugguuccuagaacccacagugggaggaaagaacuaacuccugaaaguuguccucugaccuccacaugcauaccauggcauacguuacaugcuuauacacacaugcaugcacgaaauaaauaacuguuaaaaaaaaaaaaaagacagcagugauagccagaggugguggugcacacauuuguuuucagcacuugggaggcagaggcaggcagaucauugaguucaagaccagccuggucuacagagugaguuccagaacaacacagaaaccgggccucaaaagaacaaaacaaaacaaaacgacagcagugaugguugcacgauaugauaaaugugcauaaucauguacuuauaaguugauuaauauguaucauauaauaaaacuugauuguuccauguuacuaguaagaauuauuuugggcuggagagaugcucagcaguuaagagcacugauugcucuuccaaagguccugaguucacaaccaucugucaugagaucugacacccucuucuggugugucugaagacagcuacaguguacuuagauauaauaaauaaauaaauaaauaaaucuuuuuuuaaaaggaaaagaauucuuucugcguguguguguguguguguguguguguguguguaugugugugugugaggugcaugcagauguguaugcuugcaugugcauguaacauggaagcuaguggaggaugucagguucucugccuucuuucuuucuuucuuucucuuucuuuuuuuuuuuuuuuuuuuuuuuuuuuuuuuuuuuuuuuuuugagacaggguuucucuguguagcccuuggcuguccuagaacucacucuguagaccagcuucacauuaaauuuuauacuuuaaggggcucagcgguuaagauuuuccauaggaaaagcgucugcuuuuccauagguccugaguucaauuuccagcaacuacauggcagcuuacaaaugucuguaacucaaguuccugggaaucugacacccucaaacacuaaugcacauaaaauaaaaauaaauaauuuuaaaaauguauacuuuugccgggcgugguggcgcacgccuuuaaucccagcacucaagaggcagaggcaggcggauuucugaguucgaggcuagccuggucuacaaagugagcuccaggacagccagggcuguacagagaaacccugucucgaaaaaccaaaaaaaaaaaaaaaaaauuauacuuucaugcucacuacuucagcaacacacauuaaaauuuacacucucagccacagugauagggaaugauauuuguucuaagacucaggcagagacaggaggaucucucugaguuugaagccacccugcucuacuuagugagauucaacuaaguaaaacaucugugggacugaagagaggcucggccgcuaagaggcuuugcuguucuucuuucuucuuuuuuagggggugggguggggauggguguugagacaggguaucucuguguaguauuggcugucauagacuugcuuuguaaaccaugcuggccucaaacucacaaaaaucuuuucgucucugcuucccaagcacugggaacuacaggcguguguugccaccgccaccugcuuuugcugcucuccuguaaaacuggaguucaccuccagcacccaugacaguuggaucacaaacacccguaacuccagcuccaggaaacccagcauccucuucuaaucuccauggaaacuugcacacaugugaugcacauauaugcauauagguacacauuaaaaaaauuaaaaauuaaaaaaaucuuuauuagcauuuaggaggcugaggaaggaaggguguagguaugaggccuguagggcuggagagguggcucagugguuaagaacacugacugcucuuccagagguccugaguucaauucccagcaaccacaugguggcucacaaccaucuguaaagggaucugaugcccucuucuggugugucugaagacagcuacagugaacuccuauacagggaaaaaaaaaaagguugagugcuggaggugaacuccaguuuuacaggagagcagcaaaagcagguggcgguggcaacacacgccuguaguucccagugcuugggaagcagagacgaaaagauuuuugugaguuugaggccagcaugguuuacaaagcaagucuaugacagccaauacuacacagacaaagacauguugagaaaaaaacaauuaaagcugagaguaguagcacugccuuuuaaguuggcaacacucccuggguggguuacaggacagcgagugguaauguggacagagagagguguucgcccuuauacagucuuagaugucacacaggaauuccugugcugcauuugcagaaaguuauuucaagcuaagaaggguuuuauugcacuucauuuuuuaaauuuaucuuuauuuuauguguaugaguguuuugucuacauguauguguguucacuguguauauaccuggugccuguggaaaccaggagaaggguauuggaucccuugggacuagagguauagcuggugguaggcuucuguguuggugcugggaaccaaaccacugagcuaucucuccagcccccaucuaucuauuuauugugagacaagauaucacuguguaucccuggcuguuauggaauuuacuauguagauaagaguggccucaaacucacacagaugccccuguuucucccacauccugggguuaaagguguguaccaccccacucagcaaguuuuuuuuuucaauuauuugauuuuuuuuugugguuauguguauacacauugauguaaaaaucagaagacagcuaguaggaguccuuuccuaccaucaucuggaugccagggucaaauucagguugcaaguuugcuaacaagugccuuugugaguugcuccuacacacacacacacacacacacacacacacauacacuuuuaacauccuuagugucguguggugguggugguggugugguauguguguguguguuuguguguguguguguguuaugugccuaugaguuuggagaaaaaaaaccuuagugucuugcucagguuaccgucucacugguggugauccuauugcuucagucucgugauagcuggcauuaucacggcugugccaugccagauccucacuuuuuaaaaaauauuuuuauuuauuauguauagauauagauaucucuauauaugaaugaguauccuguaguuaucuucagacacaccagaagagggcaucaaaucccauuuacaggugguggugagccaucauguaauugcugggaauuaaacucaggaccucuagaagagcaaucagugcucuuaaccccugagcccccucccuuuuuuuuuuuuuuuuuggcagcuuauuuuuaauuguuuuaaaucacguauauguuucuguauguagcuauguucacauaagcgcaggcacucauagaggucagagauguaagaugccuuuggagcuggacuuaaacaugguugugagccaucugauaugagcaccaaguggacuuggguccucuggaccgccuugcugccuuccaccuagaauuacaguauaugcaauuagcugcucagccacccccucaguccuccuuaguacuuucaacauaguguaaaucggagagcacuccuuggugcaaagauucuguguguucuaucauucucuacacccaggcuucauugggacgugugaugccagcgaugauucauuggcgugaaguaugaguuagagucagacaaucagugcucucugcucugagugggucucccugccccugugucucugagacaggggaggauucuccuguuggaucacauagugcauagagcccugugugcacagcgcucucaaccauuuguugccauuucaaauacagugacuucagagucuuccuugaaauaacagauuucuccauuuuguuuguucccuucuuucgucacaaagaccugaggaugagauguuuuugaaggaacuuucuaguaguuacucgguggaaaaggacaaugaugcuccccucuucuacagagaagaaggaaacaggaaauuccaagaaaaggaguacacagaugcugcagugcuguacucuaagguaacgugcguccaaccagcaguugaacaaggcggaagauagaggcaaagugcagacucauaaccaguccauuguuuugcuuugguuaguuggguugguugguuuguuuguuuguuuguuucuucuucuuuauuagucggauuggauuugggaaaaauguaguagaauucuauuguugauuauauucacaaacaaaagacuguuuauauguccugaauuuuggcaagauucuucccauauuccuucagacccauagcagcagcaagcuuaguggcccuuugccagguauucucacugagcuguacagcauuugucugaagaacugaugaacauuuuagcuuaugcuccuauguuaguaaauagcuagguuuuuagcuagccaccuugcuagcuuacaacuagaaugccucuggcugaguuugguggcacuugccuuuaguuccagcacucaggaggcagaagcaggugaaucucugaguucaaggcagccuggucuacauaacaaguuccagccuggccagggauauguaguaagacucugucucaauaaaguaaacagccagaaugacuuaaauauugcuaaaaaagaaagaaagaaagaaagaaagaaagaaagaaagaaagaaagaaagaaagaaagaaagaaagaagaaaaugaguggauuugccauagccuagucaaacuagauuuucuugguuauauguuaacauacuacuauuaacaacaacaaauacuuuacacuaaccaugacaagcuauauuuuuaaauuauuauuuuauauguauggugugggaagcuguugcagaguggcaguuggcuacugcuggccaccacacauacauaggcagugaagguucuuuugccaagacaaguuaaccaaucagaugugagacacgccucuccuaggccuauguaagcagcaccaguucugggcucagggucucuucgccucuacaaucaagcucucccaauaaacgugugcagaaggauccuguugcagcgucguucuuccuggccaguugagcgcgcacaagaguauggguuuucaccuacauuuaugugaacugcaugugcacuugguacccagggagcccagaagagggcaucauauccccuggaacuagagucacagguuauguauggguucuaggaaucaaacccauguccucuggaagaacagccaguguucuggauuuaacugcugagucaucucuccagccccaccaugauggauuuaacugcugagucaucucuccagccccaccaagcuggauuuaacugcugagucaucucuccagccccaccacgcuggauuuaacugcugagucaucucuccagccccaccacgcuggauuuaacugcugagucaucucuccagccccaccacgcuggauuuggaagcagaacugaggcuuugaacacuguguuauucuaacucuugcuuccuuggaacccugagaaaauuccuucuauuggcuuuucagagaucuguaugggcuuaaaacaagaauauguccaacucuugaucucugauuuuauauauuaaaagaauagagugagccuaggaguuuggcacacuccuauguuccaagcuucaggaagggaagaaggucaggaguugaaggcuagucagucuuagcuuugugacaaguuugaggcuaacgugagcucuaugagacccugucuaggagaggagaaagaaagggguaaagugagguguggcuccacgcuaccacuugccuaacacgcaugacgcccaagguuuccguucccagcccugggguucagaguauugugcacacccuguaucuuuaaaagucaauagucaacccuuggaauuaacuuuccgaaaaauauuaaagcuacaucauccacucuacaaacuuguaaaagcccuucuuuguaaugguguaagaaaguauuuggcuucaguuuuauggccuuugcauccuaaauguuaccccauggaaaguugcuuaaugaaaacagguaaaaauaagacaggagggacugcaaagaugcucaggcucacgagugcuuacugcccuugcagagaccauggcaggcagugggucucccuacugcagggaauccaaaacccucuuuuggccucugcaggcaaccacauuaacacaugcacacauacacauaauuuuaaaaauaaaauaaaucuuuuaaaaugagcucuagaacgaguuugacaucagucuaggcuacacaagaccuugucucaagaagaaagaaaugaagguuugcuguggauggagagggagaugcacuuccuauuccaugaagcugcuauuuuggugauuaugguacuuugcaauuuuauagagagcugcuauuuucuuucuuuuaaaguaaugcuuguuguuuugacuguaaaaguaauaaauguuacuuuggaaaauauagagaaguauaaagaguaaaaaaaaaagucauaaccagugaaguaccguuaacauuucugcuucuauccggccagccagaguuuuuccugugagaauguguuuuucuuuuacaaaauugggauaaugcugcacuuacuguuuuguagcccacucuuucccuucacgauuuauuguacccauuuucucacaguauuaaauuuucagcuccaaguaauuuuccauagcuaacucuguguucuguuacagagaagaaauguacuuaauuuaagaucuaauauuggcauaauauuuggcauuaugaugcuauaauaagcaucuuucuguauaaauauuuuuauguacagccaguguuuuguuugggaugaauuagcacaagaguaaaguguggggucaagccucugagugacgcugaauuguucucaggaaaggacuaguuaacauccauucugaaagaaugugggaaugcucauuucuuaagcaacacugguuauuauuacauacuauuauuuuguuaguauuauacauuuauuuagggggauaggaaauaugcucauauaguucaauuucaagaguugcaaaaauauauggugugguuucuuuuccuguccccuaguuuagucucacuuccagccccauaaucuaccuuguuaaauauacuguauauaaggcauauguaggugaauaaaaaacagccuaguaugguggcguuaaccucggguuacuugagaacugcucuugcagagaacaugacuuuggcuccgaaagccuuccuggaauuccagcuccaagggaugcagugccucuggcauccuuggguacgucacucaugugcacacauacacauuugguuuuuaaucuuaggaacuccaagugggccaaugagauggcuccauguauaaaggcaguuaugcaaaggucuggaugacaugaguucagucuucagauucugcaagauaacaggagaggaccaaccccugcgaguuguccucugaccucaguacacaugucaugguacguguguaguaugcacaugcacagaagucccagcacucgggaggcagaggcaggaggaucucugaguuuuaggccagccuggucuacaaaacgauuuacaguuauauaaagaaacucuguuuugaaaaacaaaacagggguuggggauuuagcucagugguagagcgcuugccuagcaagcgcaaggcccuggguucaguccucaacucuggaagagagagagagagagggagagggaaagggagagggagagggaggagagggaaaggaaggaaggaaggaaggaaggaaggaaggaaggaagaaagaaagaaagaaagaaagggaaagaaagaaagaaagaaagagagaaagaaagaaagggaaagaaagaaaggggaaggaagaaagaaagaaagacaaagcaaagcaaaacuaaauaaaauacauacaauauauuaaauuuuaagacuugagggcauagaucaguguuauaaugcuuaccuagcaugcguaaaacucuuggcuucuaaaccuagcacccuaccgcaaaauauuugcucugucuugcuaaauuauauugcuaguugucagacuacuguguacuuucacuagcaacauaaugagaauguucacuaucccacuccucugucaaguaaucuguucuugguuuuauuuuucuuugccaaauugaugggugaacaaguauuucagcuagccuagaacacacagagaacucucuuuaugaacucaaguuucuuauccuuuuaugaucuccagagguuuguuuuuguggguuuauuaguguuuuuuguuugguugguuguuuguuuguuugguugguugguugguuuugcuuuacuuuuucuuauucauuuuuuuauuucuuuauuuuuuuguuuuuaauuuaauggacugguuccauguggccaaggauagccucaacuuuguagcagaaacuggcuuugaacuucuggucuuccuucaucuaccucccaagugaugggauuaaggcacgugccaccacaucuaacaauaucuggguuucuuuauuggaguuugaaagggauuccuccagcauuacuuugacucuucauaguuucuuccagaguuauuacacuuucauuuguuacauuaagaguuugauccagggcuggagagauggcucaguggcuaagagcaccaacugcucuuccagagguccugaguucaauucccagcaaccacaugguggcucacaaucgucuguaaugggaucugaugcccucuucuggugugucugaagacagcuacaguguaaucauauaaauaaaauaaauaauucuuuaaaaaaaaagaguuugauccauuuacacuggacuucuugaggcagcaggaucauaaauucaaggugagccugggugaacuggcagaaguggcagaagcugugucucacacugcuguauucauuuccucauugaucuucagagguuugcuaacgggaaguaaguggaacagaagguucaguauucuuuuuuucccaauucuauucagucuuuaguaguagaucccucauuaucugagaugcagaguccccuuuauuccugugaccaucucguuguuuuucagggagugucucauucaaggccuaacacugaggacauuucacugugcuaugccaaucgcucugcagcgcucuuccaucugggucaguaugaagugaguauugaagaaccugguguccugccuguggcugcaguggaaaaugagcuccucucuguucuucugcacacauugaaaucaacuagcuugcaaacacugacauccacccagacccauucucucuucugacucaugucaccucucauaggugaccacaaacaauauguaguugacaagaaguagcuaugucauuguccacagugcauggauuuguuccaauaggccagcacuucuguguccauaucagcuagaugugcugcugauaguauuuuagauuccaaaauguguccagauauuaccuccuucguuuguuucuucuaaauaagccaggcacaaagacuugaaagauggcuugauggcucuuccagaggcuggguuugauucccagccccaacauagcagcucacaauaggcuauaacgucauuuccaaggggucugacuuccuguucuggccucuacaggcagaaagcacagacauacaugcaggcaaaacacauaaacauaauugaaagaagauauuaaauaauagcccacgcuugagcuuauuccucugaugauacagcucuccugaagucaucaugggcaguguaaaaguaaaggugccccgcccugcccaggggcaucagugagguagcugacugugaguggcuuucuucucauccccuaacugcugcaacaucaucaacuguggagcauuauauccguggauuuuaaguuaggaaaugacaaagauuagaucuauggccaggcacuagugcacgccuuuaaucccagcacucaggaagcagaaguagguggaucucugucaguuugaguuuacagagagugucuaggcagccagggcuauauagagaaauucuaucuggaaagaauaaacaaaucagaucuguauuucaggaagaugccuaugagcuguuugacaugugugauagagguccuuaaggacaggaaaguauuccacaugugugcauuuuacagaaauugguuauacacuggaguuaaggacuguuggaauaguugaauguucacacucaguguucuucaaaucaaauagaagaacaagaaucuaucugggcauggugaugcacaacuguauuccuaacauguagaagacugaggcaugcuauguguuuguggcuaaccugggcuacauagucaauauuggacagucagagcugcuacuaaaaccuaaaaaacaaaaaucuaauaaucugggauuuuauauuuuccuuuuuuuaaaaaaagagugggcagaaugucucugauuuuguucagauggccacagaaccuagaaaaacugcugcugcugcugcugcugcauagcacacagcuaauauuugacuauacguauauaaauuuuguuguauacuuuagcugugcugucaacuuuggaaaaaaaguaucccaguuuaucauuuuaaauuggcacuguacagaaauuaacagccauauuagucuagacacauuaaacuucauuuuuccauuuauacagaagcaauguacuguauuaaauauucagucuuaucuacagggguuugauuacagaaacuaucaaaguauucucuaaaugaugaaaaaagauucaagaaucugacuguagauccaaaggacaaguggagaaaaacuuaggaagaauuuucccuuuauccccucccuauauugaucaucucuuuuacuucuaauaauaguggccauuuauugaacauacccaggaguuccuuucaucacuuuagauauauaauuuaucucauccuaaaaugaccuguugaugagucaucucucuuucagaugagaaacaaagacauugaaaaaucuaacuugccugcauaagaucacaccuagccucuuacucacuccaugaauauuccuuuuuuuuuuuuccuuugagacagaaucucacuauguaguucugguuguccuagaacucaauauauagaccaggcuagccucaaacucacagagaucugauagccucugccugccgagugcuaggguuaaauggaugugucaccaagcccagcaaaauuuaccuucuuaauuuucuaagacguuucuccucuuaaaaaauggaacuauugagccagucauggugagacaggcuuaaucuuuaaucucagcacuuaggaggcaaagacaggccuauggguucggggcagccugaucuauagagagaguucuauggguuaaaguuuaggguuaaaguuuugagacaaaacuuugugucaaaaacaaacaaacaaagccagacugcuuaauaagacaaaucagacauaauauuauaaacaaguauuagugucacucaauuaaaaagucacucaggaggugagaucaauccccagcauaaugaggggaggaggggagagaaggaaaugaaugggaggggaggaggaaggaagagagaaaaaggaaagaucucaaagcagaacacaggauguaauuuaaggccuaagcucucgacugaaguuguccacuuuuaaugacccuuuucaugcucaugguuuucugucuucgguacauagugaagaguggaaaccaagggucauccuggaauuuccuuuuguuuucaggcaugucuuaaagacauaguggaagcagguaugcauggguauccugaaagacugcagcccaagaugauggugcguaagacagaaugccuggugaaccuggggagacuccaggaggcaagacagaccaucagugaucucgaaagcagccucacugccaagccaacccuggugcuuuccucuuaccagauucugcaaaggaauguccagcaucugaaaauaaagauccaagaaaaggagacucucccagaacccaucccugcagcucucaccaaugccuucgaggauauagcccugggggaagagaacacacagauuucuggggccucccucucugucagcuuaugcacacacccuuugaaaggccgccaucuaguugccacaaaagacauucucccaggagaacugcuggugaaggaagaugcuuuuguaaguguccuuaucccaggagaaaugccacgaccucaucauugccuugagaacaagugggauaccagaguuaccaguggagaccucuacugucaccgaugucugaagcacacuuuggccacaguaccuuguggcagcugcagcuaugccaaguauugcagccaggaauguaugcagcaggcaugggaccucuaccauagcacagaguguucucuuggggggcugcuccucacacucggggucuucugccauguugcccugagaaugacucuuuuagccagauuugaagauguugauagaguuguaaggaugcuuugugacgagguugguagcacagacaccuguuuaccugaaagcaagaaucuggucaaggcauuugauuacacaagucagggagagagugaagagaagagcaagauaggugaacccccaauuccuggaugcaaugucaauggaaaguauggaaguaauuauaaugcuaucuucagccuuuugccccauacugaaaagcauagcccagaacacagauucaucugugccaucagugucuccgcacugugcagacaacucaaagcugacagcgugcaggcccaaaccuuaaaguccccuaagcugaaagcagugaccccagggcugugugcagauuugacuguuuggggagcagccaugcugcgacacaugcuacagcugcaguguaaugcccaggcaauaacauccauaugucacacagguaagucagaaaugguuuuuacuuacauuauugguauuucaagagcuaauguuuaaggagaaaaacacuauaaaggaagccuggcaucaaauaaaucagugaccuaaaaggaaaacacagccgucuuauauaucauuaugcuauugagaagcuuugagcacauuucugugaacccagagcuugggagguggagauaggaugauuaggagucuaagacagcuuuagcuauacagcacguuugaggucagccugaacuacaugagaacuugucucuuaaaaacuugagccagagccagguggugguggcacaugcauuuaauucuaguacucaagaggcaaaggcaggcagaucccugaauccagccucgucuauauagugagauccccaccaggcuacauaguaagauccuguuucaaauaaauaaauauaacaaaaacagcaauaauaacaauagcaacaaauuaauuuuuuagauguauuuauuuauuuuauguaugaguacaccauugcuuuuuucagacacaccagaagagggcauuggaucccauuacagaugguugugagccaccauguaugugguugcugggaauugaacucaacaccucuggaagagcagucggugcucuuagccacugagccaucucuccaguccauuaauuaaaaauuuaaaacuagaguauuuuuaaacauuuauucauuuugugugugguauacauacuauaauacagguucauaagucaauucucuucuaccaugugugucuuggagaucaaacucagguucuuaggcaugggagcaaguauuuacuuccugaaccaucucccuagccauuucuaguauucuuuucuuuugucuugaaagauuuauuuauuauauguaaguacacuguagcugccuucaaauaccggaaaggggaaucaggucuuguuagagaugauugugagucaccaugugguugcugggauuugaacucaggcccuccagaagagcagucagugcucuuaacugcugagcuaucuccagccccauuuuuaguauucuuauuaagugguuuccauuuuauccaaagaugccuuuaagggccugggaagauggcucagugggcauugaacuuggugugugagcaugaagaccagaguucagaucccuagcacccaggcagaugcugaaugaugguggccugccugagauuccaggacaacggagacagacaggggcccuagcuaaccauacuacacacuagcugagcugugugcucaagagagcagcccuggcuuacugugcaggauggagagugaucaucuccacaggcaagcacacaccugagcacacagacaugcacaaaggaaagaaaaguccuuuuaaggugguggugguguuguuguuugggggucuuuuguuuuguuuuuuucucccccucccucauugugauggcacauuccuuuaaucucacaucugggacaaagaggccggaggaucuuugugaacuggaggucagccuguucuacauagcaagcccauuucagccaggacgacauagauauacccugucucaaacagacaaaaauuauuuauuuuauauauuugaauguuuugccugcauguaugucuaugcacauuaugucuggugcccaugaaagccagaagagggcaucagaucucucagaacuggaauuucagacacuuaucaaguacugccugagugcuaggaaucaaaccaaggucuucuggaagagcagcaaguagucuuuuuuuuuuuuaauauuuuuuuauuacauauuuuccucaauuacauuuccaaugcuaucccaaaagucccccauacccuccccccccccccccgagcagcaaguauucuucauugcugggccaucuccccaucuccuuuucuaguuaauuaagcugaaagggagggagguagauguugcccaaacuuaggauuuauugacagauuaauacucuguuagccuaacuacacuauagaagcuuauucuuuagacuuucacauuacacuguccagauuuugccauccuuuuuguguguauaugucuacagaucuuaauucagcugccaauuuauacaguguuuauagguauucuuugugacguggaucuuuuacccaucuuaaagcaguaggauuugaaagcugacauuuauguggccuaugguccuguuaaaucacauuucaaguuagucucugugguacacauuuuggggucuaucugcgguuccgcaucucacacuuuucccucucaggguguccagaagcugcugcacacugggcuggaaggaugaaguggaguccagagugaguggaauucugcagcaucccgguccagcugggagugaaugcuggggucaggaggagaugggugagagggccuucuccaagggccuucuuaguguuacagcucuaggcaaaggccuucucugacaaucuuagccugugcauaguuuuuuauucgagaugagcuuguaugcauacacuuuauuggcaguaaaucagagguuauccacucuuagggaaggagauaggaauacccaagguggacagaggucauuggcugaaggauaacguacugagaugcucauuagcacggggaggcaucccaggaaucucaggugcuugcugacuggguuucuuaggggguugagaggguagcagugauuucaccaagguuauguauggcagaggguauagggguuucaggcuccccagacaaagaaggagaaggagaagcccugcugauaagggaagucccccauuuugagccacuucagaaggcuaucaagacacugauagacuuuguccuuaauuagcagggcccaacaagugucuguuuucuuuucugccuucauuggcucuuugagccacugcuacaaaauauccaaaucugggccaggaagcuggcucggcuaguaaagguguuugccucuaagccugaaggccugaguuuucacuugauuugguuugguuuuuguuuuuuugagacaagguuucucagcauagcccuggguauucuggaacucacucuguagaucaggcucaacuugaauucagagaucugccugcuucuacaucccgagugcuuagauuaaaguugugcgccaacacugcccaccuaaaaaaaauaugaggggcuggugagauggcucaguggguaagagcacccgacugcucuuccgaagguccgaaguucaaaucccagcaaccacaugguggcucacaaccaccugugaugagaucugaugcccucuucuggugcaucugaagacagcuacggguguacuuacauauaauaauaaauaaaucuuaaaaaaaaaaaaaaagaacacuauucacaagguacaacaacaguguacuaggaaacuuuaaaauagcccaucauucauucuaggggaaaaaucuuuuuaaacuuuaguguguaagaaagagagaggggcuguagaaaggccacagcacguguauccagguuaggagucaacuuuucagaagcggagucuccccuucuaccuguuuuugaggcagucucuuguuucugcccuacacuuuguacaugaacuucaagaugguuguucuauuucugccucucauguugcccuaugcaugcugagcuuacugaugccagccaccacauaagcauggcaccagcacugagccaagggcaggcaucuggcucacauggagaguuacccaucaagccaucuugcuagccccagaaaauguauuuuugacaggugugguggugcacauauuuaaucccagcacucaggaggcagaggcaggcagaucucugugucugaagccagcccaguuuacaaaucaagucccagaauagccaaggcuacauagagaaacccuguuuugaaaaacaaacauccuucuguguuccagucacaaugacugcuguaacaauaauaugaggauuugggcgugucaaaaaucacaaguagcaagguguaaugggcaggccuuuagucucagcacuugggaggcagaggcaggaggaucucugugaguuuagcacagccagggcuguuacacagagaaacccugucucaaaaaaaccaagcaaaaauagaauuacaaguuaaccaggguauugguguuaauaugaaauagcagaacucaagauagcuaaugaaacaaaggauucuauuuuauaaaggagacauuccauacugaaauauaugcagagccugaugcuugccuagcaacugaacuacacccacacccucuucaugaaacuuaauaaaugcacacuaucaaacacauuaucaugacaaaaaugauagucuauauccucucucuaaaaguuaaauaaagauauauauauuugucuaugagauuggcaguaucauuuuguugauaucaugauuaguuuuuguuaaccuguuacaaaccuaggcaugucuuggaaaaaggaaucuuaaauuagaagaugccuucauaagauuggcauguagguaugucucacuaaugauugauguggaaagucaccgaggauggugucacccugggcagauggccugggguauauaaaaacacaggcugaacaaaccacaaagcaguaguccucaauggcuucugcuuuaguuucugucucagguuccuaccuugacuucccucagugaaggcaugucacaugagaguuguaagaggaaauaaacccuuuccuccccacauaguuuuugguuaugauguuauaugucaacaacagaaacuauaacuaauauaguugguuuucuuuuuuuguuuguuuuguuuuguuuugagacaggguuucucuguauggcccuggcuguccuggaacucacuuuguagaccaggcuggccucgaacucagaaauccaccugccucugccucugccucccaaguggugggauuaaaggcaugcgccaccauugccuggcugguuuucuuuuuuuuuuaauacauuuauaaugcauuuuagauuuaaaaaaaaaaauggccauggcauauaauauaaaaagaagugcuuacaaaucaccaugugcccuugccauaaauuauguaaaaauuuccauauggacaucagucucaagcuuacaaucucagcacucaugagccugaggcagaggcaggaggauggugagcucaaggccagcuuagucuacauaacaagauccuguccaaauaauaacaacaguaauaauuucauacauagaacuagaaggggccacugcaaagacaguaugacaaaaccacuggcccugccuaauuguauuuuaaauaacuguccuccucucuguaauuuucaguuucuaauuuuuacauaacuaccauguauucuuuuuguaauuuuaauuaguuuuuuaauaauagaaacaagcuaagugcuaagaauauuuucauaugaacauuuucaaggcacuugauacauaccucagauuugcccuccaggugagcaguaccaauuacgugccaccagcaauguuagcuuccuuuuuucccuaccaucugauucuguuucagucuauucguaguucugaucuuguuauaucccuuuuuauuguuucccuggguuccaacaccucccaguugaguguucucauugaauuucauuagcagcuguuucauuaauggcacagaagaaggauuacaguguuaacuaggauagacuuugacaaagaacuaugagaacauaucuuauuaucuuugcauaaauucuuuuuaaucaaaguuccucaaaagccucucucuguucccaucucagggaguaggucuggccacugaugaguguccaggccacaguacaggugugcgugguucugucccugugggaagggcacaucuguguuguaacaggauuccugucuuaacaagccuugcucaggcucuaagugguccugagcuagcuaacugcccuuggcuuucccuugauuaccagauaacuauucacucuucucauuuugcagagcacuuaccagguagcuauguccuggaaguacgaaugaguccuucuauuguuuuucuuuuacuuaaaucccauuugaaaugcgccagggacacuucaauccaagguacacuuuugcuaaagaaucacucauuuuuauaugcaaaaugucaccuauuaacugcagcugauaugguacauacauauucucucuuccuauuauccacuaauaggugacuaaugcgaaauauugaguaauuuuuaaaaaucaauacucaauuuuuuagaaauaauuagagagacauucaacucugacaccagcacccuacucaguuccugagccuuccucugccggaggagaaucuauaaauaacucacgaagcugacauuacucacuguguugcagucauuuuuuucugagaaaauuuuagcaacuguucuaauagagccugccaguuaucaguaguugagaaugcaagucaacuuuuaauuaugcagacgcugauuauucagacgacaaauuguuggugccugcacggcuccuuccugcugccuaccuuuaaccguucucagugcucauuagcacauguuccagaagguaggcuuuggaggggcggacaggcacucaaaccagcuaagcacuuagagaagcucugaugaaagauguuaaugcaguuuguagaauuauugacuaaaauugagucauuuggauucccugugaauuguauuuacaugcccugucccugucccccauagcaacagauaauaggauugucugcagagagacaacauaguucuuauauuuaauuuuuuccuuugucgaacauuuucacaugaugguucgugguguuuccuuuguucauuacauuuguauccagacuaguuacuucugauaagcgguuaguuaggauuccuggcacgcggacagugacaccacaguugucugaucguuucccacuuuuuuacaaaaccguuugccuuuaagagucaguguuuugcacauuucacccagauuauuggaaauauuauuucccuccugcuuaaaccgaagcugugaucauaauuuaagccuuucuagguagccgaucuuacauguaucauaccuauuucuggcauauguuugucuauuacaaagaccucguagguaugcaguuagaagccucuaguuaaaugaaauguugcgugugugaugaaccuggaguggggauggccuuuugugugccccaaggcuguuguguuucacacaguuguuuucugccuccucuggucuaucacuauccugccacugccagaaaacccugcuguguguuccccgcguggaggaucucugcuucugaacuucuuuggccugagaaacuccauaaccaaaucaguuagcauuuuguuuaaagagcagguaggcuguuagagcuugggucuuacaugucucccagguccacuugccagcgccuugaccacuguuaacuuuuguuaaccaacucaucuuuugcugccuguuuuuugggggguuuuuuugguuuuguuuaagccaagaucaguuauauggcccaggcugagccucucuucccagccucucaaauguuagaauuacaagcaugcaucccucagcauaccuuuccuuugcuuuuuuuaaaauagaguuuugccauagcaacagaaaucuaaccuaacuaagcauagccgugcacaugguaugaggaacucacauaugugugaauggaaguucauagagaccggcaucacugccuagaggccccuuucuuccuuccuugcaguugucgugcuagcugacuguacuacaaaagagguugucugaggcauaagacuaccuucaauaaaacaugcacagacaguuugcuucucugagauuucagagcagugacuaccuucaauaaaacauggacagacgguuugcuuaccugagacugcagagcaguuuccaaaaauuuuagacaaaggguaggaugaagaaggcugcgggguuuugcacacacuuaaggugcguaaguaaauaaacugagcuacacugacaggaugcucguucuaguagccaaccaaagagcaguugaaccaaagcaccuagacuucaaacaucguggggagauaaucuuaggagugcuaugcuucugcguccuacaaguauuaugaaacugucuagaaagcaccccacugguaaucccuuuuugauuauuuuuuuuauaaauucuagucuugggguuuugaguggcacacagacauaaugguuaggcuucggugugugcucauucacuuugcuuccuggggaccagaguuugcgaugagucauguuccaucugauuucugucggauccggcugcagagccaugacucagaugggcuucaggcccagcugcucaguucaucuucuggggaauagaugacaaggacgggacaaauguccugacgcacauuuccuucuguucuugcacuuccagggucuaacgagagcaucauuaccaacagcaggcagauacgccuugccacaggcaucuucccuguugucagccuccugaaccacuccugcaggcccaacaccaguguguccuucacuggcacugucgccaccguccgggcagcacagaggaucgcaaaaggacaggagauucugcacugcuauggugagccagccuuucuuuccacuacccugcugugccucacaccucacaugaaaaggauaaggggacaggaaucagcagauaugggcccagugccucuacucauccucugagucuuuccuggaaagggcaaugcauccuugggccaauaaaaaaggucuucuggcuguaauaaaaaagcccguugagggcagugagccauaucccuccaugccuuguagacagccuauccugaaaaugagcgaggagcacuuucuuggcuucuuucuuccugccccagcagcuuggaaacguauccacuuucacccguguuuuguuguuuuuucugagaugauagggcagaguacccaaccucauauaggcuaggcuagugucuaucacugagccaggaccccaacccagcaccaccaugccagucacgugaugacuaggccagccccucgguagaguaggcauugacucucuuggugugacuaggaacuguggguaaucucucuccagggccucacgagagccggaugggcguugcugagaggcagcagaggcugaguucucaguacuucuuugacugccgcuguggggccugucacgcugagacacugagagcagcugcagcucccagaugggaagccuucuguuguaagacuugcagagcgcucaugcagguaaaucucugcuguucccaggggcagggcuccagcuaaagguugucagucgccaggagaaccauuccugcuucccuucuuguaacuccucccuacaugucgcccgguccugcagaaaacacagguuguauuuccuaauauuuucccuauaagugacacaaaaucuuaaauuacacaaagggaccaaaaaaaaaaaaaaaaaaaaagcccuagaaauuuacuugcucaaauaagucaucaaaaguugugcaucaggccuagcacuuggguacugguaacccuagcacucaggaggcugaggaagaaggaucucaagucggaggccagucucaagugacaccccaucuaagagaucaccauuccaaggagcuauuucagagaugguuuaaucuggggacccagauuguggauuuucugucuguucaauuccaucucucugugcuggccucaucagacacacucuguaguaacugugggaaaauccgacccacauaguuuucccucagccuuugacccagagggaagagccacaguggagagcaugagagcagacccuugggugcuacugccagguaaugguguagacacuggagucuucaacauucaugccccaaugcaaaauggucuccacaccagagcauggcauucucauuagaaauaaguaaauggaauuggcuguguugaaaauuguaaagccaagggucaagaaugaagccuuccccagcauguuuuguuuuguuuuguguuuuaggcagcgucucucuguguagccuuggcuccugcccucugcuaccucucccaggugugccaccaugcugggccuaagcgcccugugcauuagugcucccucgauccugcucacucuugagacagucuuccuucuacucuguauccccagauaaccuagaguucacuucagagcccaggcuggccucaaacuugagauccucgugucccagcuucucaaaugcagugauauuuacaggccuauaccuggcuuucccugauagauuccuaguaagaugauuauccuuugagccauaucucucuucugcuucuuccucucuuccugcaggguugaucuagaauuuauucuaaagcugacuggccucagaauugccauccuacugccuuuaguuuccaagugccacuuuacugcaaugugucaccacauccagaguucuguguuuguuuauuugucuguuuuugagacaggguuucucuguguagcccuggcuguccuggaacucacucuguagaccaggcuacccucaaauucacugagaucugccugccucugccuccagagugcugcuguacacuaccaccacccauccagcuuucuauauugguuuuccuauggcguuuuaaaauagccauuauacguguguuuaucaucuaaaguccuggucccaaaaggagaugagaggggcugcuaaggugaaaaggauuacaaacgcuuaucaauucuguucaaaaauuaaaccucagagugggauuagcugcuucuuucauuagaauugcuaucagaauucacucaggccuuguuugcguguguuauugaagaagucucuuccucaucaggucagugacuccuuagcucaaguacaugcaauaugcaguauugauaacuguucucgcuuaggaauaaaaauagaacugacuuccacagggaaaugaugugcugagcuguagcaacgaaucuugcacaaacucugucagcagggaccagcuagucucucgccugcaggaccuucagcaacaggucugcauggcccagaagcuucuccgaaccgguaaaccaggugagauuggcucccucgcccuaggccucagcccuucccuuguuuauuuugguaucaccuugccuuacugagcaguccucaauaaaugacugaggacuugaauuuaauuaucccagcaccagccacaagauggcuauguaggccagugagaccagacugugaccagcuguuacucuggugcccuugaaagucuuccugaugguuuaagcugugucugcugcgccagauaguucuagcagcucgagcaccagaaaggcugucugacuuccaugggcuuuguguggcuccagagguccaaugccaucaucugauucccagcuuaaggaccuaagcuccgagaagguugcucugcccucagcagcagcagcaaguccugagugcugccugggcucguggugugacucaggaguagagcucgguagcuagccugagcugagagcugagagaaagaaaggacuccucucuuuucagaaagggauuugcagaacucgauguuagacccugacaugguaggaaucuguuuugacuauucuagccuagauucugaaguugaccuuuagccuagagucaagaaaacuaaugauuacaggaggaauguagaguugguuguuaaauguugguuggaaaauggauguuagaagcccaggguaaaugugaggaagccucaucuaacaccucuuuuacugaaagagaaaacauaagcaaccaacagcuucccuggaaugcccggcuguugacuccgugagauaaagaggcauuuucacuuugaccuaaccgauagagaccuugcaacguggucucucguguccaggacuagaucuguaucuguugugaggcauuuuuccuuugaauccauagagcaagccauucagcaguuguugcggugccgggaggcugcugagagcuucuugucagcagagcacaccguacugggggaaauugaagauggccuggcccaggcccaugcuaccuuagguaugcuaccuuagguauagccggaguucuccuucccugccguguguucagugcggcccuugccuugucuguuugguucucucuugccaucugaauugacgcucuucucccucccauucugcauuccuugcccccagagccuuaggcuaaugguguuucuuuuccggaaugagacauuucucuucucacagggaacuggcuaaagucugcugcccauguacagaagagucuccaggugguugaaacucgccaugggccauccaguguugaaauuggccaugagcucuucaaacuggcccaaguccuauucaauggguaggccuuucuuuuuccuaguguuuggccagggcacacagugcucuguguuuuccuaggugcuucuguguauggcuuuuugcuacagugcuuuaaagcauguugaaacucuuuuauuuccucuuuaggacagauauuugcccucugcuucacugauagacuuuaagcuuugaauuccuuccugaggauguggagaaagccauuaggucugcauggagcuucccagggaggauuuggaggcagccucacccgccucuagcauuccugucugcuuaaucacaccucccuuggcugccucagucccugcucucucaacuccagggcucggcccuuucccugguuugccucuuauuccuuuuaaagcagugguuuucaacuagaagggauugcaaauggcauuuggcaguguuuagagacaguuuugauuguuauggcugccagcaucuaguaaaggcuaaaccuacagugcacaggaccgccuccacaguggagagacccaaguuagcuaugugaaggcugagaaucccugcuuuggagauuaaaaaaggaagcugagggaaccacucaguuggaagcacccuugguggcaugcacaaggcccugguucugucccuagcucugcacaaaaaauagaauacaaggaagaguaacccuaaugagcuggucccucacccagugugccacugaggucacuugaagggaagucuagccccaauuuaguauuuuuuguggcugccauaccuccagccuugaucaaaucucaugguauacauugguaagaaaaaggguuugaaacauagaccugauacucggacauggaaacaguauguuuggucagagagagcgaaggaccugauagacgagggcaauaucagagagagggcaucagucggguuagacacgagcauuccacagugagcagcucuggauaagcuuuuauaaaugcugguuaagguuuugaauuugcccaauuuugucaggaucccagagucuaucacaaacauacacaguuuucucaaaucugcuuugcaguaugcccgugaaugucucuuaucuauacuuucagaugguaagacccugagggcagaggaacucagacccuuugugcccccuguaagacccugggggaugcaguggacccgacuuuguguucucugcacagaaaggaguccacuuucguugagacuaaggaagggaacugacaagcuucccuuucuggcuucagguuggcagugccugaagcucugagugccaucuggaaggcagaaaggauccuguuggugcacuguggcccugagagugaggagguccgggagcuccgggaaaugagguccugcuuacuggacucgucauucgucccuguggggcccuugguguagagcaaucauccucacccucaagaaggagcucuggugaugacugagauguucuguuggcuuggagcucucaucagagaggacgggaccuucccaccugaccugagccuagugucuggcacagagagcacuugaaaacagauugagacacucaccugccaugcuggcugcugcuugcaagagcuaacugcccucugauggaaaccccaugcccagaaaagacuaaauccaguaucuaaaggcugcuuuaaaggguugucacugcagccgggcuugguggcacacgccuuuaaucccagcacucgggaggcaggcggauuucugaguucaaggccagccuggucuacaaagugaguucuaggacagccagggcuacagagaaacccugucuugaaaaaccaaaaaaauaaaaaauaaaaauaaguaaaaaauaaauaaauaaauaaauaaaggguugucacugaucugcaggcagcucaugcuagccuaggcuuuuggcucgauuucaucucacuaaacgaugaaucuguuucccuggaacauuccuaugguuucuaguaguaaugaagugcuguguuccacuccagugagaacuucaauucuuagucuuguauuauaauugaaaaauaauauauagcaagaaaucaguaugacugcuuaccucaagagacauacaauuccacuuacaauauccugcuuccuuaaauuuuucauuaagacuggugauauauaauuugugaauggagaaauaaauacgucuuacuguuggcaguuucuuccugggauggca

SEQ ID NO: 6180 - RNA, 12935 nt, Mus musculus
ccagauauuuguaguaguaagagacaggugaggaaccccacagcaaguguuaguaauuguguguggaggugcccuccggggacgggggcccuccuggggcaggacguuccucuuccucauccaccugcacuccgagaacaggaaauggugacuuuggcagagcuuaagcagagcccguucauguuacaaguauguaaauucauaaggaccaguuucucuccauaugaaacagcuucaaacaggagaaggaagaagcaaacauuaaggaaaagcucuuuuauugcagaggcuacacugaagcuaccggccgccuuccuggaauguauaaucagcuucccucuggggguucuguagagcacugagacauuaaguacuacugggguccaggauucugccuaugaagaggagggcccccguguccgugucccucagaacaaagaggaaagguugguuaaggugauagucuagcgggaaggugaggcggacgggcuggaggccugggcuggggcugcuuccugcccccucuucauuccacucgaaagcagcccuguguuccacuugggugagcuucacggguuugccaguaaucuugcugaagucgggugauucaaacaacgacuguagcucuguggagauucagagauuccauuaacaccacacacacacacacacacacacacacacacacacucccuguuuguguaggcugauuuucaagaaagcaagcuagaaguggaguaccucacagugacuugugagcuaugaggcacucugugacaggcucagugaccuaccugagaacuuauagccaagauggcugaagccagaccuggccugagagaauguuuugggcuguuauaggacacauagagauacacacacacacaacacacacacacaccaaggacugagucuaaugggaggugguucuucauuccccuccccuguaauggugucacauguucccugagccacccuacaaagaaagccacaggacucaguucugucagcaagguggcaggcuccaagacucagccccgagcgcaaaguggccuugcaaacauacucauguccugcagagacuugguaaguucgccuucgaagcucagcuucagcuuggggacagucagcacagcuuggauagucuucaguucucggucgaugucaugaaugaacucagaggugaggcucucuucuaucauggucaaguucugggucacggucaggggcaggaagaagaugaugcucauacuuccugucaagggcagcugggcaaucuaacccaacagagaugcgcacagguuaguugugagccagaaaaaacaaaacaaacaaacaaaaaaacaccaacagcugccuuccccucugcuguaacggggccccagccuugugcuccccagccucagccugggcuguaggcuacugguuacuggcaguccuuccaugaguagggaguuuucuucucagccuaaaacccacagaaguuuaaugaacacacguuuguuugugguuccgcuacgguuucuauugugauaaaacaugacugaaagcaacuuggagaggaaaggguuuauuucaucugacaauucgcagggugucuucucaucacuaaggggacucagggcaggaacugaagcggaagccguggaggaacgcugcuuucuggcuugcuccccguggcuucuuagccugcuuuuuuaugcuauccagaaccacuugcccaggagugacacugcccauugugggcugggcccccccacaucaaucacuaaucuagaaaaugacccacggguuugcccagaggccagucuggugggggcauuuuaucaauugaguuucacccuuccaaaugacucuaacuugugucaaguugaccacacgaaucagggccugguucuuaggagcugaaguggaaugucccccagagacugccugccagcacugcugaccauuugcuuuguauagagcauugaaccagaaaugaacaauaaaauggauccuuugaacagauguguugauccuagggccuguggacacagcgacugggcuucccagagcccccauggaaucauaaacagaaaugucacuucucuagaguguuucagguuuuuuuuguuuuuuuuuuuuuugagacaaggucucucuauuaugcugccuggaacuuucuauguagaccaggcuggacucaaacuuauagugauccacuacuucugccucucaguacugguauugaaggcaugugucaccacaccccacuacuucaagaucuuagauuuccaaagaagccguagccuagaaaagguuaauaaguacugauuuaaaacagaaagaaaucagguacacuuagagcuguagaaugucagcaugugacauuugugacaaguugucaaaacuuugcucuuaauucuaaagagagaagcugucaaaagacuugaacuggggcuguagccaacuuggucgagcccuugcaugaagcuguguguuuacuccccagcacugugggguuugaauugauuugaacccaguagauucguauauuugaauguuuaccucauggggaaugacauauuacaagguguggccuuguuggaggaauugucaauuugggggugagcuuugaggucucucugcucaagcucugcccaggguagaaagggagccuccuccuggcugucuacagaggacauagucuccuggcugccuucagaucaagauguagaacucuuggcuccuccagcaccaagucugccugcacaaugccaugcuuccuaccaugaugauaaugaacugaaccucugaaacuguaagccagccccaauuaaauguuugucuuuauaagaguugccuuggucauggugucucuucauaacaauaaaagccuaacuaaaacacauuccugcugggcagugguggugcacgccuuuaaucccagcacuugggaggcagaggcaggaggauuucugaguucgaggccagccuggucuacagagugaguuccagaacagccagggcuacacagagaaacccugucucaaaaaaaaaacaaaaacaaacaagcaaacaaaugccagcauuugggagguagaguuaagaagauugggaguacaaagucgucucagcuaguauguuugaggccagcauggaccacaugagacguucucaaaacgaaagaaacgaaugaauagauaaacauuugaguguccaguuuuuuccuuucuuucuugcuuuguuuuuggcggugcugaggauuaaacccaggaccuuguucauacuaggcaagcauucuccacugaggaacacccuggcgagugccuagucugucugucugccugccugccugccugccugccugcuuguuauguguaugagugguaaccugcaugucugucuguauaccacagacaugccugguaucugcagaggccagaagaggauguuggaucgccuggaacugggauuacaaaugguuguaagcugccauguagguauucagaauugaaccuggugcucugaaagagcagccagugcucuuguuguugguuuuauugggggcaggagguaguuauuugguugguugguugguugguugguugguugguuuucuugagacaggguuucucuauguagccuuggcuguccuggaacuugcucuguaggcucaaacucagagaucugccugccccugccucccgagugcugggauaaagucaugugccaccaacuccagacaagcagccaguacucuuaaccacugagccaucauuccagcccuucuuuguguuuugagauggucacaaaguacaacucagacugagcucuugaucacccucccucagccuccugacugcuggggguuacaggugugucacuguccucaauucugagugucagaucuugaaaacccauucucgugaccuugauccuuaaaacaaacccugggagaaugaguucugauaacuauuucucacuccucuucaagaaaaggaaagccagagaaaggggggggggcaagccccagaaacauugauaacuugcccaaaguuacacagcaaaauucagacagccugcacaucucaguggccaucugugccauauccacccugcccuucucugaccuccccaccuccaucccuacagaccuugcaguugagaucagaguccaagccguaucguaagauggccuuaggaucugacaucauggggacucucacgguccuguccucguccaaaugaaaauccuggagggucgucuuucucgagucaaacuugguuacccacugcccuggaaggaaacagauggagcauccugagccacuguccccagaaaggccacagguccacgcugugcguccacuggccaaagcaaccugagcugucagcagcaagaacacaggagccgcugggucccagcauguguggcacagaccauaggcuccaugcaccacggguucuggcuauccuccuguaguaaacucagaaauaaguggguguucucucucugacuuggaucaccacgcuccuucuguuuaaaguggccuuuaauaugcuggugugugguacgugccugcucuccuguccccuggggacuuggaguaggaagccccagggcuuuccucuaaguuaggauccacucuugcuacuacuccauaagauggucacaaagcaacguaaaauggaaauuaaucaaaccauuccugccacaagaauaaaacagaucucaggggaggccuguggaagggucuccugaggccuuaccacugucuagaaggaaguugacagcaguucuugagcaggggugcgacuccaggaguugggggcugcucugagagcaggacagcauguauuguagagugucugggagggagcuguguuauccuuaccgugaagaugaggacacgggcucaugggggcagagccaggauuaaaccuggucugauucaaaaagccagagaucugugcccagccccacgcagccauuucacuggucaacuaauucagaaacacuuggucugauaugcucauaugcuacaagcacuguggccuucagaucucccucuggccugguaccugcauucagguucaccaccaucaccacacacacacacacacacacacacacacacucggccagagacaaguggggaagcccucacccuugaaguaagccacgccaaggagaaggaugcugagggcacugggcauuucccucguggaccgggcaaucuucccuuucaucugggccugcacccaguuguuaaucuccugaaggucuacucgaggguugcccgugaggauccggggccuggucccauaggacuucuccagaggggcaacaaagcuggauuugacucgaaguucuugagaggaaacagaucaaagaugagagcugaaucagcacccucacuuugaaagcaugccagaccccagcuuccugcucagcaucuuccuuugacuugcuggggcaucugccggcuugcccagacccuggcuagggaacaguggauuccaccguuugcauuccccgucccaggcccuccugcugucucccagagcccacuuccucuuucuguuccucuguggucucacuggcucuuuccugcccaccagugccaggccucgccugagcacacacagccuauuguuuagacaucauggaagcauacagacaacccaggccaaugaagcaacuucacgccaggcauaauggggcgugccugcccuucagaagcagaggcagcuuuaugaguugggggaccagcugagacucuauagacuuugagaggugggguggggguggggcuacugacuccucucaaacacaauucuggaagcacucuugagguucuucucaggggcaguaacagaggcaaggagcuccuuguaggugcuguggaugucaggguuggugaucaggucguaguagagagcccggugaaugacagacucuguucgauguucagcuccugccagagagaaaaggaugccaagcuucauaacugcccgugaggcccgcaucaggauagggacguuagacaucaauccuuuuguccucugagagcccgaggaggccgauauugcagauguuuuagcuggacaagaucuucagggcguggaaagaaauaaugaccgccuugcuaggaagagcucuaagacagggcaagguuaucagagcuacagagagaagagugggaugugguccugaaguucucccaucguaaccuacccuguucugaggaggagccagcucugcucacggcagcuguaccccuagaaccugguuaaaugacuaaaacacgauaggaggccacuuaaggaaccaaggucgagugccacuuacaaagugguagggauuguguguguggcccccaccgccccuuuccuguuccucugacggcggcagcauggaaacucugagugggggaaauucagguccaccugcagccuucuucaguugacacucacccagagaaagggcagagagggccguggccacgcugaguggagacagcaggacguugcccguugggcuggcacuggaucucaggcgguacagaucguagccgaaguuggagacagcugcugccagcuuguucacagggaccuugaagaagggguccuccuccuccacgggcucgcccgugcuguccgggacuggggagcccuggguuagaauacaaggaccaguagggaggcacagugaguacaucaccuccugguuggguugguccucuagucccuggggccaugagucugaggucagaaugagugugugcucucugacuccacaaccugugugcugggagguggggagugggaagggcaacacaaaagggcuugccagaccugaacuguggucugagaaccugaagccuggcccacuuuaaaauaaaacuuguagggcuggggagauagcacaguagauaaaguaccagcaugcaaguucaaggaccuggguucaguccccagagcugggcacgggggugcaugcuuauaaucccaacacuggggaggcagagaugggcagguccuggggcucauuggccaaucagccugaacuaaucagcguauuccaucucagugagggguccuguuucagagggccugaggaaugacucuggguugacuacuagccuacucugugucuguuucugucugucugucugucugucugucugucuccaccccucucuguccccuucccucugcagggaacuuccucaccaccaccaacccccaaagaaacccacccucagaccagucuucccuauucagcuugcuggcugguccuagucugccuagguucugcugugacgcccucccugucuuuccugacaagccauccccucugacuagacccgagaggaauuugucguuuucugaccuguuuucagugucagccucuuccuuaugagacuuucugcuuuuuuguuuuguucccagggcuuuggaucaaagcugggcucuuacauacguuaggcaaaugcuuggccacccagcuguaccucccgucccuguugcuuuucgguuuggaggacuuuuuuuuuaguuuucuguuugguuuuugguuuugauuuuuuguuguuuguuuguuuguuuugagacaggauuucgcuaugugacucuagcuguccugggacucacuauguagaccaggcuggccuuagauucagagauccaccugccucugccuccuaagugcugggauuuuuagauuuuaaucuguaccuaccaaccucaaaggaaguguccauggauagaguucaguacuacaucauguguguaacaugugugagggccugggcuucacccccaacagagaagggggaguuaguaggugaggaauaagugacuggcuaguggcaagacaguauugucuaaggucacuaagccuuaagccacacuuaaagcccacaauccaggucuaauaugcccaucugccuuguccuugugugacaugaccccaccccuacuuccuccguauaguggcagcuccucuggauccugaaaggagagggaagauauucuugucucgauguuaaaguaaccaaggccuagaagagugaaggccaaagcccacccuggauccagggcugccucccugcacugucucuucugcugucccaccuacccacccuacugaccucagagcugcuggggacguucuggcugcugccgugcccgagcagggcuccaguccagaggaguagcaccagggccugcaucccggaacuacaagagaaacaagagagcaaacgacuccccucacccacacccuccccugccacugcacauugcacacugcacagggacaagagucaggcagagugagcccuuccccucccuccagcucucagccccaaguggacccuugacuugaggucuuccgucccugaccugccccugcacuucuccuugagcugugcccccauguugguuccuaucaggagacccaccuucccaucuaagcuccagcacagggaagacccagcagcaggcucuucaggccccaagacaaugcucuagcacaaacacacaccaaggcuuuuccguggaggcacacggccagcuccuuugguaggauuuggaacccugucucaggaugggagcagagcccaggucauagacuuacagaacaucuggucugguccugcuauccaccaauaguucucugaccaaagccuauguuaaagacacacacacacuuucuucuagguagguucuuguguauguagcccaggcuagccuugaaguugcagcuacccuacuucauuugccuccugaguacuacaaugccaggugugagccaucaugccugacuugacucccuucuucuauuucaagagcaauucuuaguuaagaggguaugaaccagggccacacugccugggaccaaaccuugucucugggacuucauagcuaucuaaagaauaaagcccuacuuguaugguaugguaugguaugguaugguaugguaugguaugguaugguaugguaugguauuguauuguauaguauaguauuguauaguauuguauaguauaguauaguauaguauaguauaguauaguacuguauaguauaguauaguauaguauuguauaguauaguauuguauaguauaguauuguauaguauaguauaguauuguauuguauuauauuguauaguauaguauuguauaguauaguauuguauaguauaguauuguauaguauaguauuguauuguauuauauuguauaguauuguauaguauaguauaguauuguauaguauaguauuguauuguauaguauaguauaguauaguauuguauuguauaguauaguauaguauuguauaguauuguauuguauaguauaguauagcauagcauagcauagcauagcauaguauaguauuguauaguauuguauaguauaguauuguauuguauaguauaguauaguauuguauauuacuguauuguauaguauaguauaguauaauauuguauuguauaguauaguacuguauaguauaguauaguacuauauaguauuguauaguauagcauacuauuguauaguauaguauaguauuguauaguauaguauaguauaguauaguauuguauuguauuguauuguauuguauugcauuguauaguauuguauuguauuguauuguauuguauaguauuguaugguauaguauaguauaguauuguaugguauuguauaguauuguauaguauaguauuguauaguauaguauuguauuguauaguauaguauuguauaguauuguauaguauuguaugguauaguauaguauaguauuguaugguauuguauaguauuguauaguauaguauuguauaguauaguauuguauuguauaguauaguauuguauaguauaguacuguauaguauuguauuguauaguauaguauaugaguucucuguauaaaguauaguaguauugaccuacuucuaugaggguuacauuuuagaacaucucuccuuuuuuccuuuuugagacaaucuuacuauauuuaggcuccccuugaacgugugauccuucugccucugccucccaagugcugagguuacaggcaugcacagucacaucugccuacacaaugucuuagcagcccuuagcagcaccaggggucaggaagcccucaacugucccuuuagcuggcuucucuugugaagggcuaugucuucuuccccuuccuagcauggagacggcucuuagccccagagccuuccuuccuucagguuaaacagcaccaguuuuuggugggaccucccauuucccucuaucucccuaagcaacgaccuuuucugcucugacucucaucuggcacuuggaccacaagacaaaacugcagccugggcuguguguccucgcacaucauuccugugccccccuggagucaggucuaggggaggaagacaggguucacgacucagaaaagaccacuggcuguccuagugugcccucacccauccuauagcacgcacaugcugaugugcccccuccgcuccaucaccauccucucauguacacgugcccucccucgccagacacaugcaucacuaacuuuucugacuucccagaaaaauaucugaucugagaaguuaggagucugccaucaucagcuaugguccuuaaaauuaagucagacaauccaugggacaugaagggcaacaacgagaagacuccucguuccuuguucacucugcuuuuggcagcaccaccagcaggaaccaaccuggcucucccuaaucccucaucuauagcaggucucccggugggaauuuuagggaccucuguguucucauccaggggcacugccacucagcugcucagggagagaccccuuagaacaacaaagaaaucaaugcagauuuaggcuucuuguuucccuucccagccccucccaucacaggcaacagccucccuuggcugagccucaggaggcugauuuaucagagaggugcucagagaggcaccucuggucccucuggguagguagcaacugagacaggaggagauggucacccugggcauccucuaccaggaaguaaaugagauacccuugcagaugggaccccugaaguuccucccgggggcggggguggugguggugggagucuaagucacagaucuuuguuaccacgugguuagacugaggacugaaucugaggugggaaaucugaugugcauggggaaacacagagguccaaugcuggccaagagcuacaagcagggacaggugcuagggggaugucugaauguuccaccccaagccacaggaauaacggaaauggagacucuaaagggcagaaagugagggugugcagcaggggcugcacaggacacaugcaaggcccuggcugcaauaacuggguuggggaggcagucauuggcuagccaggggcaccaggacagugaugccauccuguccaaagggcaguguccaagccagauuucuaggcuccagggggaggaggguccggggagaggggucaagauucucccccucugagucaagguuggccuucccaugugccccaaaucaggaggcacagaaacugggauguuguggucucacauccaagcugagaagacaagugggagccaguacauguguuucagauuaaacccagucggagacaaacauguugcuccuccuccucccagagccaagcugccuucaagccacauggcagugaauaugcggacagugcaggggaggacaccucucucuccacuggcucaaggacaguuucaagggguucaggcuggcuggcucauggcuacgccgcucacccccuggacaguuugggguuuuucccuccugaaaucuuggaaucugaaucagccugagauaccccauaauuguaccucccaacacccccagaaaggucagcccugcagaacagaacucuuugguccccacccaucccccucagcccuggaggcugaacugaugggcagcuaagguccagacaguggcuggcucuuggaaagccugucucuuuccuuugacucagaccacucccugccguggcuuacaucaggaggugcaagggcugcaggagggcagccagaccccacaaaccagcuaggcuaaauggugcuuauuguucgcaagaggccaugaccucauuugucucccagcucuuuugguaagagagaaugagaggaagcuggacagagaaccuagcaggccucaggcagcccacugcuccuugcuguaagggaaccagcaccgaugguucugaaaagcagcgauccgaauggagucaggcugagcugcaggaagcucaccuuccuugcucacugcugguggaagcaacuucaggaagagcccagccuaugggacuauagcuccuccgggguacugcugaguccagccccagagcuuagcucccugcuucccaccacccaccaccacauccuuucccaacaccauucaaaaccccaguccagccucuccuacuggucuacagugagcggcuaauagaguccugggccucuguccccccaauucucucuccccucucaucuguucaccuugguuccuaaacugcaggggcuacuauaacccuaccuccacuuccuugcaccccucuuuucugcucucuggggugccccugccacucccagucccucuagccagggagccucuuccauaucugucuuccccaggcuagaccaggcgcugccuuaccugugguugcggcagcuucucucacagccugcacucugaggggcuccaggaagcagugaggggaguagcugccucucaaccagcguccagcaggcuucagauuacagcuacucuuuucuuaaagugaccugacuccauuuggaaucugugauugcaucauugucugguguuaacuuuaacccacugcugcccuuccgccauguggcu

SEQ ID NO: 6181 - RNA, 12935 nt, Mus musculus
agccacauggcggaagggcagcaguggguuaaaguuaacaccagacaaugaugcaaucacagauuccaaauggagucaggucacuuuaagaaaagaguagcuguaaucugaagccugcuggacgcugguugagaggcagcuacuccccucacugcuuccuggagccccucagagugcaggcugugagagaagcugccgcaaccacagguaaggcagcgccuggucuagccuggggaagacagauauggaagaggcucccuggcuagagggacugggaguggcaggggcaccccagagagcagaaaagaggggugcaaggaaguggagguaggguuauaguagccccugcaguuuaggaaccaaggugaacagaugagaggggagagagaauuggggggacagaggcccaggacucuauuagccgcucacuguagaccaguaggagaggcuggacugggguuuugaaugguguugggaaaggauguggugguggguggugggaagcagggagcuaagcucuggggcuggacucagcaguaccccggaggagcuauagucccauaggcugggcucuuccugaaguugcuuccaccagcagugagcaaggaaggugagcuuccugcagcucagccugacuccauucggaucgcugcuuuucagaaccaucggugcugguucccuuacagcaaggagcagugggcugccugaggccugcuagguucucuguccagcuuccucucauucucucuuaccaaaagagcugggagacaaaugaggucauggccucuugcgaacaauaagcaccauuuagccuagcugguuuguggggucuggcugcccuccugcagcccuugcaccuccugauguaagccacggcagggaguggucugagucaaaggaaagagacaggcuuuccaagagccagccacugucuggaccuuagcugcccaucaguucagccuccagggcugagggggauggguggggaccaaagaguucuguucugcagggcugaccuuucuggggguguugggagguacaauuaugggguaucucaggcugauucagauuccaagauuucaggagggaaaaaccccaaacuguccagggggugagcggcguagccaugagccagccagccugaaccccuugaaacuguccuugagccaguggagagagagguguccuccccugcacuguccgcauauucacugccauguggcuugaaggcagcuuggcucugggaggaggaggagcaacauguuugucuccgacuggguuuaaucugaaacacauguacuggcucccacuugucuucucagcuuggaugugagaccacaacaucccaguuucugugccuccugauuuggggcacaugggaaggccaaccuugacucagagggggagaaucuugaccccucuccccggacccuccucccccuggagccuagaaaucuggcuuggacacugcccuuuggacaggauggcaucacuguccuggugccccuggcuagccaaugacugccuccccaacccaguuauugcagccagggccuugcauguguccugugcagccccugcugcacacccucacuuucugcccuuuagagucuccauuuccguuauuccuguggcuugggguggaacauucagacaucccccuagcaccugucccugcuuguagcucuuggccagcauuggaccucuguguuuccccaugcacaucagauuucccaccucagauucaguccucagucuaaccacgugguaacaaagaucugugacuuagacucccaccaccaccacccccgcccccgggaggaacuucaggggucccaucugcaaggguaucucauuuacuuccugguagaggaugcccagggugaccaucuccuccugucucaguugcuaccuacccagagggaccagaggugccucucugagcaccucucugauaaaucagccuccugaggcucagccaagggaggcuguugccugugaugggaggggcugggaagggaaacaagaagccuaaaucugcauugauuucuuuguuguucuaaggggucucucccugagcagcugaguggcagugccccuggaugagaacacagaggucccuaaaauucccaccgggagaccugcuauagaugagggauuagggagagccagguugguuccugcugguggugcugccaaaagcagagugaacaaggaacgaggagucuucucguuguugcccuucaugucccauggauugucugacuuaauuuuaaggaccauagcugaugauggcagacuccuaacuucucagaucagauauuuuucugggaagucagaaaaguuagugaugcaugugucuggcgagggagggcacguguacaugagaggauggugauggagcggagggggcacaucagcaugugcgugcuauaggaugggugagggcacacuaggacagccaguggucuuuucugagucgugaacccugucuuccuccccuagaccugacuccaggggggcacaggaaugaugugcgaggacacacagcccaggcugcaguuuugucuugugguccaagugccagaugagagucagagcagaaaaggucguugcuuagggagauagagggaaaugggaggucccaccaaaaacuggugcuguuuaaccugaaggaaggaaggcucuggggcuaagagccgucuccaugcuaggaaggggaagaagacauagcccuucacaagagaagccagcuaaagggacaguugagggcuuccugaccccuggugcugcuaagggcugcuaagacauuguguaggcagaugugacugugcaugccuguaaccucagcacuugggaggcagaggcagaaggaucacacguucaaggggagccuaaauauaguaagauugucucaaaaaggaaaaaaggagagauguucuaaaauguaacccucauagaaguaggucaauacuacuauacuuuauacagagaacucauauacuauacuauacaauacaauacuauacaguacuauacuauacaauacuauacuauacaauacaauacuauacuauacaauacuauacuauacaauacuauacaauaccauacaauacuauacuauacuauaccauacaauacuauacaauacuauacaauacuauacuauacaauacaauacuauacuauacaauacuauacuauacaauacuauacaauaccauacaauacuauacuauacuauaccauacaauacuauacaauacaauacaauacaauacaauacuauacaaugcaauacaauacaauacaauacaauacaauacuauacuauacuauacuauacuauacaauacuauacuauacuauacaauaguaugcuauacuauacaauacuauauaguacuauacuauacuauacaguacuauacuauacaauacaauauuauacuauacuauacuauacaauacaguaauauacaauacuauacuauacuauacaauacaauacuauacuauacaauacuauacaauacuauacuaugcuaugcuaugcuaugcuaugcuauacuauacuauacaauacaauacuauacaauacuauacuauacuauacaauacaauacuauacuauacuauacuauacaauacaauacuauacuauacaauacuauacuauacuauacaauacuauacaauauaauacaauacaauacuauacuauacaauacuauacuauacaauacuauacuauacaauacuauacuauacaauauaauacaauacaauacuauacuauacuauacaauacuauacuauacaauacuauacuauacaauacuauacuauacuauacuauacaguacuauacuauacuauacuauacuauacuauacuauacaauacuauacaauacuauacuauacaauacaauaccauaccauaccauaccauaccauaccauaccauaccauaccauaccauaccauacaaguagggcuuuauucuuuagauagcuaugaagucccagagacaagguuuggucccaggcaguguggcccugguucauacccucuuaacuaagaauugcucuugaaauagaagaagggagucaagucaggcaugauggcucacaccuggcauuguaguacucaggaggcaaaugaaguaggguagcugcaacuucaaggcuagccugggcuacauacacaagaaccuaccuagaagaaagugugugugugucuuuaacauaggcuuuggucagagaacuauugguggauagcaggaccagaccagauguucuguaagucuaugaccugggcucugcucccauccugagacaggguuccaaauccuaccaaaggagcuggccgugugccuccacggaaaagccuugguguguguuugugcuagagcauugucuuggggccugaagagccugcugcugggucuucccugugcuggagcuuagaugggaaggugggucuccugauaggaaccaacaugggggcacagcucaaggagaagugcaggggcaggucagggacggaagaccucaagucaaggguccacuuggggcugagagcuggagggaggggaagggcucacucugccugacucuugucccugugcagugugcaaugugcaguggcaggggagggugugggugaggggagucguuugcucucuuguuucucuuguaguuccgggaugcaggcccuggugcuacuccucuggacuggagcccugcucgggcacggcagcagccagaacguccccagcagcucugaggucaguaggguggguaggugggacagcagaagagacagugcagggaggcagcccuggauccagggugggcuuuggccuucacucuucuaggccuugguuacuuuaacaucgagacaagaauaucuucccucuccuuucaggauccagaggagcugccacuauacggaggaaguagggguggggucaugucacacaaggacaaggcagaugggcauauuagaccuggauugugggcuuuaaguguggcuuaaggcuuagugaccuuagacaauacugucuugccacuagccagucacuuauuccucaccuacuaacucccccuucucuguugggggugaagcccaggcccucacacauguuacacacaugauguaguacugaacucuauccauggacacuuccuuugagguugguagguacagauuaaaaucuaaaaaucccagcacuuaggaggcagaggcagguggaucucugaaucuaaggccagccuggucuacauagugagucccaggacagcuagagucacauagcgaaauccugucucaaaacaaacaaacaaacaacaaaaaaucaaaaccaaaaaccaaacagaaaacuaaaaaaaaaguccuccaaaccgaaaagcaacagggacgggagguacagcuggguggccaagcauuugccuaacguauguaagagcccagcuuugauccaaagcccugggaacaaaacaaaaaagcagaaagucucauaaggaagaggcugacacugaaaacaggucagaaaacgacaaauuccucucgggucuagucagaggggauggcuugucaggaaagacagggagggcgucacagcagaaccuaggcagacuaggaccagccagcaagcugaauagggaagacuggucugaggguggguuucuuuggggguuggugguggugaggaaguucccugcagagggaaggggacagagagggguggagacagacagacagacagacagacagacagaaacagacacagaguaggcuaguagucaacccagagucauuccucaggcccucugaaacaggaccccucacugagauggaauacgcugauuaguucaggcugauuggccaaugagccccaggaccugcccaucucugccuccccaguguugggauuauaagcaugcacccccgugcccagcucuggggacugaacccagguccuugaacuugcaugcugguacuuuaucuacugugcuaucuccccagcccuacaaguuuuauuuuaaagugggccaggcuucagguucucagaccacaguucaggucuggcaagcccuuuuguguugcccuucccacuccccaccucccagcacacagguuguggagucagagagcacacacucauucugaccucagacucauggccccagggacuagaggaccaacccaaccaggaggugauguacucacugugccucccuacugguccuuguauucuaacccagggcuccccagucccggacagcacgggcgagcccguggaggaggaggaccccuucuucaaggucccugugaacaagcuggcagcagcugucuccaacuucggcuacgaucuguaccgccugagauccagugccagcccaacgggcaacguccugcugucuccacucagcguggccacggcccucucugcccuuucucugggugagugucaacugaagaaggcugcagguggaccugaauuucccccacucagaguuuccaugcugccgccgucagaggaacaggaaaggggcggugggggccacacacacaaucccuaccacuuuguaaguggcacucgaccuugguuccuuaaguggccuccuaucguguuuuagucauuuaaccagguucuagggguacagcugccgugagcagagcuggcuccuccucagaacaggguagguuacgaugggagaacuucaggaccacaucccacucuucucucuguagcucugauaaccuugcccugucuuagagcucuuccuagcaaggcggucauuauuucuuuccacgcccugaagaucuuguccagcuaaaacaucugcaauaucggccuccucgggcucucagaggacaaaaggauugaugucuaacgucccuauccugaugcgggccucacgggcaguuaugaagcuuggcauccuuuucucucuggcaggagcugaacaucgaacagagucugucauucaccgggcucucuacuacgaccugaucaccaacccugacauccacagcaccuacaaggagcuccuugccucuguuacugccccugagaagaaccucaagagugcuuccagaauuguguuugagaggagucaguagccccacccccaccccaccucucaaagucuauagagucucagcuggucccccaacucauaaagcugccucugcuucugaagggcaggcacgccccauuaugccuggcgugaaguugcuucauuggccuggguugucuguaugcuuccaugaugucuaaacaauaggcugugugugcucaggcgaggccuggcacuggugggcaggaaagagccagugagaccacagaggaacagaaagaggaagugggcucugggagacagcaggagggccugggacggggaaugcaaacgguggaauccacuguucccuagccagggucugggcaagccggcagaugccccagcaagucaaaggaagaugcugagcaggaagcuggggucuggcaugcuuucaaagugagggugcugauucagcucucaucuuugaucuguuuccucucaagaacuucgagucaaauccagcuuuguugccccucuggagaaguccuaugggaccaggccccggauccucacgggcaacccucgaguagaccuucaggagauuaacaacugggugcaggcccagaugaaagggaagauugcccgguccacgagggaaaugcccagugcccucagcauccuucuccuuggcguggcuuacuucaagggugagggcuuccccacuugucucuggccgaguguguguguguguguguguguguguguguggugaugguggugaaccugaaugcagguaccaggccagagggagaucugaaggccacagugcuuguagcauaugagcauaucagaccaaguguuucugaauuaguugaccagugaaauggcugcguggggcugggcacagaucucuggcuuuuugaaucagaccagguuuaauccuggcucugcccccaugagcccguguccucaucuucacgguaaggauaacacagcucccucccagacacucuacaauacaugcuguccugcucucagagcagcccccaacuccuggagucgcaccccugcucaagaacugcugucaacuuccuucuagacagugguaaggccucaggagacccuuccacaggccuccccugagaucuguuuuauucuuguggcaggaaugguuugauuaauuuccauuuuacguugcuuugugaccaucuuauggaguaguagcaagaguggauccuaacuuagaggaaagcccuggggcuuccuacuccaaguccccaggggacaggagagcaggcacguaccacacaccagcauauuaaaggccacuuuaaacagaaggagcguggugauccaagucagagagagaacacccacuuauuucugaguuuacuacaggaggauagccagaacccguggugcauggagccuauggucugugccacacaugcugggacccagcggcuccuguguucuugcugcugacagcucagguugcuuuggccaguggacgcacagcguggaccuguggccuuucuggggacaguggcucaggaugcuccaucuguuuccuuccagggcaguggguaaccaaguuugacucgagaaagacgacccuccaggauuuucauuuggacgaggacaggaccgugagaguccccaugaugucagauccuaaggccaucuuacgauacggcuuggacucugaucucaacugcaaggucuguagggauggagguggggaggucagagaagggcaggguggauauggcacagauggccacugagaugugcaggcugucugaauuuugcuguguaacuuugggcaaguuaucaauguuucuggggcuugccccccccccuuucucuggcuuuccuuuucuugaagaggagugagaaauaguuaucagaacucauucucccaggguuuguuuuaaggaucaaggucacgagaauggguuuucaagaucugacacucagaauugaggacagugacacaccuguaacccccagcagucaggaggcugagggagggugaucaagagcucagucugaguuguacuuugugaccaucucaaaacacaaagaagggcuggaaugauggcucagugguuaagaguacuggcugcuugucuggaguugguggcacaugacuuuaucccagcacucgggaggcaggggcaggcagaucucugaguuugagccuacagagcaaguuccaggacagccaaggcuacauagagaaacccugucucaagaaaaccaaccaaccaaccaaccaaccaaccaaccaaauaacuaccuccugcccccaauaaaaccaacaacaagagcacuggcugcucuuucagagcaccagguucaauucugaauaccuacauggcagcuuacaaccauuuguaaucccaguuccaggcgauccaacauccucuucuggccucugcagauaccaggcaugucugugguauacagacagacaugcagguuaccacucauacacauaacaagcaggcaggcaggcaggcaggcaggcagacagacagacuaggcacucgccaggguguuccucaguggagaaugcuugccuaguaugaacaagguccuggguuuaauccucagcaccgccaaaaacaaagcaagaaagaaaggaaaaaacuggacacucaaauguuuaucuauucauucguuucuuucguuuugagaacgucucaugugguccaugcuggccucaaacauacuagcugagacgacuuuguacucccaaucuucuuaacucuaccucccaaaugcuggcauuuguuugcuuguuuguuuuuguuuuuuuuuugagacaggguuucucuguguagcccuggcuguucuggaacucacucuguagaccaggcuggccucgaacucagaaauccuccugccucugccucccaagugcugggauuaaaggcgugcaccaccacugcccagcaggaauguguuuuaguuaggcuuuuauuguuaugaagagacaccaugaccaaggcaacucuuauaaagacaaacauuuaauuggggcuggcuuacaguuucagagguucaguucauuaucaucaugguaggaagcauggcauugugcaggcagacuuggugcuggaggagccaagaguucuacaucuugaucugaaggcagccaggagacuauguccucuguagacagccaggaggaggcucccuuucuacccugggcagagcuugagcagagagaccucaaagcucacccccaaauugacaauuccuccaacaaggccacaccuuguaauaugucauuccccaugagguaaacauucaaauauacgaaucuacuggguucaaaucaauucaaaccccacagugcuggggaguaaacacacagcuucaugcaagggcucgaccaaguuggcuacagccccaguucaagucuuuugacagcuucucucuuuagaauuaagagcaaaguuuugacaacuugucacaaaugucacaugcugacauucuacagcucuaaguguaccugauuucuuucuguuuuaaaucaguacuuauuaaccuuuucuaggcuacggcuucuuuggaaaucuaagaucuugaaguagugggguguggugacacaugccuucaauaccaguacugagaggcagaaguaguggaucacuauaaguuugaguccagccuggucuacauagaaaguuccaggcagcauaauagagagaccuugucucaaaaaaaaaaaaaacaaaaaaaaccugaaacacucuagagaagugacauuucuguuuaugauuccaugggggcucugggaagcccagucgcuguguccacaggcccuaggaucaacacaucuguucaaaggauccauuuuauuguucauuucugguucaaugcucuauacaaagcaaauggucagcagugcuggcaggcagucucugggggacauuccacuucagcuccuaagaaccaggcccugauucguguggucaacuugacacaaguuagagucauuuggaagggugaaacucaauugauaaaaugcccccaccagacuggccucugggcaaacccgugggucauuuucuagauuagugauugaugugggggggcccagcccacaaugggcagugucacuccugggcaagugguucuggauagcauaaaaaagcaggcuaagaagccacggggagcaagccagaaagcagcguuccuccacggcuuccgcuucaguuccugcccugaguccccuuagugaugagaagacacccugcgaauugucagaugaaauaaacccuuuccucuccaaguugcuuucagucauguuuuaucacaauagaaaccguagcggaaccacaaacaaacguguguucauuaaacuucuguggguuuuaggcugagaagaaaacucccuacucauggaaggacugccaguaaccaguagccuacagcccaggcugaggcuggggagcacaaggcuggggccccguuacagcagaggggaaggcagcuguugguguuuuuuuguuuguuuguuuuguuuuuucuggcucacaacuaaccugugcgcaucucuguuggguuagauugcccagcugcccuugacaggaaguaugagcaucaucuucuuccugccccugaccgugacccagaacuugaccaugauagaagagagccucaccucugaguucauucaugacaucgaccgagaacugaagacuauccaagcugugcugacuguccccaagcugaagcugagcuucgaaggcgaacuuaccaagucucugcaggacaugaguauguuugcaaggccacuuugcgcucggggcugagucuuggagccugccaccuugcugacagaacugaguccuguggcuuucuuuguaggguggcucagggaacaugugacaccauuacaggggaggggaaugaagaaccaccucccauuagacucaguccuugguguguguguguguuguguguguguguaucucuauguguccuauaacagcccaaaacauucucucaggccaggucuggcuucagccaucuuggcuauaaguucucagguaggucacugagccugucacagagugccucauagcucacaagucacugugagguacuccacuucuagcuugcuuucuugaaaaucagccuacacaaacagggagugugugugugugugugugugugugugugugugugguguuaauggaaucucugaaucuccacagagcuacagucguuguuugaaucacccgacuucagcaagauuacuggcaaacccgugaagcucacccaaguggaacacagggcugcuuucgaguggaaugaagagggggcaggaagcagccccagcccaggccuccagcccguccgccucaccuucccgcuagacuaucaccuuaaccaaccuuuccucuuuguucugagggacacggacacgggggcccuccucuucauaggcagaauccuggaccccaguaguacuuaaugucucagugcucuacagaacccccagagggaagcugauuauacauuccaggaaggcggccgguagcuucaguguagccucugcaauaaaagagcuuuuccuuaauguuugcuucuuccuucuccuguuugaagcuguuucauauggagagaaacugguccuuaugaauuuacauacuuguaacaugaacgggcucugcuuaagcucugccaaagucaccauuuccuguucucggagugcagguggaugaggaagaggaacguccugccccaggagggcccccguccccggagggcaccuccacacacaauuacuaacacuugcugugggguuccucaccugucucuuacuacuacaaauaucugg

SEQ ID NO: 6182 - RNA, 2798 nt, Mus musculus
cagaaggccagcaacguuccugacugcacgcaggagucuauuagucuauuagucuacagcuugggcaaauggaagacuugucccagccucaguuucuccauccacaaacagggacgaugauaaugauacgcacccagagagcuggaugaggaucaaaugggcuuuuuggcacuuagaggcgcugugcagcaagcaggcauagcuggcuuacaucuucaccaccaaccgcccucucccaaagacccacuccagaaaccugcccccgaccgaggcgcccaucucaccuggcuucguacacagguaggaguaaaagcccucggacuugagcaugaugagcagcgaaccccagcccaggaggacugcggagaaaaggagguuuuccaacacagcggugcaggccauccaccagcggcgccgaugggcaguggccagggugggcgccauggugcgguguggcgguggucgggcuccgguucugcagacaccugcgcgcagaccucagcuucagcgguggcucuacccaacccguguagccgcuggcgcacagccugucagucccuugcagcccaggcuauaggugcccgccgcaaaagaaaagaacccuagcccugucagggaccugggccaccccguacccgcagcuaccugguaacgcuaccuuaggccacaguggagccccgcuggccaagaggaaaggcuucucccuuaguucacucggagguaaacugaggcauggcagcuggaaaagggcuaauuaugcucaaggacguggagcggguccugaucccaagcaagacugaacagccacuuugggggccggaaagggaggcagcucguaguaaggucaccugagcagaggcucaccugagagcugccacucccagggacccugacaggcucccgcccgcccgcacucgagacccuuccuuagugcuuguuccuucaaccacaaaaucagcacagggagccccgaaacggcccgcccacggcgcuuucauuggcgggaccgcacaggaacugccgcgccauugguuaguguuuaggucgcuaggcgcuaccgccacgcgaaccccgcaugggagaggcgaagccgguucaaaccggcggcgcgagccaaccgcgcgacccccgugucgggcuguuaccccggcgauuagcccguuuccauagaagcggaucccgucccucuguccuccuggccuuuuucguuacgucucccucccggugucgucccucugacaaguaugcaccuucccuccaaccccugccugcgagcggcuucagguucucgcacccucgucugagacccggauccugggaguccagcucacccggcuccuaccaguguguaucgggcccgcccggcgccuuuucuguccccuuuauuuccagcccuuuuauuccuauccuaagaugaaaaacacugccgcccguugauuggcugaguggggcuggaaacaggcgucggccaaucagcagcuacccacccgccccccggcgagcagaagccgguuccggccggacuuggagacaaacaagaggaaugggggggcuggggggcggcucgggcaggcccagcucuacccaguuaaacuggagugccccucgacccggugaccgccgcgggcaucgccccacgcccuucucguugcccucuuccuugucaaguucaugggucagcguuucagggagucuugguccacagcgagcugggcuccaagcaccgugcgguucggcccgcaguauagaccaccguucucgcccggagagaaccagggccggaugcuccaacuccgcaggccauuaccgcccuuuugugcuguuucccggccugcuccuugggcuuuguguccgggcuccucgcugccuagcccccguuguccuauccaggcgcugucuacggguaucagaacaccccgacccaggucguggcauaauuaccgcaucccugcuagaucucccgacucaccggguccuugccuggaaucaggugccuccugccuggucuuuaaucggugucccuuaagggucuguagucaggauuuuggacuaagagccccugguccuccaguugucgccauccccaucccgcgcccucuuuucucggugccuucagagaccggucaguguucaggccggucaccuuggcaugcccugcccucccacuuucccaaacgacucuuucauguggcuggcacacuuucucguccacccuucuucaugcugugagcaaucccgagcaccuaguuagucuaagucugacuuuggagagcgcgauagaucacuagggguccaaagagcuccguccuuucuguaucaucagcggagcugcgcugcucugaggaccugcuuggacguggaauggagccucagcacgaaagauuuggcuguccguccgagucucccugacgagaggcacuaaccuccccucagaaaacacucgguaucccucagauucuccacacuucaagagccggcuugcuuuagagcuaaggguguccccagcagccugacucagcuucccucagcucgagugcgcccccuggugcccagaaccuucgccagccauucugcuagugcaugcucucccagacuuggucuaggcuugcugguggguuugggggccugaugaccuacugugcagaaaucucauaagcuccaaauuggaccuacuaucugccaauagauuaagcccuucaauccuuuuccuaagcaaucugcuugaggaccuucuccagacauauaucuaaaauguucccucccccucuucaaauaaauagugcccccuucucccucag

SEQ ID NO: 6183 - RNA, 3148 nt, Mus musculus
gagccucugcucuaacucugagccaugacacacacagaugugcacacacacuuaguuccacauaacauccacagaagcaagcucucaucuuaauuuccucugaccucacagagcucugucucagagcagaccaucuggaauaccggccggaguauuaaaacacagucauagcuuuauuuugaaauacaauauaauuucucaggacugcugugauauuuaagugucaaacaaacacugaaggacaugccuguaacccugacauuugggaaagugaaggaaaauaauaguaaaacucugagcugggagacagggucaugagagccaucuaaguuugaaaugacccaagucucuagucaugugagccuccuccccgccagcagggucuccaggcuucagauucccuauggugugaggacuguggcaugcaccaucagugguuuuacauagggaguucuagaucucccaccguuacacagugacagccugucccaaaaaacaaaacagaacaaaacaaaacaaacccauucaugucauauaggccucaagagacaggaaauacacauucuuaggacaguuuacuauaagcuuaaaacaaugaaacaaugaauuauuucagcaggaccccuuccuugucccuugacaggaagggaaguagccacauucuuugauaggaaguugcaucuuuuuuuuuuuuugaaaaguuuuuuuuuagauugacuuauuaugucuaugagaguuuugccugcauguauguaugugcaccacaagcauaaggguuauaagcugccaugugguuguugggaguugagccuagggccucugccaagagcaacaagugcucuuaacugcuaagccagaaauagaaacagagagauaggggggcuggugacggaggucaauccccagaauccacaaagaagugaacggaguaaagccacuccugaaaguugcccccugaccuggacauguguacugugacauggacaugcuccacuccccaccccacauacauacaaggacaggcccuggggccgauuccuuagcccacaagcucacuuccacucucuccacagugcuuuuuccugucuuaaugagcaguucagggccacagagcuagcucaagggauuagggugcuugcugaucuuacagaggacccagguuugauucccaccacccacauggcagcucaggaccaucugucacaacaucucuucuggcuucuguggucaccagguacacacaugguguauauacacucacacauauaaaauaagaauaaauauaaaaauaauaauaaucuguuuuuauuuugugccuaacuuaaaagguaugauuuuucucuccaucuccaccuggcaugccaggaucuucaguucacccaggcuguacuuuuuucuuaaaugccaauagaauuguccuugagcuuugaaaauaaauaaaugaaguagaaauuaaaacauaaguaaauaaaaguaaagagaaaauagccagccgggcguggugacacacaccuuuaauccgagcacuugggaggcagagguggguggauuucuggguuugaggccagccuggucuacaaagugaguuccaggacagccagggcuacacagagaaacccugucucaaaaaagaaaaaaagaaaagaaaagaaaagaaaauagcucugggcuuagcauugguaaauuuuagguuguagaggaugguaggaccugagauagauuauaaaugguauggucugagauauuauuuauucaaacuuguuauuuuugcuuggugcauacacacaaauauucugcccuguuggcaggaucaagaagacagggugcauucaugguaaaguuccaucagcaacaaaagcuuucaauuuccuucugcuuuuucuguugcagaugagacaaaaggacccagugaaaggaaugacagcagacgacuagcgccaccgcccuuucugcacuguaaguaccgagcuguugucagugggcuuggguccucaaggccagcagcucccugugaaaugagaaaaccuacuucauuccucaucuggcacucuaggacugauggucacugccgugcuaacgaggggacuccuggguuuccauagaaacaaauuauggacauuguuuauuucaggggcuggaagacuuuuuacccaggucauagggcuaacuuggggugucccuuguuaugcugagaggaaguuaucugcucaaagagcaccuucuagcaccaagaggcuaagaaaaccuaggaccuuuauucucuggcuuucccaugguucuuuuucacccaggccugugugcgugcuagcuaggcaagcacuauauccccagcccaacccauguucuuaagcagcuucuggggauggaagaggaggauuaagcagaugccaguuuuguagucagugccagaaccuuaguacucucucuccaaggcccccaccaacuggcacgccuccuccugggaucucuccacuugucaugauuuacugugugcuucugguugcccuuguugcuuccuuaauaauuucuauuucuuuucuaguuuugcaagacaguggucaacaggaaggcccagcagcuccacccuccugaguggcaggccaucuucggacgcagccuuucugugcucauucuucaggcaacuuucaaucccuuacuauagcuauuucuagaugcccuuuaacauugugaacaaauagaccgucugguauuauaaagccugugugugcgggagccugauccucuaagauacaugguguagcugcuguguuuacagcucauccucucuccacugugcucugacccauuucuguaugcccuccccuuuuauuuccaagugauggucucagucuucccaaugagcugccuuuugugaugugauuauuuaagcucauuuauuucagccuugggauaaacugagcuauuuugcuuccugggcagaucuuuggcaaugcugaauauucacuuggggagagaggaggaguuaaaaauacagagacaccuacccccagcuccucacaauaggaauguggcuucagaccccugaccucugcuccuaguaaccucuuguuugcgugcucuaagcaccaagaaggcacccaaggcccagccagucucagaaaauuuagcaaauaauaaauaaccccua

SEQ ID NO: 6184 - RNA, 3148 nt, Mus musculus
uagggguuauuuauuauuugcuaaauuuucugagacuggcugggccuugggugccuucuuggugcuuagagcacgcaaacaagagguuacuaggagcagaggucaggggucugaagccacauuccuauugugaggagcuggggguaggugucucuguauuuuuaacuccuccucucuccccaagugaauauucagcauugccaaagaucugcccaggaagcaaaauagcucaguuuaucccaaggcugaaauaaaugagcuuaaauaaucacaucacaaaaggcagcucauugggaagacugagaccaucacuuggaaauaaaaggggagggcauacagaaaugggucagagcacaguggagagaggaugagcuguaaacacagcagcuacaccauguaucuuagaggaucaggcucccgcacacacaggcuuuauaauaccagacggucuauuuguucacaauguuaaagggcaucuagaaauagcuauaguaagggauugaaaguugccugaagaaugagcacagaaaggcugcguccgaagauggccugccacucaggaggguggagcugcugggccuuccuguugaccacugucuugcaaaacuagaaaagaaauagaaauuauuaaggaagcaacaagggcaaccagaagcacacaguaaaucaugacaaguggagagaucccaggaggaggcgugccaguuggugggggccuuggagagagaguacuaagguucuggcacugacuacaaaacuggcaucugcuuaauccuccucuuccauccccagaagcugcuuaagaacauggguugggcuggggauauagugcuugccuagcuagcacgcacacaggccugggugaaaaagaaccaugggaaagccagagaauaaagguccuagguuuucuuagccucuuggugcuagaaggugcucuuugagcagauaacuuccucucagcauaacaagggacaccccaaguuagcccuaugaccuggguaaaaagucuuccagccccugaaauaaacaauguccauaauuuguuucuauggaaacccaggaguccccucguuagcacggcagugaccaucaguccuagagugccagaugaggaaugaaguagguuuucucauuucacagggagcugcuggccuugaggacccaagcccacugacaacagcucgguacuuacagugcagaaagggcgguggcgcuagucgucugcugucauuccuuucacuggguccuuuugucucaucugcaacagaaaaagcagaaggaaauugaaagcuuuuguugcugauggaacuuuaccaugaaugcacccugucuucuugauccugccaacagggcagaauauuuguguguaugcaccaagcaaaaauaacaaguuugaauaaauaauaucucagaccauaccauuuauaaucuaucucagguccuaccauccucuacaaccuaaaauuuaccaaugcuaagcccagagcuauuuucuuuucuuuucuuuucuuuuuuucuuuuuugagacaggguuucucuguguagcccuggcuguccuggaacucacuuuguagaccaggcuggccucaaacccagaaauccacccaccucugccucccaagugcucggauuaaaggugugugucaccacgcccggcuggcuauuuucucuuuacuuuuauuuacuuauguuuuaauuucuacuucauuuauuuauuuucaaagcucaaggacaauucuauuggcauuuaagaaaaaaguacagccugggugaacugaagauccuggcaugccagguggagauggagagaaaaaucauaccuuuuaaguuaggcacaaaauaaaaacagauuauuauuauuuuuauauuuauucuuauuuuauaugugugaguguauauacaccauguguguaccuggugaccacagaagccagaagagauguugugacagaugguccugagcugccauguggguggugggaaucaaaccuggguccucuguaagaucagcaagcacccuaaucccuugagcuagcucuguggcccugaacugcucauuaagacaggaaaaagcacuguggagagaguggaagugagcuugugggcuaaggaaucggccccagggccuguccuuguauguaugugggguggggaguggagcauguccaugucacaguacacauguccaggucagggggcaacuuucaggaguggcuuuacuccguucacuucuuuguggauucuggggauugaccuccgucaccagccccccuaucucucuguuucuauuucuggcuuagcaguuaagagcacuuguugcucuuggcagaggcccuaggcucaacucccaacaaccacauggcagcuuauaacccuuaugcuuguggugcacauacauacaugcaggcaaaacucucauagacauaauaagucaaucuaaaaaaaaacuuuucaaaaaaaaaaaaagaugcaacuuccuaucaaagaauguggcuacuucccuuccugucaagggacaaggaagggguccugcugaaauaauucauuguuucauuguuuuaagcuuauaguaaacuguccuaagaauguguauuuccugucucuugaggccuauaugacaugaauggguuuguuuuguuuuguucuguuuuguuuuuugggacaggcugucacuguguaacggugggagaucuagaacucccuauguaaaaccacugauggugcaugccacaguccucacaccauagggaaucugaagccuggagacccugcuggcggggaggaggcucacaugacuagagacuugggucauuucaaacuuagauggcucucaugacccugucucccagcucagaguuuuacuauuauuuuccuucacuuucccaaaugucaggguuacaggcauguccuucaguguuuguuugacacuuaaauaucacagcaguccugagaaauuauauuguauuucaaaauaaagcuaugacuguguuuuaauacuccggccgguauuccagauggucugcucugagacagagcucugugaggucagaggaaauuaagaugagagcuugcuucuguggauguuauguggaacuaagugugugugcacaucugugugugucauggcucagaguuagagcagaggcuc

SEQ ID NO: 6185 - RNA, 788 nt, Mus musculus
cucucuugcuauuaguuaaauguuuacuugacacucccauuauuaaaugaugucaccuugagaguuggagcuaaauccuaaucuuuccuuccccaguacuuauacuaaaucuagcucuuguagaucaucccacaccugcuaucuugugucuucagagauaucugggucucgcaagucgucccacgucuucuaucuugucucuucagugacuacgucucaacuucuguccuugcagagccaugaccaggcgcagacaguauggagaaguugcuaaucuccuucaggguguaaugaauguucuggagcacuuucacaaauacaugggaaucccacagauccgacagcuuucugaaagguaagauauccucacagacaauggucuuuccauaagaaaagauggugcugcaugcuuucuccaccuuauucuaggaagcagcugcagaugcuaugugaccucacccuacagugcccuuuauaccuugucuuugcagccuacccaagucaacuaguacacucauguguauguaugugugugcacaacucuccauugucugcagaacuguugguuuaaaauaguuauuuugaucauaagacuuggccaggcuuggguaauauuucuucucugcuccagacaccaucaguuaaggcagcugaagauggaaccagaggagcuggcuaccauggcuaguaaaugauguucacugucagcugagaacucagcuagccuauggacugagaucuguguuguccucaugggugucucaggcuuucucauaguaggacgguug

SEQ ID NO: 6186 - RNA, 2034 nt, Mus musculus
gcugagcacagugucaucuguaaucccaggacuuugcagcaagaggaucaggagcucagaucuagcuacuggauacugagagaguauaaaacuagugugaccuacuugagacacucaaaauaacccaaaccaggugcuggagagauggcuccgugguuuuaacacuuguggcucucacugaggacccaaguucaauuucuagcagccugcuacccccaaccauuuguaaugccaacuccaugaguccaguguccuuuuacguuuuuuucaggcaucaggcacacauauggugcacauucaugcuuacaggcacucacacagcaaauaaauacaauuaaaaaaaauaaguaaacaaacuuuuugauuuguugacuguuguauacaccuauaacucaacugcaggaggaccaugaauuuaaggccagccuugucugauggccagccuugucaaagacauuuuuaaaaaauaauuauaauuuuuuuuuuuuuuacugaucuucaaggugcucugggucuuuauuaucaaguagaaagaaaacaaagaaagcaaacaaacuugguuuuuuugcuuuugcaggugacaaaugaccucaaucuguucuuaagaacacaucuauuuccauagaagaauagaguguaacacucacaacacguacacuuucuugagaacaugggauuauuuuaccaaggaucugaauuuucucuguucggcaugaauuauucaaaagaaggaaaugauuuucaauaaagcauuuagcaguacaauccuauuacaaccaaaccagaugagugguugucaaagagaugugccaagcagcaguauguccauaugcuggauucccacagggcuuucuucccacuccugggaagacucguaccucauaggcugcacugaacagauggugugugucagcucuaucagacgcagguguaaaggaaggucaaccaucacagagagcaugggguguugcucggugauagaaugcuggccuagcagaaaccaggcacgagcacuucaaaacaaccuaaaagaugaaggggaaaaaagcaacuagaaucagacagaucuccagaacccuagacuguccuuucagacauuuaaauuauuuuuuauaaaauauuuuauaaaaaauccugucugauuccugaauuuuaaccuggaaggaguaugguaguguuccucguguggcccaggggauuaaggaaaauaauuucugugaggugaccaaauuaauugauaacacccucucacuuguguuuguucaauagguaagcuguacaucuaucauguaauuaaguguaggguguguguaugugugagugugugugugagugugugagugugugugaucuggggcuuuacaugugcgaggcaagugcucucccacugaucucauguccugaguugaaacuucuuucuguucuuuugauaaccuuauuuguguacugccaugccuuuguucuuuccuaaccugccugcccagugucucuagggguggccagaagggccaucagaugaaucugcccuugugcccuaauccuuuuuuuucccaaucaguggcccuuguuuacaggucuuugucauuuuaaauauucaugugugcaggcauguuuguaccgcuguguguucuuggaggucagagaacagcuuuuggaguugguucuuuucaucuacuauaguuucuaaaacucagagucaucagguuggcacagcaagaucuuuuaccugcagagccauuucacuagcccucuuugauuuuuaaaaugcaguuccacaucugcauaauuauuuuucgggauucuuagaaagcaauguuguaugaagaagaagaggaggaggagaaugagagagagagagagagagagagagagagagagagagaauaauguaguuuaaccaagaccuuccugucuaaagguaauucauuucuugaauuagcaaauuaucaaaugucuacuguagugcagucaguauugaucaguauugauugauugguguggaauggccucccaggcauauggcuaagugaaaug

SEQ ID NO: 6187 - RNA, 2769 nt, Mus musculus
auuugucuucaaaauaaaaauuuauucaaucuguaacaagaacauugaaucugcgcacaaguucacauuuaaaaacagcggagcacaucaguaauaauaaaaacaacuaugauacaagugggacaucccaaccaccaggauuaaggaaggagaugagaccacucuuuauauucugcuuugaaugccucagaaaggucccagagauuccagggagcaccugcuuuuaauaaaaugagagcauagagaaguuugggauagccuggacaaagguaacagucagugcgagucuuuuggacuuguuuggguuucaaacaagucuuacaaaacaaaguuuaaagggaggagggugggaaaggcaccuuugcuacgccaagcaaaucaaucaaauaaaacaaaacccaucauuucccagugggcuuacugacuaggacacaugucaguuucucagcuuuccauuugggguauuugcucucuguagacaggaugcugccaccagcuucgcugugaaggccgauggcagcaccagcccuauaccuggggugggguggggcucuucaaguugguaagaggugauuccaguuuagaaauccuguccuagaucucuggggcacugagaugaggcugguucucuuccuagcagaagcaggccuagucaccucugcuucaggcuggagcaguacagaagcaccuugcaauagcucuucauggcaucaagaggucccaaagcccuggggagagcagcgugcagcuuccugcuuugguggcaggccuuuuccuaauaugggugccagaugagucgaggcaacgcauacacuuauguccaauacaugcuugaucuuuuaguuuggaagggauaacgaagucuaugaucuuuuaaguuggauuggugcugaaacaacggaaugucaccuugucuaccguuaaaaaucaaaaaccaaacaaucauacuauccauucaccaucacgaccaucacuauggagacacaucagcacuaagaaaggacugcuggaugcgagugcaggacacagaaggagaucggcuccacagcugacccacuuauccacaagggcugacaauaauauggcauuuucucugggggaggacucauaggacaaccauggcuucagagccugaggccacagcgaugaugcauauuuuaauacucacaaaguaaacaaaguauccacagauaguuguuuggaaaagccaagaaaaacuggcuuuucuuuaaaaugcccuuaaaacuuuuugcauaaugcuuagaaaaaaacaaaaacaaaaaaccccaaaaaacccaacucccacagaacaucuuuacugaaagagaaccucaggugcagaauccugugagccacugucagaggccuucagaggaaacaucugggcucaggagcaggagaccuuggaaccugggauguguccccaggcugucccuggagcucuugguaguucucagaaugagaaagaaggaaauagcaguagagacaaagguacagagcaggaaaacacuaagaugcugaagagguggggaugcaggaacaggaacgaauauguuaagaagaacaagaggcaacuaaacugagaugaagugcucccuacuauacugugcccacaccacccacugcugcuguuuccaaaaacaacaaagggcuaggguccucucccuauagucagguauagcucaauguagucaggcuguagcuccaauccugccugcuccuggggcuguuagcccaggcacugaaaugucagcuccucugucuaagugcccacauguaugcuuauacacuuuuccagaccuacugacaggacuacuguggucuuaaaaacaguaaagagagacagaggcauugagcaagagguuaagcacuagucaggaggucaagauuuuuccugcuuaacaguucgucagaguuagguccaggcuuuccaugaacagaaaaaaaaacagacagacaaucugaaauuaucaaaugcuaaaguaaaaagucuucaacagcuuauuaugcaccugccuuagccauaagcaugacuuaggaacaacccaaguguugggguuuggagggcuggcaagacccuuuggcauagcugaauuauagacccuguguggaagauaccuaggcaggugaguuaaaugauaggaaauacaauuaagaaggaagacagcagaagaugguuucuuccauucuuuaaaucuugaaaacaaaaucagguguugucauuuguccguccgcuccccagugcccucauugggcauuuucucagucucugcuaagagagaugcagugaggauauucuacaccgggagaugagagagcaguguccauuggugauaauguguggcauauggaugcuacuuuuuuugagacagggucucacucuuuagccgaaguuagcguccagcucauagugauccuccugccucagccucccaagugcugggacuacagaugugagccacuacacccagcuuuuauuauuauuuuuggugaugcacucucucaaccuugauguaaacacuccucacccuaucauaacuucucguccuuccgucacacugguagacaggauucuuuagcagauggguccuggaauccaccaucuugccucccaagccuuccucacaaugaaacauaccaccuaacgagacaacacacaaauauccaagaugcacaaagauguaacauuuaaagaaacuaccgaaagacagcacagguauauauaacuucuauaccacauauuuccgcagguggucgcuaacugcuucc

SEQ ID NO: 6188 - RNA, 7323 nt, Mus musculus
ucucucuuuggaccaagcgccucccgaaccuguaugcgagggacgguggcagacacgaggcacgaacaccccgccagcgcacgcacacuuacuuuucccuuuuuacagcggaguugagacgcccgccggacuuucgcgcgcuggacagggcguagccgcucuggccuggcccugcccccguccggccccgcccccucagguugauggcagcagcagcugggacugcagcggagcccgcagccgagagccgcaggcagcggccggaacacccuggcccggacgcacggacgccgccuccucggcccuucgcauaccccggcccgcuccgcagaggagucgcagcgugagcacccccgcccggcuuaggaccagguaccccccucccugccuccgccaccgcagccaacggcgcgggcggggucucuggagggggcagaggucugcgcccccccccccccccgccgcuaaauucaguucgucagggcggacuuggugucuauauuuggccggacagcggcuggcgaggagacaccuagucucacaggaacgcacugccggggcaggaggcuggaggagggggcgaguaggccggccuucaggccuggggcuacagaagugguuugaagggcacaaggaugcccgggcaggggaggggcaggaagcaguuggccuuugggagaaccugcuguguccccuugggaaaaguagcaagcauugcuaagcuccuagcuccagaagccgaagucguagaaccagaaagaggaccucaccuccucccugguugcacaucugguccuugcagguggggucgagggcccccacccucaagagaacggacuagccagcccaggcaucgcacccaagaggcuggaccaaaguaugauauuugugucagaugaccauagccaggacucccccaccccaccccauccggagaaaucagugcauggggaaauagacagaaggaagaucgcccuacucccacauaccccacaccaccggaggaaucuuuuaaaaagaguaggaagcagggcuaacaaaaggaccucuucucuuggccaagcuguagaaaaagacacaccggcuugaacucagcgaugugaauaugggaucuugagggcugcaguccuaccuagccuugagcuacgguccacugacuaaaagagaagguguuggguggggagccuuucagagagacaaacacuugcaaagaggucucauacaugacuagcagcaugaggggacccccugauauuccuccucaaaacauuaggucuuggaggaaguuucagcccugugucagccucugcuaucccggcuagccugugugucuaagaagcggugagauuccccauccuugucccucauauuaaacaacaugagacagaugucaaaaaccagccuccaacuuuggucacuuugaagauccuggccagauaauccuacucacucacuccucccuuccacagcucgcaggauuaaggaccaacgugccucuagacucugauacucccuaucuuugccccagccaugagccggcguguuguucggcagagcaaguuccgccacguguuuggucaggcagcaaaggcugaccaggccuaugaggacauccggguauccaaggucacaugggacagcgccuucugugccgucaaccccaaauuucuagccauuauuguggaggcuggagguggaggugccuucauuguccugccucuggccaaggugaggggugaggggaagaaagcaauugggagggcacuggcuagggucucugggauauaucccacacuagccuuuucucacugaaguccaggccuccagaagggcagucuguguggacuggguacucugucuuugccaaacccacaaagaaugguggagaacagcaacaucagcgugaccugugcgcccgaucucuaggccacagagcacuguguuccuagcagaaaccaagauggguguuagugauggagaugguugggauacagcagaccaagguccagucagacucuaaccuuaucuuuaccuagugucagagaaaggcagagucagagagauggagagagacacacagacacacacagaaacagagagagacagagauacagagagagagagagagagagagagagagagagagagagagagagagagagagagagguguucagacucugauccugggagugggaugaaacuaaaaagagaaguuacaauagucagagccuucccuccccugcacaugagggaaagggccaggcacugacugccaccuuugcagacacguagccaucuguaccccaggagagauaccccaaagcauaaccuugaccuagauacugagcccuauaccuugcuaaagaagaccucacaagugguggggucaggacaggccugacaauagccuaugacucacgcuggacaaugcagacaccauccagagacagcaucccaagggcucacauuucagcccgagccaccuccucccccagugugacugccaugucaauggcauuuagucacccucucucccagacuaugugcuuugggccaaugccaaccccugcagagucuucagagcucccacaacuuacucaugaagacaaaaagaaagacgagugccagccccugguaagggacacucagcaccaagacugcgugcugccuaugacuccaaggugaaaccaagggagaggucugccccaggggcuaagccacugccgucagagucacucacucagaccucucucuccaggggcuugccaaagguccuccaacuugggggacagguucaagcacauccuccucacagggcauguggguucacgcccaugagcccagcacugggaagaccgaggcaagaucagccuaggcuaaucaacauaaugagaccuuaacuugagucuggguuccguguccugcuguggguacuuuguuaggucagccugucucucugaaucagacuuccuaauacaaaggcauucacacugugcaucuccagcaaaguucaaagaguagacugagggugggggugggguuaaauucugaaaaaggucugcaaagagaaaacuaauaacacagauuugagagguaaacaaaucuacugcccacuucaaaaccacauacaggagagcaagggccugggaugcagcucauugguugaccauuuacuuaacaagugcugggcccugaguuccguucccagcggugcuugugcacacacacacacacacacacgaaugacagugaacccauaucacccucucugaccccuccagacaggacgaguggauaagaacuacccacuggucacugggcacacuggcccugugcuggacauugacuggugcccacacaaugacaacgucaucgccagugccucagaugacaccacagucaugguaggagacuaguggaugcugccaagcugggcuggggaacggggaggugucucaccugugcuggggaagauaauagaagggguagaggccaggagcucugcccuguccugcccaguucccagauuauuuuuaguuaaauacauaccugcgcccucccagagggcacugccuagaacuaauuauaaccauggauaacuuggggcccuaagagcagggguacagcacucugaaguuuucuugacagaguaaggcagucuuuggagagcucacaacugcugcuucacggugcugguaccaccaaguuuuuuuuccuguauuugacccguaccacucaagaagaccaauagcacuaagugugugagccaucucugaaucccaccugcuuguugccuuucuuccuaccuagguguggcagauuccagacuacaccccuguaagaaacaucacagaaccugucaucacacucgagggccacuccaagcgugugggcauccugucuuggcauccuacugccaggaauguccugcucagugcaggucugggguggggcuaaggagggucccuucuguagaugagggugggagugaggaaggagagccucggaugauacgccuggucacucuggacagggggugauaaugugaucaucaucuggaaugugggcacuggggagguacugcugagccuggacgacauacacccugacgucauccacagcguguguuggaacagcaaugguagccugcuagccaccaccugcaaggacaagaccuugcgcaucauugacccccggaagagucaagugguugcggugagugccuggccuggcugccuauucccuagcuagcacccccuuguucaacaccagccguuagugccugauacccagucaucagagccucuggucccagcuuuuaccugucuuaucccuacuccggagauuagucaugacccaacccccuccgcaccccuugcaggcucaacagccucaaucccuccuacccugaguaaacucccagacugcaacccgguucgcuccccucccauacaucuaagagcuccgaggagggcuccuugcuuugagauugaggagggagaagcuggaaacuccauccuccaaccagaaccugcaugaaaccugagcuucaggacccucuccucucagauauccaacgccaucuuccagggucuggggccugacuaccgagaccugacccccuuuccacccauugacccacuggguggggaugaaauaacccucaagcguggcuuaucccagcugggugcccugggaggccaguggcccuguccuggccagccuccuucuaaccugggaagucgggugccugcaugucugcuuggagcacaggcguggugcggcugggagccggagggcgggugggcgggcacucuaacccacuaacccugcgagcaggagcgagcccggccucacgagggcgcccgcccacugcgggccgucuucaccgcagacgggaagcugcucagcaccggcuucagcaggaugagugagcggcaacucgcacucugggacccgguaggccaggcggaggcgggcgcauuggcucgcuuugcagggucaaccaggagcacccuccugagugguggcccaacccaagaggcccaaguggagcacggggcucccuuguggauagaacaccacugcaacccuaggaugccugcagacaucacccgccccagggaucagccuuugagggugcauaaggacuggaaccugcugagagcuccaggccucuugcucucucacagcccugaucuccaggccaugguccugccacugaccucggagaagcugaguucuuagacuccuuuuccccacccccacccccaccccacacucagguuggcaagguugcucagauuuccaucucccgaaggcaggcagcaaggugaugcuccucccuucucccccuuccucccaggagagguuugcagcccacgaggggaugagacccaugcgggcugucuucacgcggcugggucauaucuucaccacgggauucacccgcaugagccagcgagagcuaggccugugggacccgguaacacaguuggaggcuugggaugugugccccgggggcuggcaucacgggcgaggggccagacgcccugcacccgcaggguaugcccauuccgacagggcugaagguugcugccaccucacacccaacacugcccaguuuugcugcgucgccugaaggagcucgcgcuggcgcccccuccuggugaugccaagucccugggggugguuugcugugacugcaugcaaccgcacaggguguuccugugugagggaaagggaaagaugcaucuagaagagccuguagcucucaccagagcugucuuggaaacgcaugggauuugggguggcuauaaagcgaauucugauguaacccgggaggaagaacagggcuggucacucucccugugcucggcagaacaauuucgaagagccaguggcccugcaggagauggacacaagcaacggaguguuacuaccauucuacgauccugacuccagcaucgucuacuuguguggcaaggugcuggaggcugggcuggaagaaccagggccaggaugaagaugugagcacgcugucuggcagugccaucuaaauuggcugguuuugcagggugacaguagcauucgguacuuugaaauuacggaagaaccaccuuucgugcauuaucugaacacauuuagcagcaaagaaccgcaacgggguauggguuucaugcccaagcggggacuggaugucagcaaaugugaaaucgccaggucagcacuuuugucccuccugucccccugccucuauuucucaugucagcucccgggcuuccccuaauugugcuguucuuuggggaaaaaagaaaggagccauacuagucuuuuucagugacagucccagcauuguccuacuagccugacauuccaacagagguguuuuaacccaacacugauaaugugugaaugguaauuacucggcgugguguugacuuucaacaccuuagucacagacauagggauuuuaaaaaaggauggggagucagcaggaauguugaauuucccccucccucauagguucuacaagcugcacgaacgaaagugugaacccaucaucaugacuguaccgcgaaaggugaggaaggagggcguuggcuggaaagcaucaaaacagccauccacugcucagcucauacaggcccuccuguccucccacccccucagucagaccuguuccaggaugaccuauacccagacacgccuggcccugagccugcccuggaagcugaugaguggcuaucaggucaggaugcagaaccugugcucauuucgcugaaggaaggcuacguuccccccaaacaccgugagcuucgggucaccaaacgcaacauccuagaugugcgcccgccggccaguccucggcgcagccaguccgccagcgaggcccccuugucgguaagcucugagaucugaccacgccacccugacucuauccccugccuccugcucucugccauggucucuucugucucccacaugccagcagcagcacacccuggagacauugcuggaggagauaaaggcccuccgagaucgagugcaggcccaagaggagcgcaucacugcguuggaaaacaugcucugugagcugguggacggcacagacuagcacugccuacgcgcugcaaagcucugcacacugcagacucaauggggcagggcgcaccgacuggcagcaccggcuuuuggucuggaacucugcacccugccucgugggguuggaaucaggggagggaucagaaaagaaacuccaucucccacaagaggccugaacacacagaucuuaaguggcagggacugagcuccguacuag

SEQ ID NO: 6189 - RNA, 19628 nt, Mus musculus
uuaggccccgacucuggccuuugcucuacggagcuggcgaccuccuggugcacaggugacaucuagaggauccgggcgguccucgaucaguguugugaagagaaggggucuccgggcugcccuuggucuccaauccacgcccccaggccugaggguuuccuuggccucuucacagagccugaaggcccagcaguugacuuugggaaccucaucuguggccccggucuccuuaacgacugggggaccuggaggcaaugguagguccaggacagaggcucagaugcccagugggcaaggcaaccauggagguugugccuguccgggucagguuuccccagcuccucgggccgcagggccuccccggguagcccgagggcccacuccacguacugaagaggcggcuugggcugccauggcccugaccuuccuacuaguccugcucaccuuggccacacuuugcacgcgacugcaccggaauuuccgcaggagcgagaguaucuauugggggcccacggcagacagccaggacaccguggcuggugagaagagccccccucccccuuucuggugcgcccaauggcuggaauuccuugcccuugacuucucaccuucccacagcucuccugaaacggaggcugccuuugccuucgcgccggaucaagcggucucgcagacggccccugcucccacccacaccggauaguggcccugauucggagagcuccgacugagcggcuccgccccucugcgaccgcugccacgugggccguccgcgggcgcccccuggcggcgggccgagaggcccuggaggcuucaccugguuccuggaagaguagccuuguagcuuuccugauacaaauuccuguuucuaauuaaauuauuuuaguagaauucggagucguugggagauugucucuugcccucagucacacuccuuucaggucucuagucaguggcccagggcuauucgaaucacaucaggccgguuucuaaucaaguggcuuggugcucaggugcuggcacuccucucacuagcucaccuuucugcaagucucuccgcccaacacacacuccugacucuucacccccaaccuuaagcuugcuguccugccucagccuugcaaggauugcagagagaggacaugguaaguagcagcaacaaugaccugaaccaagaacugaauacugggcuaagccccaccuccaaccucuagacaucagaaguggcacauggucacuuauuuauuuuugauacaaauguacaugacacacguucugacagcuacccaccaccacaggcuagggaaggugguuggggagaagagcuggugggugcugucagugccuugccggccuucccagcugcagccagauccccaggccuucaggggugggucacuguaggugcagguagugaugugggugcuggccuugcagaggcuagggggaggggcucaguuccacagccaccagcugaguuggggacccuggggagccagccccaggcgcaggugcuguccucugccuggccagcacacuucccauaggggucggggagagauggagggaagugguuuuccuuuuaaguuuauaggacagggauacaaguaggggcagcaacuggaccacagcuggugacccugacagucucccugucccagguggggggagaggggcugacuuccaaugcugguuccacuacucugguuccccugcuccucagagcuccaggugggccaggucucuggaacggcacugccgcucacauccucaguugcaggaacgcagggacacucaguuaccacagaguuaaaauuaagggguagggagaggaaaagacuuuccaguguuugcugcuggggacccuggcacacaaguuggggccugugcucuaggcaggggccguuuggcaugaaagagcagcaagggggggcugcuggcuacaggacagagacauccagagauaauguacaaaggagggggugccccugcucggccccccagggcuaaacuggcucauggggauagggugcaguaggcggagcugccccaucuggagugucccugccccacacccuuugcugagggcgccuggaaggcaggugaagagcugggagggguuccuugaggcuccugcacaucagcagggcagggaugcuauguacagagggaggguauggaaugugggagacagaggcuccugucaccucacauuucuguccuuggggcuugaggggagggcaccagggcaccuggaugccagaggaaaacgguggcacuaagggcacuugugccaguggcucuguuggggguggguuagugucuggaguggcccagcucccauggccagugaggucccaggguguggguaagggcagggaaaguggucacuguuucuucucucggguggugauggugaccagcugcuuggcagccuuggcgaugucauaggcgcacuggaucaccugcugagucagcagcuggaaguccacaggggcgcccggcucuggaggcacugucuuccggcacucgcucugaagccgguaggcgcuggcguugagcagccgcagugaacugcgcacaggcuccagggcuggccucuggagggaggagugaggagccgaugagcucuggacuuuaagccgggcuucugacuggcucacugugcucaccuccacccaggcagcagucagcuuaccugcaucugccccaccccaaggcccucccacucugcuucucgguggccccuguaccuuugggaagagagaagccaucucagucacagccaaauguaucuuuucugaacaggguacaaagcugucagggaaaggggguaguuagaugagagauuucugaguuccagagccagaggacccuagcaauacccuccaccccaauucucagaaguuaacaagaacuugugcccacccuaccugucauguuugaacuccugggcugcccgcaauaguuccugaauguucuuggugaccugcucugucuuuaggaugacgucuucggugcuggggagcccggggucgaggucuccaucuaagcucuccagcucagggugcagcucauccuccuugcucagcucuaggaaucgcuucccuucaagccuaacucagguaggaggggaaaggagccauuccagccacugacggcuucugcaccugcaugcugggcccucaccgccuccccuccaggcgcucacagggcuggguagagacccccagguaucucacccaagcagaggguccccacucuguguguucucauagucacuguccgcaccacugccguggcgugagagcuugcucuggaggguggggaggggugaugggugagcacacacuccuggaccuguguagcccacacacugccccugggcccugggauggaaauuaccgcguggcgacuuccuucuugggagcacgacagcaguggggaggagggagugaagggcacagaagaggcagacacccccuuccggaucugaaagccaggacagggccagagucagucuccaccuguacuucagugucugucacgcguagcuuaacagcuacuggggcuggugacucacggguucaggguucacccuuccccagguccugcuuacccgauaaaggccggcagggacaugcacugaguagauggcaucgucuucgagcuccugagggagcagggcagugucagaguuagugugacccucauuucccccaccaaggccaacaggcuacucaccgugcuguggaaaggcuggagccggguggcgagcucguccccagguguaccuccaaagggcuucaaugcagagccuggcucauacauagagaaggccuggcggucccugcggugggugcuuccaccaggccccaugaggguguguucugcccguucacugggaagugaggguggaggcacugguccggguggcugccgaagcugcagguucucugccugcaauuuguggaucucccuuugcagccgccgcagcucgucacucaggcugcuguugaccuucaugagcuguugcaccuuggccucggagguagccagagccuucuucagcuccagguacuccugcagugucacugccccaucugacagaucugaggaguccaugcucuguagggacagaagccagucagucuuggggacagaggcugaccaaagcugggcuauguauaacauggaacugggucuaaaggccagaaggaacagaggagacuacgggagggaagaguagggucagugucagacccuggcacgguuguuccgcguggcgccugcacugggcaagggcuccugguccgugucuucgucggaagccacgcugucguagucgugcuggucauccagcucgcucuggcuccgugcagacagcucaagguugucuaaagacagaagaccugucacuugggccugcucagccacacacaucauuuaucaagaucccaggcaaaggugaccgcagggccugcaacagugccuuagccugugcgcucccaccuguggggcugcuuagacucuugcccugcugccuccguuuggccucacugagaaugucgaugaucaagguggcaaacucucgggcauugaaacgggccaauuucugucgucccuacaaggcggaaaggacaaagccggcaugagggaccacuucugguuggcucaggggcaggaacagaauagcaaagcaggacgcugccaucccauccauucacagcuaaaacacccagcccaacaucagcagggugguagcccaggucagcaaagccuuaaggcacccaagggagcccuuaggaggcuaaaauacccagcaguacuagagaauagcuccaucccauuccuagucagacucugagggaggccuugggagagccugccugggugccagcuugucucuggcuaaagaagggcagggcccucagacugaaaggaaaccacccaggccucccaccuaucccuccucaccugauuccgaguggcugaguauucaggguugacuggcaggaagggcacagcacugcgcuccgucaccagggugcuaugauuuuggguagcuagccacacugugggggaagggcagggagcagaucacccauggugaaugggcccucagagaagcacugagcagagccccccaggcccucuauucugacugggucagugucacaggaagcagggucuccacgaacacaaaagcugggccacacccugugagccccgcccacugacaacacaacaaggcagggcccaccaggccagacccagaguuuggguuggaaucuggcuguggccaggaaggagugaugcaggguagggguggagcauggcuggggagacagccagaaugggaggcagccagagcaacaugagcuccagugccugguggguagggaggcagcuggcuccuacugcccagugggggauggcagggacucaccccaguaggucucagagcaguaccccguuccccugguucccuggguccuugcucuuugcagcaggucccuuacgucuacuguguccuugcucuuuacagcagaucucuuaccacucaccagcaucauuuucucuccgauccaccucaucauacacauccauggcaaguuccucaaaaagccgguugcugagcuggaggcagagaggggacccagggucugucaggaugccgugugaugugggcaagucucaugacccguguuacccagcucauuuuagaacugagggauagguaagguuuacugugcaaggaagagaguccaggccauuuccuccucucagagaugaggcucuggacacaccacuuggagggcagaaccaggaucaaagaaaagggcauggggaggugaugggaggggcgaggcuggcaagacaggagagggcugcucuaaguagucccagcuuguugaggcagacucaccgcuugcagcuucuucuuggcagcuuuggccaauucagacagauccaagcuguggacaggagggaggagagaggccagacaugagggauggccuggccccugcugguugccucccaagcaugcagggggcucagggagaugagaccccgaggucacacaccaagccucccccacccaaacgucacagccugcagccaacagguguggguaccucugagacaugcacuuuugccgagaucuaauccaggaaggcagcaaagggaagaauaggacagagcagcaauuacccagcagcaggccgcucuugccuucacacgucaagcucagacacaucuccacacacucaacacacagcaugcaaggaaaucugccuccccagccaguuccucuguccacugucagcuacacggagccauccgguauuccuucuuccucagguccuagccacgccucccacuucugcccuuguuuccucuggucugggcuuuuagacuucuaggcuugucuuuaaaauccuuuucucauccaguggcagagugcuaacauaccuggcuaugcucucugccuuaaaacaguucaauaguaaauguacauagacuauagcccaaccauacuucuucauaaugcuuucuuuaaaaaaugcuaacuacuuuguauuuguuguguuauugucaaucuuccccgaaggguaaguauuagccccccaugcugagaugacaugacuaaggcucaggcuagguaaucuguuucaagucacacggucagguaccaccguaccaccacuccccauuacagccuggacucuggccaggaugguuccaccuuugcugagguuccccacaagguucauucucaccuggcuccuuccaaucuuauucccucacacuaugcugugguacacaaauugcuuguaguuccuaccucuguacccuaccaccucuugcugcuguccugccuguuaaguuguagcucagggcuggcgagaaggcucaguggguaagagcacagacugcucuaccgaagguccugaguucaaaucccagcaacuacaugguggcucacaaccacccaaaaugagaucugaugcccucuucuggugugucugaagacagcuacaguguacuuauguauaauaaaaaauaaaucuuuaaaaaaaaaaaguuguagcucaggguaacguggugucugcauuaccucggugucucuagagcagcagcuggcucugagaaggugcuaaguuacaaccacugacucgauguccuuguguguguguguugacuaugcauauaugggcacacauaugaaguagaauugagucuuggggucuuggaacaggggaguucuggguuuaggaaucugagcugcacagccugaccgucccauuugucugcauaggcugugauggaaaaccucuccuaaugccaaggggcacugccuggcaugaagcuguaguccucugaggaccacuagguggcgccaacucauccuugucccguaaacugaguaaguggcuggguuauccaccgcugaguuaucuuggggccuccaagaucagaggcaaaaauucaccaugaccccccugccaccgcauacuggaguucuggccuacuggacuccaguuccaaagccaccaaguucccuguagcuaucuucuuccuagagggaauacuucauccaaaggcuacacggcagauccagucuaguuaggccuuuccuugaaccuaaacccuccagacauuuaauaaucacaagguucacaugcacugcuguaugcugagcugacacuccuagccuugagguccacaguagcagggacuacuaauucccguguugcuaguuaaugugggcauagggugggaggccaggccucugaagccuagagagaggcagggcucugggucaagucaccuugacaucuaauagcuggaaaggggcaucaggugggcacucaccugucagccaucugugggaugauguaaugcccauucuugugaucugaacaaaaauaaaaaugccaagucauggauggcagguggcgccaguauccaggagcccacuucaccaccgugagcaggguuugacacggaggaaauggaggucggcgggauaccccaagagcauuggacgcuggcuggaagucaggcccacccccacuccuuggccccaacauacuugcagcaacccagagccugcagcaauuucacaggagccaguugccuagcaacacaguuccccagcuggcuuugucacuauggcaccugcugcuugggugugucugggucccaccugccuggccuagucaggcccagcucauucucugcucaccaggcuuucguccacagagauagaaggccaaccggucagugagcucauacuggcacucaacuagccuuucugccaguucauggugccccgccugccuguggggaggggacacggcucagccacacagcagcagucacuccccuccaccuacgccucacccuuuagcugauucucaccuggcauagucgaugggugugcggccauugacaucaggagacccggggucagccccauacacuaccagcagcucagccugcagugucugcccugccuuggcagccacauguagagguguagugcccuuuucugggugaaaaaaguuggccugggcacccaaggaaagcaggcgcagacauguuuccaaguugccuguucgcacacuugagugcaguugcugcgaggagcagagugugcaauaaaugagugugacagauaacgugugcccaaggaacuucuccccuaaccccacaacuggcuguuccugguacuccuacagcuccaaagggccaaaaccaggccaugucaggcaggccagagggcuucuaacuacaggauaaugccaauuaauaacagcgguuguguugccagucacuaucuuccaugagcucugcuuggaacagauaccagcuagaggugggccugugauuacuuucccauuuuucuggugaagaaaugaaggcucugaauagcugagcaaggcccucgaccucaggguucccuagcuuucaaguggcagacggacgggaggccuuguguauccacuugggagcagaggcaucuuagccaucagcagaaugacacagccccagagugucugcacuuccugcuuccccuggcccuacugccucugggacccaggccucgggugucgugggugugggagggggccccucacaccuugcugaggucuuuggcggugaccccaucaucaucacggcagggaagcuugugcacgaacgccagcaucugguacuuugcccugaugaacucugacuugauggggcugcauuggagcacacaggaagcaaugggagcaagaagcuuagggaagagaccuuucaggccccgucccaggcacacggucugcccacugccccugcagccccacucacuggacuuuaucuuggggguuggcuuugcgccggccacuuugcacuugcgcaggguccagcagggagugcucccagauggaguuggccccguugcuggcaagcgugugcaccaucuguggggaagagaugccaagcauagaguguccacugcaugcugggcacugagggagauacucccaaagugccugcuacagcuggaaacaucccuaaggguccuacagugugucugguauccacucaggccacccaaagucauguguccuguuuagcacuucacgcuggcuugccuugguggguucgccaagcuucagaacguuucagagcuugcucagcacacuguccagauaugaguucaagcugcugaucggggggggguggggggggggccgcauguugugaauaggcgugugugugugugcaugugugugugugugugugugcauuugcaugcgcgcaugaggcugagggugggggccccaggguaccuggacccugcacacugggaggaagagucucugguucagucccuaccuggagcagcguaggaggccaggcgcuguggcgcaggugcuugacaauggagaugugucgucccaggcuccggugcacacugcagcacucgucacaaaccagcacaccucugcugauagaugcccagccagggucugggggaacagaggugggaaguuguuaggggccagaggaaaggcccuaccuccagagcacucaucaggggcuggcacaugcuuagugcuucaggcacauuuacucagucuccucaggagcccagaaguuggccaccagcccuuuccucuaacuccucugggaaugcaggguccccagugcuccucagcggguacagcuuccuaucccacagccacggcgaucagucucacagccucuccucagggauuaauauugccacccagccacuccauagggaggcaggaaccccgaugccacacaucacacaguccuggauaugcuccuguuagaccccaucugacagccugcuccagccucaggccacagucaauguggguuuguggccuucaggacaacgggacuaaccuugucugaguacucagcguuuacagccaaguauucagcccaugauuccuuacaggaagugcuaucuugcucuacagaugaggauuaaacagcucagagaggucaaagggcuugcucaaggucacacagcuaauaaggagugcugcuggaaugcagagccagacaccucacugccagagaccaggccaagccuaaacuugcugcccucugcucccacagccucaggaugagucuggggagccacucucuaguccuuggggugaaaugaacuugggaaacaggaaugggggcucauggauggagcuccuggguccucaggguaggagagaugccaccacaccaagucccucuggaaaggggaggagacaacugcacagggcucaggcuacagaaaggaaaggucaugggggagaaagcggccauugugugcuguccagagugggggcagggagucgcucuuccaggacacucugcucugcccaggcccccacccaggcucaggaagccuuguucugggggauggggcuggcucucugccucgccuuauuagaacucaggaugcucagcaguggaggcucucaggggcuagaguaaucucucccauccauaagacaauucuugggcccuuggagccaacgucaccaucagaguucccagaaucaugagcagacugagucagggcugaacugcugcccauguugggggugucccccaguacaguguggaaaugggaagugaaagcugucuuuggauucgggcuucuuuuggaaucucacaaaacaaggcaaggagggauguacagugaccaccacacaccuucccaggagaugacuuuuaagaacuggggaagagaucagccaccucugccaagagggggagcccuagaguacuuuuguguugguuuuacccaaacaaugagaaccacgccccccuagggcauggaaaacucccuucccccacucccaaacaccacugggucagggggucugccugccagucaccuccugcagcccaggcaggaagcgggaaaugaugcagccuaaauuccucuuguugaagagguaggguuuccugugaguggggagacgcccaggccgggaucagaagcggccaguccugaggccuccacccgaggccuguggcccuguggagaagccaggccuacaggaaccagcuugacauucugggccaguggucccagagccucaagcucuaaagccuuccuggcaccuucucccugcuugagaaggguccuccuuuccccugcugugaccuccaacaggaagggagggcaggggacacugcugaucuuagucacacuggugccagcucaguucuggaugacacagauaggaagucugugucuaacaauucuaccuguacucuagguccaaaugaccuuggcuagccaacggagcugcaaaccccaccuccaccagaucugaaacggaagggccaggaaggguuucuaagaagcuccuugcaaacugggcaggaggguagggaacaugaggccuggggaaggcagugucuuccucuagcugcuccacaggcaggugagggcuagugugaccagguuaucagaagggacaucaggauaagauaacuggugccaaccauaggaaggucucuaaagaaaacucaugccggggcuggugagauggcucaguggguaagagcacccgacugcucuuccgaagguccagaguucaaaucccagcaaccacaugguggcucacaaccaucuguaacgagaucugacgcccucuucuggugugucugaagacagcuacagcaguguacuuacauguaaugaauaaauaaauuaaaaaaaaaaaaaaaaaagaaaacucaugccaccaccaaaagcuacuaggccagcaaagggccagaaggccuggacagaaagcccaggcucaggccucucccccucuaagcuaagggucaagcccuuggaagaggcgagaaaagaaaacugugcuaaaagcaggcaagaggaauccaaggggaaggagguuuccauuggggguguggucagaggugggagcuguagagagcuauggaaauguuauauucacugggcagagugguggccacauaggcuuacauaugccugaaacccacaggauagccacgcaugguagggcaugccuuuagucacagcacucaggaggcagaggcaggugaaucuccagcuuggucuauauaguaagauccugucacaaaaaaaaaaaaaaaaaaaaaaaaagacagaaagacagacuacaggacaaacacucaccuggcuauacagccagcugggcagugcuggugcauaccuuuaaucccagaacucaggaggcagaggcaggugagucagaguucaaggccagucuggucuacagagugaguuucuacagcuaggaccauauagaagagaccuugucuuaaacugcacacccccccucaaacaaaagaccacuaccauauuuguucuuguaagaaggcaaaugagucuguacauugcccugcaacauauuccccagcucuggugacuuacggccuggguaucugaagaucuuuccuccagccuaucagaauguaaggcccgauguaaaggugguggguugggaagugaacguuuguuagccaggccagaguucuugggaccaaggcaaugaggaagaguaggcagaggcaaaguaaggggacaaucacccugugauugugcacccugacuccugcccucuccuggauucccaaggcaggcaggggcacagcaccugguaaggugacacaagcugccacagcagccacauuguguccuugcaacauagucacaccugucucugagcacaggcucaccuccuaccucuaucacacuccaaguuaauaaacuacaaaaccaccaugaccccacuccaugaucucacuccauagcccuggcuggccuggggaucugccugccucucugucucucaagugcuggguuuaaaggcaugugcuaccuaccauacccagacaauaacagaguucuaucacagugacucugugacucugggcuauaaugggauauauauggacuauauuuuaucauaugcaugggauaugagaaggucaggcaugcuuaugcucucuugucugggaugcuauaggccuagaucaaggaugccauugucugucagacccaguguggcacagggcacuccugacaaagaccaacacuuguaccuggggaauggcugccacguggcaaucacuacacuacacacuaggugcuaaggugggauaaugaggaagacugucaacgcucugcccaucugcuuaguaauuugcauucugcaucagagagaggaaaagaaaagaauccugaggcaggccugccucugucacaugaggaugggggcuaugagcucaguggccuaacaucuaacacacccuguuccucccagcaccgacuggguguccagaggcugcagccagccagucacagacucuaucugcuccagaaccaagaauguagacugggaaaugcaaggguccucaaaauccauuucuguuccaccugagacccagagugagcaaagcaucauagaauaagcuggaaacaaagcuacuaccugacccuggcuccccugauggggccugcuaggcuccacagacacaccgcucauccauucaaggccaaccggggaaagggagucgucauuuccagcuaacuagggguauggauguccaucuguaaacggaucuucuaggacccuccaaaccgugacauauccuaaggaggucucagggucagucaccuacaaggugucccauguucaugacucugcaacuacccacaacucccaguacuccaguuuagaucaugagaauuacaggaccaucauuccuugggcucacggucagaucuugggauuuuaaggggugacuacaaguuaugggccugcauaucagcacuccacacucucaccuaaucacaucuucauuacccagaguccauaagaccccgagacuguauggagacacagcuucuuuuauagaggaugggcaaaggccagaacuuccugccuccagccagcugcugagucccaucaacggcuguguccucccagagaagggaccagccuggugaguuguugcccucccuucacuuccucagcaagccaagggggcuuucacagcagcucagaccgacucacucugcugguuaguagggaggaagcaguguguaaguccaguucgcucaggagucagcuggaccaggggagcauaagcaaccucaccgcuuucuccuauccaaugagcuagagaccaggagggaucggcgucuagacugaaccaauaccuagcacaccuucuccaacaggccuacccggaacaggaaaagcugagucuagauguucccagacaccagcaggccuggagaugcuuccggggaagaugcccaugcuuagauuguuccugaacaccgggcccucuaagcagccccagccuugggaagcaggggcggggagucuuaagaguagcugccccugucaggugcucccuaggagcucguauccaggccccuugcccuccaccgcuccggcgggcacgcgggccaugugagcagcaggugcaagacgcggggguggcagggaugacacaaaccauccuagcgcccaccucccacagccugccggccuccgccacagcccuccugccacaccaggcuggcgcuuccgucuggaugccgcgauggaggugggaggcgguucccucccguucaccggcuccaacgcacagcgccccccgcagccggcccucccgccaaggacgccgcuccgcaguggcccccgccccgcccuccggcccggcacagcgcucccgccaggccucggcgcccgcccggcggcggccugcggcgcggucccgcccccgacccgaucccgccgcuuacccggagcgcugcaguccgcacacaccuccgcucgcggccccuuccgggacauccucagcggcgacgcggccgcagcccucugggccagcguggggggcgcgggcggcgggcccgggcggcggcggcggcccugcggcccggcccggcucccgcaaggccccggcgaggcuccgcgcgcgcggccaaccguccgcccccggggcuggcccggaacccgccgugcccgcccgcccgcucgcccucgggcgcccuccgccccgcgccgccccgcgccgccccgcgccgccccgccgccgcucgccgcucuccccgcccccugcgcggcccaggccgcuccugcaggaagcagugaaagcccugcccaccgggggaggggcggcccgcaccccgccccggcgcuccgcucagcuccguggcugagccucucggagaaaggaagccugcgcgcaggcgggaguggacggggguucuuaaaggagccgcggcccgcgcccgccuggucugcaaccgagacacacgcuagcacuuugaccuucacuuuccgauuggggagugguccaggggacgcucggcccaaaaaccgagagacggacgugguggggaucgggguggacaggaagcauucccaggcacaaugcuccuagcggucagaggcuggguuggggugagguguguguucugguccccuguguccaagucaguguguccaggugggucuguggccauaucccugcgguguacacucacuaccaccaauauggacggccaggugcccgagaggucacuuaacugugacucccucucugugggacuaaaaauacaucauucuuguuucaaauaggaaagcaaagaaucugggugauuauuaagaguguugugugcaccaguaauaacuugcuaucuguuucguguacaucaacgauguuuccgggcugcccgacggguguguauguauccuaagcauaugcuuauaacaggagccaauuuuuguaaggauuuuuuuuuucuuggacuucucauggagacggggguggggggagcaaggaacuaaagugcauguugcacgugggugcaccccacacugagcaugcucccccauacacgugugacccguuugugcccagcccccaccccuacagccgcaaaagggcugucagagaacucagcuuauggagagggcaaaagcacacaacaccagguugggggggggggggugaggggcggcggcgcgcucguaggggaaggggcaggucagcgguggcagaguuaagggagauuccuggguguuagggauuccugcucaguaauaaaacggagguuugaggggaguccuugguuaggggugucugagugggucuauuucucccagcaaugccagagcagcagugacuugugggugggcaggcuccuucccuagggggagacaaguaaugcuuaugagucacaccacccaaaauacacgcaaaguuccaucgccuuuugcugcaacccagauugacaaguuuguuugaaauugugauccacaggauauauuuauaaucucaccuuaaaaaaaaaucuugcagacaccccccacccccaaccaguagcucagcagguggggcuucugccagcaaagggugguggucaugccacaccaugcugcacucauacccaagagucuguaggcuugguggccgcagcaauggaggugggaagcagucuagcagcugaaacugggcgcgcagcccaggagcaguggccgcccguucaccccggaucgacccccagcuauggaauuucauuuauuaaaugucgaggcagcugcuggcagccccgucgcuuggcugccuuuguuucuucgcugugugggcgcgucuggagcacguggcagccagggcguugagaccaaagggaaagcgaccugggcuucgugugauagccggccaucuggcaaaagggcaaccuagccucuaaaugcaugcuggccucucuccuuucuuggaauacagggcgugcagaggaagaaugauucacguccccccaccccggccacccuaucucccuauuggcucagggacugccugggagggacccuggcucacacaguccaaacuuuguugcagaacccccaaccucaccacagccaagcuuuagagcuugaagaugggggaagaaggguuucuggcuuccccgaagaugucaucaucccaggaacugaacagcucaaauggaaucauacacaagguuuugaaaacgauuuaaugaggaauuguacaggcauucucgcggccucuccuaguugccccuccuuucucuagcccccuccucaacucgggcugcaaucacgacacucugcugaccccuggcgguggaggugggcugcggcucugggcugcagagacgccuaccggcuccucccaggcugcagaaaggggcgaggcagucuacucaguccucccgggccuggcaccacugggugugcaggaagcaggagagaagaacacacaaagaaacccaagaagggcgcaaggaguuugcaagcuuuugcugucgcuucccacacaaacacucucuagauuguuguucuaaaucggguuggccaggaauuccuuauuucugccuugaggugggcucgaggaaggcaacauguucgcuccuaccaccugucucaggcugguugaaggagagaggggccguuuucaggcaguucauacccuuagcucaucccaugagguaguaucugaucccaguuuagaggugagugggccgagaaacucugaaggauaagcaauuuguuuaagaucaagcaauuguuacgguauuuaaauacaacucucuugacauuuucucucccaaggcaucuugguccuuuuaccauuugcagguggccgccacagaggccaauuugacuuugaccacacucucugcaagggcuccuuguggaagcgcuugucucucugcucuuucaggaagcaggcaaucuggacucagucauuuuccuuaggcagggacccacaugggauggagguggggaaaugccaccugcugcugucuuugcucaaccucauccugguucuugcugagccauguaggggaaagacugucuucuucgccucauuagacauucucuuuuccaacgugauguguggaagcugggguuuaauuuucugagagagcaaagauuugagaaauauuucgauucucagaccccuggcugcuucagugacccuugguacugaugcccugcaucucucuuagggucacucuuuagucacuaugaaucuagaugccucuuuacccucccugggacccaagcucacuucugcaggccauagacccccgacccaacgcuucaggucagcccuaaaagccucccccauuuccuugcaaaaggcaaaaugccaaaggguggaggcgcccccaacccacuuggcauccaaguaaggccuccgcuucggccggguuugacucucuguccacccuuccaggaaaucaguuccagaccaucucuggucauccgaaacgcacgguucuaccaggcggacuacaagccccaugaugcugcggggccaagcuguaacuaacccagcacggcgcacccggguccccuccucucuuccccgcauucgcuugucccucaccguccgcucgggcugagggccgggcuaugcggcuuaggggagccggagggugcgggcgcgcgucccugcggcggcggcggcggcggcgaccccggggccggcgccccgagcgcccccgcuccagcugcgggucccugcucccuccgccgagaggcgucuuugugugcgggggugugggaggggaggcgcgaggccgcgugccgccgagugcccgcucccucccagggcgggugggggcugcuccgcgccucccgccgccgccucccgaggacgcccgccgcccgcaccacgccgggcgcgccgcccccgcccgccgccgccgccgccgcucgcacaugcccgagccgcagccccgcgagcagacagcuccggccguccgccccgcggccccgggcccgggcucccgcgccgucccuccccgcgggccgggcgccgcggccccggcaugaggagcgggcgaugauccccgccaacgccuccgccaggaaggggcccgagggcaaguacccgcugcacuaccucguguggcacaaccgccaccgggagcuggagaaggagguccgcgccggccagguaggagcgccgucggggaccauggccccgcacgcccgcgcggcguggggagggggcgcggcgccgccugu

SEQ ID NO: 6190 - RNA, 7884 nt, Mus musculus
cucgcgacagcguagcacuggcgagaugcaggcggcgccagucacauagcuggaggagccacacucccccaaguaggacagcagcagcgcggacccugaacccucgcucaccgcgaacaggggggccgccgggugucggaagcgaauguaagucaccgccuccuugaggucggacggguccccgaaaggcuguagucuggggcugacuagcgggcaaccgugguggccgcggcgauggaagaugaccggguaguagccgcgcuccagggcgagcaggcagagccccaguacauugcgagugaggcguccccaugcauuggggauuaccaacagcacuggagggaggcucccaggguuggugacccggcggccccuggcacaagguccuaugacccaauccagagccaccagcccaucaucugccagcugcagguacucacgggcuagcucaggcccgggcccgacuggcaggaugaaguggcagaagguuugcagguggggucccgacagccaggagcgggggcuggguuccagcgccgccgagcgucgcagagcgcgcagcaggcacugggccagcgccgacggcuugcaaaugaggcugcagccuccggggagcgcuucgcgccggucgcugaacugauccgcggggccuccgcucgccaccuccugcuccucguggucccggacugagguucgcgcuccgacagcgcgcuuccagggucgcaggaggagcaaggcgagcgccgccaguagcagcgcuagagcggccgcccacggaggcauggccuggcaggacaguccccggagggaggcacugggcugcggggagcggagcuguccucucgucgggcuccucguucuguccgcgcggcuccgcccggccgcccguggcugucaagaguccucccaagcaggagggcgcgcgcgcuccggauuggucguggucaggaggagacagccaguucgggucgagcuccccucgcccgcccccccacucccgcccccagcccuuuguacagcgauugcgacaagcuggagcagagggugaaagagagccgggccacaaagcgggagcgaggaccugagggccaaccagagagagcggaacaaggagugcuaggaaaggauuggggagggggugaggcuggaggccugggugaacgggaggugccugcuucuacccuugcccucaaugaagucuggcuccaggggagacccugggucacugcacccucaggauccgcuauugaggaguagcaaaaaagcaagaagggagcaaagcgcugaucccucgcuggcuucacuuuccccacucgcugcugccuuugcagcuagagacguguuaucucucucuccuucgccuggcccugccgcccagccaggaccagcaacugggcgauaacucaguagggcugggacucugcaccuggccagaggcagacugaagcaucugacccugaccacgaguuugagggagguggcugucguuucucuggagggcauccgggcacuagccgguagacacuuguggccuucccagcccacccccaaggacgcuuuccaagaguuaggcgucuccacuacuuaucaagaaggacuguaggaaaggaaagaggcucgagucuggccgaauauguugagggagaggauuaagggaugcuuagccccgcgguggggcuuugguagagagaagugugguucuuuaggucagaucaacaucuggucauuucugcaggggugggugaaauaaguccgggcacaugggagaggccugaaauaacuauuuuuugauguauuucaaaccuaaaaagauuuguuuagggguguguguaugugugugugucuaggucagaggacaaucugugggaaucaggucccuccuucaaucacuuagguccacagauuaaacucuggucgucaggcuggcggccagcaccguuucccacugagccaucucgcaggccuguuucaaacuuuugauugggcgucaauccuuagcuggauuuccuuugcagcgcucccuugcaagggaggccgagcugagcacuguagcuccucggaccaguguuuccuugggcaaaggagagcgggaaucaagaaagcucuggcuucuuaaggcuucugggccuaagacccucccaaaacagcucggggcucaguucuuauuauuagcgagagcaggacuggagcaacgugaaggugaagcgcuagagccgggaccuucucucugggacagcuaggauuucauaauuccguguugagcggguuugccaaaagagcacacaagucuccaccugggucacccgguccuuaaggaucucacuuccugcccuuugcgggguuccaagauucuacucaggcgauacaguugcgcucugauggucgcacaaacgcuccgggacgcaucucggccgagggaggugguuccaugggcuuggagaccaggagauccuuggcgacuaacuuuuccggcuuuggguucaggacgcgugcgccggccuggaggcgggcaggggcgggccuggcgguaggcggggcggggcgggggcgggccuggcgguaggcgaggcggggcggggcgggggcgggccuggcgguagggggggcggggcacgaggccgggcgaggagggagcaaggcagugcgcgagccgcggucuacgugggcgcgcgagcggcgcggggucgcgggcgcgcgcgagcgaguggcgcugcagcuaguugguuggcgggacugcuggcccagcugaaaugguucauccuccuccaccuccgccccgguugcuucugguagcccugguggggcuccugagccuucgcgagguaaggcgaccggcuccggguaaggucuuggccgggggaaucucaaagcgcuuugcuucaacuuuguccuggaaagaguggcgcgcgcgaggggauucggaggccccuccauccguccgcgccucuacuccuagaaccgaaagggcggggcccucgcagaggccaacgcccagcucuucgccuuggacccacaggugguggcugagccggcggaggaggcaggaaccccuuguccugaaggccuguggccugugccuccacagguaggaacccuguagggccgaggacgagaaggguuugaacggccucgcugcacccucgguggucgcccgauugggacaucugugguuucuccugcccucagucuccagcgucuucaucucagcccagggcuuggggcugguuguccccuucuucacacccaacacgaaguccccagcugcucucuucuuuucucauguguagguguuaccaagagugacuuacacacaggugagccaaggacagguaaguacaaccaguagcccaucuugggagccuucccuggaggcagacugugccucgcagguuaccucuaucuaucuuggcucucaguccauuccuuaccacuuuguguagaaagaggugaggcuuccacuugccagucccagggcagauggguaguguggggucagggguucuguugaguagcuagaugcauggcaaguaacuccaaguuacucugaagguagcaaaaacaaccuauaucccaaugcuggugugauuuggauucucuugucuuucuuggcucugauuuucuucugcaagagauggcauucugucccuucagcuuugagaagugagugaauagugcuuggauugcaaaacacuauaucauguuagcaaugugugcuuuaauguguuguaaacaguucaauuuuuaaugaaugcucuuuuuaaaaauuguuuauauuuauuuuauggguaugaauuuugccugugggguauuuuuuguuguuguuguuuuuaacuuugguuaguuuugguuuuuugauuuuuuuuuuuaagauagcacuucuucauguagcauugacugucuuggaacucacucuacauacacuacaguagaccuggcuggccuugaacucacagacauccacuugccuuugccuccagaguacugggauuaaaacccugugccacugccugaggccuguguguuuguauauucagaagagauggaucuggagauauagguugugagcugucauuugaguacugggaacugagccucuggaagaggagcaaaagcucuuaaccacugagcugugucuccagcccuccaccucucucugacacagggucucauguagcccaaacugguuucaaccuucuucuauagccaagaauggucuuauuuauuuuauuuuauuuuuacuguguuccuuuuuuuuuuuuuaagauuuauuuaucauuauauguaaguacacuguaguguauguaagacacuccagaagagggugucagaucucauuaccaccaugugguugcugggauugagcucuuaaccgcugagccaucucuccagcccccuccaagaauggccuuaaagcucugaucuuccugcccguugaagggcuaggauuacagcagguacaccaccggacguggcugucucuuuguugcauguaauccuucuguuuaaguuauuucauuguucagaauccaucugacuuuaugacuuauuuauuuuuaguuauguuuacaauccaccuguuauggcugauuuccccugucugacuuaagacuugcauuaucuucaucugauuucuugauucguuuuucuccagcaucacaggcccucaccacacaugugaauccaggcucauuuccucugagauaccuaccuucuuuucucugguuucuuuucuuuucuuuucuuuucuuuucuuuuuaaagauuuacuuauuuauuauauguaaguacacuguaguugucuucagacacaccagaagagggugucagaucucauuacggaugguugugagccaccaugugguugcugggauuugaacucgggaccuuuggaagagcagucagugcucuuaaccgcugagccaucucaccagcccucugguuuauuuucuacucccagccuaucaggaucugaaacccacagcuucacacccuggcccagcagaagucacagcaucccuuucccucauacuuugucugccuuuaucccauccucuuaccguuaacugagcugucuggacaugguggcguagacuuuuauacucugagcuacucgggaggcugaggcaggaggcauaaauaugaacucaaggccagccuggacaauguugugagacugacuaaaacuuaaggggggaaaagugaaacgacaguugaggaucgagcuugcugguagaguguuuguguggguucagaucccuagaacuuccaccuccacuccccagaucuccccagcccaucucucuuucucucuucucucucucucacucacucacacacacacacacacacacacacacacacacacacacacacaccccgguuugaguuguaucaguuuuuuacuucccugaauuucucucccccuacuccauggccguuagaggugggcucaccuagccuaagcuagccugguauuuacuguguacccuggucuggccuugaacuuucaaucuuuuguuccaaauggcugggaucccagguguacaugaucacaccuagcuuuccuugagucucuuauacauuuccucaaggccugggaguucucuuuuggugucuuuuauagcacccagcacaggucaacucagaauaauguccgacgaaaugcuccuacccugggaucgugcagucaagugugucuggacacuccugggagagcgcgaggauuagauggagaaguagaagacuuggucuuuaucugagggccagggcugggacuuguagagccauugaugcauacacaguccgagauacagcggaagccuccucauucucacugggcuggagauacagcucagugguuaagagcuuccgcugcucuuccagcgucuguucccaguacucacgugacagcucacaaccuauaccuccagaugcaggggucugagggccagggacacgggucagugcgauccccagcaccgugugugggggcuagggagcaugucuggagucuaaugggguuacagccauguggucuugcccagaggugcaucuuuggggggggggggugugcacuugauggagaagagaagugaauuagaaaggauuacaucucaguacucaagacccuuugccuuuuccuggaaguggaugggcacuuucugguaaccuccuuauccuggcaccuaggauaggaaacgcugugauucucugggagggugcugggccuggcuugauaucucugccuuuccuccaggcugaggguaucgccuucuucuaccaccccugugcccaccccuggcugaagcuccagcuugcacucuuggcccaccuguauguggcuaagcccacgcucauuccugacuucagucucacgugggaccggguaagugguuagugaaagaugugcuaaaagaaaaagaaauuaaaaaugucaaaacaaaacaaacccaaaacaaacaacaaaaaaccugggcuugguggcuaccaucuuuaaucaaguacucuagaggcaaaagcaggcagauuucugagcuugaggccauccuggucuacauauugaauucuagaacagugagaaccugucucuuccucuuccccccacccccaaacuaggguguugugcuacggaagagcgaggcacuaugggcagaggaaggaaaacucagggucuucuuccaucuuagcucuacgucaccuucuuucauagcccuuggugcugacagcaugggggacugcacuggagcuggcauggauagagccagccuggguugcccacuggcugaagaggcagcggcggcggaagcagagaaagagugugugguuucucucugacaaucuuuuugggcccacucccacgaugccagccuccagaagagggaagcugugugggagacgguguguacaggugaggggugcugggaccaggcuugcuggcaagaauauuggguuaauagagaguaggggcugaguccuuuucuauucuccuuaggccccgacucuggccuuugcucuacggagcuggcgaccuccuggugcacaggugacaucuagaggauccgggcgguccucgaucaguguugugaagagaaggggucuccgggcugcccuuggucuccaauccacgcccccaggccugaggguuuccuuggccucuucacagagccugaaggcccagcaguugacuuugggaaccucaucuguggccccggucuccuuaacgacugggggaccuggaggcaaugguagguccaggacagaggcucagaugcccagugggcaaggcaaccauggagguugugccuguccgggucagguuuccccagcuccucgggccgcagggccuccccggguagcccgagggcccacuccacguacugaagaggcggcuugggcugccauggcccugaccuuccuacuaguccugcucaccuuggccacacuuugcacgcgacugcaccggaauuuccgcaggagcgagaguaucuauugggggcccacggcagacagccaggacaccguggcuggugagaagagccccccucccccuuucuggugcgcccaauggcuggaauuccuugcccuugacuucucaccuucccacagcucuccugaaacggaggcugccuuugccuucgcgccggaucaagcggucucgcagacggccccugcucccacccacaccggauaguggcccugauucggagagcuccgacugagcggcuccgccccucugcgaccgcugccacgugggccguccgcgggcgcccccuggcggcgggccgagaggcccuggaggcuucaccugguuccuggaagaguagccuuguagcuuuccugauacaaauuccuguuucuaauuaaauuauuuuaguagaauucggag

SEQ ID NO: 6191 - RNA, 6688 nt, Mus musculus
auuugaauccguuuccaagguacuuuuuuuuaaaugacauuuauuguggauuuuagcgcuaacauuuggaagcagugucugggcagaacaugaaauucuagagugcuuagcaagaugucaugcuugagggauuuuuggaacuuuugcucuauuguuguauucggcgaauugauuggaucugggaagucugggcgugagauccccacucuggccagugcuuguagucuccuccaugguggucacacuccaagauauacugauaaccacgauauccaggguacugguagcaaacccagcuagaaaauucaaagcauauuuuguuauuaaaucugguaaguacauaaccccccgccccaaaaccugaguacuuuuuuucucaacaucaagucauuaguaaguuagguuccaacugauuaaagauuagccuuaugaaaaauuaaaggggacuggagagguggcucugugagugcuagcugcacuuccagagguccugaguucaauacccaguaacuauaugguggcucacaaccaucuguaaugugauucgauguucucuuguguaucugaagacagcuacaguguacucauagacauaauaaauaaaggugucaguaacugcuucuacaaagauaaccauuugaggaaaauagagcaaguuguagcugaagcaaagcauucuagaucaguacuaauaugccagucuaugauaucuaguaaagcaucucauaucuuaauguuugcaagucuuagaaauguguuucauccuuguuuuuguacuuacgccccacauuguaucuucauggaaccaacuucauuguugaaccaacccauggcuugcaaggaaggguagucaucacagauuucccacuggcguccaauaaaguucucuuucucgaagaugguaaucuuagacucuuuaugauucuauaauacauaaguuuaaagacuuugcuaguauaguuauucuaacuuaacaaauuaguacuauacuaauuuuuuggcauaacaucauuguugagcuuaacagggauuuuauaagagaaaauccagcuggguuguuaugguguacauguuuagucccagcaaagauagacguuuugaguuggaaauauagaacuaaauuuagggaagaaucauaagauagaauauuuggugaguaucuagcccaggcaagugccauuccaaaacucagaaccauuuuaaacucacaucaaaugguugguuuguuucugcuuaagcauuuuuauucaaaauuugcuggguacgcuagacuggccucauguucaagagugccuuuuaaauuuccugggugcuagaauuacaaguauauacuaccauguccagcucucacagacuaaaugcagccucuuggaggcuucuauuuccaacuggggucaccauguuggaggaggaauguggagauuugguauugaaaaggguaguucugcaaaccuuacuccugaauuaaaauauuuacuuguuuauggauaauuggcugugaucugccguugauguucuuagauccaaauuccugccacuaugcuuucuuguuugccuugcuccagagucagauccagauccacagcuccagauucagucuacugaaaacagucugaagccaugagcuggaacauaaauguccuuuaagucaguuacucucucucucucucucucucucucuuuuuuuuuuuuuuuuuuuuuugagacaggguuucucuguauagcccuggcuguccuggaacuuacucuguagaccaggcuggccucgaacucagaaauccaccugccucugccucccaagugcugggauuaaaggcguaugccaccauugcccggcucuaaauagguacucuugucaacaacgaguaaauggcaauacaaaaaaaaaauuuuuuuccuccagccccacuaggguuuuucaaaauuagaaaaacggaccaaguuuggccaguucaguuguauccuaaacaagagcuuaaucgaaaacuggauauuauuaaguaaaagaaaugaauugcucccuaaauuucaggaagaaauuacuuauuuuaaagauuuuauuuuaauauaugaguacacuguaguugucuucagacauacuagaagagggcacgggauugugagccaccauguggaugcugggaauugagcucaggaccucuggaagagcagccagugcuuccuguuacauucaacauaauugacagaagcaacacaaauaccugucugaccucauccuuuacccugccccaauugaagaaaaguggauauuucagacucacagcggaacagaugggucggaaggacaugagacgcucaauaugauaggcauugcucccgcuccaggcaucccaucgaggguauucuccucuuuccaggaugaacuguugcccacagaagcugguguguucauaaccaauccagcugccaaaaauaggucauuguuguucaugguacucaaaaccuauauggccuaagggagaagaccucuuuucuuucagguaaguuuauagugagguaaaauaucaagccaaucacuaguguacacucaugaacagguuuuaaaauguauuuugaaaguaaccacugaagauaguggccccuaguaauguguauuaacaaagcucuguuuccauuuuagugaucucugccuaucuggggacugacgaccuagucaccaguucuuuggcucuagagcuuguaagccucuuccuaagagcaguagcaugauggguuggguaucucuacuuuuuaaaaaaagaucuccuuuaaucccagcacuugggaggcagaggcaggcggauuucugauuucgaggccagccuggucuauaagugaguuccaggacagccaggacuauacagagaaacccugucucggaaaaaaaaacaacaacaacaacaacaacaaaagauuuauuguguguucaguguucugccuguauguauguuugcauaccagaagagggcaccagaucucauuauagaugguuuugagccaucaugugguuggugagaacugaauucaagaccucuggaagaacagacuguacucucaaccucugagccaccuauccagucccucuccuuguuuacuuacuuugaagguucuuccuauugcuguucauauuucaccuucuuaauggagcauccuacguuguuaacaacuuaguuuuauuugaagcuauuuguuguuuguuuguuuugguuuuuuucaagacaggguuucucuguguagccuuggcuguccuggaacucgcucuguagaccaggcuggccucgaacucugagauccgccugccucugccucccaagugcugggauuaaagccaugugcaaucuuuauuuugguacagagcagcuuguggaagcucgaucacgugcaaacccacuucugcauaggacaacaagaauacuaguguggguuuacacuuggggucaaccugccaaaaaucagaagacaaaagccaaagaauaucaccaagauugacuaucaacaauaaauuucuggaacacugagaacuaauaugucucuggauucuugagguuuuguuccuuuuaauagagcagcgguggugcauaccuucaauugcagcacuugggaggcagaagcaggaggaucuaugcauuugaggccagccuggucuacagagagaguuccaagacagccaggguuacacagagaaacccugucuugaaaagaaaaaaauauauauuucccccuuucccuauuuuauaugggcaagaaaaacagguaaccuaugaacuucagaacacauauacaauuacuguccuaccccauugcaagucuacuaccaagaugugaacaucuagcuuugaguuacuuaauucagcauguagugauugccuuuagaagaauaagacaccucuaagaaaugauugucaucuggggaacaucuuccuagauccuuacucacaugguacuaugucuaaagagaucuaucugaaaagguccugaagcucuguuggugcucauacucacgcgccacacuccaccuuaagugaccggacauuaucaaaauuacguucagagacauuugggcaggagcuggugaacuccauccucuugcccuggaaguucucuugaucguagaugguuaucugaauggaguugaaugggacaaggaagagaaccagguaaagcauugagaauaggggugcaaguuaagaacaaacuucauccugugguuuucauaacuagcuacaacccaggaugccugauaaggucucuuccagugaagacagggcaaaaaagggguucaaagugguaccacugcccagugacauuaacauguucaggcuaaguuuaugauagaaaugguguuccagggacaaugcagagcucaauagaucaaggccgugugaacucugauuccaccauguguccugcacccaugugacccagagaucaggauucugggacuuugagaagcacccuguggauuuuuuuuucuuugcuucuaaggcacuaaaggaggauugugauaauuuuuucauccuuucaacuagaaccuagcuccugaucuggcaagcuccccaaacugugaacuuguuucagaguugacaacugaggaaaggauuaaguguuaggggaauagugaaagacccagcucaugacuaaauccaacaucagguugagguagguccugcaucucauggcucuugggagacauaauggcaaauuagaauugaccuaggaaacaagcauccaucucccaacugacauagaccuccaggaaagccaccuuucaacaaugucuagaugucagauuggcccuuccuccuacagaacaguuuugcuuugcuuuguuuuuggguggggacugucucaagaauaagugcagccugguaguuacuaugugccagcaccgcagcccugccccgcuggauucuuccauuuuucaugccguuggcucagcuuaccuuccauggccccaaggauccuggcauaggguuggucugagccaucuuggugguuggaagaguuucuggaagagaggauacauaucagugaugugauuuucaggaugggaguaaugagguguaagguguaggaaaaaggaacggaggcuuacagucccagauuuugguugagauccuggcucuggggcuacuaccaaaaccucagguuuucuaucaacaaaccuuuuacauauagacacuguaaaaauuagaaaaguaauacagguaaaagacugcaaaagcauuugguacucuuguuaaauauuccuucuguccucuugcuugccuucagagaacauugccugggccucacaauaucaacuuccuaacaacugucuagacucaucauguaucuagucauucagucgggagggccagaauuccccaccucaccugccacucauuaaacugcaguccaaccuucuugucuucucagcacccaaacuaaccuauccugcaugcccaugccacugucuccucucucauagaccuagauguuuugaccuugcugccucacgacuccuuugccuuuuuccaaccugcagagucugacuucucccucacucuucagcacuuacagugcucaucuaugucacuacugaguguacacugugucaguaucuccauagcagaaauuccugugugacugauacagcaccaugccaaagcugugggaagaugaggcauagaguaauuugaaauuaaugccugcuauuugaaauaguaggaggauugcaaguucaagaccgaguuggacuacacuuagacucugucucaaaucaauaaguaagggcuauugaguuccaggcuagcuaggguuucauaggaaaacuuagucuuaaagagggagcgggagauguggcugggaauacagcucaguacuagagugcuugcccagcaugcguaugaacucuuagauucaauuccuaguacugugugugaagaagaaaggguaauuauaaaaauauaauggcuugggcuggguguggugguguacggcuguaaucccagcauuugggaggcagaggcaggcggauuucugaguucgaggccagccuggucuacagaguaaguuucaaacagccagggcuacgcugagaaauccugucuugaaaagccaaaacaaaacaaaagagccaauggcuuauuugaugucagucccugcuuuacuugaauaauguaucuaguccucacaagucaaauaccaucacuaucccauuucaugaacgaggaccaaagaccguagaaguuaagcaguauaugaugaggagaaggaugggugaaggaaagggaaggggaaagaagacuggcacguguauaucagguuucuagacccagaaccaacacugaggauucuacucuggcauccagcccaggagcuaaugcaugaaaaucuggauauuuccauagcaacggagccuccaaauaagcaucuccuccuugccacgcccgcccugugcccugcgaccugcugacuccuagucuccauugcuaaaaauguaguuacugccacaggcaacuacuuaagguagcaaaugaagcugucccccacuuucucuaccuucaaauauucuaaccucuaaaugggacacaacugguuuuuccucugcaucugucuaucgaggaaaggaaagauaaaggcgccgucaagaccuuacucacccaacucccgcugcacagucugggucuccaucuggugcagcuuc

SEQ ID NO: 6192 - RNA, 2293 nt, Mus musculus
ggagauuuagguuacaagggagccuacaauguccgguccaggagacccuaguggaaugugccuaucuggcugucugcaggucucugagggguuggaaugcggccugggcugcaggcuuccucuucccuccugcuguuuucccuaggcugccuccgugcuggaaugucggcagccugggaagguucuugguaaggaccucuuccagucucagcaacaaauuccagcuggggccuggggacagcucccacauggguacggaggcccccagagagggcaacaggagcaccaggccugugggaacugcuauacucuuggaucucaggcugguagacuuucagcccugacaagccgaucuggagaucucuccuucccuuggccaggucccgaggaaccugaacugaagaagucaggaguggaaagaggaagccagaggagagaggaggcuggcccuuucccacaaggccuugccuuguccagcccugacaugaaacaggaaggggaguagccucagauuccauccucagguggggccugccuaccagcaccagguucucugucccacugcccccccucacagcaggaggugacucuccugaguuugucaaccauaucugucugcucaacauuuccagggccugguuccuuucuuggugaccuuugcagcuccugugcccuuuguccccugaucucauuucuucucccucccauucccauuucuguaaggagcugacucacuuccuccucuaacgccacuucacugccaggcccuguggcaaacaggguguauguggggagggagaucucacccaggccacagcagugggucuuggaggccauccuaggcgcuggaggaggggguggggaggagagauggcugcaggccacagggaaccccccagccauugugcagucuggacaggcgucagggagcaccugcuugggccacacuguguuuggggaggagacugacaguccuaugaggaaggaggccgugcuuucaguagaacuauaggcucccauagaaagcuagcucucagcccuggguggcaugggcuagaggccaaguggugacagcacugucaggcagcuugagaacgucaugacccuuugugacacccagucucaugcacagacccaucacauugaauggacaguauuuggagguuuaaauagaaccuucuagaggcccagcaagaaacaaagguuugauauugucuccuguguagguucuugccgguggagcgcugccuccugccucccucuuuaaugaacuggcuugauuguagaauugacggcagaagcccagucccggcuggcguugucuucugccucgcucccuugggcucuccaggcuguaacagccuaaagcucaacacuccaggcucuggaggggacccagcucaugcggagccuggcauacauagccuuucauccuucugagaagaugccucaguuaccuagggugaacacaggcggggaccaaguccccacucauuugggcauguauugagguuaaaaagaaaagaaguaaccgggcgugguggcgcaugccuuuaaucccagcacucgggaggcagaggcagguggauuucugaguuugaggccagccugguuuacaaagugaguuccaggacagccagggcuauauagagaaacccugucucgaaaaaccaaaaaaagaaaagaaaagaaaagaagagaaaagaagagaaaagaagugggaauuggaaagauggcucaguggguaaacggauagaggacuuuaguuuugaucaguguaaguacauaaaaagccacauguauagcauaugccuauaauucuaacccugggaggcacagacaggaggaucauggagucuuagcacuagccagccagacuaacuccucagcgagcaccaguuucagugauaaacccugaugaaaagaagaacugggcuggagagcuggcucagcggugaagagguuacagcucuugcagaggaccugggcuugguuucuagcaucucacacaagcuuacaaccacuguaaccccaauuccaggagaccuagugcccuccuccggccuccaugagcagcaggcacacauguagugcacauacaaauguggagacaaaacacaaauacacaugaaauuaaaacaaaauaaaucuuuaaaaaaauuuuauaaaagaaauaaaaggcagaaaaaugauagaggaagaugccucacgccagccucuggccugcacacacaggcaaacacauacacacacaaacgugcauacaccacacauacaugcagagaguaaggag

SEQ ID NO: 6193 - RNA, 17164 nt, Mus musculus
uaaaaaaaauuuaauauggcaauaaaauaaaaugagagaccugcuggagaagaccuaugaagaacagcaagcccuaagacucugagacaguguaaaaaucuacgcagcggcuacaguuuccgaucugcucccgauucacucccauagugacggucucuuucucaccaggcaagggauugaggcuucuucugcccuggaggaaaugaggaagggucuaaaauaagccagacugcggucuggaaauaacuuuaugcuaauuugcagcccagccuugggaagggcuucccugagcccauuuccauucgcuuucaaaggacuuuccaucuucuuugguuuuccaguauauuccucaaggcuaccugcugcugucaaggucccugggaggaaaggcugagaccaaaggcccuuguccaaagggccuuuguuugaagucagccuguaagaucucagcuccaaguuuccucagugcuaggccucagccucaggcagcagugcccgcucuguccagagccucugcaccuuuggucccugauuggugaaaugagaggauucagcccugcccuguacacagguuguaagauacagaugauggugaugggcugccuuucucggcuauacuacugggauagccuuguuggaccacagaguccccaggcuggcaugaccuauagcaucuaauuaggggggagacagggauucucacagcagguugguccuugggccuguagagucaccaucuuauuaacugacagcagauacuuuaugucccacuugacaguuauagugacuuagggucucauuauguagcucuggguggacuugaacucaagaucagcauguggacuuguacuacucugcuuggcugcuggcaguuauuuuuagcuguuggguuuucuuuguggccuuguucguuuguuguuaugaaacagagugucuuguagccaaggcuagccuugaaauucuugccucuccugccuccaccucccaggcgauggcagaggcuugcaccgcuaugccuggauccugacagcuauuuucaaucagcucuguugagagaauuaaguaagacaugagcgucugcgugaggacacgggcaguccaccagcugggugaaguauucauucucuccccuggaaaccuucccuccccacauacaccugccagucacaucuuccuaaaccucuccaucuucccgaauuguaaccgcguuccugagugacacauagcuuccccaggcuggguuccuuuauggaacaguguaugccugcguccuuuuauaccacguagauccuccagaacaauuuacugcaugaauacacgaaugccauuuguauagccaugaucuuugucauucucacuggccgccucuugcuccuggcuccugggcugccagagcccacuccaugcugacccaggagagguggaagcagacagauuugaaagaggcggugugguagggugagaggguggaccaggcuguggccguggcuuuugaaaucuguuucuucaucucuccauggucauuacggaaggucagauuggaaacucaaaugugcccagagcccaggaaacagugcagguggggcaggcggccgcuggaaagagccagcacauuccuugaauggcuuugcccuucggugacccaaaggucacugccaauugaccaugggucaagugugucaagagucucugauuuuucaagagaagccauaaaucuuagcuuuuaugugaagucuccugaacaggucaaacucagauugauagcagguccucaguucccggacaccagcaucuucugaucuucauguucucagaccacgaucagcucagcugggacagaaacaaagguuucccauuuggagaauuaaccuuugaucguuuuuguuguuguuuuguuuuguugagacagguuccuccuauaucccaggcuggccucacacucuguuguuuagccagaggaugaucuugaucccccuuggcucccaccuccaagguccugauccaccaaaaugugauccaccaagcccauuuuguuguuguuguuguuagguuggagcuaaaacacgggccuuucugcaugguuuggaagcauucugagcccugggaauaaacagccuuuuacauggaaggacacaaaaucuuggcggcuggucuucuggcaagugccacccugacccccaaaacugaagauuuagggaaacaccaguguccugauagcagauuuccuccacccuccacuccucauugggcagaaauuagggugcagaggggacaaugggccaguaugguaugcaggcccucugcgcagucuucccugacaagacaccaggaccugaaggccacucccauaccucacauugccccugugcaggacacccaccaguggugacacggcaaucacccauaaauucuugucagagaagcugucaggacuugggaaauaaauaaugauauuuaacauuuuguaauaacaacaauuaaccaguaaauaauguccuuuaaacugcaaacgcuggaguaaauuaauucuucuaaugagcugucaggcagggaagaaaaaaaguaccgguguucuuuggugccacgcggcugccgugugagcagccgggggaagcucaccucgggcccugggagcucauuaccgggaagcacgcggcaacggauugcggggaagcagcccggucucucucgcucccacgugggcgccaggccgcagcccccuccgcaccgcgccgcucuccugcagagcaucccgccaggugccgguccugagcccgcaaugcauuucaauuagagacgcccccucuucccuuccucccuucuggucaccugggcagcgcugggguggcggggagguaggggggucgugguagggaggcaggaguugggacuugcuagggagagaagcucuaguccuugcugcgugaccuuggggagguuuccagcccucucuggacugagauguuguaaauggcaacaucugaagcuaaucaaaccagcugugauuacuucuguaacccugagaagccugugaccauaaaaagacaccugaguaaggcacucuuuauguacugauucccagucgucuccgagauauacugucaggugacaaaagcaagaaacaggagcgugugcugcgacugcuaaggagcggccauggaucccucuuugcugacugcacacccagacaggaaaaggguaacaccacaggccacugaggagggaagcucuaugcccuuauuuucaaagccaugugcagaaauuaccuauucaaacaaacaaacaaaaagcaaggaaggaaggagggagggagaaagagagaggagaaaguuacaaaagacaaagccgauuaucagaggucuucuugccucucuguggcuuucaggauguaaaagucaccuggggcccugcugaacugugaccccaccaggaccuccacggaagccaauacauuguaucucccaauauccuauccugaacaugggcuaaugaggaagucccucccaggggcuaagccuguucccuccagcuucaauuucaguuucucuccuccuguucuguauuggguagaugaaaggguugcuacaugauuucagcagaaaagggcuggggagcaaagagaagggaggggaugggagaggaggguaaggaaagcccuagcccucagaaagcucgaaagcccaaggcuccauacuugcaugguucacaucacucugcauugcugggucucccucaggagccagcucagucaguggcccccacaccaggguggacagaagccccccuccacgauuggagaccuccuagcuaccagagcugcaccucccagcauugacacccacccagagcagaagaguguguaaucucccugucaccagggugucuucagccauugcgcaguaccacagacauacucuaaauccacagcagacugagcuggcugcccauugcuggaauuggaaagcacgcacguacgcucagaggcugcgcccgaugggcugcuuuggggcugggguucugaagacaccaaguagaaggcccagccuccauaaccaucuaauccccacucuuuugcuuuuguggccuugccuuucucagugaggugaauccugacucaaggcuuucuugccagggccuugugcaaagaaagaucuggaauucaaguuacccaguaaguucaaaaccugccugggucacacaaagugaguucaaggucagccuaggacaauuagugaaacccugucuaaaaaaaaaaaaauguuuuaagugcaaaugggggcaccgaggagauggcuuauggguaaagugauagcuauucacaaaugaaaaccugacuuuggauccccaacauucccugaaaagucugguacaacagaccaccuauaauggcaacacuggaagagacaaggcagaguuugaggcugacaagcaacuagucuagccaaucagugagacuccgggacucaaaugcaagauggagaacaauaaaagauaccuuagcacaaagucuaccuacuucccuccacccccaacccaacgccaaagaaacacccgcacacaaagggcuaagaggcuaaguauauaacucagcgcucagugaggaggagucuacuaaauacuggggaggcccuggguucaaaccuugcuacuauuaagagaaaaaugaaguuugagguagccugggcuacuuagcaaagacccuuugcuucucaaaaccucaagagcaguaggguugguggugcaagccuuuuaaucccagcacuccugaggcagacacaaauagagagcucuaugaguucaugaguucaaggucagccaggguugugagacagguaguaagcuugucucaaacaaaacaaaaggagaacaaagaauguugcucaguaguaguacauacaguacuugccuagcacaugcgagauccuaaguaggguuugauccuaagcaccccaaaaaagauguggguuaaacagccgaguguccagguacaguaagcacccccaaaucggugcgucuaucuuggcgaccuuucacucugcuagauaaacccgguuuccaagacugagugaggucacugugcuggcuccugaguaggcagucuaccucugcagugccucuuugggaagcggcccagaagagccuccaggcuugguuuggcuuuuuuugcagcgggcagcagaaacuggagcugaagccggugcaaaacaaaguucccggcuuuggaucugagucagcugcuucugagccugggggcucaaaaguaucaaaaucguaacuaccucaaggucgccuggaccgcucugcagcugaccccuccccuucgccugagccuuccacaggccuccagcaccugagaguggagcaccagcuggaagggagggaugccccugugugcacaggaaacugagccucagccacacggaaauuaaaaccagcuugcccagcgcugagcuaccaccucgcuugaaaucagauugauuucuugggcuuguugugacggcaguguugcgauugauucgucuggguggcggggaguuuaucaauucgaagcugucugucauugaucuggauaagcuucugagacagcccaaacaccuagcaaggccgagguuaccaccaaccccaacucaauauuaauuauaauaaugaacaggcaugaagaggguagguucauugccugccccgcagggcuggccucggugagguucuguguuuaauauucauuuggagucaacaacgugcaaagugcugcuacuggacaugccuggacggagggacgucugcaugggugaggacaccguccuccucuucuaugggaccgagaaggagcaggcacuguugaaacagggaaggcuuagaguagacuucaggagggacuuccucauggauacacaauacuaauccacuuaugagcuuagacagguuacuucuguuugagucugucuuuguguguguuugcauaugaguagcauauguaugauugggaguggcaggucuauguauuugcaggguagaggauauugaacacuaaccaccuuucuuucuugguuugauuuuguuugguguuuuguuguugguuuguuuguuuguuuguuuguuuuuguuuuuuuagacagggucucccuguguagcccuggcuguccuggaacucacucuguagaccaaguuggccucaaacucagagcuccucccaaaugcugggauuaaaggccugcaccaccacggccuggcacuuuuuuuuuuuaaucuauuuuuagagaugggucucuccaggcuagagagaacgcagcgguuaagagcaguggcuggggcuggugagauggcucaguggguaagagcacccgacugcucuuccaaaggucugaaguucaaaucccagcaaccacaugguggcucacaaccaucuguaacaagaucugacgcccuccucuggagugucugaagacagcuacaguguacuuacauauaauaaauaaauaaaucuuuaaaaaaaaaaaaaagagcaguggcugaucuuccagaggucuugaguucaauucccagcaaccacauggaggcucacaaccaucuguaauggaaucugaugcccucuucuggugugcaugaauaaaucuuuaaaaaagaagaagaagaagaagaagaagaggaggaggaggaagaggacgacgaggaggaggaggaggaagaagaagaagaggaagaagaagaggaaagagacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaagaagaggaaagaggggagaagagaagagaaaagagaaaagaagagaaaagaaaagaagagaugggucucucacuagcacagaccuuguggguuaggggggcuggcuggcuagugaaacccaaggacccaccuuucucuguuucuccaguguuuuccacaccugguuuauauauaggcauagggauuggaacuugcauucucaugcuuaaauuaaaagagcuuuaccucccccacucccacucccucaucccccacacgccaagccugauccuucuucuguaaaguggccucuagaguugcuccuggucagaguucucgaccugacacuacaaaaccagagagcucuucugggcaggccucuggcucaggggguuucagaugacccuacuccaggucacaggcaccugccgaccucaaccucaacacagaguaagcaaugaacugacagacuguagaauagguugauccaagugaguguugacugaguaccugauacaggccuggccuugaggcaaaccuacuggagaagcuauggugacuuaccuuugaggagaugggaucugggguggucauggagcugggcacccccucacuggagacuucagaguugcccugccccugugagaagcuuggaagcugcuccugaagcucuacagguggacugagggaaggacagagaaagauuccaaugaccagcagucaagaggacuccagucaggauauugguccuucagaggacgccacucacacucaggagaaacgugaucauucuugagguucaguuacaagaagcaaagaauaacagcugacucccagcacccacccuacaaaacucaaggagucacagcaagaaacacugaaguuaaaucaauauaaagacuuccuggcugaggucugggugaugaagguaaggauggauggagaagcuuccugucugccugacagucugcccuacugucucccugugacgucuccucccugacuccccuguuccuacaaagcucuccucuucuccagcuccaccacugcagagacccccaugaccaugaccaugaccaugaccaugaccaugaccaugaccagccccaagagaaacaucagaagaaaguuaauagcaaaaugcuguggcgaaucuaauugauuuuuuuuuccuauugguucccuaauauaggcaacacuguuccugccgcuuuucugggcuggagauuaugucauaaauaaagagauuugcucccuauuuccaugugcuuaucuuuaauauguuaagaacucaacaagcuuuaggaggacuugaaauaagcaacagauccggugguggcuccugcugccguggcggcagccgagagcuuuacuugagggaagggggaggccagaggcugaggugagggacuggaguaccugcugcacugggacaagaucagaagaggagguaagagggaaagugggagauccggggaagcuaugaccaaauggacaagcaggggcgaaggccuguggggucaaguaggaauggagugugaagguucaggugggcugaagcccaguugguaaguguuuguccaccauccaugaaguccucccaucucaugagccaggcaugguggugagcaccugcacucccauaacuccgguaguagaaacagaaugaucagaaguccuugacuaaauggcagcuucugggccagccuaggauacaugaaacccguaucuagaaaguggagaaaagccugugaccccagaacuuaagaggagaacagauggaugaauucaagaccagccugaucuacauagggaacuauuggccagccauguuuacaugucucaaaagaaaaaaagaaaagaauaaaagaaaaauuaauaauaauagcaacaauaauaauuauuguugcuggauagugauaguauacaccuuuaaucccaguauuugggaggcagucagguggaucugugagucuggucuacagagugaguuccaggacagcuaaggcuacacagagaaacccugucuugaauagauacuacuacacugcugcugcugcugcugcugcugcugcugcugcugccaccaauaguguguggguuuaaguacuaacuccauuacugcauacuaucuaugugucacugggcaaaucauucauucucuugcuucauuacuuaaaacagagagcuugugagauagcacagcaggucaagacacagccuccaagccugacagucugaguuugauccccaggaucuacacgguagaaccaacucccaaaaguuguucucugacuucuacacaugugccauggcaggugcauggacauacaaaauaaauaaagagaugugauccauccucacgguuaucauuuagacagaggagcagggcaugguggcucacauuguaacccuggagucccaguguucaggaggcaaggucugggggauugcugcaaauugaagaccagccugaguuauauaggcagacccugucucaaaaauaaaacuagcagugaggcuggagaucucacuuagagacauaguacuugccuuacaugugagagguccucuguuuaauucccaagacuaucaaaagcaaaagagcaguauaauggauaauaaaaugaauaauaauaauaguaacaacaacaauauacaucucauagaggauuauagcgacugacuguauaaaaugcugagagcagugccugguccaggguauugagagaaaauguuagcuugucuguuguuggccuucauuaaaccuuaacuguggcugagccccugcccugugucagacccuagccuggucuucccugauuagugaaucauggaugcccccgggcagagagcacacaaccccgccccaccccgucccugugacuggccuaggacagguagcaaugacaggguacuugcacgaggaggacccagaaaggggacagugacccuccuuguggaggcagcuucccugugguccuguucugaggcucccaacucuccaguucuggaugccucucaaaggaacucacuuccuguaaacugacugggcagaagcaagauccuucucgacagacagcgcugaccugcugcagaccuuccagcagauucaagaccauccgcccugcauuguucuauaugcuguauugcccaagcacagucgccauucagccuaggcaauacuacuucuauuucccauuuuacagucaggaacacugaggucugaaaguguggcuauuggcucagaggcuuaaagcuggaaaguaacagaagcaggauuugaaccuugcucuaaacauugucuucacacagcaauaguggccaaugauaaggaaacaugauaggggcuauuuaagagcacuggcuggccaggcagugguggcacaugucuuuaaucccagcacucgggaggcagaggcaggcagauuucuggguuugaggccagccuggucuacagagugaguuccaggacagccaaggauauagguuuuucaaacccuaucuugaaaaaaacaacaaacaaacaaacaaacaaacaaacaaaaaaaagcacuggcuguucuuccggaugacaaagacuugauuccuagcacccaccaugguggcucacaacugcuuguaacuccaguucuagggaaucuaaugcucucuucuggucuucaugaacaccagcuaugcacgugguacacagauacccacaugcaggcaaaacacucaacacauaaaauaaaucauuucuuaaaugucaagcaaauguuacccaccuuaaauauauaaaaaacugccaggcaguggggcacauaacuuuaaucccagcacucggaaggccaaggcaggcagaucugcagaucucugaguucaaggccagccuggucuacagagcaaguuccagggcagccaaggcuacauauauaugagauuaaaguuaaaauuaaaaauccaggcuaagggcugaggaggaagggaacuuaagaagcauucagugauuacuagccacgugucauguccuccuucgggucuucuugcugaaugagcaucuggaagucaggugacacuacuuucuguuuauaggugaagaaguggggacucugaacuaugccugaggcaagcacaaaacugagaugauuucaacucuggucugcuuuuacagccucuaggagagcagucucucucucucucucucucucucucucucucucucucuuagguuuugucccuugcaagucaccacuguggagaaacaguccucccaguguagguuggggaagcccugcuugcuguuucuggugggagaggaauuucuaacucuuggguaggcauuuuauagccucucuuuucuccaggcauugucuggaccugcagacucugugacuuuaaggaccagugaccucacaaucgguugccauagagaccauugugaugucacaaucagaggacaaguaguucaaggagaggagucagggaugggaaugcacagcuagaauugagcaccauuugagauuuguguccuauauuccugccuagaaaaugaagaggcgggaggcagguuugcagcuggcuucuuagggaucacgagggagaaugaaugcacguaggguuuccugggacagcacugugcugacagucaaaggaaggguccagaaaaggaacaacagaaacccauucccacacuguggggcuggagggagugggcuacuucuacagcaggaagguuuaggguuagacaacagcaggaucuuuagauagaauaucucacugaaaaauauauguuccugagaguaauguucaugggagacgcuggaucucaagggccuccagagccuuguagagauagccauguuguaccauagcauguuagcaccauaucuucuguccaaggcugggaagaucuuugagggcucuccugguccuggcauacagagugcucaauacauguuuccucauucuguagacgugacugagacaguaaugaauggcuggguucuauagugaaggaugaauggagagggagacagguggagaagcccaugggaaccuagaggccacacagccacaucuccaguuuuguauucagccaccugcuucugggggcugucucugaggguauggaacacuugaagucugauuuggauccaagcuaagugcuggccauuuaauugaauaucuacuggauagauuagagagccaacugucccuaccuguuccaagcagcuacucuuccugacccugcuccuaggugacccucuaggcccaggccccugcaggugaacucugggcagagaggcccaggcccaggaaaccuauaauccuucugcuaccugcuccacuaaggccuggugacaugugccuuucuucccucccuuugcaauauagcacaacuauagcauuaaguggcugugaaucaccaagccuccuggggccucaaugucccuaucuguacaauggagacaaugacagcuuuguaccugccucauaggauuguugugaagaugucgucaaaucccuggcuuaaugcccucaacagcaaaugauaaauggugcuauuauuauuuuuaaaaguaaagaagaagaaaaaaaauccacugaacucagggccugacuuccuuuaaauggagaauagacagaucuauuguaaauuugcuuucaaugcauguggcaaucuuuucuaaaaaggaaauacuucaggccuuucugcaaacugugaaucagcuacgagaccaugccuucugcaguugcaaagcuuuaucccagggcuuacucagaaggggagacaugauuacucucucacauuuuuucaauccagcccccccagucuugccucaggcacaagaagaacaaacacucuuuugccuucacccuggcccaggcugggcagcuaucagagacaguggcaugaggucaggugucagaucacccuggcugggauguuguucacaccaacccuuuccugccuggugucagcagaagcgauuggcacuggcccuaucauuucuguauucaggggcauaccagcugugcucccuuccccagagaaagaacucaaauguguagcaaggaggaugcuuugagacagggucacauacaacccaaacugaccccaagcuauaguugagggugaccuugaacuucuaauccucccgccuccaccaucugagggcugacugggauuagaggcaugcaucaucaugcucaguguguagagugcugggcauugaacccagggauucaugcaugcugggcaggcacucuaccaacugagccacaucccuaucucagaacucagauguuugagaggguauuucagccaacugccaagccugacucuccugucaccauuucuaggucaccauggaaucccugguugccuauugacgaaggguaucuaaauggugacccugaggccucugcaucuuuccacggagcuuagccuaccaggugacccauuuccuuaggacaugaucaucaaccugguccugaguccccagccccugagcagcaccguaaacccaaugccucuggcagacacguuuuaugucaguucaagcacuaggacuacugaguucagaggauuuuauuucuagagccuuccauauuucuccaggauuaucaccugucuuugcuccccccccccucucucucuccugguuuauuauuuuuggacccuuuccaagccaagcugccuugaucgcuuggggagacaaaggcccccagcauccucccacggugucuuugggucuggcaagggugcccuuggggaccauuucuuuuccuuuggcauaaacucuucgacuggccacaauauccagguggccuuggcuuuuaggagcuaguuugccuaaaagacuuucugugugugucagggacuauggaggcggggagugaaggccucugucuccaagguuggggagggcuaugagaagaguaagcccugggguacagaggggagggagaaggccagcuguucucuuucuuacaccgugccaaccuagccugacaccaaauuaauagcauucaaaugagaugcaaagcauuaugcaaauauugaagagaaggccacucuuaccagagccucugggcuguuggaaggccagugccuggagcccuuucauggaggaccccaugggcucgcuuccacuucaauccucauacuucaguaccagcuugugcguaggaccaaagacacuggccaggcacucaaauuggcuuugccucccaagcacucaggcagggccccuucccaucuaaaacaagccacaggcagcugugaagguagcauaaccucccugggucuccuuuccccacucaucagcacguaugcaaacuagaugcaagguuuuugcaucuauuuaacuguccauuaaaauagccccaugcccaucaccucugcacaggccccugcuuccaaauugccaaccccugcugccugcaaaagccauguguuuccugagccugguaauugcugugguguuuguugagcuguauuugcauuugauugucauuuaacuuucuaucuuucuccuucaaucaaaccggguagggggauaggggugggguggaaagguggggagcuggcggcgaggguguggggagagaguugggcuucuacaacugauucuucauuuuugucucagcccuaucaugguuuucaaagagcuucauuaauuaguaccacaaacuugaacccggagacuucugccuccacguggcgggggaggggcuccucccacccgucccagggcuccuaagugcaaaugauuuugccaacgggauggaucucaaguccuaucuccagucugcguguuucagcaccugccucauuucugcccagccaguggcauuaaacauuuauggagcuguagaggaucaaaggccuccgcuggagguggugggcaggcuggaggcccggguuuggaggauggaaaguaguucacaucaaaccgcuuucugcugcugucucagugcacccuaggcucuugccacagaucuggucccauuccuggagugggagcuaaugcucagagccagaacccucaggugacugacuuuggguagccaaggauaucaggccugauauucauggccauaccagaagccacugagucuggagacuugcucaaagaugaugguggcugugccccuaccaucucugggaugaagugacagcccuuuccucugcuccccuaaaacccaaaaccccuuuggaugcucugauuugaaaacugucuugcagaagaguagaucugggcuuucuugguuugggguuuucuuuucccuccucuucuugcucagaaagcaagugucaucccagcugacuucaaaauaagucaccgauaggccugugaucccaugaguugaugaguuguuuagaauugggaaagugggggguuggagagauggcucagcaguuaagagcacugacugcucuucugaagguccugaguucaaaucucagcaaccacaugauggcucacaaccauccauaaugagaucggaugcccucuucugggaugucugaagacaacuacaguguacuuacauauaaauaaauaaauaaauaaauaaauaaauaaauaaauaaauaaaucuuuuaaaaaauuacuuaaaaaaaaaagaauugggaaaucgaggccggcuuccugagggauguggauuagagauccacucucaucucagagaugacuaguaacccccucuccggcuuucaaccucagucuguaguagccuuccuccgggguuaguagugaaguacaauucuucccucaaugccugaaacucauccaaaugaugccagacugauguguucugcuuuguauaccuucuuaaugaaguaaccccuucaagguaaccaccaaggacaaccugccacucagaugaccaaagaaccuccuacagccuagccacagaugacuccagcguuacucacucuuuucuacgggguugauggggugggaagcucugcuuuguggaaccaaucuccuuacugaccacagcucccuggcaguuuccacgaugauguugguuacauaaaccacacccccacccugcccuccuucauucgcugaaacacaagcagauuuggcaugguuugaagcccucacugacuuaaagcaaagucccccucacccccccaucuuccucuuacucagcuuucguauggcaucugugaccugccuuaggcuuuggggauccucacuuauuuacaauauucauugagcauuuagaauguacuggucccugggcuagguuugaguagagggcacauaggccgugcaacuaccuguagugaaaaauuagacagggaaaucaggaucuucugagaguaaagagcuggguagacacaguaaagggggcugugcaggucaccacaggcugguguguguguguguguguguguguguguguguguguguguccaaaaaccagagaauagcuuacaggaguugauucuccccuaaugugacguagggcauagaacuccaguuaccaggcuugauagcaagugccuuuuacccacugagcuaucucacuggccaguguuacuuuucaaauuguguguaugaauagaguaaacucucaaacuguaagccuugauauagaugacuguccccguggacauuuuauugcccuccauuaugggcaaugccgaugucuaggaagaaugggcccuuugaaaggcaugagaaaggauguuuaccaaaaccucuacugcucccuagauugguccaggcucugccucaagcuugcugggaacccauuccacagaagccauguuuaccagaucuucaguaaagaaugacagcaaaccguauuauuacucuagucaugcagugcagauccauucccuggguucaggagagaguguuguauccugggauuguagucugcaauggacucccucuuguaucccaggcagucaggaaggccauguugcagguucccagaaaauuuccuuaccuuucuucuuauagguaguccccagcucauccagagcccuacugccaagauagucgggugagaccuccagaagccuuuaagucaggaggaacuauccugauagaucagguucauccugcauuguggcucaacccccuuuucccagagcuguguaguccugaaggacccagggaugugagaaaugucaggaaugccugugagaaaggaagagccucauggcacucacccguuuccagacuucagucaggcacuucugcg

SEQ ID NO: 6194 - RNA, 3718 nt, Mus musculus
gcaguauuguugccaaaguacagagugucaucaguaaguuggagcagaggccuguggccacacagcuaaggccccccgucaccuugguucuaccaugcugucagugaccuacaguuucuugccuucccaguccccuuggccaagcucauugauggugggccuggaaaaagccaccgaaaaucaagugcugaacacccacauauguaucagaccugggcagggacuugagacuccagccccgucugagcauccucagcccugaucauguagcauagaauggggagacgcagggggccaguacugccagucaccccagacaggucagccauucacucuuccccuccuaugaucaugccccuuuuucccagggcgccgccgacaccagaaacaggaugaagagccaagugaggaggcagccaugaugaguucccaggcccaggggccacagcggagacccugcaauugcaaagccagcagcucaagcuugauugggggcaguggggccggcugggagggcacagccuuacuccaccauggcagcuacaucaagcugggcugccugcaguuugucuucagcaucacugaguuugcgaccaaacagcccaaaggcgaugccagccugcugcaggauggggucuuggcugagaaacucucucucaagccccaucagggcccugugcugcgcuccaacuccguucccuaggccauuggccuggacgcccacccaagacuccugcaaugcaaaaauguacacgaaccaagccuggguguuuucuauaccagaaacccucaacuacaaucuuugcaugaaaugaagaaaaccuuuugacuguuuuuuaagacuuuuuuucuuuucucaaguucuagggggcauuugcacauauauuuguacucaacauuucaugggaaagcggcagauccgcgcugaggagcagcgagggcagggacaggaggcccuggucuggacacuuccuccagcacaaucccuucccccgccuccugcuccucccccucgaccgccugcccacuguuguaaaauaaucagaaacuuguucuauuuuguggcagugacaauaguuuuauauuaaaagaaaaaaauacaguuuucauacagcaaaaucuauacaauaucauuguuuuauuuaauauaaagaucgcuacccacuccuuuccaugguucccacccuacaaggacuuccccucucugcagcaguugcacuacagguagcuacuguguauauggacaaaugagaaaugaauccuuuuuucuggcuguccaucuauuuuauuucaaauaaggaaaaguguauuuggauuuuguguaaauacaucuagugauggcauuuuuucaauguuuuuaaaagcuguguacaguacaugugguagaguguuucucaaauugucuauuguagcaaaggcguuuuugucguaaaccuguucuguguccuuuuuuguucuuaccacuucucuuccuccucaccccagauacuuccucuuccccacaaccaauguacauaguaauuguaauguuuuagacuugacagaaacuuuccuguauucuguauauaaaaaccaaaaauacuucaaauuauguuuucugccugucuguccucccugucaugcuuagaaggggaaguguccuggaucucacuuuucacacccuuuguacaagugucagucucagguagucuccagggaagcuugguggagaaggcagauguuagugaagggagccuaagcucugagagggaacuggaaaggagugcuugccuuuggagggcugcuguuucccuagggagcccuaauacaguaacaucucucuagaccaaugguucucaacaguccugaugcugugacccuuuuauacagucugucguguggugaccaccuacccuaaaaguauuucagugcuacaucauaacuuuaauuuugcuacuguugcaaauuauaaaugucugacacaggauaucugagaugcaacuccugugaagggguccuucgacucuugguaaggaggugacccagguuaaagacugcugcucuagccugugcggcucuugguguaacuugaauaacuucugcuguucucaucaggaaauacccugcuguguuacccuaauucuaauuuccugggcauccugcuagcuuccuggagauggcuuauucaggaaguucuuccugagaacaguccccuagaaaaaucuguguucuggcacuauucuaacuaguaccuauucauauauucaagucuguugauagggcuagaagacgagcuuuacauccacagcgucuauaguugugcuccaagaacacagugcaguauuaaauagggaauucccuggucucagaaaucugacccugacucccacauauaguuguauucuugucccugccacucugcuuccacuucaggaaggacuucuuaaaccuccaaaggcagaaaggaacuaccuguccuucacuguccuaggcaagguccugcuuggaaugcccacaucccuagcugucccugcccagcuuacccucagucacuguuuccagaguaauggagugucuaccuaccuagucuugcuaccugugaaccguucuagaaacaaauuaccgccuuuucgaaagcagaggucauggaguaacaaccauguaauacccacuguuucggaguuugaggaaggaggaucucaaauuuaaggccaccaugggccuagggaaaccaccuccaaaaucgacagggaaagggguggggucacaaaguuaggaaaucacaugguugaauccugacaacccugucagugccagcauaagaagccucaugccucuggccuguaacgggaaauguccuagaagagcagcggagggcuggauaaugaaagaaugagaaaagagucgcuucauugaggaaaaggcauccaggacucgacuccagacacacgagcccauucauguacacaggacuccagacugagagacugcuacauacucacaccuagaguaaacagagauguucauucagucacacgcguugguggagacuacagaugcaugcacagccuggaggacucccgcgaugggcacagacaccuacgcagugcucucaccgccggcgcccgcccagaauccagaagcacgcccaaagccugagcggagaucucagggcccuaggcaugcacacacccacccgucccucaggcagauguuuccggguacuuaccgagcacgcguucccgggaguucgcaagccuagagggcgcucccaggacuccaagguguuucuccuaggcacgccgccagggcacgcaggcgcacgccuagggggcgcucgcaggggccacgcgugcgcgcacaccccugcccagccugccgccgcccucgcgaggccgaggcgggagcgacgaggcccgggcgggaaucgggagcacugccggcauggagaugcugcugcugggcgccgggcugcugcugggcgccuacgugcuugucuacuacaaccuggugaaggccccgucgugcggcggcaucggcagccuucggggccgcacggucguggucacuggugagugcgcgcgagcgggcggcggggaggccgggcggguggccgcggcccgaccggcugagcuggcucccacccgccgcccgcaggcgccaauagcggcaucggaaagaugacagcgcuggagcuggcgcgccggggagcgcgcguggugcuggccugccgcagccg

SEQ ID NO: 6195 - RNA, 3718 nt, Mus musculus
cggcugcggcaggccagcaccacgcgcgcuccccggcgcgccagcuccagcgcugucaucuuuccgaugccgcuauuggcgccugcgggcggcgggugggagccagcucagccggucgggccgcggccacccgcccggccuccccgccgcccgcucgcgcgcacucaccagugaccacgaccgugcggccccgaaggcugccgaugccgccgcacgacggggccuucaccagguuguaguagacaagcacguaggcgcccagcagcagcccggcgcccagcagcagcaucuccaugccggcagugcucccgauucccgcccgggccucgucgcucccgccucggccucgcgagggcggcggcaggcugggcaggggugugcgcgcacgcguggccccugcgagcgcccccuaggcgugcgccugcgugcccuggcggcgugccuaggagaaacaccuuggaguccugggagcgcccucuaggcuugcgaacucccgggaacgcgugcucgguaaguacccggaaacaucugccugagggacgggugggugugugcaugccuagggcccugagaucuccgcucaggcuuugggcgugcuucuggauucugggcgggcgccggcggugagagcacugcguaggugucugugcccaucgcgggaguccuccaggcugugcaugcaucuguagucuccaccaacgcgugugacugaaugaacaucucuguuuacucuaggugugaguauguagcagucucucagucuggaguccuguguacaugaaugggcucgugugucuggagucgaguccuggaugccuuuuccucaaugaagcgacucuuuucucauucuuucauuauccagcccuccgcugcucuucuaggacauuucccguuacaggccagaggcaugaggcuucuuaugcuggcacugacaggguugucaggauucaaccaugugauuuccuaacuuugugaccccaccccuuucccugucgauuuuggaggugguuucccuaggcccaugguggccuuaaauuugagauccuccuuccucaaacuccgaaacaguggguauuacaugguuguuacuccaugaccucugcuuucgaaaaggcgguaauuuguuucuagaacgguucacagguagcaagacuagguagguagacacuccauuacucuggaaacagugacugaggguaagcugggcagggacagcuagggaugugggcauuccaagcaggaccuugccuaggacagugaaggacagguaguuccuuucugccuuuggagguuuaagaaguccuuccugaaguggaagcagaguggcagggacaagaauacaacuauaugugggagucagggucagauuucugagaccagggaauucccuauuuaauacugcacuguguucuuggagcacaacuauagacgcuguggauguaaagcucgucuucuagcccuaucaacagacuugaauauaugaauagguacuaguuagaauagugccagaacacagauuuuucuaggggacuguucucaggaagaacuuccugaauaagccaucuccaggaagcuagcaggaugcccaggaaauuagaauuaggguaacacagcaggguauuuccugaugagaacagcagaaguuauucaaguuacaccaagagccgcacaggcuagagcagcagucuuuaaccugggucaccuccuuaccaagagucgaaggaccccuucacaggaguugcaucucagauauccugugucagacauuuauaauuugcaacaguagcaaaauuaaaguuaugauguagcacugaaauacuuuuaggguagguggucaccacacgacagacuguauaaaagggucacagcaucaggacuguugagaaccauuggucuagagagauguuacuguauuagggcucccuagggaaacagcagcccuccaaaggcaagcacuccuuuccaguucccucucagagcuuaggcucccuucacuaacaucugccuucuccaccaagcuucccuggagacuaccugagacugacacuuguacaaagggugugaaaagugagauccaggacacuuccccuucuaagcaugacagggaggacagacaggcagaaaacauaauuugaaguauuuuugguuuuuauauacagaauacaggaaaguuucugucaagucuaaaacauuacaauuacuauguacauugguuguggggaagaggaaguaucuggggugaggaggaagagaagugguaagaacaaaaaaggacacagaacagguuuacgacaaaaacgccuuugcuacaauagacaauuugagaaacacucuaccacauguacuguacacagcuuuuaaaaacauugaaaaaaugccaucacuagauguauuuacacaaaauccaaauacacuuuuccuuauuugaaauaaaauagauggacagccagaaaaaaggauucauuucucauuuguccauauacacaguagcuaccuguagugcaacugcugcagagaggggaaguccuuguagggugggaaccauggaaaggaguggguagcgaucuuuauauuaaauaaaacaaugauauuguauagauuuugcuguaugaaaacuguauuuuuuucuuuuaauauaaaacuauugucacugccacaaaauagaacaaguuucugauuauuuuacaacagugggcaggcggucgagggggaggagcaggaggcgggggaagggauugugcuggaggaaguguccagaccagggccuccugucccugcccucgcugcuccucagcgcggaucugccgcuuucccaugaaauguugaguacaaauauaugugcaaaugcccccuagaacuugagaaaagaaaaaaagucuuaaaaaacagucaaaagguuuucuucauuucaugcaaagauuguaguugaggguuucugguauagaaaacacccaggcuugguucguguacauuuuugcauugcaggagucuugggugggcguccaggccaauggccuagggaacggaguuggagcgcagcacagggcccugauggggcuugagagagaguuucucagccaagaccccauccugcagcaggcuggcaucgccuuugggcuguuuggucgcaaacucagugaugcugaagacaaacugcaggcagcccagcuugauguagcugccaugguggaguaaggcugugcccucccagccggccccacugcccccaaucaagcuugagcugcuggcuuugcaauugcagggucuccgcuguggccccugggccugggaacucaucauggcugccuccucacuuggcucuucauccuguuucuggugucggcggcgcccugggaaaaaggggcaugaucauaggaggggaagagugaauggcugaccugucuggggugacuggcaguacuggcccccugcgucuccccauucuaugcuacaugaucagggcugaggaugcucagacggggcuggagucucaagucccugcccaggucugauacauauguggguguucagcacuugauuuucgguggcuuuuuccaggcccaccaucaaugagcuuggccaaggggacugggaaggcaagaaacuguaggucacugacagcaugguagaaccaaggugacggggggccuuagcuguguggccacaggccucugcuccaacuuacugaugacacucuguacuuuggcaacaauacugc

SEQ ID NO: 6196 - RNA, 7737 nt, Mus musculus
cgguaccagggugcauugcggcaaaauggcugcccccaggcgguacugcgcugggcucguucgggccuuguuaggggcccgacagguggguucgcaugcagggagggaauggcuugcuccgcccggcugucuucuagguaaccaggcgaggugcguguccugugucgugggcuccacuuucucugguccccuccuggccucggccucuagucguuauggucaggacuccgccuuggaccguauccuuggauuuucucagccugacaguucguugguuccgagcguccccgcggugucggugcacagagguaaaggguccagcuauguuaguuacagguguuugguucuaugacauguuuugauguguagcccaaaccagcuuggaauucggaucuucccgcugcagccucuuaaguguugggauuacagguguuggccaugaccggccucugaugguuuuagcaguggaaaucauguaucguaaguaaaaucccucugccucuagaaauagcaguuuaacuucucauuuaauaaaaaauaaaccugagcccaaggagaggcgaguggagaaggcugucaaagaguuugaaagugagggucugugaaacagacgaaggcucuuguugcuugacaaccugaguucaguccuuggaacucauaugguggaaacugagacccagacaguuuugcccuaacuaccauaagcucccacugacacacaaauaaauaaauauagcaacauaaagaguuuuaggaaugugaagaaccuagacccucuguugguuacagucagucauuagucaaggcaaaguugucucccucaguccucaaugcccagccuguguuuuuuuuuucucccauacaguugucauuuugaaaaagaaguuauucauaaauaguuaaugugauuccauauuacauaugaaaaaaaaaaaaaacaagagacuuagagaguuuagguaaccuaaugaucaaguaagcucaaaugccaaacuauucucaaaguuaagaauggguuggcuucugccaagccauuaccagguccucaaguccucaucaagcaguauagacccaauacguggaucuugagcccuaucuacuugguuuaauccuaaauuaagucaggccuuauggugcaugccuguagucccuacacugaggagguggagguggaagaucuggagaaaaauuucagcucugacugugguacccuaugcugcuaugaagguacugcaaaauguuucaaucucuccuuaugauacugcauugcaaguaacagugccuagucuccuaccagacuguaguccaugcuucuuucagggugacauugagacagaguuucacucuagaccaggauaaccuggagcucacuauccccagccuccugcauguggggauuucagguucgagccaccacauccauuuuauaaagugccguuucuuugguaucauuuaguguggugguuuuguuuuuuugaggcagggucuaguuauguagcccagguuggccuuggucucaaaggagauccacucuuuuuuaaaccucuuuuuuuuuuuuuuuuuuuuuuaaagauuuauuuauuauauguaaguacacuguagcugucuucagacacuccagaagagggagucagaucucguuacggaugguugugagccaccaugugguugcugggauuugaacuccggaccuucggaagagcagucgggugcucuuacccacugagccaucucaccagccccucuuuuuuuuuuuuuaaagauauauuuacuuauuauauguaaguacacuguagcugucuucagacacaucagaagagggcaucagacuuagagagguaaccuaaugaaaucaaguaagcucaaaugccaagcuagucucaaaguuaagaguggguggcuucugccuggggugcucaucuuuuauguugacugcuuccuuaguuaucagagaugaguauccaaccuaucacucccguucccauccuaacacagaugagcagaaucuacucuuggugcacacucccgacaugccugagaauccacggguccuccgcgugguccuccugggagccccaaaugcagggaagucaacacuuuccaaucagcugcugggccguaaaguaugcuacagauaucucaucucaaccucuacaccucccuuuuaacacguuauuuucuguauauggguguuuugccugcaaguauguguacugcuugugugcuugguacccacagaagccagaaaaaggugcuagauccucugaaacuggagugacaauuaguugugagccaccacuuaggaacugggaguugaaccuagguccacuggaagagaaaguaguucuguuauccacugaacuaucucucuagcccucuauacccaucuuuuuuuuauuuuuuuauuuuuuccauucacuucuugcuuuucuuuuauggauggccugggagagaucuggggucucauuggaaccucucucuuucuggaagguguuuccuguuucaaagaaggugcacaccacucgaugucaagcucugggggucaucacagagaaggagacccaagugguagguacuugcagaaguucugcaaacaagauagugaaaccaaacaauuagccuuuaaaaaaaauuaccugguaguggugguggcucaugcuuucaaucccgguucuuaggaggcagaggaggcagaucucugugaguucaaggccagccuggucuacaaucaaaacaaaccaaaaacuccuuuuuguuuuuuuguuuuucgagacagaguuucucuguguagcccuggcugucuuggaacucaccuugaauuuauuaucuuccugccuacucccaucuuucagguacucagguacaagagguaccacauacccagcucucaguauuuuaacuuuuggagacagagucuuaccauguagcccugacugggacugaacuaaauauguaggccaaucuuuccuuuuuuuuuuuuuuuuuuuuuuuuuuuaauuuuucgagacaggguuucucuguauagcccuggcugucuuggaacucauucuguagaccaggcuggccucgaacucagaaauccaccugccucugccuuccaagugcugggauuagagguauaaggcaugugccaccacugccuggcuauugacuucuuugugcugggauuuuaggagugugauaccacaccugacuaauuaaagcaauucaacacugaacucugguuuugugugguuucuuuuguguagugcuggggagcuaaccuugggcucuugagugcuacccaagcauucugcccuugagccgcaucuccagcauuaaucuuucauuuauucauggucacccucuucccuuggggucccauuagcauugaaaucauaccgaaggauaagagaucuaagaucaguuaacaguuugcccaugaaggaaaggcaggaugcugauaucaaagacagccauucucuaacuauguauguuuaugcaugucuuuaaucccagcacuugggaggcagaggcagguggaucucuuaugaguucaaguccagccuguuacauauagagaauuccaggacagccaggacuacaagugaggccuuggcaaaguaaaaaaguuaaaaaauaaaaagccucuugugacucaaacucacuuuguagaccaggccagccucgaacucagagaucugccugccucugccucccaaguggagugcugggauuaaaggcgugcaccaccacgcccggcuuucuuuuuucuuuuuuuuuuuuuaaagauuuauuuauuuauuauauguaaguacacuguagcugucuucagacacacuagaaaagggugucagaucuuguuacggaugguugugagccaccaugugguugcugggauuugaacucaugaccuucugaagagcagucagugcucuuauccacugagcuaucucaccagccugacucugcaaauucuuguuagaauccuugaauacuuaccuaauaugaguaaagcccuggacugaauccuaagacuuaaaguguguguggcccuuuucuccacuaguccauuaaaaaucuuuucuuuuuugggggggcgguguggguaucuuucugauucuagauucugcuugacacaccuggcaucaucaguccuguuaaacagaagagguauuagcuauggggacacaugcuuguguguuuguugggggaggggugauuuuuuuaaaaagaggagaaaagggggaggggauauuuguucauaggagcuggaaguuuucccuuuuaucuaccauuccucauaagaacugaccagucauaagccuuccugacugauacauuuguucuuuaggcaccaucuggagcgcucuuugcuggaagauccauggacgagcauggaaucugcugaucuugguuagacucaaacuaaagaucugaagcccuauuaauggggccuuucauuccugggaguuugggagccgaggucuggcuggggcccguagccaggaacuugucgugggucaggaggaagguuacagauauccuuuugucugucugccaccuucuaguuguaguucuuguggaugugucagacaaguggaccaggagucggcucaacccccaggugcugcagugcuugaccaaguucucucaggucccuagcauccucgucuuaaacaagguaaggacugcccacgugagagaguuuuccuuccagagucccauggcucucaccaugcacuuuguucaucccgcauguccagguagauugccugaagcagaagucaguucuccuggagcugacagcagcccucacugaagguguugucaauggcaagaagcuuaauaucaagcaggccuugcgcucacgcuccagcacccacugcccuggcccugaaacugagggcccaaaugcacacucagugaggaacccucagagaauuggcuggcccuacuuccaggagaucuucauguuaucagcacuaaacaacaaggaugugaacacauugaaggucaguuagccuugcccauaauccaccacuucuaccauguuacgauaggccucauccagaccagccugauauccaccgagauccugucuuuuaaaagacaaaacaaaacucuggcucuggucauuuauguuuguaauccccgaauuugaaaggccaaggcaagagaaucaggauuucaaggucauuuuuaaccacauagugaauucaagaauagcuucaguuacaaugagacccugucucaggaaacagaaaacagccaggggugguggcacacagcuguuaucccagcacucaggaggcagagguagaaggauuacucaguuugaggucaaccugguuuccauugugaguucuaggccagccaagcaacauagagaccagaaacaaaguuaggaauguaucucaguugguagaaugcuugucucgugugcuggauucaguaucuagccccacauaagcuggacacacacgugggugcacaccugcuacuauagcauuuaggagauagagacaggaagauuggaggcucauucccagccuggacaaacgaggauggacaaggccagcuugaucugccugagaugcucucuuaaagguguuucagucaguuguggcagcucgccccuguagucagcuacuauguaguaauuuuaaggucagcuugggcuacaugaggaugggucauagccuuuuccuccuagaagcaugcauaaacaaauguucugauggggguuaagaaccuacucuuccuuuguucccacagcaauaccuucugacacaggcccagccaggacccugggaguuccacaguggugugcucacuagccagacacccgaagagaucugugccaauaaaaucagagagaagcucuuagaguaccugccugaggaggugcccuacggugugcagcaggugugggcagaggaaaaggacacagugccuguauaccaggcacaccccuggaacaguuggguaccaagagauacagagaugagccugccugauuaguccugaugucuccuuauacagaagacagugauaugggaggaaggaccaaguggagagcuagugauccaacagaaccuucuggugcccaaagaaucucaugugguaagugagggaugcucagagaaggguagcaguguuacccauggccucuuccccaucugugaggccaagagcagaaccaugugccucucuuuucacuacuugcagaggauccugauuggucagaagggccucuugaucucccagauugcacaggaggugggccgggaccucauggacaucuuccacugugacguucucauccgccucucugugaaacuccucaaaugaccauccucuguugcuucucccaguggaucccugcucaagcugcuggcagagucacugacuagaacuaccccugucagaggggucuacaggacugggaagggccauggacacugacugguuuccauugugagggacccauagcuacagcugcauauguagcagaggauggccuagucggucggucaucaaugggaggagaggcccuugguccugugaagguccugugccagccagccuggcauugccgagucugcacagugcuugcccaaccauguuuccacuuagcucaguucucggggcguuccucugccuagggucucagucaguuguauaggauacaugcugaaccacacccuagaacccaugguucuaagucauguccaccccgcuagcauuggaaccaaacucuugcccugaguuuccaguuguugguaggaacacaauuuuucucuucucccccaaguuccucaccuugaaguugcauaaggacccguguuuccuuuuucuuuuauuauuauuauuauuuuuuuuuuugagaccggguucuuacccuacaacucugacuggcuggcuaucucuacauagaucaggcuagcuuuaaacucacaaagguccucccaucccauccaaccacccagccucggaugcuaauaaaguuaaaugacaagugcucuuauucuuaucuuuuauuucuuuggcacagugaagaggaaaauguacccuuucccccaaccccauucucuugucagccuggguguccuuuucuuccagcagucugcuccagggucaugagcucuucuuggcacaguuugugggagcagcaagagaaccguuaccauuacuaaacucaguaaugguaacgguuuccucgccauucccaagugccacagcugucagcaggcuugauuaggccgagcagugagcccguguacuucugcaucucugcugcaaaccaggcaggcucuggaggugggguacccagacuaguacaucaucuauacuguagugucucaucacaaacuuacaguauaugaugauaucccagccaagguccuggaggaggaggugagcagcaggccuggagugagccaggggauuggcucagggucagucagggacaccuaagucccuaccucugcuccuccacuucccucccagagcagcaucucccugauccugugguccaggauaaccccagguggcuuagagaaggaagcuaaggucuacucgggucucuuagggauccagaguuacaggcagaaacgaaguugugaggcaggagcuucccucugggcagaccuauaagcaggcugacagccacuccaaggacugcuuaccuggagcuggaguggagcuggagccucguccagggaauccucugcacagggagagccugccuugucu

SEQ ID NO: 6197 - RNA, 16584 nt, Mus musculus
ccucuuccggcgggcgggguugcggacccgggccggucucggccgccagucggcgccgcccgcagccgggaaacgcggcccgagcgaggcgcgggcuguggggccgccgcgugcccggccccgcucgcccgugcccgcugccagcccgccaugcccggcuucgacuacaaguuccuggagaagcccaagcggcggcugcugugcccacugugcgggaagcccaugcgcgagccugugcaggugucuacuuguggccaccgcuucugcgacaccugccugcaggaguuucucaggugcgacccggggcggugggccuccgccggcagugcagggggaugagggcggugcacgggggacgggcucgggccggagacacgucgcgccuuugucugcgaggccgcccggugaccucaggagcgcccaccaugaugucaaggggcggcagugacgucagggcccuggggaggaccuuacgcacccaagcguagggucucggguccuaccugcccagcuccagguaggaaaaacugccuccccacgcucuggcggagggaaagccgcccuuccugacccguagccggcccuuccccccuaccugagagcccgagcggccacagucuugaacuuugaauccuuuagggaagggaaggacaaagccucucucucccgcgcggcacucaagccgcuggaguuuucaccuguccaaccucuucuuuuccucucugacguugagagagcggccgcuauuguucucccauuucagagauucaaaaaaauaagggcugcgauuugcccagggucacacgauucaagucuuuagcugggaauccagcccgggcugcguguggccaagcaguagagguuggacugugaccugcagcccuccccgccucuuaaguggggaacccucccuuggggucuugaguacaauggaugguugguacaucggccacccggguugguacugaaugcccugugcccacugaggauccagguccugccuugcggccucaggcaucgcucacauuucugggcaccccugggcggucuugaggcuccuggcacugaaggcugcauguuggaggggagaucggggagccccaacgcccguggaggucgugcucuagagcacaaggcaggcugagucugccgcggucccgcgaggggaacuggcagggaaagcaaugugggacuugugccucagugcuucguccccacugucuuccgaagccccuggcuggcggaaaucucagcaggcccuuuguuuuuuguuccuagcagccgcgggcuccugcucucacauaugcuccugcucaagcugcugugguccccccuccucccuucuuuucucccuccucccucuggcccuccucccugaaauguacacacuuaacuccucuacagacacacacgggcccauugucuucccggcucccuuccuggcccucugguuuccagaugaggccagcugagccagcccccuccuccagcugacccacccuuacugccucggggaaggagccaggaggggucugucaggccuuguucccuccuucaccuccuucucaguccccucgaggcugcuucugccccuccuccucccggaaauccccucuuccucucccacuacccccuccccccauccugucuucuccccugggcuugggccuccacugcucagccaggagcugccucugccuucuccccucccccacgauccaguuguguuuaguggcuucuggaggaaagaggugauugagcaggcucugccuccccacuaucaccccuacccuacaaguuagguuguccauagccuuggccaaaccuuuuguccuggcugggccccaagcugcagaguuagcugcugccugaagccuagggaccugccuuaguccccuugcugucuucaaaaccaccgggucagcacauuccagaagcagccaaguggaccccccucccccuuggcccaccccucuuuuacuccugcugcugcuggcuauuacccagauugagccaggaaggcugcuccugggugcaggcauagcucuuuagugccucacuuggguccuucgcaucagggacauggccaguaguguggaccaagaggaggugcuuugauggacugggcaccugggauauggacugcccaggcucuggacagugcuguuacagcagggccgcccuguagucucugcuuccgccuugaggccuaccugacucagaucugccaggaaugcagagccugggggcuuucagucuugcugggugagcccaugccuugccugggccauggcagucaugugugacaggucuuguaggggucaguugggccauacuggcaggaggaagcaugcuaccaggcucuguggguguuaauaucuguguggagaugggagaagagggacaggagagcuggcagguguuaggguggccaaguuucaggagcucugccugugguuaaagccugaguuaccacagacagacauaccacagacagacagacauacccaggugcugcuuuacuagggagccucugauugguuuuuugcuuccucccccaccccuccaucuuuugaauugccucucagaggcaaguggugaaggccaggagggagugugaggaauggauggugggagcacagagccgggggcccugcuauuccuucccacucuuuuaagaaacacacccucaaagaggagaagggauaguauaaaguggccucaagaugaccuuagccuugguucuaggcuuggcaccgucauggaggcuggguagcccuggcauuuaauccaagcccaucccuguauacccucccgucagcuuucagaguagccaaugaaaaccauucuuggggaagcggguggcagcaugccuguuucuuucaaguccagcugcuguccuggggggaggggacgccagcugccaccuguugggaaagugcugcccaaggcagcugugucuguccgcacuggaccuagaaugccauuugugggucguuuaguacccuugaaaagugggucccuucugacuucucuugucccuuugucucagccauggcaggcuaggaaggggccuggcaagggagggaggcuacccugacugacagggugaagcccagggcuugaggagccuugacccugccuucuucccuuucagugaaggagucuucaaaugcccugaggaccaacuuccucuggacuaugccaaggugaguccauacugcuagguuggaagccuagguacauaguauaugggcuguugcccuugcugggggcuggagcucuuggcagccaggaggcacagagccagugucaaccccaagccucaugaucuugugcccccacaaagguagccuguucucucccaccaggccaguuugcaaacgcaggcuguguuugcccugggggggcaggcacaaugcccagccuguaggggugcacagagcugcucugugcccauaaaaagugcucccuccucuucccguggcugggggccaggaccccugcacuaagaggaaggaagcagaaggggguuuaccuuacggccgagcaggcugauggccugcuucccugaagggagcauguucccaugcagccauguugggggaaucuaggguccaagucagacagaguaaauacauacuguacucuguccuucauccuagggcacagagacauagucugagaggucuuugaucaagaaacuauuacugccgggcgugguggcgcacgccuuuaaucccagcacuugggaggcagaggcaggcggauuucuggguucgaggccagccuggucuacaaagugaguuccaggacagccagggcuuuacagagaaacccugucuccaaaaaccaaaacaaacaaagaagcuauuacuggcuuacaggcacagccagcucaguugagagugggguggauagcaacuccagcaggcucugauagcaacuccaccguccucugcccacagaucuacccagacccagagcuggagguccagguguuaggcuuggcuauccgcugcauccacagugaggagggcugccgcuggagcgggccacuucgucaucuacaggugaggcucggguggggagcuagaacuaacccuuccuuggcagauacugacuguuaucugucccaccagggccacuugaacacuugcagcuucaauguaguccccugcccuaaucgcugcccagccaagcugagccggcgugaccugccugcccaccugcagcacgacugcccuaagcgccgccucaagugugaauucuguggcugugacuucaguggggaggccuacgagguacauggguccaggcugacgguggaaggagggugaggcaccugggaccccaggcaucccauccccuaacuuaaccccuguggugauuucagagucacgagggcgugugcccccaagagaguguguacugugagaacaaguguggggcccgcaugaugaggcgacuguuggcccagcaugccacgucugagugccccaagcgcacccagcccugugccuacuguaccaaggaauuuguuuaugacaccauccaggugaggcccuugcugaccuguagucugugagacuguguaccagggaguugggguacugaccacucuugcuauuucugguccuagagccaccaguaccagugcccacgccugccuguucccugccccaaccaauguggagugggcacuguggcccgggaagaccugcccacccaucugaaggauagcugcagcacugccuuuguucucugcccuuucaaagagucuggcugcaagcacagggugagaugccccuucuuccucagccccuuagcccuugagguccuugacagagcaucaguugcugccauaguugaggccucgauggguccugcuagucaacuccugcucauucccagugcccuccgccauuguccuguuccuguggaacuaggugccugccaccccgaccugcuucuccucucccuugggccuuccucuuuugguaacuuuuuccuucucccauggcuuuggguuuugccaacagugcccuaagcuggcaaugggacgucacguggaggagagcguaaagccacaucuggcuaugaugugugcccuggugagccgacagcggcaagagcugcaggagcugcgaagagagcuggaagaacuauccauaggcagcgauggagugcucaucuggaagauuggcagcuaugggcgucgucuacaagaggccaaggccaagccuaaccuggagugcuucagcccagccuucuauacgcauaaguacggcuacaagcugcaggugucugcauuccucaacggcaacggcaguggugagggcacacaccucuccaucuacauccgugucuugccgggcgccuuugacaaucuccuugaguggcccuuugcccgccgggucaccuucucccugcuggaucagagugacccagguuuggcuaagccacagcaugucacugagaccuuccacccugauccaaacuggaagaacuuccagaagcccggcacguggcgaggcucccuggaugagaguucucugggcuucggcuaccccaaguucauuucccaccaggacauccgaaagcggaacuacgugcgggaugaugcgguuuucauccgugccucugucgaacugccccggaagauccucagcugaguagagccuuuuggcuucaagugggaagggaggcgggacuggaucugaaacuggauugggggccggaccuccuuucagcuucuuuugccuaggcuguuagcccacucucccuaccaccaccaccaccaccaccaccaucccuaccccucaggugccuccaauuggugcuucagcccuggccccuggggggagcaggucucgggguuaucaagggcuggaaacacgaucccagggccugucuccccuccugggcagggcagacaugccuugaugccagccacauucuaccuggacugaggugccugcucaggugcuaugucccaagagccauagugggggugggagguauuggcaaagggagggguaaggguaguuagaagaaucugccuugagauuaacuucucuuuccauucacccaguggugcccucucugguuauuuauuucucuagugcuaggugggcacagcaggggaacucugauuuuuaauaaauccugaauuguauuuauuaaccugauuccagccugucuccucccaguagguuaggguucugggaggcugggcccagccagaggagaggggugaacugcucugcuugcagccauaccucucuaguggacgauauggggauugcaggaaacuuggagugggagcaucaccugcccucuggugguucaauagauaggugcaguuaccacuuaagcuggcaucuccaguccauaccucaccaaagacaagugcugcuuagcggggcugucuauaucaguaauaaccauguguguguaugugugcaggccaaagaucaacaucaggggucuuccucaguuacacuccaccuuuuugagacagaucaaaaauccuggaguuugcugauuccacaagacucuaucuucccucggcugauccagcagccugggugguaccggugugcauugccguauccagucuuguacuccaaggccaucuuuacagccugaagucuuguggccaggagucaagggaaguagcuuuuccccuuagagucacuguuagaguuaaugaggcugcaugugccugacagaugaaggacugagugagugagugagugucagucuguacuccaggaguaaagaggccuuugagauguagaaagcacuuaagauuuucucaccuguaauuucauuugcuuuuugugcaguucugaauggcugccucugugaccagaggcagugcauuucaccagucaacuaagaauagaagcaaacugacuccuucaguuaguuuggggcaaagucuggauuucugugggguccccucacccccaccgugcaugccagacucaacuacauacaugcucaaacccuaaauucuuuaucaguaggcguauaguucccacuaauuuuggcaauaaauuugggcuugcuuucagcaaguuacuuagcuuugugggguuaacuccacuuauuaaugguaaaaugaauucuguucaacuacugguauuggaauauaaucaugacaggagguaauuaacaugaagugucuuucucuccuggcccagcagagcugaaaggugugcucuguagagggaggugcaaagggccuuuaggaagacgagaggucuucacuaggugaggauugcuuagcucucacuagccuggucauucacuauacacccaucagggagaccaugggaccuuagcugagaaagccaaaaugcucccccaccauacagaaugguagacauaaccugcugcugacagggaaugggucaaacugcuacaggauuucugaaacuuggacaucuugucucugccaagacaacugcauaacugaaagguguaacaccuugcaauugacacacuuuguuggcccauuugccugucccucauuccagcugugaucauagcauuauagaauucagggcacaccagagcacggaguggacucagcucuguccagugauacugcagacagcugggcucaccucccuccgccguuuggccacacugaaggcuccaugugcagagcgcuugcuacacgugaggggagggaggcagagcacuuugaacgagcaugggcaagugaagggggcuuuaaaucccaagcaucuucccaccugcugacuagcuuccccugacccucccuacccuacacucccaucagagcccuccauuccauuuaggagcaguguguaccacugugagggggugaggcagcaccuguuaccucugucuuaaguaauuccccugcuacaagugggagggagguuuuguauuuguuggagggcuuaaugggaaaacagacaccuacugaggacugauggcucuugggagucaaagggccugcagugaggcaccggcuuccagcuggucccuaagagggcuugacugaacugcauauaaccuuagaaccaaucccagucugagacgauaaauuggggagggcauuugaaaggugaaugggcuauugccaccaccaaagaaacuaccccuuuucuaagugaaauguuacagagauugucaaaaacaaaacaacccuaaacaccucaagcacccacauuaaaugaauaggacaagguaaaaaaaaaaaaagaugagguugguguguuuuacugcuuuauaauaaucuuaaaaaaaaaaaaaauuccaccaugcccauaaaccaccacagguaaggugagagauggagaccagaugcuacaguauguggaaagucggggaguccaggguuuccuuugggguggcaugggauuuuggaggcaaggaauguagauaugaggcccuuauugcuuggacccuuauugcugguuggggauuggcugggguggggugggagacaaucaggcugaacgaggaaacaccuuacaccaaaguugggggcagucauuugcaggguaagggaaucacaguacaauuuccaugcagacuagaggugggggugaggugugaaagcccccaagucgguguuugguccaguuuccuacaguggcagcccccuaggaaggagaauuugggguuacaaugucagguuggaggucaaaggagagaguagagcucuucaaauaaguggcuagcggaggugccugggugaggcggccaauaccccggaggaggcauugcaccagaagcugaggggcucggggacaggacagugauaccagugcucagacagcaaggaaacaauaaauuaggacuucguguugcuaucauuuggcauaacacacgcaggcauuuuuccuuuuuuuuuuccuucuuuuaaauauaaggcaacuugccaacacauaauuuaaaaacuggucuucagucacauugcuucagaucacuacagaauuucuggcuaaggaacagugagaauaaaccccagaccuucaguuaucagcucacauucccccaaggcgaggaaaggcaagggcuuaguacuauuacuuucaaagcccaacugugcaacagaagacaggugcaagaauuuacaacaaaacagucuaacguuacagagaaguguugaauuucuagacaacuaauugccacuugggaaugagacacauugguccuggaacagguggaagaugcucuugaaugggugaggggcaagaggggccauucccaauguaagccccucugcagcggucggaaccacgcacguuugguggaggaggaauugaaggggcuuaaggcuuuguguuuuuccuuuuguucuucauuaaacugaagggcugcaaaacuuagagggugacuguaccuguggggcacucauacacaaugcuccucaaaccacucauucauacagagacacgacauuagaacuuacaguguggaccagugauucuuagccaguguagagaaccaaaugcauuuuuaaacuuuuuuuuuucaaacuuuuuugguguuuuuaauuccaaacucuagugugaucauccuuuaccuagaacuaauucuucaaguaagguaguuucugguuuguuucucuuaggagggaggguaggcaggauugaggacaauagcugaguuuggacagaggcaacggugacaggagguccugggaaugccagauggccacugcauuucucugcaaaggagagucaagaaccaagaugccaaugcaaugguuuucucugagucgcaaggcuuuggcagggacaagagcaguggcuugagaacaacagaaaugagcaccaagcccugagggcuugggagagacggcggagugccuuuaugcugaucuuugggggacauacggaauuagcuuccagagcacuuaggaagucugguuucuuagucccagaccgagaagccuaccuuaagggccuaggccacuccccucagucauaacuuaguccccaaagaaauagauguuuagcaaaagauggcgagagucagaaguggucaggguggagacugccugacagacagcugcugagaagacaggguuaggaucuaacaggaaaccaagaguugcuugagggaaggauaaaggaccuucuucugcccccaaaucgacccggccaaguucccuuccuuagacaucucaggaugaucacacuggagcagggaagcuuugaaacuauccaguuacuuaaaaguaagacuaaaccuagaagggcaauguguguugccugaggagagcgucccggcucccuaucuauacccugggugcugaauaugaagacuucgacuaucugugggaucaggggcucgggugccaggagcucggugggcuuugcucaacauggccaggcucuguucucggaagcaggccugcuggaaauccccacucagguaauccaccguuugcaucaagcuguucuggcuugccacuggaccacccccagucccugcucgguagugggccccaggagcugccccacagucgaggggugcacccgugggcugcccaccauggaauggcaugguuaggucuugagaccccgagcugucgcuauugggaguugguagaauguuguuccacagggguuggaaguaguggccauucggguaggccaguggggcugguaggccguugaccgguggggauggggucggcuucuccagggguggcuucagauggaaggacugugccaggcagaguuccuguggguaggcagcggccuugcccacaaaaccaggcccugccaacucacguccugcuguauguuugccugucaggccaggggcuggcgucccaccggccucgcugcacaucuguuguaggugagccagcuggugcugguuccagguaacuggcuugaggucgcuaggguagccagugggggcucgagagaugccugugggcagguugacaggaccugcagcaggcagugcggcuguggccgcgugggugugcuccaugggauugaccacacaugaaggcauugguguggggacgcugugggucgacacccgggugcuugcauugaugagcagacugcgacuaauagggcugggguuggcgaucuggcccucacacacugagguagugcugaugccugcccucgucuggcaaaacugguugaucuggugcacaaugcugcucagguccgggggcuggcuguguugcaggguggccgccauugaaagggggauaguugagguagacacggucacauucgggggugcaucugagucuggcaucuuccggccuccaugcagcaagggauuaggggggugcuggagacccugaugagucagggccugaggguggaccaagcccuggguuugggccaucugcugaggguggcccaggcccugaggcugcuggaggcucugagggugagacagugccugugguggugguauacccugaggguguugcagugucuggggaggggcaugggccagggucugugcaugcugcagagccugcuggcgggccagagccugggccugugggugggcuaaagugcugggugccacaguagcauagggugccacugggggguucaugauggccucagggaggaaccgagcucgggugccgucaaaguccuugaguaugcuuuuggcuggcacuuugacaauggcaagcaggccugccuugguggcggccugagucggguaggggcuguagcgcugggcugaugugucgaggccguucacaguacgacgaacguguuuccgcuggggaaccuucacacuguuggggaagauuuuuauagucaguggguuguuugcgaccuucuuagcauacgcguccaauucggcuggggugggauagugagcaguucucauuuucuguguaguguccccuagagagagagaaagagagagagagagaaagagagggaaggagagcagagaggaagggcucaucagugccaagccaaccagccuuccuagacgcccuacugaagccaugacgacaggaugccaagccaaccagccuuccuagacgcccuacugaagagauggggcagggggcugucaucuacagcauucacucuagauaaaaccacaguccccacaaccacaagcacagcugacacucacuggggacgcacacuaggccaggccugggaguaacccucacuacuacugcagggggcaggaccacugggagccuguuucagaggucucuauggaucaggguggaaaaacaacuuuccaagucucuagcuuggaaaucuagaguguagccgguucucauggacaucaccaagaguacagcaugaggcuccaaguucccaccugcccggacggugcaggguuaaagcuuuaagcagagccgccugccagugcccuccucagucauuccugacacugguuaaggggacacucuuagucccuaggcagacauucagucugcaguggcuagcgaggcagcuggggugcuucggccauggguguacaggcccaucuggcacagggaauaagaugcuuucucaggagagaaggaggaagcugccaacucucccacucacaaguucacgucuguuuacaguuuacugggggccugacuggcugaagaucaaaaggcuuuauuuauuugccuauguggaggacagcagggagggacugagaagacgacacaggccaucucuaaguccuggguggcaaacaccaucuguauuucauccauggcaacugucacuuuccaaaaaggagaaggaaagauuugccuuccuuuggagacugcaggaauacccacucagugugcuucauuaauguuaacagucuccuuguucucaucuccgggugccucccaucaggggacuccagcggaugcuggguuuccaauccaaagggaacauuuuccauaacaagaccucuuuaaggaugccaggcucccuccuacaagggagcucugcuguuuucuucucucagagaagggggucuacccugagcacacacaaaaagaacuuaauaaacacuugcugaaugaguaaguauacgcacugcccaaagcagaggaaaaauggcuuggcacagagccugggcucagcuggcugacucccucccugcuuccucccuuggcagaaagaagccaggaaagaccaagggcuagucuguuagugcccagcugguagcucugguuggccuuggcccaauggagccuccauucagagccaugucaccgggcaucaauggagcagaagcagacccaggggagcaugguagaagaacugggggggaaacugcuguucucugaagcaggaaaagacaaaguucaagucuaggagaaacaaguauguggucccaugcucaaaaagcagaccagagcuggggauguacccggcuccggcuacgcuuccaucucaucagccuaaaacacuguccaauuuaccuugacaucaaccagcucauuuagaagaaauuguuaccagaaaacucucuaaaagacacaacuuuaaaagccacccaaaugauuucuuuggcucugguuaaugucagcagcagcagggaaagaggcagggccuugugacaucacuaacaguggccugcagaagucccugucuucagacagaccuuuacugaggcaaacccaggauuccugguuucaucauggaagagaauuucaggaaaagugaguauccugaaaaaaaaaucuauuaaaaaaaaaaaagaaagauuuauuuauuuauuuauuauauguaaguauacuguagcugucuucagacauuccagaagagggcaucagaucucauuacagacgguugugagccaccaugugguugcugggauuugaacucaggaccuuuggaagagcagucgguguucuuaacugcugagccaucucuccagcccucaaagcauauuuacaacgggcauagacaccauccuaagucacauuauuuagaguguauaauucauuacaagguuuaaagacugaaaauuuuuguuuuaggucuaaauguaaaaaauucuuuuaauaucauuuuggccaguagugguacaugcuuuuaauccuaucauucagggugcagaggcagguggaucacuucaaguucaaggccagccuggucuacagagaaaguugccagccaguacuacauagggacuggucuuauacauuaaaaaaaauuaaaauauguuuuaugcuaccaugucuguaagugccucuggaggccagaagagggcgcugaacucccuggaacuggaggauggacuacugugaggcaccaguguguuggaaauugaauccagguccucuggcagagcagccacugcucuucacugcugaucuuucucccuagcuccacuaagauacauaaguugggguuuuuguuuuguuuuguuuuuuaagaauuucauuuuguaaaugaagauguaagguagauuuuugaguacuuuuuacaucugggagagugaaaccugugucuagggaaauguauguugccucacugguggagucaggacagauagaacagguuccuggguagacagccucuuuccuuccuucccauuucuaggcacauuuucuaccauucuauucuaccucaucaaaacuuacagagcaggcggaguucugggccggcaugcucuguagaaaguuccaggacuaaauacaggugguggugcaggccuuuaaucccagcacuugagaggcagaggcaggcggauuucugaguucgaggccagccuggucuacagcaugaguuucaggacagacacagacacagcuacacagagaaacccugucucgaaaaaccaaaaaaaaagcaagcaagcaagcaagcaaacaaaaauaccaacaacuaacacagacuuuucucccucuuguuuuaauuacugauucuuguuucucuuguguguauaacuguaugugaaugauauggagggaugucagagcacaauucugugcaacugguucucuccugccaccucuauguggggucugggaguugaacccagguagcuaagcuugcauagcaggcaccuuaccuacucagccaggucagcagugccccacucccguuaugcuuuuggaauccagacuucaucagacaacagggcugucccugaaauggcagagacccuccugacucagccaugucaguguuagaaucccaggugcaagccacugugcucagcucccaccaagcccacacucacuguguuucuggcucauguaugucucucuccuggucucuuaacguucauauuuauaucuaauuuaaagccuucaugggucuagggcuacacuugguuaguaagguucugguuuggaucccccaaaaugcauuaaccgggcaugaucuuguauaccuaugaucccagaacuuggaagauaggagcaagaagaaucagaaauuuaaggucacccucaaccucaaagagagcuaaaggcuagccugggauacgugacacucuauuuuucguuuuuucuucugagacaggguuucucuguguagcccaaacucaaucuauagaccagguuggccucaaacagagauccaccuauccuugagugcuuggaauaaaggcauguuccauugccacuuggcuaugacacuaaaugaauggaucaacugaaaccugugugugugcaugcaugcauguauguacaugugcaucuucgagagugcguguguuugugugugucuguguguuucccguguguuuaccuguggaggccaaaugacaccagcuaccuucaacaaucacuccucuauuucauucucccucauucuuaaaaaaaaaaaaaaaucaguacuuugagaauuuuguauaacuauuuugaucaaauucaugccuuccccuacagauccaauccuuacuaccauaauugagacagaguuuguagcucguuaacuccaaaagacuagccagcuaguaagccucccagauuuuuguaagcacagcggagcuuggcuuuccuuggguacuggggagccaaauccaggucuuccugguggcaaaugagcuauccucuuaguucguaaaaccuaccuuauuaaccucuaacacugccucauacuaacuauuccugaaauucuuuuugggcacgcgcguccgcggaggcccagccugugagcauucuggaacuggcugcaaggguuguuaaacaugagccugcggaagcaacccccuagcgacuucuuaaagcagaucaucggacggccaguuguggugaaauuaaauucuggcguggauuaucgaggggucuuggccugccuggauggcuacaugaauauagcccuggaacagacagaggaguauguaaauggacagcugaagaauaaguacggagaugcguucauccguggaaacaaugugcuguacauaaguacacagaagagguggaugugagacaccaggaggcacugcucuucagagauggacagaugaagugguuuugguucucuuaccaucuuaguuggccuguuuucaugguggcuggugggaguuuguuuguuuguuuaauugacauuggaauaagauagagguauugcauuacagauugacucuuaaguuuuucacacacacaaaaaaagaaau

SEQ ID NO: 6198 - RNA, 5834 nt, Mus musculus
cggcgaaacgggggcgucugucgaguccggcgucuuucucugacuuugaacucaaccuagaggcuaagucguguuuccccaacgagggaucagagaauagucguucuggguuucuugacgagucccucagugcucagaaccguaccagccacaucgcacacgcgugacuugggcauagguaguuagacuggagcgauaaggcgcccacuuauguugcccggcaaaaaaacaagauuguucuuucagaggucuaaugcgaguggaaugcgaagaucgauacaguccccacuguccgggacgaguuggcacuaccucagaaagauaaagggauucucaugauuggcacguaaaguauaaaccaccaaaaccgagccggucuguguggggagaggagcggcguuauuugguguuugccgagggagggaccgggaaaaccccaguuggacaaacugauucaccugaagaguacaugacguggucucuugguuguaacaacuacugagcacagugcucucgguuucucagaauccgcacaaaacgcugccguagggggacucggagcuuuacucaaaacuuauagcgucgcgguagggggaaacccagagaagguucuaugcuucuguccagaaauagugggcugguugguaucgcugcuaggguuucgaccaggaugaaugaaauccugacuucuucaugacgccugcagcucuaagggaguuauaaaaugucaguauucaggaggugguccuuagcuaacaacguuccuauuucucagugggcgagagaaggguuguuuauuuuuugucccugccccgccccaaacuagccuacguggagggaaccuguggucacuggcucaggccggaguuggcuggggaagcaaagagggagugcugggguaaaacgcucacacaaaacauuacaucgugcuaucacuuaguaaccgaaugggccuugagugacccuggggaccucugggaguuaauguguaacccuggaaccaucagggaaggcagcaaauacccaaaaggcauaggugccugggagucugagcuugggcuuuugccccucaacaucuugaaacaccguucuccuaguccccacuuuuugcccucguuguccacuuccaccucccaaaggcacacucccuucauucagcaccgccucuggguugcuccuuuucuccuggucugccgaucccgcuccgcagagcaacugccuuacucucuggaguggaggcgggcuuggaucccgcaucacagugaggacagacugacaccuaguggccagaagccgcaucuacuccaggccgcugcccuggagagagggucaccccagcugucugggcaaaucggcagccuuccccgccccagccuccaaggagccagaagaggguugggacugucugagggaggacugugacaaccgcuguguuccaggagcccaagaacgauggggagaaguguggugauggugggugacucaacaguuccuaagcaccacucgugcggggcgcgggagaagcagguaaacacgucgaucccgguccaagagaggaaucgagucugggcggagccguggucugaggcggcgcuccugagcccccggguuuagcguucagcagcccggucugugcgacggucccgcccagcucugcccugaaagaguugagagaggagcguucucgcagaaccugcccaggguguaggagcugguggcggcagagaaagucgggaagugggcuaguggggccguacgcacgagggcggccgaggacgccuucggaugucgggaggcgccagacagggugccucggcaacgauggcgaggacagccccuucgcgcucgaagucggccgauuccgggcggggcccugggggacaccggccucgcgcccuccucgcggcagaggcgcccgaggggcgggggcaggcggcggggcggggcgggggcgagggcggcaggggcgggcagaggccucacugggaacgcggggaggagcgaaggggccuugagggcuccgcgaaacuguggggcuggcggcccgcggcagaaacgaucguggcgcgcuggccagagaaggaacgguguucccagaacugucggaggagacggcuuaaggggcggacagacagacggcaggaagggucagcaugccccuacuguuccaccccgccuggccgcugcuccugggcgccacgcugaccuuccgggcacuccggcgcgugcucugucgccugccccagccugcacacgugcaaaccgacccccugcgcaccuggcguuggcacaaccuacucgucucuuucacccacuccauuguaucagggaucugggcacugcuguggugagugaacaacccgggguaaaugagauggccgugggaucuuucgcggggugcucggacugggcucccucuugcuauucccaucacgggugaacagacgccaaggaucucaccugauuccguuuggaaaacuacccaaccaagaacggcugugggaaacccaagguaccugggcuuuggccaagucccuccuuacucuucaaccagccaauaguaggcgcacagagcacccugggacuggcaagacuguugggggaggcgaggguccuccgggaggcuacaaccgcgagaacaucccuuuucucuauuccagcuuauggcaaaccccugaaaugcugguggagauugaaacagcguggucagcuucuggcuauuugcuuguuugcuucucugcagguagguuaugcccaagaagguuaagauuagauuggaagauaauuucaaaguguucagucuuuuccucuuucccuaccucuccacuaggauacuuuauccacgacacaguggacauugugguuagcaagcaaacucgagcuucuugggaauaccuuguucaucaugucaugguaagggagaacccggugaaaugacacaggcaaaaucuucacaaccccuggagccagggagggaggccaucuuaacccagcagcgucugacuucuaaguugccuaagacucucucaauguuuaaacaccuucuggggacagcagagugccuaggccuaucuacuaucuagguaaacagaccaggaugucauacagaguuagacccucguggacaaagucuaacgcuagugaauaaagaaaccuuagcaguaaaguugguguuccucagcuuccgacugauaugaccuguuuucaugggcccuuguucugucacuuguccccuaggcuaugggcgccuucuucucugguaucuuuuggaaaagauuuguuggugguggcgucuuaacacuacugguagaggucagcaacaucuuccucaccuuaaggaugaugaugaagauaaacaaugcucaggaucuccuccucuacaaggucaacaaguauaucaacuuggucauguacuuccucuuccgauuggccccucaggccuaccucaccaaguucuuccuacaguaugcuggccagaggacccugggcacauucuuguuggccauccugcucaugcuggacuugaugauaaucaucuacuuuucucgccuccuccgcucugauuucugcccugaacgugcacccaggcgccaacaaaaagacaaauucuugacugagugagaaaguagaacccaggacuuguaaaagggauggcaagcacagccaauugcucuguaacauaaacuaguacucugccccaagcuuggguguauucuggggccagccuuuccaccuuaagcuuacacccacacuauugaaaacacuaaugaaagcucucugaaguccuguucuugggcaaggguugagggaagcagaccaaccgguugggcauggcuaaaugggugaggacaagacacuguccaaaagccugccaacccauacugcccugaaauggaugcugacaauucuaaaauaaccccucugcucuuccaaacccugguauugguuucacaccagccuguagcagggaaggaauucuuguaaagcuuguccuuugagccugugauggagcagugucccaggagaaccaacaccugucuauaauaaaugacccugguacugagcuagcauggggacugcaucaucauguguccccauuggguuaagcaaaucaagucuuaauugcucagagcugagaaagcccuggguuugaucccagcacccaccccgcagcauggccuuguccccagcccaacuagaaagcgacaaaugacaagcagcauuauuuauggugaaaaaaguauauauuuagaauuagccaucuggacucaguuuagaugaucccaaucugaaaaacaaaacaaaacggagcugaguuacuggagcugaauuccuuaagguuaagugugcugggaggacaggacagggagggcggggcuuguuagagagugcagucagauuugcuguugaugcagcaucuaaacagagaaaugauuaugcuuaccuuguuggcaacaucuagggcaucauaaucaggagccaagcgaacauacgccuucuucucuccgucgggccuguguggagaaggaagccucagaguuagaugcucacaaccccugcccuucccacacccuucccauaucccuccucagcaucagugguuccuuuguuggugucauucuuuuccaaacauugaguuuuccaucauuugcacagagcuuaaguaaaggcccacaagcuuucugaucucugccuggcccaacucaccuuaucaggguauugacuuuggccacaucgaugucauagaguuucuugacagccuguuugaucugaugcuuauuggccuugacauccacaaugaacacaagaguguuguuguccucuauuuucuucauggcugacuccguggucagugggaauuugaugauagcauaguggucaagccuagggagagaugggagaggaaaauggaguuagcugcccuggugccagcauucaacacaugguuuacuuuagaaccagacuaggaaagaauaggugcaucagacaauagaucacaaucaucuuuaucagacuuuggucgcuaaauaaugucaucacaugcacccaaaccacuaugggcucaacuucccauuuacagucaaauccuguauauucucuugacuaaagaaucaaguuuaauuuaugcauuuauccacuggaguuccacauuuacuauuaugagaccagaucaaauaaauaacuauagagaaaauugugcucaauugcuagagguuggcuacaccccaagaguguaguugaggcaggggcucacaauacagcacaagcuagccugaaauccaagagccacacucacucacacccgccccucugaucugagacaugaaccccaagaugaccuuggacuugagauucucuagccuccaccacccagcauuacagaauaaccaccaagcauggugaaaacaaugcaacucuaaaauuggccuugagcuaucaggaaacaacuuuuucuuaagauucugaaaagccaaguuuuuacuuaugcaacugccaaguaaugacucaaaaauucuagguacaaauaggcaaugaauugugucuggugaguacuucccccauagacaaaacacuuuucaguaagcauucucucaaacuuccuuugaguagcgucagaauuugaucaauuaagugucuuucaggcuggagagauggcucaucuguugagaacacugacuguucuuccagagguccugaguucaauucccagcaaccacacgguggcucacaaaugucuguagugggauccgaugcccccuucuagugaguguaucugaagacugcugcaguguacucauguaaauaaaaaaacaaauaaaucuuaaaaaaaaaag

SEQ ID NO: 6199 - RNA, 2666 nt, Mus musculus
uaagcucaugggaauugggcugggccauccuuuucagccaagauggcgccgaaagcgaagaaggaagguauguugcgguaugggaaucugucaggucggucuuggauacccgcagagcgaacucgcggggaagaagaaugcccggcuaagccauggggggcuuguucuguggcuacugucgcgacuaggccccgcugcgggguaugaggaccgcgugggccaagccgcaugggcugguuccagugcaggggauuggcaaagccaccgggccggcagcggccgccacugauggccaagcauuugacuuugggaagcuccuuaacauccacaggguggcgcuccgggucuccagaccuauaagggauuaaaaguaguccuuauucgcccuuuccccacguuaaaugggguuauacgcacccacgugaugguacaacggguuaauuaucuuugccugugguaucgugcauaugauggaaaaaaucugaagucuccugagaccugugaugucuucaaaggaaccacugaugcacaugcuggcaggacggccggaaggggucacuuuacgaaugccacacuuaauuuuaauuguccucucccagcuccugccccucccaaagccgaagccaaagcgaaggccuugaaagcuaagaaggcggugcugaaaggcguccacagccacaaaaagaagaagauccgaacgucacccaccuuccggcggcccaagacccugcggcuccggaggcagccaaaauauccucggaagagugcgcccaggagaaacaagucaguagggacccuggacccaguagcauguaguagggcauuaggaguucuuaacguagcuucccuuauaaaacacaauuguugaaggagcuggugcgguggaagugugagguuauuuagucaguguuugaaaguugacuucaaagagauguugcuuaucuugguuccaagugauaggggacuuguuggaacacaggagaguguugauuaagauguccaauuggggagugauggccuucgaauaguguuaugaaacacacuuuuuuuuuuaagauuuauuuguuuuuuuauuuacaugaguacacugcagcagucuucagauacacucacuagaagggggcaucggaucccacuacagacauuugugagccaccgugugguugcugggaauugaacucaggaccucuggaagaacagucaguguucucaacagaugagccaucucuccagccugaaagacacuuaauugaucaaauucugacgcuacucaaaggaaguuugagagaaugcuuacugaaaaguguuuugucuaugggggaaguacucaccagacacaauucauugccuauuuguaccuagaauuuuugagucauuacuuggcaguugcauaaguaaaaacuuggcuuuucagaaucuuaagaaaaaguuguuuccugauagcucaaggccaauuuuagaguugcauuguuuucaccaugcuuggugguuauucuguaaugcugggugguggaggcuagagaaucucaaguccaaggucaucuugggguucaugucucagaucagaggggcgggugugagugaguguggcucuuggauuucaggcuagcuugugcuguauugugagccccugccucaacuacacucuugggguguagccaaccucuagcaauugagcacaauuuucucuauaguuauuuauuugaucuggucucauaauaguaaauguggaacuccaguggauaaaugcauaaauuaaacuugauucuuuagucaagagaauauacaggauuugacuguaaaugggaaguugagcccauagugguuugggugcaugugaugacauuauuuagcgaccaaagucugauaaagaugauugugaucuauugucugaugcaccuauucuuuccuagucugguucuaaaguaaaccauguguugaaugcuggcaccagggcagcuaacuccauuuuccucucccaucucucccuaggcuugaccacuaugcuaucaucaaauucccacugaccacggagucagccaugaagaaaauagaggacaacaacacucuuguguucauuguggaugucaaggccaauaagcaucagaucaaacaggcugucaagaaacucuaugacaucgauguggccaaagucaauacccugauaaggugaguugggccaggcagagaucagaaagcuugugggccuuuacuuaagcucugugcaaaugauggaaaacucaauguuuggaaaagaaugacaccaacaaaggaaccacugaugcugaggagggauaugggaagggugugggaagggcagggguugugagcaucuaacucugaggcuuccuucuccacacaggcccgacggagagaagaaggcguauguucgcuuggcuccugauuaugaugcccuagauguugccaacaagguaagcauaaucauuucucuguuuagaugcugcaucaacagcaaaucugacugcacucucuaacaagccccgcccucccuguccuguccucccagcacacuuaaccuuaaggaauucagcuccaguaacucagcuccguuuuguuuuguuuuucagauugggaucaucuaaacugaguccagauggcuaauucuaaauauauacuuuuuucaccauaaauaaugcugcuuguca

SEQ ID NO: 6200 - RNA, 2349 nt, Mus musculus
uguguaugaguguuuugccugcaugaaacuguguagcacaugcaugcuuggugcaggaggagagaagagugugucuaaaccccuggaacucgggguacaggucggagcagaaacccugaucucuauaagaucagcagcaaguguucuuaauuacuuuuuuuuuugauugauugauuuauuauauguaacuacacuguagcugucuucagacauucuagaagagggagucagaucuuguuacagaugauugucagacaccaugugguugcugggauuugaacucaggaccuuuggaagagcagucagugcucuuaaccucugagccuucuugaacugucucuccaaaccuaaucauuguuuuccuccuccuccucuuccucccucuccuccuccucuuaguucuugagacaggaccucacaacacaacucugaauugccuggagcucuuuaaguaaaucagguuggcuucaaacucacaaaggucuaccucugccuccaagugcaucacauccagauuuauuuuaagacaaaagucaccgggcaagguggcgcacgccuuuaaucccagcacucaggaggcagaggcaggcggauuucugaguucgaggccagccuggucuacaaagugaguuccaggacagccagggcuauacagagaaacccugucucgaaaaaaaccaaaaaaaaaaaaaaaaaaaaaaaaagacaaaagucauacucuguaguccaggcuggcuuuaaaguaaaguccccagccucauaagugcuagaaccacaggugucagcccccgugcuagacgccaguaaugauccuuaaguaguuuuagccacagcugagacagcugugauuucucuuacucuaguuuuucuugugaauaauuucauaguccucaauccugaacuagucuuccccuucuaauacuguauuccacucauuuuuguaucuucaaauuuagcuccaaacauauaaacauauaucaauuucuucuuugcgcgggcgguguguguguacaaaaaggaaaagcuguucugguuuugacuguucuauuccggcuagaaaauguucauccguauuagaagcaggguucugcaaucccauaguggugagugaccacgccaaaagacgaaguuucacagucuaccuaacacuucuuuaucuuucauggaaggaggcucgacgggagaagucaacagaucugggacgucugguccuuaguggacaccucguucagaucuugacacccccguuaggagaucccucucaccucccagggcagaagggcgagcaggggcagacucuaugagucaugugccaggccuggagucguggagggaagcaccgccucuccuugggccccuucucucccccuuuuccccucggcggcuccgggucuugccagaugcugugcuacaaucacggguuccccaucaccaguuccguuggguaaguggucccggggaagacgcggcuccaacagggagauggaggggagagacuuaagggaucccagucuggaaaggcuccagucuggguguaggcgguccuggcguuggguagggcaucuggagcccgggcagcgcgcgaggaggagaggagaggaggggguuggcgagggccgcgcugaaggcggcugcaaacccgggagcgacggggugcggggcagggggcggcccuucuccaggaauuuccggggaucguguugcaacgcucgcagagugggacggcgggccucgcugcgcgucuaggguugucgcccccuccucucaccggucgagggcgucggcaguugcugccccugcgcaaagugaccccguguggcggggcggccccgagcccccccaggccucucuguuaugguagggccaucccagccccgaguugucgucgggucuccgcggccccggguuaucguaggggcuauccgaccccgugucauuguaggauccgcgcgggcccgggcuccccgggacgcgacuccccgcccacaacuagcggccgggggaucuccccgcccccgaguggucuucgggacgccccgggcucgggugauugugggcucucccagacccggggugauugucucguccccuuggcccgcgguggucguagcgucuccaaggccgagggcucccacaggcucuccguggccccgggugauugucgguaccccgcggccgcggauaaucgucgggucuccacgggucccggccgccggggcggaucaggccucugcgccuucccggggagccccgcaaggccgcagacaagaugaacauucuggcgcccgugcggagggaccgcguccuggcggagcugccccagguaggcaccagggccacgucgggccu

SEQ ID NO: 6201 - RNA, 11896 nt, Mus musculus
augaauaaaagucuuuuuauuuauuuauuuauucauuauuuuggagaaagacaaaacaggagaaaucacaaauuaagaauccaugaugcccaguuccugcggaguuacacuucccagcuaagacaggcaagcuccucaacuucuuuuaccagcaugaagaaagcuaucuccaccuucacagacgagugaguccuuucccgagagaacugacuaagccugggagagcaaccaauucaagugugaagggcugcaggucccaaggcagcacgcucagaggaccuggagcagggaucccgcaguaaagcagcagcagaugucuacaaacacuguguggcgacaguggcucagaguauuuagagucacagcucugcaugauggaccucugcccucagcaacucacugggcuucaugaagaugccuuccauggccuuccaguaguuguucugacuuggcugggccauaccauguaccucuuuuuguccacuuaugggucguccguacuguucuccugugacagacagcaguacgucaguggaagaauguuugaaccucaccucaccaucucuaacccaguaagguccauuacagagcacuguccagucauccagauagucgccuucaccuucuucgccaaaggcacucacuuccuaaaagacacaaaaugguaacauuaacaccugguggucagggcuggggagauggcucagcagguaagagcacugacugcucuuccaaagguccugaauucaaauuccagcaaccacauggugacucacaaccacucauaaugagaucugacacccucuucuggugcaucugaagucagcuacaguguacuuauguauaauaauaaauaaauauuugggaaaaaaacaacaacaacauguggugguuaggucugaagaguggaggaauggagcugagaaugguggagcccaccacagcuguaauauuagggaacuggagauaagagcauuagggaggucaagaucaacuggcuacauagacaguuugaggcuagccuaagcuagaagagacccugucuccaaauaauaaggagucagugagaagaaaaauaaaacugcccaagagaaacaggauugggacuuucuaguguuaaugcacaaauauuugugcuguuguuguuuugagacaggguuuuuuuguguagaccaggcuguccuggaacuugcacuguagaucagacuggacucagagaucugccugccuuuggcuccuacgugauggaauuaaaggcgugugccacgauacccagcuuguugaacauuuuuuucugcaugagauaaacugugagggaauaaaaagacacaaagggcacaaggaagaaugagcugucucgccgggugugguggcccacgccuuuaaucccagcacuccggaggcagaggcggcggauuucugaguucgaggccagccugaucuacaaagugaguuccaggacagccagagcuacacagagaaacccugucucaaaaaccaaagaaaaaaaaaaaaaaaaaaaaaagaaugagcugucucagauuaugacccaagcacugacauacuaugucauauguuuuuuuuaauuuauuuuuuuaauuuuuuaaaauuuauacauugaagauuuauaaaaaaaaaaaaucaggcacuagauguuaaauaauaauugaccaugaggcuagagaguuaguucagugguuaagagcacugaccguuaaagauuuauuaaccugcuccuggaaauaugccacuagccuuggacgacagcgcccacugaauacauacuuuuagaauuguuauauuuugaugauuuauaaugauguuaccuguucuguuugugaugcacugaauaaauaguuucagaguugcaaugcuuggaugauuuuugugcuauacugugccaaaugauuuuuguugguaugugauuguuuuacuggauauaguuucuaagagauguaauguuugguuuuuuaauguauaaaauccucugcuugagagcugcaaaauacauucauucaaacugccucuguguucguuucuguuugucaccgucgaauccuuacccaccuaaguucgaggacacucauuccagggaccccaaaaccugacuggggugguccauggcaggaguccaugugggcucaaguguucuuucuuuuaagcaggugagacuaugguguacacuacugcauuuggucuucugaacaaacucaucacuuauuuuaacuucuggggagaggauaauacaaccauacacuuguuuccagggauccggcacccucacagacacauacaggcaaaaugcuaaugugccuaaaguaaaaauaaaacaaaaccaaaaauggagaaguggcucagagguuaagagcacuuacuguucuuccugguuccugaguucaauucccaguaacuacaaccaucuguaauaagaucuuuuuuuuuuuuuaaauauuuuuuuuuuaagauuuuuauuuauuauuguaucuaaguacacuguagcugucuucagaugcaccagaagagggcgucagaucucauuaugggugguugugagccaccaugugguugcugagauuugaacucaggaccuuuggaagagcagucggugcucuuaaccacugagccaucucuccagcccccuguaauaggaucuuauacauaaaauuaaaaaguuuuuaaaaaguuaaaaacaaaaacaaacaaacgaacaaaaaaccccaaaaccaacucagagcauaugcugcccuuccagaggacccaggucugauaaccagcaacccacacagccaucacaaccaucgguagccccagcuccaggggaucugacgcccacuucuggccuccaaggacaaugcacacacaacacagugcacagcuauacgucuaggaaaacacucaaacacauaaagauaaaaaauaauucuagucaggcacgacgagguacaccuauacuuucaaaauguaacaggcugaggcaggaggaacaccuugagcuccuggcugacuggagcugcauggugaguccaaggcuaguacagcgaagcccugccucaaauaaauagaugcaugcacacacaccacagucaggggcuggagagguggcucaguggauaagggcuucuugagcauucaugaagcccuggcuuugguccccagcacagccccaaacuaggcaugguggcacaugccuauaaccuugggaagcuggaagguacagucaggagcuucaagagucagggaccagcugagcuauagugaaugggaagccagcccuggcuacauaagaccuugucuuaaacaaacacaauccaaccuggcaugugucauauguagugaucuacauccagaaaauuauuuuuguuacuucuuuauaacuguaauuuugcuauuguuuuaaauuauaauguaaaaaucuguaggugacccuguaaaaggguuauuugacaauuccagagaggucaugacccacagguugagagucacugcuuuagaccaucugugauugacuacacagugacccugucucaaaaauaaaacaaaaaccaauaauuuuaauuuuuuguucuuauacauacaaguauuugccugcaaguacguugcuguaucacuagagugccugguguccagggagaccagaagugagcgucugaucccccggaccuggaauaaacugagcuaccaugugagaacugagccuggauccuuuagaagagccgccagugcuccuaacugcugagccaucucuccagcccuguacucuuuauuguaccaacuuacuaguuuuuuuuguuuuuuuuuuuugguuuuguuuguuuguuuuguuuuguuuuuuucgagacaggguuucucugaauagcccuggcuguccuggaacucacuuuguagaccaggcuggcuucgaacucagaaauccgccugccucugccuccugagugcggggauuccaggcgugcgccaccacgccuggcuuaacuuacugguauuuuaauguauccuauuuugacuucccucacuuugguuuagaugaccugaaaccauuuucuucacacuuaagaaagagauagagucauuucuccaagucugcagaaaagagaaugucuuaccuagaaaggaaaggguuaaugugcuccuuauagcaacgcauauacuaaaauuggauaaucaaggaggacauacaaguuugugaagugucucauauuuauaaaagaaggaaggaaggagcgagcuaagcaccaagaggccagacaaguagcaaagcaggaacacccaccgccugccaucucaccugguuuccagagagaggugaagugaaaugguggcugugcagguuucgaccuguguugaugugugucagacggaugggcugcccgcauuugauggggguuccccuuucacacacuguggcugucuucccccguauccuccaguaacuguugcugucauccacagaggucacaccugucacugacugcugcccacuaccugcaggcaaaacacaaaggcaaagaggagaggcagucuggggaugaccaacgcccugacaagcuguuugugccuugaugggaguaaucaaggaaaacuucugcuaagcuugcuuggcuccuaggaaaaccucuaucacaccuccuucuacagcaucucuagaucuugacauuucacuccuuuuuuuuuuuuuuaagauuuacuuaaucauuauauauauauaguacacuguagcugucuucagacacaccagaagaaggcaucagaucccauuucagaugguuuugagccaccaugugguugcugggaauuuaacucagaaccucuggaagagcaguuagugcucuuaaccagcugagccaucucuccagccaccaacauuucuuaaacacuggguauuauggaacaccagucaugacugugacugaacuaaggacagacgcaaggacaccaaguuguagcauacugacuauggaauaagauguccugugagagccauuugugaaucuucauugaaccuuuaaggccuuggacaagcacaugaauucgauccucuguagcugugaugaauucagccaaaucacgagacaagaugcuaaauagccagaguaugaagaaaaacagguuuuaggucuagaguuaugugcagagaacuugauaucauuggcuaugaaaaagcuaccuucuaaagauacuggauacuuggaugcuccuuacuccuccugcuggggauucugggauugagagaaagguuagcagaggaguuccagcuaagguacccaaucccagaaggccaugucugaguagcuggagauccauccugggagguagugagagcauagagaagagggacugcagcagcuguugcugugacugccaaugacaacuucacaucucccacugagguccugccaagauggggggccccaccaccaugaaucauggcaugugugauggucugagaucacccacggggucaucaguuagccuuccucugauccucugauugagggguacccaugcuagguaugcccucucuaggauugagacccccuuccuaaggaauguauccaagaaccuggauauuguuggcaaauaccagccuuucuuuuuuuuuuuuuuaauuuauuaauauaucuaaguacacuguaguugucuucagaugcaccagaagagggcaucagaucucauuaaagaugacugugagcaaccaugugguugcugggauuugaacucaggaccuuuggaagagcagucaguacucuuaacugcugagccaucucuccagcccaauaccagccuuucuuuucccugaauggggucuuguaaaacugaguaguagccugugagcuuuuggcucccuuucugcacuaaccagagcuaacaguacaacuaauuaaacugauaaaagacaggccaagggagcucaaccuaagcccuuccucuucuggggccaaggaugugccccgugucacaaauggcauggaggggaggaaacauacguuugggaauauauuacuuccacaacauugacauuuaagacacacucaaugaguacgcuuaaacgggugugaaaggaccagggagauacccaagggugaaggcacaggcugccuaagccccagccuaaguuccaccccagagccacacaguagaaagagaaugaugccugcaaguuguuuucugguuaccaggccugauuauucgaguuccaccuucagaacccacauaaaaaaggacaggcacugugaacugugcccguaaucccagcacugggaagaugucacaagcagccuucagcuuacugccaagccagccuagccagccuggugagccccagguccccaugauagaucaugccucaagacacagagugggggcaagggagauggcuuagugggaaaaaguauuagccaugcuagcuuaacaucaauuuccagaacucagguaaaaacuauaaaagggagucaggcaugguagcauaccaaggcagaggcaggcagaugucugugaguuccaggacagucagggcucuguuacacacagaaaccaucuugaaaaaaacacucacgaacauacauacacacacacacacacacacacacacacacacacacuuucuuguuuugaaacagggucaccaagcccagugauacacaaaucuaagcauaaaaagagccaaugaauuggaucaaugguuaaagguauuuuggaguuauacuugaguucaauucugaagauucacaguaggagacagucaacacgccccaaguugucuuuuggcaaguuuuacucuaguuaggacuguauaguaaagccuugucucaaaaagccacaauaaaauauuuuuagaucauacaaauuuguagccauaccuuagcuaauauaauugugcauggugaaaacauugaguaacuguauguauguaaauaacuguagcucuuuuguuugcuuguuuguuuuucaagacuggguuucucuguguagcccuggcuguccuggaacucacuuuguagaccaggcuggccuccaauucagaaauccgcugccucugccucccaagugcugggauuaaaaguaugcgccaccacugcccagcagcuguagcucuuaaaaaggaaaauguacuaucaucagguauugggcuauguaaaaguaauugggggauuugcuccaccccuuuugcucccaaauaaggacaaggcguuucuugguccauucuaguccuuuuuggucccugaauaaaaggcacaggaaccuaauaaauguauuaaaaggcugugagcccuauagcuagacagaaagucaucuauucuacugugcuagcuuggcuacuccccagccucauggucguucaccugugaccugagccucaucagccccacucugcuccaccuguguucucauggccacuccuggucccuccauaucuucuuuucuucuuccucccccaaccccuucucacuccucugugggaccccaugacugggacgggaaguccugccuucccucucuccucugcucagucauuggcugaaucagcucuuuauuaaccaaucagaggugacggauaacaauuuuugcauaacacugaaacuggaagugcuuaaccuggccaacuucuggacugcaguuaaagagaagcauagaaauuagcaucugaauagaugaugcacaaacccaucccccaagagggcuaauccaaguucuucguuuaaaugauuuugauuuuuugauuuuuauuuuuuuaucgagacaggguuucucuguguaguccuagcugucuuggaacucacucuguagaccaggcugaccugaaauucaaagagauccaccugccucugcuuccuaaguguugggauuaaaggaauggcccaccaccacccgacugcuaauuuggauuuuuguuuguugaggcagugucucacuguguagcacuggcuggucugaaauucucuagguagaguggcugucuucagagauccugccucucucugccuccagaauauuaagacuaaaugccuccugcucuaccaccaccgcccagccuaacuccauuuuuauuuaguagagccagagcaggaaacauuaaauuaaaacguaguaaaacugccgggcagugguggcgcaugccuuuaaucccagcacuugggaggcagcagcaggcggauuucugaguucgaggccagccuggucuacaaagugaguuccaggacagccagggcuacacagagaaacccugucucgagaaaaagaaaaaaaaaaaaaaaaagaauguaguaagccugaguagguguuuacugaaugaggugguuaggaauguaaagacuacauacucccuggacuaaacugguaagacagguucugagaguugugaacagacuaaccaucuuagaaggucacuuccuuucuagcaaauagcaucaucaaucauucaaauuauaucacaaguacaccuccugucgaacuucaugacuuuauuuccuccagugugggggcagaagcuuuccguaugcucggcaaauacucuaacacugaaguaauuaccagccuuugaacuucuguuguuuugagacagcccccacuauauaggcuaggcugaucuugaaguuacaauccugcuucaaccuuuugagugcuacaauuacagaccuaggccaccacgccugcccauuagucuuguuuuauuguuugauucacuacuguauuuccuguaucuagaacaauacgagacacacuaaaagugcucuuuaaaucuaggccaaaugaaugagcccacgaauaagugaguauuuuaauugcacaugauaaaaaacagacuuuccucugcaaugucugucaaugcuuaaauucuuuacaagaaaguuauugcuaaguuagagugucaaaaaauaugagcuaaaaauaggugacauuuaaaaucugagauucagcuuauguugucuugcucuaaaugcuccucucuccagcacaaaauaguggcagcccauggaaucugaaagauuuugaaccugcacagauuuggauuaaacccugucuccaucauucacuagcuggcuuugagcaauaucucuaggucuauuuacucaccuaagaaaauaacuuuaguaucuguccucaauacaauguuaaaaaccggaaaguauauauguaacacguuuggcccacagcucaucaaacagaaacuaacauuaggacuaaguuuccuuggcaacucgucguccucuucaagaaauagggcacggcuaacuuucccagaccacgcccucagacuccgaggccccgccccuucuaggcucacccggccuaggcagcccacccagagcggugagucccccucuguaccugacccauagcgcacgucgugagaaugcagucggacauuguggcguguauugaguagcuucaccacggagccgcaaguaacgacagccauguuggacgcucccacagcgcuccacaaaccacccaacaacagaagcgacaagacagccauccuagauccgagagaacuaaucauccaagaaaauuaggcccguccccggaaccggaagccgaggguagaacuacgccaagauggaagagaagacuccuuaaccugaaucuuuaugguuccuuuggcgagagcggcuuaaagaacacgcuggcccgggaggccuucgggaccucacuuuguacugggugcucuguggcggcugcguuccuuaggcguucgcggacucggaaccaaagcccuagacgccggaggggaaaagacagcaggaaaugacccucccacucccagugacagagagccggaggugacguacuacguuaacgcagcagcggcgacgguggugguggugguggcggcggcugcggagggcccuugcgguggguccggacuauccuuuugcagucucugaucggcgacuccauuuucuucggugggagcuuagcguagcggagaagcagcggccuucaagcagguaacgcucagccuggagaguguguugcgugugugggugcgcagguggcgagccagacuccuggggccuggucccguaagggaagaagcuuuggggugccccacugcgggaaggaagggggcccuggcuuucccugaucugccaggggggaaaaggacaggaaaguaccgugauugcucagagucuccagcccuuucuccacgcgguaccacccggaaccugugaccugggguuaccucuugaaucaacaggcuuucugggaucccaucuucuccgcggcgucuggaaucugggccacgcaaaaaauugggacuagaagagagaccuaaggguuucuuuacuuggcaucaggugaucggauuaauuaguccggcguuuggguccugcugagcuuucgagaguucagccaugaggcggguguacugugcugaauguuagcucuuuacaaaauguugaguaauuauacgguuuuuuuuccacauaugggcaagucccuuaauccuuucuaaagaugcgaguuuauacuuaaguaccuggagccuuccaucuuguauaauucauuuccucgaacacuugccaaagaccuaucauaaauauuagaauugguuguuaaaucagaaauguguauuguuugacaucagguacucgaguaucuuaaguaaagcaguuccucuguauuacagaaagaaucgauuucuguuuuccuuuaggaggcgggucuccuguaauaauuacaugaaaagacacgguaauacaaaggucauaggguaauuuguuuuucaucccgccccacuccauucccgcugcuccccuucuucagaauccuccauuacuuauuacuuucauuaauuuguguguguguguguguguguguguguaugccucaauuaguuaauuuauggugguuuacaaguacaugggugaagaaguauucagagaagccugggcuacaacccuaaagaaaauguuccccucccccagcaaccaugaauuacuaucgauccuuaggguuggugggaucucaugaugagccccuccccccuagcaaccguuaacugcccauaaaccuguaggaagggaggagccuggucccccuccccagcauugaaguaugcuacaauguguggaagucguugaauuuaauuaauuuuggggagaaaaaguuuaguucuauuguugaacacucacaguuugugagucuucaguguuuuaguuacaaaacaauuauagcaacaauggagaagcugagccaggaggaucauggaauuuacguuuugguugcauuuguagacccugucucaaaaacagcucucccuucaaccacgaguuuagagccccucuccaugccuagugucccaccacuacaggcuuauuuuauuugguuggcuugugugacuauuagauuagacuagauuagauugguaaaguauuuuuuguuguuuuuauuuuuuucaagacaggguuucucuguauagcccuggcuguccugaaacugacucuguagaccaggcuggccucgaacucagaaauccgccugccucugccucccaagugcugggauuaaaggcaugcaccaccacugccuagcuuagacuggcaaagaauuaacacucuccaaaugaacuuaaucuuacuuaccaagugauauaucaagccagaaaguagaacaguccuaaaauccaaucaaagcuuauuuacucccucuaguucuuuuuuugguuuuugaagacagaaucacucuuucuaguuguccuugaauccacagagaucugcuuccugaguacuggggacuaaaggcuugugccaccaccauccagcaauauucuuguuccuaauaaauguaaucaccaucugggucgggugugaucacuggcuuccucacaaugauuucccaauaucaaucaccaaauccuauguuucagaaaagaccaaaccaaaccaaacca

SEQ ID NO: 6202 - RNA, 28918 nt, Mus musculus
gggcaguuaaaaaauguguuggguuagugaggagggaaggacacagacaacuugaacgcuuuuacucaauacaauuaaaaaaggccaacaucaaauuuaaaauauuuuuucuuuaaaucucuuuuuucuccauucuccugggcauaccccagggaggaaaguaagguacccauggccagcccuggcuccuaaugccauccucccaagugagcacagacugggaaguuuaucccccaaacccaacaccucuuagacaacaaggcaguggagugaggcacagaggaucagacuccuucccuuagcuuauuggcacaaagggagagcaauuacauuuagaaauauauauauauguuuuauauauauauaucuuuauaaaaauuuaucauacuugaucaaaacuaucccccaacccuuucuguugccccgaaagagcaggauacuaggcuuggacacaaucccugggucuucugguuuucuugccccuguggcccugggucuaaucccaugagagggaacccagcgcuuuguccaccaugcccugcagggacaggccagcuguugaacaaugucucucaguucccauaugccccacaaauccugcaggaugaagggaagcucugcccacccucaagucccuggauccugagccagagucaauucuauacuguagucacuugggucuccacaucacuugcgccugccgaagauggacuucuugccaggguucuugucgcccacacuuaaaccaaugaggagccgagcuuucucuucuuccugcuguugcauguucaggucacacuuuguuucuagcuuuccccggaccucagaccccguugcagguuucagccuuaguuuuucuuugauuaccuggcaguggaaaggaauaaaaggaaaggaaaaauuagugaaacgggguguacaauuuaaagugaaccaauucaaagauuuauuaagcuuauauguaaacacaaaagggcacuucaaaguauauagauaauagucugcuuguaagaagcuuacaaucuaaucagaaccaucauaaagcugauguuguagaagcccuuaauucccucaaaauuaaugagucacuagcauaccagggcaaaggcauggacaaacaaggacagaucagucauuaucugccccuuuccuggccaucucuuaauacagcacagaagagaaggcucuuaaaaaggcaaugugcuugccagucccugcuaacgaaacagccaugagcccuggcgagauaccugggcaaccagagcuuuucggcugucccuuuugacagccauggcaaaguccagccauguccacguguuguugugguacuccagacaggguagcaccaaguuaaggucgccccaguccacacuguucuucucacccugcaacaggaagagaaagagggaaaagagcugccauuuugaaucuaagccagaacucugaguagaauuccuacaacagcaaccgacauauuugaauucccucccauucuggugauggggcugacuccugcagaaagcaggacagguuugucacccauggcccacuuucacaggaagcccaacugucacccugucuauaaucuuuaguccccuuccuacucuaagugcugggauggaauauaccuuauaacugacacacaguggaacuugugggauuuuuauauauaugaaggaguuguucauggcagcucgcucuuucaucuugucaauaucaucaacugggugcugggaaagacagaaaaggagcauaagcccuaaaaccaccagagcaacccaagaugcuaaauuacuccacucucaguccuggagaagacuuaagaccaaaggaacaacacccacccagguccacagaaacuauuaauacccauuuaaaaaaucuaaacauacuaaaauguuuuuaccuuuuuguuucuuuuuuuguuuuuuuuuuuaagauuuauuuauuuauuauauggaaguacauuguagcugucuucagacacuccagaagagggagucagaucucgcuacggaugguugugagccaccaugugguugcugggauuugaacucuggaccuucggaagagcagucgggugcucuuacccacugagccaucucaccagccccuaccuuuuuguuucuuuugcuuuuuguuguuuuguuuugguagcaacaggguuucuuuguauaucauuccuggccugccucugcuucccaagugcugagauuaaaggugugugcccccaugcuaggcuucuuuugccuuuuuugagauaggaucucauacaguccaagcugcccuuggacuuaucuuccagcuccuguccucaaguguugaaauuauaguggaccaccacauuuagguucucugauuuucauaugccauaccucagguaauuugcgaaaugaucuucugacuccagaacuccuggucaagcccugugccacgcccuucccggagcccagugguacugcaucaucuguugcuaucagcugccgaggcuuuacaacugguauuccugugaaaaagcaugcaaaccaacagugacucucuuccugaagcugcuuuaggcugccacuccauauuccuggcauuccaacauaaccaauucuuaccaguagucaccaguuuggacuuauccucuucaucaccaacuucaucaucuucuacauuucgaccaggaaagaaaaagcccaucauucuauggaagaaccggugggacagcuggauggugagaggcaccacauuuaccugagagggaaagaggugaagaaacaauuaagcucaaguacuagcccugucuuugauuacuaacuaguuuaacaguuauaacuaguuaguuuugagcuaaccuuugaccaagaguucccaaggcauuguuuacuaaccucaaaguguuccuuaacagagauaccaccaacagguggccggacuuugcugaagaggcggagggcuagcugucucccagacuggcaggaacucuggggccuuagaaccaccuauaggauagagcggccaauaacucaacuauacaucucuuaaaaaaacaacuuaaaaguaaaucacaggucuucuguagaagaauugaagcaagagggaacugaagcaacggucuuugcuaagcuaggcaagcuguuccagcucaaaucacaaugcccucccucuggucagaagcuaaguggcuagggauggaaaaauaagucuugcuguauaaauguggggaugaaaauugguagagugcauaucacuuacaaggcccugccuaaaucccauucucccacaccccaagaaaagacuugccuuauaaauagcauuagggagaagguuguucauagugaaccagcccaacuccaggagauguucugcugugucaucagauuuauucaccuguaagacagauuuuguucuguucauuauaagcuaauaagcuaagccucugguuucauuucucucuuuccucuguaaaucaggaucuuguaaaguccaggcuaguccucaaagugugccuguggcuagcuuuggccuccuaacccuccuuaacuucacaucuggaaugcugggauuaaacauaagcaccaucacacccugcuaacaccucuuucaaucucauaugcaaccaacauacccucuaaaccaguguuucuucuaaguaaaacuagcuaaaccaguaacgguuaaguaacuuccuaguuauuguggcauuuaaauuucuuauucauuuucaauaucuuuuguaauuggaauauuucuccuugggcaacuacagaaaugcugucaguaucagaacagcacuauuccaacucaacuugguaauuacuucagucugggccuuauuuaauuaucuauauaacuacaucauuuauuacaggcugaugugucuccaaucaugaccaucauuaauaaauacaauuagcccccuuuuuucucuauggauugaaucaggccacgccugagacuuggcugcugcugugacugugccacccuaauaccuugcuguaaaggaaccucuguagcuccagcucagcgaugcccagcuguccaucuucuucugucaggcgccaacgugccugagcaaaguaaaacucggugcgacggaccacacucacaucuuccuguuguuuucgaagcuccauuuuauuggcucgcugcaguuggaaauccuuaaaacaucuaugcaugaauagaagauucaaagggguaaggaaaaaaacacacagccggagugcccuguaagcccagaaaccaacuuacucuggcuuaguuaauaacgacccccccccccaugucuuguuucugacacccugagcuauggguccuuuaguucuuuuuuuuuuuuuuuuuuuuuuuuuugagguuuuuguuguuguuguuggguuuuguuuuuuuuuccccgagacaggguuucucuguauagccccggcuguccuggaacucacuuuguagaccaggcuggccucgaacucagaaauccaccugccucugccucccaagugccgggauuaaaggugagcgccaccacacccggccauggguccuuuaguucuauggcuucuuaguaaagcacuguuuucccacuaacuccuaugauuucuauaucuuuaacuuucuucuuuacuguauuugcaguuuagauacacaccgcuaaggccacagaagugguauucaacuucucaauuuuguagcaaagcuuucuccaggaagcaugccagugagaacccaaacggguuuuuuuguuugcauucaccucuuuggccaaccucagcaaggcuuauucaagaagaugugccuaaaucuacaacagacuuugagaacacacacuaaacuuaaagauuguaagggcacgaaagggaaacaagcucuggcugagacuggcaaaggcugcguaccugaugaggauguucaguucuucgcuuuccagcugcagguuggccuuuucuugguucagcuguaacugaaguuuuugguucagguccagcaaguucucauucuugcugucauccuguaaagacuaaggaaccaagagaagaguuuaagagauccuccgugucuaucacaggagcucuguccucagauugccuaggaugguuaccuucaugauagaguacaucugcuucucuaggugccuuaucugggccacaugcugccgcacagccuccugcagguguaguaugcugcugcgcugcuccucaggauugcuagagaucuccagcuggaaccucacgcgcuguuucuuuucacuaugcuccugaaagaagggaaaaguguacuuuuuuuuguuuuguguggugcugcgaauaaaacccacaguuucacacaugcuaagcacaggcuuuacuaauggaaggaauauccgcagccccuugaauucauguuuuuuaaaaaguuaagucuugcagaaaagugaauggugcucucuucuggaaagcugaccuuuaccaaucacgcaguagcaagaauaagggguaggucaguauaaaagaucugcaauccacauuccuaagauuucauaagcuagacccacaggguagagauggaggcaaaaauguguaggugccacuguuagugauguuuaggugaccugucuagaacaagccauacagucuugggacacguaaacauaaacaauaggaauuccaacagcuguaauugacugagaagauguaccaaucauaagccccuuccagggugagguauuaguuucuuucuuacccacucugccaucucaccagcccagcacuacuuuacuuaacugggaucuaaguaaacggcaagaucaaaguucaggugagucuaaccugaauucuagaaaggcucacgcucaccuuccgcuuggguucuacguggagaagcagguuguugacaauguccagaaucauagcauacugagcuggguugguagaaauuuccaauucgugguggaugagaguaaaaguauccacagccccuacagaauuguaagcaguuaaauaacagguucagguuucuccccuaaauauucaaucuccuaacauauauauauauauauauuuuuuuuuucccccgagacaggguucugcuauguaguccuggcuggccuggaacucacuccaccugccucugccuucugguguggagauuaaaguugugcaccaccauacccagccuaacgaacauguggaaccacucauguuagucaauccuucacaaagggaagaggaggcacgcaggaguagaaauagacuucuuucagaguccuaaguaauaaccacugucccaguuuccucuaagagcacaggcuguucuaauggccggacuuacuaacggccaagcaaauguuaguaucaauagcgcacaggaaccccuuuaauuaaaaccaugcaggaaauaacuacuuucacaaaucccuuuaaagccugaauaccuuccugcuucuuuaagagauccuccuuuuccugguucucaugaaccucagguggcuuaaucugaguugcuagcucaggaucaaugucauggcuguagcuaauauaguacauccggcaauuacaacgugaaaugauccucuggacuugcugggcuugcugggcuuccgcuggcugguuccagucugggaagaagugaaaaagaggagaaagagagucuccauaaaagcugugauaagaggucccaucugaauauuaugucuaaggaguuccaaaaauguuuccagucuacacuggcaaaaaauauuacuucaacauacacugauguuaagcugggggcuggugagauggcucagcggguaagagcacugauugcucuucugaagguccugaguucaaaucccagcaaccacaugguggcucaaaaccacccguaaugagaucugacacccucuucuggugcaucugaagacaacuacaguguacuuauuuauaauaauaaguaaaucuuaaaaaaaaauuauaagaauagauaagcuggggcuggagagguggcucagugguuggaagcacuggcugcucuuccagaggacccaggguuuaguuucuaauacccacacagcagcucacaacugucuauaaauacaguuccaggggaucugauacccucacacagacuaugacauauauaugacaccaaugcacauaaauaagucaaaacaaaaaaacccaaaagacagauaaauugggaccaggugugguaacagauauucugugaguucuagaccaguuuaguauacgugaggacagucagggcuauauaaugagacccugucagacagaaagacaaacaaauaaucugaaagagauagaugacagacacggcuggguuugcaacugguacagcaaaugccuggcaugcaaaaaaccucaaguuugcucccuaguacugucaaaaauaaaauaaaaacccuauguagcucaugccuaagcucaugaguuagaggacaguuuggucucuaaagccugagacaaaaagaaaggaagaaugcagaagguggguuagauaagagaaugaggccccuuugggaugaacauucacccugggagagggaagagagcugaccugugguugugguaaccaugccucccacugccugcccacuuuccaucagcuccugaacagaguccagacuacguucccggugcuccucaauauucuucaccugcaaacacauugagggaccuuuagcuccuggaaaaagguggcuuguucuaacaccaccauagauggccauguuuccaauagagucaugugcugcaaaagaaugcuucagucaaugacagguugcaggcccaauagccccauaccuguaaucccagcaagaggcugugaggcaggagcaucauuacagaugugaggucagccuggacuauguaguuccauggcagucuagaacacauagcugagacucucacaaauacaaaacaagaggcuguaucauacaacgauagugugguaaucuuaguucauguaaagacacuuuaugauguuuacauaauuaaaaaaaaaaaucaccuaacauuuuuuggggaguuuuccaccuugcuucuaucaagugcugggauuauaaacaugagccacgauucggagcugguauguucuuuguguuuuucccguuuuuuuaucuucagagcuacucugaacccaggaauaguggcugacacauguaaucccagcaguuggaauaagaggaagacagaucucugggcuuccuggacuuugaggucagucuaguuuaccuaucaagugcuaagcagcuaaaacuacacaguaagaccucaaaaaauauagccaagauggcucaguagguaaaagguuugcugaccgagucugaacucauauaaaaggggaaaaggauggacagauggcucagcaguaacgagcauuuguuuguuguucuaccagaagaucaggguuugguuuccagcaccgacaucagcaacuaccuaguaaguaauuuuaguucuagggaucugacacccuccuucuggugucagagggcaugcagaugauauacagacauuuaggcagucacacauuaaaaagugggagaauugacuccacaaaacuauuaucuuuuaaccucuaaaaacaacagaucucucucauacauacauaauagggccugaguuuaaauccucaguaccaauguaaaaauccagggaaggccacccauuccuguaaucccaguucuauggaagguagagacagaaacauuuuggagcaugcuaaaucccagccuagcuccaauuucaaugaaagacccugucucaagggaauaaggcacaacaugauagacguuuaaugcccguuccuguggccucugggaaugcacaggcacauauuuauugcacacacaucacaugcucacuuauacauacaccuacuuaaaaagaaaaccauucugauauugucacuuuggagaucaggguaacuaacagaaugaauggcaugaaaaaucaaagcaguaagaucaaggcuucaggacuggagacauguuucagugguuacgaacacucacggacugcucuuccaaaagaugaagguucuauucccagcaucaacuggacaucuaacaacuucuuguaauucuaagucucauaagaucuaacacuuucuucuagccucugcaggcaccaagcauacauuggauacacagacauacacgcaggcaaaguacccauacauauuaaaaauaaauaaacauaaauaaggcuuuaggggcuggagaugacucgcaguuagaagcacuugcucuucuugcagaggacccagauuuaguucccagcacuuauauggcagcucacaaucaccuguaauuaguuuuagaccugacacccucuucugguucuugagggcacuuauacauacauggcagacucacaaacacauuuaaaaaaaaaaaaacuuacaaaaaaaauauauaaaugacacacacgaauauuuuagagauccaggauuuggaugacggaucuacugaaucacaaagucaccuggggaagagaaaaaucauauucuaacucuaaggaucucuccacuuuaaugcuaaugcaacuuaggggagggaaaaaagccuucaacuauaaaagguggcauugcuuauaaaugcccagaaacuucugcccaccuuuacauagauaauuaccacuccuacaucccuauuucuuuggugguuauggggaucaaacccagggccuuaugcauaauaaucaaguguuaccacugagccagaacuccagcuaagauacuuucugugacuacccccaagaauacuaguaauagacaugguugguuaacuuccuaugugaccuaaccuggccauacucggcuugacaucugaucuaaauguucaucugugucuggcaucauuacacuugagguugccuugacugaaccagaaguuccuuugcagacauucuagccagggacaagaagaucuacaaaagagguuaucacucugguucauuuuauuaucaucauucauguuuuuuauuguuuuuuuaucagauauaacugaauccuuuaauuuaugugcacacuuaccacaugucaaauauauaaaugauaauauacaacacuagccugauaugccucaugaucaucaacccuccgguaagucuaagagccuaucuuagaaauuaaaauguucuaccuuagccaguuggugguagcacaugcccuuaaccccaggacuugggagacagaggcagguguauaucugaguuugaggucagucuagucuacauagcaaguuccaggacagccagggauacacagagaaacccuaucuugaaaaacaaaaaacaaugauugcugaaacaaucaucuuuaugaaaggcuaugaaaaaaaaacaaaaaacaaaaaaacaaacccuuggcuagccaugugacacguuuccugcacuacagaugcuaaggcaaagggaucuccaguuccaggcuaccugggccugagaccaaacugcauagcaagacuugucucaaacugacaaaaaaaguucucagauccauugucuauuuccuuaguugccuguuugugugacguuuauuaagggacuacaaacuaaaaaaggaaaaaguuccugucuacuuacucuagugcugguaaauguaacagugccacaggagagaaaagcacuaguuccuacagcacagaggcugcucacagucacgguaucagcagcuuccuuuccuacuaagcagaaagguagguacuaugaagaaucucccagugguucuaguugaaggggccaacuauagaaaacuagagauauacaauggaccuccccacccaggcugacuaaccucuaaccagagcugucggccauccuguucaguagggcugcuuucagugguggcaaaauacugcaugccaucuaacaggcaaguccaggaagucuuuuguuucagugugucaccauaccaagcuggaugguguuggcacugcagcaacugagcuuuggcagccgauacaaugacacagccuucugucucugcuccacgaagaaccaucuaugucaagagaaaugcaguuuuagacacaaagggggcugagaaggguauucagaucacugcuaacucuagcuuacagagcaagcuuuauuggguuuuauacguggaaguguuacucaggaaaccuacagaaagguacaaagcugaguucucgccacccauucuucaguuauacguggagaaacauugaguuuagcaauaacaagcccucagcacucaggaaaccaaggcaaagacagccaaguuugagaccagccugagccacacagugggacccccucccagccccccuuuuugaggcagggucucacuauauugucuucaaacucaaagauucccccuggcucugccucccaagagccuuccuuggguuaaaggugugagccgccacauccaacuuguagaauccuaauuuuuuuuuuguauuuuuaaaaaaaugauagggaaguaaacauuuuuauuugggaucuaucuucguacugguuuccuauuaaaaaaagauaccuggcaguuaaccagcucaauaaggcaguuucgguuguauaugucaucugucuggcaggcagcaaugccacacaauuggucacucauaccggauuccucuucugugaauacuacaaaucugucugucucuucaaucagcuucugcaacauguaagcaccuggcaaggaaaucggaaauggggaaaggucagcgucucgaagggaaggagaacacaugcaggaccacacugagcuucuauuacuuccugucuagguaaggacugagcuacaucuucaaccuggaacacgggugcaguucacucuauccaacccuugacccaaaggauaagauaaaagcuauuuaguuccccucaguguuacuaaaaauaaaagugaacgauuuccaauaaaaauagaaauaccaguuuaaaugguguuauuuuuguuccuaggguccacauccagacaauggcaggaacugaacccagguguguccgcuugucuccgcuucuacagugcuauagaacaggcuuauacuuuccccauuuuaacuccuuccagcagccaagucuccuauaugcacagugacguucuguccuucuuacgcaucccagcuguuccaccuccuuccaguccuugcugccuccuguugauacccuguaauaguuuccucaucugucuguccaccaccaguccucccacacaacacugcuagagcuaccuuccuguugaaaucuaauugugacagucuauucagagacuucaauaguucuucauuccuaauguggaaggucucccaacgauccccaucccaacaaucuuucuaacccacuccuuacacuccucuuauuacuguguuaaggaaaacaaacuguuugccaucucugaacaggucacccuuuccuaauaucauucucuuuuuuuuguuuuuuuuuuccgagacaggguuucucuguauagcccuggcuggccucaaacucagccugccucugccucccgagugcugggauuaaaggcgugcgccaccacgcccggcucccuaauaucauucuuauccaggucauucccuccucacugacugccccuucccccauuuccacacauuccacaagccauacccuaaaaacucaauuuaaguccucaccucauuuccuucccuuucacuguaacuucccuauuuuuugaauuccuucugcauggcacugacacuucuccacuuguucucacgggcaccacuaacuugcauugccuuguauucguuauacccuaaaaugccauuccuuucuugccaagucuuacuuaccuucaagauuuuccccagagugcuaaagauaaaaaaagaaccugguaguguuucaguuuuaugccaacuaagcacuuaaaucuuuguugccuuaacaaaguaaauguaucaaaaugaugcaaggcuguggauaugaucuuaguaguugcuuagaaugucugaguucaauguccaauauugaaauuuugaaaaauaguucuuuuuuuguuauuguuuuguuuagaaaaaguaucacucuacagccuuggcuggccuagaauuuguacagaccaggcuguccucugccuugagugcugagauuaaaaauguguucaacuacaucagcaauaaagcauucuuaacucugcuucuuucccuuucucuucugauuccaauucuugcugaucuucuggccacaggacagacuuucaaagcuuccucauuuuuagcaauauaaacccaagauggccgaauauaaauaaaugacacuugcaucucugugucuguaucgagauggaaccagucauaacugagucauucuuaaggccuuuuccaagcacauguucacguucuaaauguaaacccauagucucaucugucccagccuaccuccugaugaucccuuaucaggccguccacugaagcugggagugcugacaugaggugggacuugggcacuaggugggauaccccgcuuuggcuuuuuggcugacaucugaggaucaaucuucaaaccuuucagggccucaguagagagauuacguuugaguacagcugcuuuuuuguagccaucauauaagccaaaggcaaugucccuauuggugguuguccaggaaauccguaaaucuaccaaauacagcugguguguaugaaaggcaggaucaccaucucgagcagaaagcuccugagaaacaggaaaaggguaccagggucacacagacauucccaccucuauuccugaacagaaaugcagagacaaacuugcuauaaacagagggagaaauggcaagacccucgagaaauauuaagucgucuuaguuuguacauuacuuuacauccuaacugcacuuaaugcaguuuuaaugaaucaguuaauuucaaaugcuauacuuaacugggaaagauggagaaagccagcacuaaacaaaguguuaagaacuuuuacucagguggguggguaugggggacuuuugguauagcauuggaaauguaaaugagcuaaauaccuaauaaaaaauggaaaaaaaaaaaaaagaacuuuuacucagccaggcgugguggcgcacgccuuuaaucccagcacucaggaggcagaggugggcgaauuucuguguuugaagccagccuggucuacaaagugaguuccaggacagccagggcugcacagagaaacccuaucuugaaaacccaaaaaaaacaccccaaaaaaacaaaaaaaaaaaaagaaagaaagaacuuuuacucaucccagagagauggcucagagguuaagagcacugucuguucuuccagaggucccaaguucaauucccagcaacuacauggugucucucaaccaucugaacugggauguggugcccucuucuggccugcaggcguauauguagguagagcauaaaaucuuaaaaaacaaacuuuuuuuuuuuugguuuugagacaggguuucucuguauagcccuggcuguccuggaucucacuuuguagaccaggcuggccucaaacucagaaauccgccugccucugccuccgccucccaagugcugggauuuaaggcgugcgccaccacgcccggcuuaaaaaacaaacuuuuacuauuuccugaagaccaagagauuuguuaagagggagagaagaaaaggaauuuucuuucuuucuuuuuucuuuuuuuuguggggaacgguggugccagggauugaacucauuaauccaauaccugacacugaaccgaauacccagcucaggaguucucaaggaugaugucgcuaugugacagauagcacaugccuguaaucccagcacuucaggcaguggcaagaggacagaaaaguaaaaaaauucaagccaaacuugggcuacacagcaagacuaucucaaaaauaaaacaagacagcagcagcagcugaucacacucagcauuuaaaaguguuugcugccaagcuuggugaccucuguuugaucccuguguacaaaugcacacacagacauacaaacaucuuucuuuucuuuuuacauuaauguaauaaaaauuaaaaagaagcagcagcagcuagugagaugggucaguggguaaggguacuuaccaccaaaccaauggcuugaguuggaucuucuggacuaauagggugggaggagaaaacugacuccugcuaacugucugcucacuugcacacauauguaaccaccaacccaauaaaugcaacuuaaaaagagcagcugacacaacuauaccaagugaauauaucauaaugacauacacaguaugaacacagaaaccuuaccagaauuuaacucucaccccaaggaaaugcuauuuggacucaggagauaacagguguggacaggcacaugaggguagggcccacaugacaguaaaagccacaugacaugauacuauauuguuggacuucuaaagucuccaaaacgacuagaaacuucugcuaagccaccaguagucuauuuuacccacugaaauugagacacuaacauaaacugauaagagacugucaagcaguaccucuucaguggugcgauugcugugccguugguaaguaagggaagacaggcucaauaggugggucuuugugaucaagggaucaaggcaguggucagcguucucuucagugggugaagccaucagaugaacagucaccugacuuaagucacucaccaucuggguuacacuccacucagaaauaaggcgccgcaucacugugccagcugaaaaaaaaggagcauauauuccaugcagaauguaugaaaguuaugugagaagaggagaacggaaccaagaagaaacccaaggaauagacuaggagaaacagacccucuggccugaccuugagguauaagccgcugaguuccccgagugaagacauggcccugacugcacucaaucuggaugccccguugcugggcaaaggaagcccaguaauguaccugguaaugagagagaaaaaaaaacugaagaaaggauggcagaagagaggauuaagagauucaacauauuagaaaauaaaaaaaacuaagaaagggaaacccaguuaacuacuguuagaugcugagucuaaccuguagcuggggaaacagugcaguauaggaaagcuguuuguagugcuggccaaguuuuuucuugcugggcuucaaguuauuaaacaguuuuccucuacagauaggccuugugaugcuaguccaaguugcccagaaauucugcauccagcgcaggguacuacuauacaccagaauucggggcugggauauugcuacaaaggaaaggacagacguauucaagcugugguugacacguaggugaggaagcgcuucccuagcuucacuuuuagagauuacaaaacccacacacccuccucauaugcagugucccuagcacuucuuucaaggaucuaagcucucugcugucaccuacugccauggucuaaacguuugucuguucaucccccuacucgacuccgacagccagauauuuagguuaaaauccuaaacuccaaggugauggaauugauaaaggaagcugacagcaaggacaaagaccuuaugauauugaugacaaagggugcacugggucagcugaggaccuucaccagacaacuugcaucuuuaacuuccuagacuauacaacuuugagaauauccacugcucauaagcaacacaacuuaugguuuuauuguuaacagcaguccaaaaccaccaauccuccugcaaaggucccaaccuaaacucuguucuguccuucugucccaucccucuuucacucuaaguggucaggacccaagcccauccucccacugucccaggcccaagucucacucccacuauggcgagucaaauccaucuugauggagagauugagguucucagagcggaaggcccgguaggagucauggagcuggcccaaggguaccucaggcaggaacucuggggcccucagagugacacugugaugaucaugaggauucccguggcacagccacuguagguccagugucaugcagaggucaggcaggugaaggaagcagcagucgucauaccugccucacaacggagccccagcccucagagacuuggucacuuguuccccuuggcucuucccucucccccaccccaacucccccauccaguuaaggcccccacccuucacuccacuacucacuuagaagcuguucuuacguugacauccagguccccucugaacacaaacugaccagguuuccaaugaaaagaaagguggcuccacucccagugcauguucucaguuguauuauagggguccuacaaugacccgcccgagcccaaagaacgagggugagcuacagacagacaaaagaccaaccuuucucuucacaccccacaugcugugcaggucccaacuacaccaucccaacaaggaaaugacuccacggagccccucaccucaguggccagcugaugcagguuugcuuguucaauauccauaugccaguccccauggaacagaagacggcucuuaucccaccagggcaaaggugggcuggggucagcugaaggcuuagucaagagguccacacacugaccaaucaguguccaggcuggaucccaacaugggccccacaccacuguguacuggaagauuuccgcuaggguagaggaaugcaggcuuacuacaccucucuggucuuccuuugcuccaaaagguccucagauuaucgucuacccaaggcccauaaauaccccucagccaaaccaacuguuuccuuuacucacaguggaagucaugguaaaacuugagugggggcauguuucuuucuacugccacguuaccccagggaagccccaagugcaggaucugacgucgacgggagcauggcuggccacucugcucagugcccgcaagucgacccauuagccgccagucccggaucucaaacagguaccguggauagucucugauccgaacuauuauuagacagcagaugaacacugguuguuuacguucacacaugguuucccccuugcuuguuuuacccauuuauagucaaucuagagaacaagggcuggcaauuauguagcaaagauaaaacaggucacagagaccacuaggcaaaggugagggacagagagaacaugaaauucaagagccacacuagccucacaaaagccugugcucauuaauaugucagcagaguaguuucaggguggaaaucaggaacaaagaaaggaaagcagagcugucuacucaaaccaaguguaguucccaauacagccuaaaccuagcuccuuugcaaucacucagagagcucccuggcacucacaggacagauaccaggcuccaccaauaagaugcacuuacccagaaaaguuuugacauugcacuugagcauacgacaccacugagugacaagauccauuccuucagcaggaaaagggcuuccaggaucaaguucucgaaccugcucuaucacaugcucgggcccaugaaaggaugcaucugcuagagccaccagcucuagcccugccaggcuccaagugagcagugcacggcgcauggguguguugccauagagacgacgagagcgcuggauguagauuucaauguuuuugcguuccaaagaggcguagagcuccucaauuuuccgagcuggcaauagcucuccaugcugcuuucgcagggcagccacuuuggcaucuagcaacugcagccuuuuggcacucuccuuacuuucauccuucaucaguucguaguuaucaugaaguuucaccucaaagaugucauccaggaaaacccaagaaaagugcugaaccuuuaggaguaaaucagguggaagaggggcagggcuuggagaagcccaagcaugagucccucgaugcagccccuuuagccauuucugaacucccacagccucauccagaguucgagagaagucauacugauaaggaaacuccacugagacugauccgagggaaagaagccaaacccgauugcggagggucugcagcgcagggaagggguuccugugaaggaucaucucuucuagcucaggcagaagcugcaccucuaccuccuucaaguugaagaugcuauugccaucaaagccagcagccaacucggggcaguaagccugcagugaaccuccaugccgguucagcgacacacucucugcagccaggguaaugaacuuguccucagccacgaaagcuguuagcuuggcagugcucaccuccagggucagggugagcagccgccuaggcagggaugacucagggagauggucuucuggcucccaaguggacuguggaguguuuagugaaugggacucaauaaucucaggaaacacaguagcucguaagaggucucggcacuguagaguggcccugacauguugguacagauacaugugaucuggggggcuccagaguaaagucagcccugcaccacacugaaccuuuaggguauaagaaaagaaugcacgucacuaugucucaggacaguagaaggaacaggacuaucacacaugccuaccagguucaugaauuauaauucauaaguccuuccuaagaaacuacauuaacuacugccuugcuugguuccccuuagcacuaaagugcuaaguuaauagcugucacuuguaaguacuuacacuuuuggauuuucuucuaguagauucuaaaaugccuuaaguuugaggcauguuuucuuugguaguuaccauacuaaaacuaacauacagacauuaauaaucauuuugcuuuauguuuccacauagaaguuaccauucaaugaacaccauccaaaaacaaguacaacuugaaauguuucaucaaugaauuagaugaccugaguccuaaaacacaauauaaaguauaacacagcaacugacuuacuaggaauauauguccuggucauccugagagacaaagucaguucugaauagcucaagggaugagaaauugaaauaucaagacacggggcuggugagauggcucagcagguaagagcacugacugcucuuccgaaaguccugaguucaaaucccagcaaccacaugguggcucacaaccauccguaaugagaucugacacacucuucugaugcgucugaagucagcuacaaguccuuuacaagaaugaugguaagugcucuuaaucacugagccaucucuccagccccaacuauuuucuauucuggauuuuuguuuuuugagauaguuuuucuguguaguccuggcucacccugaacucacagagauccaccuacuucugucucuagaguccagggguuaaaggcgugucaccaccacucagccucccacuuguuuguuuuuucguuuuuguuugugacaaggucucucauuaaaccagaaacuugcuguuacagucaaaccugcuguacugugugaccaguacuuuuacacacaaggccugugagucucaugauccacuuucuccauccuucaaugcuagagcuacaggccuggcuuuuacauggguacuaagaaucugaacucagguccucuauagcauucacagcaaguacccuuaacugcugagucaacucccacccccaauuuuuaaaaugcccucuuauuuucacacacacacacacacacacacacacguguguguguauguguguguguguauauauauauauauguguauauauauauauauauauaugucauauauguauauauguguguguuauauguauauauuacacagacauggaaauacuuauaauuaaaaugauuuaucuguuaucaccuuuaaaaugaccccagagcuugggguagggaaagcuaaaauggguacagcugcaauaagauaguuacaaaugggaauuuauugaagcuggaaauaugaaaauuuaaauggucucuauuuugcauguauuuuuaaaaacacaguaaaauguuuaaaaucuaagaaguaaggaaagauggacaccagcuguccuuuuccucuauguuucacaacauuagucaaaaaaaaaaaaaugcuuuaagugauccaaucuggcccauagcccuaaagcauuaccucuagagagcggaugcugcugugauaggugagggagagcauggagagacccagcacuggcguggggaugucaggagccuugcaacagggcugcaucuucucugugacugauuuuacuaaugcaagcacaaguccuugaauccccacaguggaggucucagcacuacccaagacagucaguguguccagucguagcucugaagcaccuggcaucaagaaaccaagacauucuaaguucugaagugacaaccuguccuuuguccuuucuuaucccuuuacugucuuuagugccaacacuucuccuaagugauuccuaguauguuaggaaaacuuucucuucucuuaccuaacuagaccuggcaaagucaaugaacuuucucagugucuagaauuauccauacaucauuuacucuccagaacuauacacaagaaaauaaaaagcugguugcaugccuuuaauuccagcauggggaggcagagucaggagaaucugaguuugaggccagccuggucuacuucaguucuagaacagccagagcuacacaaagaaacacugucuugagaaaaaaaaaucaaaagacacaccacacaggccucauccucugaucacgccaagguuaaguuuuucccauugugucuuuuuuaaauacuuccuucuucaauagacacuaagaaguagaacaaaguuugucauccaagccuuucuaacguuuugucccucuaacaaggaggcuacccagauaauaagcuuccuuaaugaaaagaagaauuucagcagacuucuuguuccacuuaccaaccagugcggaaagagugaacagguucaugucuuccaccuucaagucgaccuuccacaguaaggucacagacuccccaagugacgacuuccuagagacagcugaccuuucagauuguggaaucaccaaggagaggacucgagacagacacugggcacagaugucugauauuucuaccugaaguccucgaauaguacagucaagaaaaagaguauuggacugggugcuggacaagcccaggggcugguuauaacuucccuagaaaagaaaggaaacccacugaaaccaugccgaugcaguuaggagacccugaugcagcccccacaccaagggcacacuccagccucagaugcgugucaggacagggcacuccgugggcccugacucaccacacagcacccaccuaccuguagugugaaggaauccagaacaagugcuucgccccaaacaugcauauuagguggauguggugcccgcugaaugugggagucacugcccacacgccagcagagaugaucuacaguuagcacugcucgcugauggauacuuuguggccggaggugcugguagucugaaauacaugguaaggagguagucaauuaaggcaccguggccaugaaacaggcauagcuauaaccaaagggcaaauccucauucccuucccaucccugagccuuacccagggagauggaauugaaccccaaagcaaacggugguguaucuccaagcugaauggaaaugcugacauuggagacugaggugcugaagauaaugggagccaggaucugagggaagguucuacacagggauaagacugacaucauuauaauagccacuuccugucaaggaacagaguucucaaaacugcugacaguuuaguuuugggccuggccacagcuacaaaguaaaaagugaaguccuucagauugcuguuccucccaaugguauucugaaggaacagcagaaagauaugaagacaaaguuuaaaaaaaaaaaaccaaaauuguccggcagugguggcacaugccuuuaaucccagcacucaggaggcagaggcaggccaauuucugaguuucaggccagccuggucuacagagugaguucuaggacagccagggcuacacagagaaacacagagaauuuuuaugucuggaaaaaaaaaaaaaagacaaaauuacaaaauguacacauugacagccaaauauaaugaauagggcagcaucacaugguucauccuagucacaagaagcaucccuuacaaaucacuuucugugugcagagcaacacacacacacacucuauacagcucacagcccagcucacagcccagcucacagcccagggcaggugagaugcuguuucucaccccaguccacuucucuuauguaaguaaggcacugugcuagguaccgaggaugaaaacauaaaaaugacauccuccucaaagaaacagaaaaaaaaaaaaaaaagaaaaaaaaagguaucuucauaccaacaaaggauaucaucccuguaacaggaaagauauaucuacaacagguuugcuucugaaaugaagauguacagaacucagacaauuaaaucuauaguuaacacaaggcgucacuuuaaggcuaaaaagaguauaccuggugagagguaacuuaagacucaccuuuucuuucuuuguuuaagaucaggugaacuggcuccuugggucuccagugcuagcauaaggagccagugagagaacuccuggugucgguaaugaaugauacagguguucagaacuagagaagcugagaggucgaugguggucaccugggaaugagaagaccccaaguauggguuuuauucccagaacuggcccaugcagcaacaugaagagagcagacauagguucuuggcagcuaccugcacauuagccuugagggaguugaggcagacaauucguuggcgacucugggacagcaacaacccaucuguaagaagccaaagaacagaugaggggaagccacaaaguauaacuaggaaaagggcaagugcgggcaaaagaugagaacacugccaucaacacuuugagucagggauaucucaucuucucuccuuccacccacagugauauuaaacccaguagggcacuaacacagaacgccugguccucccaucucuuaguaccaguaaccccuuccaugaaccuuccaauaggaguucagugcucaucugugccauaucauaguuugcugugaagcuucgaagcggcaguugguccucaucacggugguacaggaaaugcagcagcuucaguguccaagucaagugccuggaccagagagaguccacaucagaaccagcuggcaugccucucccugcucuccacacacaggcucagggaguacuaagacuagccaugggaucacccucagucugcgcggguccuuaccguuuuugacuguucauagacaacaccacacuuguguucuccaucuucaccuugacuuggucuggcagccgcuggaggagguauaggccaggcagaguugguucagcaaaguucucagucaaaucuggaaauaggaaugaauaauauacaugagaaccugauuacuccuuaacauucucaaauucucccagcccugccccucuucagucaaauccucacauauaggaagguaaaaagauaagcuaagcaaaugccuaaguggguacaaggcccaaaacaucacagacccagguaucugauauacuuccguucccagacucuaaaacgcuaaaagcauaaacaguaaagugaauaguuagguauaauggagaagauauggacuuaacugucaaauaauuuacacuuacuuucacuaacuauaagacaucagccaagucagcuaacuaaaauguucuaggccuguuucuuuauuugaaaaaaaaaagauaguaaaaacauacauaaaacaugcagugcuaacucacaguaaccauuagguuuaaguucuuugacucagaacacggaaauaccuauuuccucucccucuaccuaaucaaaggccauugugucuaaugacucacaccucaacaaggggccaagucacugguuuuucuacuuccaaaauaauccccaagacuacagcagccaagaaacucaaugaccgaggcuuuaccugaacaagaaacugauuuggaaauccggccuggggcaugacacaguagcugacuauggaagagaccuucaugcagcucagcauggaguguccacacauccacagugacagccgucagaugccaacugcugacgcugaccuguaggcgcagguccagggccagugagagcucuaccagacauguauccuccugugaagggagguuuaaaguuuuagaucaaauuggaauggucuggaaccagugugguauuucacaccuauaauccuaguucucaagacuaaagcaggaggcccaccaugaguucaaagccagacugggcuacauaucaggccagccauagcuacacaugacaaaaucgucucccacaaaacaaacaaagcuacaaugguuaggaauacugguugagcauugccuugggaaaaaccuuuaaaggcacagaaucuaacaacacaaggacccuaagcuccuucauacccaugcucaagaggcuaugaagccccacaaucacccugacguacucaccagcugaccacucuucaggacuuugcuauugaucuuugauagguucacuuuacagaugagacugggaaagaaagaaaaaauuaaaagcauuuaauccagaggugguaguauagguccugaauccuaacacucaagaagcaaaggcaugggggcuggagagauggcucaguguuuaagagcacugacugcucuuccagagguccugaguucaaaucccagcaaccacaugguggcucacaaccaucuguaaugagaucugaugugcucuucuggugugucugaagacagcuacaguguacuaacauauaauaauaaauaaaucuuuaaaagaaaaaaaaaagaagcagcagcaaaggcuuguaggguccugugaguucaaggacagucugaucuacauauagaguuuuaagaaacccacggcuuuauagugagacccugcuucaaaaacaaaacaaaaaacucugaccccuuuccucacuaccucuuaauuaaucuguuggguagaaaaaacagggcaagcagaacagccagucuuggcuucuccucaagacugcacagagugagaaccugacguguagaugaggaggcuucgacauucaguuucucucaagcaacuccaaacagggauacuaucagccucuucuaccuaccacucaccucuucccaucacuguccaaaagaaaucugcuucuacugaucuggaugugccacaaggacucagagguagccaccuuaagaaccaugauguuuauggcaucuacaugaauggagaauagcuggaaggauaauaaagauaugcaauaguuaauguaaaggcaccacucuuccuuuccagcugagaauggaagaucuuagcuuuuaucccuccagauaguaaaauaaucccccaccguuccuccccaguccaaagccaaccaaccaucucugaaaugcaguugagcauagcagaaguggggcccgagagauggcucaccgaauaagagcacuggcuguucuuccugagaucucggguucaauucucaaaccccacagagcagcucacaugugccuuuaacuucaucuccagggcaaccaacacucucugcuagccucuuuggucaaugcagaaguauccucgcacgugcacacauacacacacacaugaauauuuaguuuuuaaaaagaguaaaaguaaucucacuuggcagaagaucuucaacaaggaugggcugagggacaguuccuuuugcuccaccucuguguucugagagaauggggcagacaggcuagaaaccuucuguagaucuguccugaugcgcacuucuccaaagcacaaugccacauaguuucugcccagaagagaagccucauuaucaucugguccaucccuuucagagcaauuuccuucccucccucacacccucucccagucccauaauagcucaaauaacagaggaaguuguuuucagcaugucucacaaaacagcacuuggacuaauaggagacuccagcaagaacgucccucccaccucgacuaaaaugucuccguagaagaauuuuauugucaaaacucaaccucaaaauauuccucaagggcagaguaaggacacagaguacucacggcagaucauggcuaaggaguuugcuggaaauccacaaguugucaauuuccuaaaaugacaguaaagacagccguguaccugguugcuaggaaaucaaugaugggcagguuuaugaaccagcaaagguccugagucccaggagaagggaguucuauugguccucccgacaaauccucuuucccugguuucucugaucaacguggcuauccugcuccucaugaugauguuagcugaauuugcuuagcaguucucuuuuuaugaacaaguugccacccuauuuccucucuuaaauuagaacagugaguuugcuguuuccuguaaucuuucucuguuuacuuccauaucuuucuuccauacccuggauacucugugucauuaguuugguacuagauacuaaagaggacccagcagauaccaggcucuaccacugaaccacuauuccagcucauuuuaauuuugagagaagcacucacuaaguugccuaggcagagcuugaauuuauaauucucuugcuucggccucuugagaaacaagaauuacagguuuauaccaccagaucuagucccauaaacacuugaaacaacuggcaucuauugcagaguccuccaaguagcuccuaagauccucuugacaauaauaauaauaacaacaacaaaaacaacaacaacaaggguggaguuaacuaggaaaacuacccauggaggaagcuaaaguuugaaacccccuccaaaccaacacacacaccacacacucccgcccuucuccucucucucucucucucucuuucucucugcaauucccggaacucaccaccgucugcuggugcugcugaaacuuaagacugacauucuggauccaaaaaaaucggaaggagccaaucuuuagcucugccugcaacuugcgcugacaccaccugguggccaaccggaccacaagccaccugcagaaaaaaaacaguuggauuauaagacccucuacccuuuuugauucuagaaaggccuugcaaggggugguauccugaagccggauuuuucuuaggaacuuuacgauuuuccuaaaauauuucucuagucauacucauuuaggcacaacaaccagaacuacgggccccuaaauucaaacaaaacuaggcaaacgaaacucacccucuaaaagaggucaaaaaaaaaaaaaaaaaaaaaaaaaaagaaagaaagaaagaauaaacaaagaaacccucaaaucuuuaggaacccaaaguaaaaagagguccucaaaaggcaaagugaaggcagucguguuaaauacgucaucgcacacuccuuagagggucccugucugcguccccacccugcagccguuuccgagaaggcagaggucacucucggaacugcucaaacaccgcucugcucuagccagccaguccucccgaccucucugcagggcgcggcugcaggugcccuucgcaaucugggaagaggacacggaggcgaacggggcaggaaagggagaccaccgagggaggcccccucccucacacgcaaacauucgguucccggacuggacauugcuucggguccagccagaugcuucagcgccccugcccccaccucgcuuccccucgccucggcugagcgcccccuccugcucgcgcccccuccgccuaaggcgcccgaccaacccgcgccuccuccagccggucuuccucgacccccccgacccuguggcuagaauccccucaccggccuaggaagagugcgcuaagcgcaaccagcagcaagaccaacagcgcggagagaaauagaggcauuuagguccggguccggcccggccuggccccgacccccgccaugccgggcccugacgccggaaccgcacagcgccgcggcgggcuucggccgcgcacg

SEQ ID NO: 6203 - RNA, 331 nt, Mus musculus
ccuggguucaguuccugccauugucuggauguggacccuaggaacaaaaauaacaccauuuaaacugguauuucuauuuuuauuggaaaucguucacuuuuauuuuuaguaacacugaggggaacuaaauagcuuuuaucuuauccuuugggucaaggguuggauagagugaacugcacccguguuccagguugaagauguagcucaguccuuaccuagacaggaaguaauagaagcucagugugguccugcauguguucuccuucccuucgagacgcugaccuuuccccauuuccgauuuccuugccaggugcuuacauguugcagaagc

SEQ ID NO: 6204 - RNA, 5094 nt, Mus musculus
ccuuccggacccuggcagaggaaucacuccaccucacuacuccaccucugagggcguggccuuacccuagaccaguccuggggagagggcgggaccaggacgggagguaucugucacgcccccagggagucacguagcucugcggcaagugcugccaccuuauuuacuccagcuuggaccgagcuaaucagaggaaaagugagcugugcuguggcucccgcggcugacuggcugagugacuggcugaguauagguaaggucuccaagcgagccugagaugcucgcguccgguuugucuucccaugcuguccuugcccucucccugggacccaaguuccucugcuuucugugguuuugaaaccccaugcauggcucaggaaaaccgugcuucucuucuuccuucuaguucuccuuuccaguuccaagucauaugccuccaggacuuuuucauuggggucagugcauuccacccaggacauuuuaaucucaguccauuucugguucuucuaggcuuguccucuacucuaggguauaggcccaggaagagcaucaggaccgguuagcuuguaucaccauuacccgucucaccucuuccaggucuccuuccugcuuuuccugcaucucucccucuuucccauaauccacucacucagccuuaauuccucgccucuggggucucuacuaggaggcugaguuguggggagccaagccucccuauuuccugugccucuugcauaugagggaaugccggguacuagggaugaucuggugaugucucuuuccuguccucucauguaugcugauauugccucucuccuaccauacuugcagcccugggagucaaucuccaccauagguaggggaguaggcaguagcaaaggcagucagguuuucaguaccuguaccacugcuacucccugcccccugccuuccacuagacuuggggaaggaugcuguagguuaaacgucucauucacaaaccuuugagaaaagugauccccccccccccccgccuuagggacccuuuugaagaaaagaaaggggaagcaggaaagcaaaaaucagaaacaacagguuuucuguuuaccucaggaaggggccagauucagugaaagaagagcuggcauucucaaccuggcagcaguuuccaggaagaccuguggcuucagggcugucgccucccaucccccacgcugcaucucuucuggagcugggaagggugcccaccaggaacaaaaggagaugugggaacuggggcccuaacucuguuagcugucaaagagauugauaccacuuugaugcccaggcuccaggccaaaggcugcucuccugcucccagccccgugcugggaagccuguuugguuaggagaggaaguagaagguccucggagucuagagcuuaugucuucuccauucuagacaacugucaucaugccccacucauacccagcucuuucugcugagcagaagaaggaguugucggauauugcucuacggaucgugacccccggcaagggcauucuggcugcagaugaguccguagguaagugggagccuguggucaggguugaggagagguugccaaggaauucuagccaaagaaccagccugucuccccuuugcuugcuucuaggcagcauggccaaaaggcugagccaaauugggguggagaacacugaggagaaucgccggcuguaccgccagguccuauucagugcugaugaccgugugaaaaagugcauugggggggucaucuucuuccaugagacacucuaccagaaagaugacaaugguguccccuucguccgcaccauccaggauaagggcauucucguaggcaucaagguacacagucccugguggugccugggggcuagguguggaaaccaguguauauaagagggugacaagccagaccucuaucuguuucccuugcagguugacaaggguguagugccucuagcugggaccgacggggaaaccaccacucaagguaccuguuggguggguacaggggugggacauguugaugcuggcaagauggaggcagggugguaaggcuggcacuguguuuucagggcuggaugggcucuuggaacgcugugcucaguauaagaaggacggugcugauuuugccaaauggcgcuguguacuaaaaaucagugaucgcacgccgucggcacuggccauauuggagaaugccaacgugcuggcccgcuaugccagcaucugccagcaggugugugcugggggguugggugguuggaugagggccccggggccgguggagaugugcuuucauggcuuucucccauccuaucuucuacuucuuccaguuaacccugcucuugcuuucagaaugggaucgugccuauuguggagccugagauucugccugacggagaccaugaccucaaacguugccaguauguuacagagaagguaagaccaaacauagccgggagggacagccuagcaggggugccuguaccccaucccugcuaagauccaggcacacuuucccuuaaggaucuuuacugauacccaaacgggcuucauagacuaagucuaugcugagcccuugguuuccuguacccaccuaccccugggugaggagcacagugcgcuaggcaguggucccagcccuguacaaaccuccucugcuccccagguccuggcugcuguauacaaggcccugagugaccaucauguauaccucgaagggacucugcucaagcccaauauggugaccccuggccaugccugucccaucaaguauagcccagaagagaucgccauggcaacugucacugcccugcgucguacugugcccccagcugucccagguacuaaacugcuccuaucccuucaggucugacuugaggguuuuccaugacaccgggguccuuuacccugggcaagacagagaaugaucagucagucugucuucuccuucuacuccaggggugacuuuccugucugggggucagagugaagaggaggcuucucucaaccucaaugccaucaaccgcugcccacuuccccggcccugggcccucaccuucuccuaugggcgugcccugcaggcaucugcacucaaugccuggagaggacaaagggauaaugcuggggcugcuacugaggaguuuaucaagcgggcagagguagggagcuagaggugaugacuuggggagggauucuguggaccacagaggucccaaaccgggcagcgugcauuccacauccguggucuggcucagucugcucauugaaucccauuccguuuugcagaugaacgggcuugcagcccagggcagauaugaaggcaguggagauggcggagcggcagcacagucccucuacaucgccaaccaugccuacugaggcacgcugacucuacccacagcccuuggccuagcaaugcacaucccauuuugccuauagucacagccagggccaaauagcuaugcagaacagagauaucuuuauccagcgccaagucaucucacaucucacaugccuuacauugcuguacccgagaccacaggaugggaggguagagaugcccucccauguuugaagauggggggacuuucuagaagucagaacagaacauguggaccuuuuuccugucuccaccagcccuuacaguuacccuugaugguauaguuuguccuugggcucugcuugcuaauuuucucucuugggaucagggggacgugaacuccagcccugacucgugcuccuuaugcucugaguacauagcaaauaaaugagagcaaaacacagcacaccgcucugucugucugucuguugcacauaccaaagucuaccuccaugugugcgaccucuugcugauccuaucucagagccccucugauugugguggugguggugaggugagaucugaguuuuccugagcuucaaguuuuguggaggaaggguucaccuggcucaccaucccuagcucaggcuccuaccugcugauuuccaaagcuggaguuguuguuagagggccuggggguggagaggaggguacaggucuuccagggacugacacauuaaaggauccagcaggaugagaaacuccauuuugugcaaggcucaaaggggacaagcagggaucagagugggccaguucuccuccaucucugaagaaugugcacuuaggucuuuuccaauaaggaaaccuuccaagccucggggcuacagagcugagugucuagaagcuugccaagggcuaugacccacuuccauguagagaagggauucaucggaggguucuggacuuguuagaacugauagggcuuuguggugaaugauuaccccugggcuagagugugagguagggugacacuagacagaugugcacuggaaaagucauugauguucugcucuguguggccugaccuuauaaucaaagcagcuaacucagcaauuuccauaugcuucugccaggcacuguucuucuaaccauuauuauaugcauuaacacagcucuguaaaguagguaccauuguacuuuucauaggaggaaacaggcuucaaagagaggcugagaggcuauuuaggauucgaacagcaggcauuacuauauagaggcugugcucaggaauuuuucaaugaagcauccucaaucgcucgaauuggaaucgauuuuuaaauccuagucuauagucucggcuaguugggaggcugagguaucagacauuagggacaggaucacuuuaacccucuggaucguauagggagaucugucucaacauuaacuaaaauaaaauuaaucacauaguagccaaccaugcuaaaaaguuaccguuuugucaguuuuaucuuuaagcuuugaagagcuggugcucugaagaaaagaccuauguuagaaaugacauuaggggcuggugagauggcgcaggggguaagagcacccgacugcucuuccaaagguccgaaguucaaaucccagcaaccacaugguggcucacaaccaccuguaacagagaucugaugcccucuucugguacgucugaagacagcuacaguguacucacauauaauaaauaaauaaaucuuuaaaagaagaaaaaaaaaaaaaa

SEQ ID NO: 6205 - RNA, 14542 nt, Mus musculus
aggggcacauuucguuuugagagaccggauggcucccacuuugauguccggaucccaccauucuccuuggaaagcaauaaagaugagaagaccccacccucaggccuucacugguaggccagcugaggcccagguuggcccuaagaacaacagcucucaacccauaauugcugcagaacucuaaaccucucccuacugugaaauucuuuuuuuggagggagauuguaacuuuucuuggaagacccacauaagacuccuccaagguuggccuuggccgcuguccaggacaccacguuccagcaaagcugucagggaacuguucaguugucccauguuuucuggaaugugagguguggucaauaaaccagugcucacuuggccaccacggccauuuuugucuccagggucucaggcccccuugcuggcccuuuaggaacucuuaguugcuuuucaugcaaaguuucuucuagggagcugcuggcccugcuagggugcgccuuccucagaggcuggacaucuuggggcacugguaacagugagcagcacuggacuaaguuccgggucucucuacccuccgcccaguguagaggaggccaguguagaguuggacugaccugacuauagacacggauuacccaccagcacuucuggcuucacuaggccuggagaagagugaggcaaaaccagucagguuucugggaacugugggcuucugagcauugagcaaagccugucaagcauccagaccacaggggcaggaauucagccaagaagcagcuuaaguuauggucagugaccaagucaagcugcuuuuggagcuucuuucaggccaacaggagccagagaauuggacugcauuuugccccaggucuuaggauuccuucaccacuauaguuacuguuagagguccuuucauucuugcauuauuaaaucucaguucuaguccuucugaguauuguucuuaaucuuccaccagggggagugugggucuguaggauuauagaggaaugagucucuugacuaccuagaacacaaggucauggagggaacagaaauaaaagaacugagcccacagcugugagcuggccaggcucugcucacuggaaacauggcucagcaguguaaaacaacuuuauuagaaguuaguguuuacuuccaucacuuaagguaagcaacugagaccgcagguauguaguaaagggcacauucuuuccugccagaaccuguguuacccuucaggccaaccagucacaugucccagguucaacagcacacagcugguguuugugagcagcguccagucugacccucaugcauguuuuauguuuaaguccccuggacugccugugaucaaaaaacccauccugcuacaacuccuuuaggacagggcugguaaaucucacgaguccagaucacuucaguauuauuuccuuaaaccaaggagaaauuuucagucaaagaagaugaaugcccaacccgggacuccugcuauguuuccucagcccaugacuagacagcacugaacagcagaggagauggaugucaaagcgccucauggaggcuaaaggggguguggcgguaaagagacaaacuggaaacaccgcaggggucugagaaucugaguguuaaaggcuucuaggggacagcugagaaaacagauugguggccucaugcugucacauuccaaagucugugggaaagacugaaagccaaagccucuauuuggccaaaaaaguuggauugucaucuuaguuccagcgagaucuggacgaacuaauaguugcucgucacuaaggugccugacccaagcaucuuagagcuauuuauacauucaagaucgugauuaacauaacaugccugauuauuaagucacauuucccauuuccccuugcccugucaggcuagauccuugugagagcccaacccugggcuuggcaucugcccauaggcucuaagaggugagccuuugugugcccauguggcaaucauaagaguagucaagggauacagcugauaaucuguggcccuucuugggcacuguugauggguacacacuuccuuaggcuuacaaacagcccccuccagugacaacauuccucuggauagaauccagguaagagagccagucccaacaaagaaagggagggaaaccaaagcgcaaaggaagaauugacaccaggucuagaucuugguacauccguggucagugacccagaagaaaggucuuucaaaggcuuaggugguccuaguuacuauguauuuggagaugcaucacuaggcagaaccaggacauaaacugagacauaguaucaggggcugcagcacaucugugucuuagagcugaacauacccaaguaugaggcucacaccaaagaauccuguuaagucugagucagugaugugacccuacccuuuccccacaggaugcuauuaaaaccauuuucaacuuggacguccuuucccucuugguauucuuuggguagucaggcugacaagccaaagcuggucagucuacuuuuuuuuuuuuuuuuuuuuuugaaacaaagccuauguagcccaggcuggccuggaacuuuuaacuacauagcacaggcuggucucaaacuugugauccuccugucucagccuuuccuuaagauugugcaggaggggaucagugucagaaaaagcuuugggucaaggcagaauagauuccccugaaugauagacauacaaagugcuuuaaagauggguccuaggauacugaaaaggguggagugagugugugagugugugccuacuaggugggguccuggcacucugcuuaguccuagcuuuccccccagacuaaaaacuagucauuucguagauaccuagugaguguggcaguacuggagauugagcccagggccucacucuugcuaggugagcccccuuuuuaaaauuuuauauugagggccuugcuauguuguccaggcuagccuagaacauguuaucccaccucggcuucuccauagcugggauuauagguacggccaugcuaacaucuagauuuaaaaacaaacaaaaauccagguuauaccaauguuuaaacaccuuaggaaaaaaaaaggccacuuuuucuguucaaaauuggguccucgcagcaccagaagccuccuuuccccuagaacaaagcuguucucgugggccucagcugaggagcuaaaggagcucuucagaagaaaggggcacucagccaagggccaggggguauucuuggcaggaggugggaaaucagugcacucacccuagagcagaaguagcuccuuauuggcaggaagugggguggcaucuggaagugcuggggggaggggggccagccaagacaauguggccuucccucucucagcuccccaaccucccaagcagggcugucaccuguacauacuagagcaggcucccagcuagcaggagcagcauaggguggccaauggguacguuccacaggguggcagacaggacuucuugugccccgauuucuuaagggucucaucagucacgaugaguggacugauggccaaguugccggucaucguaagugcuauagcgcuugacaugaaugcgacggacacggucccguaguucaaaggugucuucaucuucacugggggaagccuggcugcggcuccggcuuguggccuccaguaaggaauugucagggacucgaggggucucauagaguaggacauugaguguuuccucauagauacgggccucugggaauuccaccuggagugaacagaaaagacagaaugagguuucauuuagugaggaaacaccuaacguaggagucagguggcugcccggcuaacaagggaagcaugagggggcaugagaguauagaucgacaccucuagcuacccuacagcaucccacaacugaagacuaguaugcauggguauauccagguauaagcacaacuccaugggcuuggugccagaugaagucugagcuuucugggcuguaguuccuguuuguguaaaguggugccaauagcuaccuuugguuuugguuuuuuuuuugagacagggucuccuuauaguucaagcugccccagaaucagaauccuaccuuagccuucuaagcacggugauuccaaccaaguacaccaaccugagcuaacaccucugaagaguuaucaacauagcaggcaagacauacauccuuuaguccagugacuaccccagcacaguaaacaaccaaaauauguaauagaaagcagcugcuuagccaggcagggugaugcccgucuaucaucccugcuaccugggggggcugaggucaggaggauggagaguucaaagccagcccaccuaguaaaauccugucucagcagagggguggaggagcagaggauagcucaguggguaaaggcacuugcaucaauccugacaacuugaguuugguccuaggacagaacuaguagaacccaaauggagagaauguuccaagcuguccugucuuucacucacaggccauggcagagcacacccaccaacacaaaucaaugaaauaguaacggagcagcucugagaagcagcuucauuguuuuucugaccuagaauggccccagguggccugucuccuaucgggugugaggggcuagggagagagcaucuagaaagaagacaggcccugucacuccugcugcugcucaggagcugcacugacucuacugucacagccccuugucuaacuccuggucccuccccgucccccggcuccugccccuacaaagacugcuccccacucuaagcugcccuuccgacgacccagucugcggcccagcuucucgggucucugugcuugagcccauuacuuaccagguaaccuguguggcacugcaccugugaaaccugaacuuaagcaguguuuaaguggaaagcacaccacacugucuguacugucuccaaguacagacgcuagggaggacaccagcuggcaucugcaggaagcgagaugagucuauguauauaugauauguccccuaucaaguaauucccgcaguugacuacaguggacuaugccgacgacccuaguacuaguggccugaggcaggaggaaugccauguauuuauagccaaccuagccuauuuagcaaguuccagccugagcuucagagacccugcuucaaaaauaaaaaauuauauaaauaaauaaauaaaaacauuaaaaaguuacaaaaaacucauaaaagguucaucaggcacugugaucacuccaucggcucagaaagccagcugaccaggaacaccaugcucgccuggcugcaagagcaguguuuaagcagaacgcacaccacacuguugcuucugaguuguaccuugccacguauuggcuacucagacucucauucccaugucugcaaguagggacacagaccaaugcuguuuaaauggcuccccaaaaucagauaucugggggggaaaaaaaaaagcugggaccagagcugcaaccugaguugugacaacuucaaagaccuggcccucccacagccccgaggggaaguucccugcugcucuuccucagcugcugaccgugucugaccaaccuccaaccucgguccaggcucuguccaaccuggcaccaucauaccauauuugggaaaguacauguggcccuuguguugcugugggcaggguacacuggggcaguaccagcucuccaucuuggaguccgugugaucugucccuggcaggcagcccauacauaccuuggucugcuucuucucuguggcguacacaaucgaggugcagcacaccucugccagcuuacggcccuggccauagaaagaccagcagcagaucucguccccaaugacauccuugaugaagagcacgcggccguugaagcgcagggacagcuugucaaacaguucaauguucuuuagcaggugaucaucagaguugcugaaacaccagaagcccagcagccuggaaugagcuuccagcacaaggggacugccgggaagcgcuagggucuccgcucccugauccuaucauguugaugugaggauaaggcagagggacagggaagcagagagcaaccuguaggacuggggccugugagggaaacggguggagcuggcccucagagagcaggagggaaggagugaccccaccuaagccaggaagaaaaggccccucagagcuacuucugcuccuucucugccguggggugaugcgcuguccacagggaccaggagagucuaaaagcaagcugcagccaccugggccuacccaaccauggccuguugugagggcacagugagaagcacaggcaccaggaggacucagcucacaucucgaccccgagcucccuucuaccccucuucaugccccucugccaggccugcugcacagggcccacucugggugcccagcccuuuaacugccucugcugcccuccccagggucccagcagagacgccugccguaccugguguaugaguacuuguuguugcuccuguuguacagcagcuucaccacaggcugugagggaagagagagugagggccaggccaggggccugguguccccagguguccccagaccgagacccucaguguaugcaguaccuuuguggaggauucaaugagccuguccuccucccucagggacgugaugauggggauguugcacacaggcugguaggagucuuucuuguccugggugacacacagagcggagagcugccuuuaggauucugugcuagccaagcauaaccagggacauccccaggccucugccacggucacacacagacacacacacacagacacacacacacagacacacacacacagacacacacacacagacacacacacacagacacauacagacacacacagacacacagacacacagacacacacacacacagacacacacagacacacagacacacacacacacacacacacacacacacacacacacacaccccaccugguaaggagguaccagacaguucaugacauucuugguaauagauacugccagccaggaagcaguuccccacugccagaaaucugaggcugauaccuaggcacaugaacuggaggcacagcccgcucgugcagccaagcgugacucccuagaagccgugugcugggccugggcagcuccccaucguucugacugcauucggacuccucaaccucauuuccaacccagcuucccaggggucaaccaagccucguguccccagggggacaacucuggaccccaccagaccacgugacacuucccauaccugcagggcagucuggcacgugcucaccagcccuugaaugagguaauauuuugcuucagccaucaacuccuggauuucuugccggcuuugagggagggugauggugucaucucggagguaauucaagauggugccaaagugcuuuccacaucggucuaugagaauccagccuagggagugagaggggucccacaggacuaccguuugccuccaagcuguguccagcgcuggcaaaggccaccugagagaggcaggcaggcagcaggaugcaagggaaggagccacaugaggagaggccagagcccaggccagggguggcuccgagacucuaggucucaggacagugcuacucuucccuauccugagucugggaacugcuaucuucagggcucuguggaggacuggcugucuaauguuggggcuacucgggccacccuggugacacagaaacaaccagucucugcuuaccuuuugcccacugcccagguucuacuguguuuaugacaagcuuauccuauuuggauauaaauacacacgucagcuuugagacaguuguuccgguuagccgcaauuugagauugaugugucucagccuccugagugcugggauuauaagcaggagccauuacuccgggauucuauuugauaagguuucauauagcccaggauggccucagguucauuauguaguggacacuggccucaaauuucugcuccuccuguccccaccucuaagugcuaggguuacagauguaaccacacccagccuaaguaugauacacaagcauacaguuuucuaugugcaaucucaaggaauucugaggcucuguuagaacuuguaugggggaggaaaagauauauauucuagaucuauugggucaagcccagccuuggagucagcucaagaugcucccuuccuccucucccuuacccagcaugcccgcaugcaauggcucaccuucuuugucagucagcaccuccauucgcccacugaacauggccuugagcauggugucgugccgggugagggcccgcacugugguguaguacagggagccucccacauugagcugcacguacuuguugcccagcccgccucccuugaagccacugaucuugggcuuggcccccgaggcuggacacagacagguguccccugacaucucccgcugcagguagaucaccacacggcaggagguaggcuuagaagguucugccgugguggaagugaucacgagugaguggcccucagaggccagggccucauacucucagugccuguaagcaagagguagagagaacacuaaagucagcagagaggucacagggaggagggacagcagagggaacucugacacaguuuacuuuguagagaagcccuuccucacuguacgaguuagauucuugucaacuugacacaagcuaacaucaccugggaggagacccucgcuugagaaaaugccucuaucauacuggccuggaagcaagucucugggagcauucucuugauuaauaauugaugaggggcagagauuggggggaaccaucccggggaagguaguucuggguggcauacgaaggcauucuaggggccggagagauggcucagcccuuaaaggauaggcucacaaccaaaaauauaacaagucacgccggcaagccaguaagcaguaccccucuguggccucggcuucagucccuacccccggguuccugucgccagguuccuuuccccauuucccuuaaggaagaacugugaccugggaagucuaagccgaguaaacucuuuccuccccaaguugcuuuuggucacaguguuuuaucacaccaguagaaugcaaacucggacagugggcaacaggaagaaugccccgcacgcuguucucacgguaccaggagccaggucugggaucacagucucccuguggugugggcaucucaccagcuccucuaggaucagcucugcuuccggcugcagggaaaaacccuucaaacuagcuaagggucggaugagcagaucucccugggaucuaccagaauggcuccagaaaauguuuuuccaagauucccaggauuccaggcguccagacuaaccaacugggaaucuagccagccucggauuuucccaggagccagggggacaggauacacuuccugucucaggaauagcccccuccaggauucagguuaucauuagucaaaggaagccaggauccaggaaggaaagugagugugguucuaagagcacggggagagccgcuguaggggcagccggccagggagcuuggcaggaguuaccugagcugcccccuucucagccccagcccugccccagguuccuguaacugucaccuuucucaaggcacagcagacagggcuguugugcugcuuucccccaagagcccuuuuucuuccuucccaucaagaauggggggagccgggcgugguggcgcacgccuuuagucccagcacucgggaggcagaggcagguggauuucugaguucgaggccagccuggucuacagagugaguuccaggacagccagggcuacacagaaaaacccugucucgaaaaaaagaauggggggaacagacacaaugacccuaaaaaugaguaagcucaaaacugaaaggaaaacacuaacaguucagagacccgagaaaugacuaaaggaaaagcuggugcucguuccucguuugcuuucaguuauuuuucuuuuuugguuuuucaagauacagguucucuguguggcccuggcuguccuggaacucacuuuguagaccaggcuggccucgaacucagaaauccgccugccucugccucccaaguucugggauuaaaggcgugcuccaccacugcccggcucuuauucuguuuuuauugcugcuauuuacauucuuaauucuaaaccuguagauggaaagaaguuugaauguaaaaaaaaacauuaaguccuagcugggcaugguggugcacaccuuuagauccagcaccagggaggcagaggcaggcagaacucugugaguucuaggccagccucaucuacagagggaauuccaagacagccaguuacauagugagacccugucucaaaaaaauacaauaaauaaauaaauaaaagcugggugagguaguguaauccuagcacuugggagacagagcagguaaaucucucgaguugaggccagccuggucuacagagggaguuccuggacaguuaagacuauacagaucucuaucaaaaaugaacaaaagauugaauuuucacugaaaguauagagacuuaccgugguugccaccccuaaacagcacaguauaaaaauuauuuauaucacacuucauacauuuacaguauuaguauuauuaaauaagccagagauaauagaaggaauucaggaggguguguauagauuauauguaaauauacagcauuuaaugucauaaagaacuugagcauucucagauuuugguauuugcaaaaaaccuagaguuggggcuggagagauggcucagagguuaagagcauugacugcucuuccgaagguccugaguucaaaucccagcaaccacaugguggcucacaaccaacuguaaugagauuggaugcccucuucuggagcgucugacagcuacaguguacuuacauauaauaaauaaauaaauaaaucuaucuuuaaaaaagaaaacaaccuagagucaaugccacacagacaugaagggauaauuggaugaugauggcauuuuuuugagaugucuaugauguugcauuggauguucuagaccuugauauauagacuaagcugaucucaaacucagugauccaccugccucugccuccugagugccgugauuaaaugacagugccacugcuccugucuguaaucuuuuggcuuauccaaacuaccacuaaccaggccaaggaugguggcucacaucuauaauccagcacuuggaagucugaggcagucuggacuacagagacgccaucacaagguuaaaaaaaaggaagaagacuaagcuguaccuuaauuggcagaaugcuugucuagcaugcaugaggcucuggguuugauucccagcagcauauaaacuacaugugauggcccaugccuauacuccaagcauaggaugauggaggcaggcagaccagguaucucagcuaccaagaguacaaguggcucugccugaaaaaccaaccaaccaaccaaccaaucccaauugucauuagguacuauuagguucuugguggugcaccucuguaauaccagcaagcacuaucagacuaagcccugccuggaauacagaaugagacagaacccaaccugguccagauagcaggaucuuuaaaacacacgcaaaaaagaguaugauaguaauaaaaagucacauacugaagagaugccucaccuguucugaacaccagcuguucugagaagaguccugcccucauggaccccacacuucaguggaagaagacagacuagcugagcaugguggcacaugccuuuaaucucaguauuggaaguuccaggcuacauagaaagacccuaccucaaacaaaaacagaccagaagccacacuauaaacgaugggacaaagaggcagacaguuauagaggugaucgacgucacugagaauauaggaaugauaugagaauuaucaggcugaggcuugagaccaauugaagaucacauuucaguuaagaucugaaaaguauagucuagacagcaagagcaaagcuccuaucugaacaaguuuuagaggcugaagagaugcucuuccagagguccugaguucaauucccagcaaccacaugguggcucacaaccaucuguaauucgacaccucuucuggugucugaagacagugacaauguacucauauaaaugaaauaaaucuuuuuaaaaaguaaaaaaaaaaaaaaaacugccuuuaaaaaguauauuccugggggcuggugagaugguucaguggguaagagcacccgacugcucuuccgaaggucuggaguucaaaucccagcaaccacaugguggcucacaaccauccauaaugagaucugacucccucuucuggagugucugaagacagcuacaguguacuuacauauaauaaauaaauuaaaaauaaaaauaaauuaaaaauaaaagagauuauaacuucaaaaaaaaaaguguauuccucuugcaguagacccagauacaguuagacccagauagcacccaaaucaaaaggcuuacaauacucuguauccuguuccaggagaucugacacccucuuaugggugcugcugcaugcacacacaugguacacauauauacacucaggcacacacacguacaaacaaaaauguuaaaaagugaaacaaguuuuauggggcuagagagauggcucagcaguuagacguacuggaugcucuucuaggaccuagguucaauuccuagcauucauauaguggcucacaaccaucuauaacuccagucguaggaguucugaugcccucuucuggucacugugggcuccaggcacacaugugguacacagacacacaugcaggcaaaaucagcacacacauaaauugucuaaaaggaacacauuuuggggacaguagugacauggcggcggguauauaggaagaagagggaggauggucuggcaggaagccagagaagacaagugcuacaugagaaggaagagcugggguuuaugggaauugcaacagacuuuggggucggggaaggcuuuuagcaggggagugaugugauccaaggacaacuugaugcugugugggaugcaaaaguacaugaaaggaaaugggaaaaucagaggaaggacugguccaggcaagugaugauaaaggcuuacaccacagaagcaaugcuguaaacagaaacaacaacaacaacaacgccccaaaguggaaccaaccucuuuaauaccggaacacucagucguuuccuguuauuccucauguuuuacagguaaaacccacaacacugguccucaaacaagaauuaaguauauacaucagcuugcuaaacuaaaacugacccugaagagauuucaguauguccuuggaauggucgggaguggggggcuuucaggaaggucuauauuggugcuauauuaaguagcauauccuuuugauggcuuaauugcuuucagugauggaacauggaggaaacgagcuccgggagucugacaguaacacuacaaugcuagacuggugagcgacugaccgccuuaccucaaagcgggaaaaaaaucaacuccucaacaaguuuuagcaaguuccucacauacuuugugugcagucccauuuccccagaaucaaggaagcacauaaacacguucugccaaaucaaagaaacccaagugacuaggcuugccaacugaggaagucaaauccggagcuaaucuauucuuuuccuccuaagagcuacuuugaguccuagaugacgucagaccagauuccacccagaccaauuagguccaagaguccaauggcaggugacgcccuagaaagaaauuucugagaggaugaaguuuccacugauaguuucagggcucuuuccucaggacuucgccuguggauagagggguaauccuggggcuggggaacauacacgugucucuaugggaaccuaaugcgaagccaagcagaacaaagcgcaaacgaucacgguaguucaaagacuugggguucuaaaggaaggacacgagguacggcgaggugggaaggcugauuuuggcaagaaaggucagaaaucguggaagcggcucuuauguuucacccaaaggcucuccaguggaaauggagaaacaucccaugucucucguugcaguguaggcugcucucccgccacaccccuccucuucugaaaaacugagauccguggugccucccauccccagaaaagaccugaacuucauccccgcgcgccaucccgugccuuuugcccaggacucagcagagccuguccuuccccucugcacccgcaccucuggcucucaccguccgcggggacgccucuccgagucucagucaaguagcaagcggacucggugccaccucuggccugcggcugccugcaaucucggcugugagcucacauccugcgcccgccgacuccggaguuacagcccaacccuacagaucgggaaagagacuacaagacccggcaugcacagcgcgcgagcuagcagugggucgaaaacuugacguuugacuuccuucuacuuccggguucgggaacaaaucua

SEQ ID NO: 6206 - RNA, 5374 nt, Mus musculus
ugagcaaaggcuucugggccuagugggcaguuaucgcguguugcaucuauuucccagcaagcaccgcagggugggcggaugcuggugcuucuggacucgggggugacguguggcuccuagaucuugucuccguggcagcagccgguugcaguugccggagagaagcuucuaccgacagucgucagggccgcagagcgcugccgaggcggcucgucagguaggucggggacguggaggacuugggacgggaggaggccgacgugacccagcgccgaggauuggcuggaccggguggaaagcggcgguuucccuaccucggaguuuuuagggaucggguuuacacucagcucagccuggcucccucgaugucaccggugaaccgagguucggacauugcaggaguauaauuuaguaaagacagccgcgccauuugcccaguucuuccugugucuacgccuucuccaaacuccacagcuacaacuauuuguugugccugcggaccugggagagccagggagcguagagccaggcacagccuucaugcuuaggaaacucaaucccacguuccuggagcauauuuguggugggaguuaggggugggcuggggaucugauagcccgcuauguaccauaucuaucuuacccaucucuuuaaacuguccuuuccagccauacucucgguccaauccagauccauggcaaucguguuuggcuccuuucuucacuuuucuccaaagugcugcauuaagcauuacuaaauucugucaauucagacaucaucugaucucugaacucccguucggcuucaaaucuuuucuucuguuacagccuucuguuuccacaugaauucauucauucugcaaacauuaucagagugccacuuaccugcaggcagccugcuuagagaugcuuggcucacagugagaaauuuggaaaggacgccucuauucugcucuucccuguucccucuguuuggccaaggcagugagugaucuuuccaacucugaucaauaagcacugccgaaauccacugcuagcgguuaucauuauaaaaaauaauccaaguucagcugggugugguggcgcaugccuuuaaucccagcacuugggaggcagaggcagguggauuucugaguucgaggccagccuggucuacaaaagugaguuccaggacagccagggcuacacagagaaacccugucucgacaaacaaaacaaaacccaaguucauuuacucauccagcuauagccgguugccagccuugcucccucuugcuguuuugaucccaggacccuuugugucaaaaucuuccagccuuaggacgcccccauaugcuuuucccuaugcccacaaugucccucucccuucucuuagaagauuuucuggacguguuuaggucccagauuguuuuuucugaaggcuuuuguugaccucucugccuacuugaguuauguccuccuguagaauccugacagagcacugagcgcuguuccucauacccugaucacaguuuguguuuauuugcuuacugucugucuagagacacuauguucacucuguccuuggagcugggauucaauaaggguuuuuguuuuugauaaaugcauguuaacucagaaggcaguaggaguucaaacaaguguuugcagucucaugucauaugaacucuuccauaggaccugguccaguuagucccuaggagcucuuaaauacucaaacuauccaacuagaacaacacaggaaggcaauuguuuuuuuguuuuuuguuuuuuugagacaagggcuuguguagcacaggauagccuggaacucaguaugcagcccagguugguccuaaacgugugucagucuucuagcaacacagugaguugcuagaauuagagucacgcaugaccauagcuagcuuuuaacucucauuuuaaaauucauccuuuuuguuuuguuuuguuuuucauuucagggcaugcauuugaaaagccuuuuugggaccuuaaacagggauuuaugacuaugcuuuuaucucgcucgcagcuuaggccagauacacccaagugaacugaaauugucuuuucuccuugcuuagugauauuucuguaaaaaucacuugaugcaauauaauccuucagguucacgugucuguuuuccuccagcuaagcugugcugcuccagggcaggcaccauguugcauucaucuuuacgcccagcaucuagcagugucggcauguaguaggcacucaagaaauguauguugaaugaacgaugucugugacaagcaacuggacuuuccucuuuccugacccuugcuccuaugacauaccuccugauugccacugucaccccuucaaagcagaccucuagggcuuccuggaagggaaacaggugaggcugagagcuggaggcagagggauggguguaugaggagggcugggguggugucugggaugaaauucaggucgcugcugguuucucugcagcuauggccaaggacaucuugggcgaggcagggcugcauuuugaugaacugaacaagcuccgaguguuggacccagaggucacccagcagacuguggagcucaaggaggagugcaaggacuuuguggacagugaguaccaucuggagacacaguguuguucugcuuugagcaguuuccuuaccugaccuuggccauuguucuugggucuaccagaaugaaguugcgugcucucuggauugagccuggucucuggguucccauguguacccaaccuucucugcuugcccucuuacacugccauggagucccacauuuagugccaagcaaugguuuagauugggggagguguuuuuagaugugcugcaauguuuuguuuuuuuucuuuuagcaaccuuaaaauugaugauaaagaauuacacccuggaggugggagaugaaaugauauacuauguuacuuccugguggcaggauguguuguuuggaguuagagguagugacugaggagcagcucagcacagugcucagcucugggcuacugaucucccagaauccuccuuuccuagcggcuaagccgacccaguaccagugggacauucagauucagcuagagcaagggagcuuucuuuccuuuuuucgagacaaggccucacuauguauguugcauguuggccucaaacucaugauucuaacuuagccucccuagugcugggguuccaggccugugucauacacucagcuguaugccguggcuuucucugggcuuauuuucauaaaauaaaacgauuccaccaagggcauugggaaagcaaaugggaaauggggcgccuaaauggcacgguuacaggugggaauucucacaccaccuuuuacugaaacccaguguugucuggccagucuagagucugcacuuggguucugagagccuuuucugagaaagguaggguuggguccacacugcagucuguguucuaagucuaguccuggcgccucuccugccacagaccagauagugggaggcuuagguuagugagcauuggacagccacaacacaauuuaggugugguuagcuccccccucccuacuuccaagggaugcuaacaagaauguuuuguucuuuuccucaaagaaauuggccaguuucagaaaauuguugguggucuaauugagcuuguugaucagcuugccaaagaagcagagaacgagaagaugaagguaagaucagcaguugguccuggccagaaacccugcuuauuauauggaugguggggucaucuuuuuaaaacaggcauuuaauaagagaccuggccaaguuaauguggugagcuuauaugccaauauuuuuuuaagacuuuauuuuagugugaauguuugugcacauaaugagugcaucagaggccagguguuaaauccucuggaacuagaauuagaaauguuagguugugagcugccaugugaguguggggaauugaacccagguccucuggaaauacagugcuuuaaugacugagccaucucuucaguccucaguuuuuguuuuagauuuauaugugugacuauuuagccuccauauaugcauguguaccaccuugugugccugaugcccaugcccuuggaggucagaagacggcauuggauccccuggaacaaagcuacagaguugugagcugccauguaggugcuugcauaacugaaccuggcuccucuccaagcgccacaagugcucuuaaccagagucaucuuuccagccccaccaguccaugcuugucauugcucccuuugaucuucauggucccacugguggguguuuacccuccuuuuaaaaaugaagacacgaaagauugccugguagaugacuuggugaguggcccaagacuaaaugaugccucccaauagagcacugcauacacuugugggccugacugcucgugcugccauuucguaccagguacuuucaggagaagaggagguuaauagucaugacuaaccaguaaaaccagguccuccucucuuggaggacuuuggggacuuuaaaaccucgccuucuuugguaacgucucuuaggccauuggugcucggaacuugcugaaguccauagcgaagcagagagaagcccagcagcagcagcugcaggcccugauagcagaaaagaagacgcagcuagaaagguaagcggccauggccacugcaaacgccuuuuccuucucugccaccuuggcuucccucaccauuucccagguagagcaucucacuuuaaaaauugauagaagaaaguggggacuugguuaauuccaaauugccuccauggugugagcacugguucuuauaacaaggacugaggccaccucccgugccuucccugggguagaguguucucccagguggcucuaaacagggcuuugcuuaucugacacucuggcccugccuucucaauucaugguuucuugcaucuguuuuaaagcucuauacacucaaagaauuauguuuuuauuucauucuuuucagggcuucuaacaauuuuguuuuucagguaucggguugaauaugaagcuuuguguaaaguagaagcagaacaaaaugaauuuauugaccaauuuauuuuucagaaaugaacugaaaauuucaguuuuauagcaggaaggcaaaaaaaaaaaaaaaaaaaaaaaaaaaagcaccccaaccaaaaaaacaaaccucuguaccauuccagugaugucacugaugugcgcaugcaguguuacgggggcagcugauaaacagugcacagccucugcuaguggccaggcagcacagggcuucagcucgacuucucagcacaaacucagugucuguaaacuuugguacauucacaaagcucucaaggaaaagcaauaaauaccauuugcaaguggcuuggucuuucu

SEQ ID NO: 6207 - RNA, 9844 nt, Mus musculus
agagagaagcccagcagcagcagcugcaggcccugauagcagaaaagaagacgcagcuagaaagguaagcggccauggccacugcaaacgccuuuuccuucucugccaccuuggcuucccucaccauuucccagguagagcaucucacuuuaaaaauugauagaagaaaguggggacuugguuaauuccaaauugccuccauggugugagcacugguucuuauaacaaggacugaggccaccucccgugccuucccugggguagaguguucucccagguggcucuaaacagggcuuugcuuaucugacacucuggcccugccuucucaauucaugguuucuugcaucuguuuuaaagcucuauacacucaaagaauuauguuuuuauuucauucuuuucagggcuucuaacaauuuuguuuuucagguaucggguugaauaugaagcuuuguguaaaguagaagcagaacaaaaugaauuuauugaccaauuuauuuuucagaaaugaacugaaaauuucaguuuuauagcaggaaggcaaaaaaaaaaaaaaaaaaaaaaaaaaaagcaccccaaccaaaaaaacaaaccucuguaccauuccagugaugucacugaugugcgcaugcaguguuacgggggcagcugauaaacagugcacagccucugcuaguggccaggcagcacagggcuucagcucgacuucucagcacaaacucagugucuguaaacuuugguacauucacaaagcucucaaggaaaagcaauaaauaccauuugcaaguggcuuggucuuucuucuauggugcugugugcauuauuuccagucccucugagaacagaguuguucuaccccccccccauccacacaacaaaccaggcuaacaacaaaucagcagcugccuuuauuuggaccagacacauaaguaacaaccacagcaacauggcuugcaagcagagccagcacugucuagcacccaccggguuuuguuucuguagagucaguggaacaagcagcagacauacacuggacaguccagucacccucacaagccugcguacuaggaagcccaguggggugaggugccagaguagggacaugagagccguucauagaaccagcaccagaauaacccagagcaggcuaucuguucaagauagaaauggaggcaccuuccuucccuguaacccauuucuggcuuggacucaugugaggcuauaauauauuuuucucccagagguggaggugugggcaggaaaccauguuaaaaagugcuaaagagacaaaauacugcucauuuguugacuaucaaggucgaggugaggacuuggucaggugugugcauuccaggucaggagcuaaccggcuucccaccuggccuuuuuagcagugcugugguagcgcuuuggcaccauuuugcuguaacuuggucacaccccugcugaaaggugaaggccuggcacgucucccaccacugucuuguuuguaugcacugcuguugguguuucaaaugcugcugaaacauguuuggggcaguuuuccuguguuguccaaaaggcaacugugcuguggggucuuccccaccaggcugguggccgucccuauuuuuucuuucuuuucuccucauacuuguaguacggguuccgaagcaugaacaggaggaguaugagggggauuauuaaauagggggcguagacaccuacgagggucagucguucacggaaacucucgggucuuugucccuugaaagcaacggcuuuagagaaauccucaaacaggaguguguagaggauuggaauuaaagucguuauggugugagcugcauagaugauugcagggauucggauccaccggcagcuuccugaagcagaggaggagaaaaggguaaucagguuaaggcgacuccaggggcgucugggaccugcucugccucaucacccguuugucugccucugaguggaaccucagacuauacacauggaaaccagguguugcgcugcucaacagguaagcuuacaggacccaaacagcucagccagucugaucuaaaacaggggaagggacccugucccagcacccguagugauucacgugcagaaucccagugagaaauaaacuuuuccacucuauaagcuuaguuuccaagggcaggcauggcuacuucauaaauaaauaaauaggcauacuuuuuuuuugaguuuugccuacauguauuuaguguccugaggccagaagaggguguuggauccuggaccuggaguucuagaaugguuaugagcugccaugugggugcuggacaccaaacugagguccuucagaagagcagagcugggaggaagcuaggcuuacaaccaacacguaagagcggccaguguucuuaauugcugagccccagccccagaaauaauuuuuaaaugagaaguuaagcucuucagggauuagcucgauacuuccugcucauaaggcaauauacuaaccuaaggggaaaguaaggccaaggauaaauaaauaaauccugagccaaacuaggauuuugugcacuguaccaaccuuugaagaaggcauaugccgcaaugggaaagaaaggcagcuggaacacaagcucacagagcaggaaggacuugaaccacacugggggcuccugcaucagagggucuuugaacuccuuugaguaccaccgcaacagguugcugaacugcaaagagacagggucacagugagcauggccuugcggcuugcauggcucaguggcuccagugcaccaauauccucugcuaagagucccuugugcagcccugguggcagcagucacaugcuccaacuggcucuugcaucugcagcacugacucucccuuuaauacaguccucauguugaguuaccuccaaccauaaaaguacuuguguuguuacuucauaguaguaauuuggcuacuguuaugaaucguaauguaaauaucuguuuucccauggucuuaggugacccccaugaaauagucauuagacaucuaaaaggguuaccaccacagguugagaaccauuggccuagauggucacuaauaaaaacuuacuagccauaauucaaauguuacccucucugcacaguaaguuuuccuuucccaucccaucuuaguagaacugcacaucuguuccucacucugugauagcacaaaccgaggcauguuacuguacaugcuacuguagagcugcagugccagcugcuuacgagauuuucaggaugcuauuccucuaccagguuuugguaagaaaauuaaaaacccauccugacauuuucccuuucacaaaugcauauccaagucccaaagcuagauacuucgaaugcagaaaccaguugacuuuucuaggggggaggguagaaggaaguaaaucuaaccucuguggagacauggacauuuuaaucccaauauuacaaauaaguuuauuuucauuuaucuuuuaaaagaccagcugaagccaggcgugguggcgcacgccuuuaaucccagcacuggaggcagaggcaggcagauuucugaguucgaggccuggucuacagagugaguuccaggacagccagggcuauacagagaaacccugucuagaaaaaccaaaaaaaaaaaaccaaaaaaaaaaaaaaaaaaggaccagcugauauuuguggaaguaguaguaguaguacacagcaucuagguucgcagggcuggaguuauugucugguuccagcuccagccucacccuugccauuaaccaaucacagcugcaggugcacgcugacgcgcuuacaggggagacugcagcugcaacccugugcuuuacaggagccagacagaggcuagagccuggccaacuuagcauccugaaucccaggccauccucagcuacauacuuggucuacggcuaaccugggcuauaugaagucuugucucaaaaacaaauuaacauuacaaaaauagccuggagguggcacucuuacaccuucaaagccaacuaaguauugggauaugguggauaaaggcagcuuccuuguguuuauuuuacaauggaaaaucuagggauauguuuuauguuaauuuuuaaucaaaagguaaaggcuguuaggggugguggcacauaguaaccccagcacuugggagauggagcuggaggggcggaguucaggccucuuuggaggcuaagucugagauacaggagaccuaucucaaaaucaacaaaaccaaguaacaccaaaaaaggcuggccauugugaaacaaaagcucguuaccacgagggcuuugaagcauccagaugcugcuggggucacaggcaucagaacacacagcuuugauucuuggcaaugccgccugccuccugaacacucuucagggcaguaagguugggacaguaaagguuaagucagcccucccgagacuccacuuccucaucuguaaauucagcagguuagacgguuuuuuucccuuugcauugugguuuuugagaacaggucucuagcugagaugggccuugaacuccugacccuccacuucguggguucagggaauagagcugugcaucacagcuucacuuuacaaugacaucacuguaaacaaugucugaggucugccucuuccacagguccgcacagacacgugcugaagggcugcaaaguaagaucagcaaagcugacugcccagucccaaucaguuggagcccauaggggucuaccacacauaucugcugccagaacagccuagacagugaguggaagacaaagacaagguccccagcaggguggcaggacugcuggagcuggaggccaagggccuggcucugacaagacccuuaacagcaucacacauaaugccgaugaccauccuaugguguuccgaugcaaugacuuaauacaguggccuguagaccagcagauagcacagaugaaggaagcuuauuuguccagaccuggagaugcuccagcuuaacacuacccaauggaagcaggcaacugcucauuaucacuuaagcccaaaccccaagguuuaaaagaaaacacuuuccauuuacaccacaccccuaccuggaacacaucucucugaacucaugggcuacugcauccugcggaccuacagacucacaccccuuucuuauuuuaacagaauggauucacucagcugcaaaagauacuacaaaaucuuuccaguuuaaacucaaacucaagucuuuuaacuguuucauaaugguuuuuaguucuugugauuugauugaaacagcagcaaaaauuuagcuugcaaaauucagcccaacugcugaggccuucuacauuguuaggaaaaaacucuagaucauaaguuuuagcuaucuauuguuuuggggggaggguguaaauuucagcuuugcuauuuuauagagauggucuugcaguucuaaguucaaguaucauucacgacaaucugaggcugacucaagucacagacuauuauuuucuucguggagaaacaauaaaaucauuacucccucauccaaaagcagcaagaggggaacaggggauggccuuccaaggcaggaugcugcagguucaugcuuucaguagucaacagcagagaugcaguuuugggccaguacauuaaaaaggcagggccagcaagcugguucugugcuugguaaagugcuugguacacaaacucaauaacuggaguucaaugcccagaacaaccucaaagguagaagaccuggcccacagguugucgugaucuccgacaaugcagcaugcacucccuaacaguaauaaagugucaaaggcaaaaaggggacagaguaaagggcuagccaggaaaccuagcaccaggugcaugagacacaugaauaaugcuacaucccuaaccuggaagcuguuguagaauauucgaucacacugugauuuccgagguuguguuauuuacugggggaaaaaaaacccaccacaaacccaaaauccaacuuucuuuucuuuuuuauuagauuuuccuuuuuuuuuuuugagacaagguuucucuguguagcccuggcuguccuggaacucacuuuguagaccaggcuggccucgaacuucugccucugccucccgagggcugggauuaaaggugugugacaccacgcccggcucagauauuuucuuuauauacauuucaaaugcuaucccuaaaguucccuauacccucccucugcccugcuccccuucccacccacucccacuucuugguccuggcguuccccuguacugaggcauauaaaguuuauaagaccaaggggccucucuucccagugauggccgacuaggccaucuucugauacauaugcagcuagagacacgagcucugggguuacugguuaguucauauuguuguuccaaauauaggguugcagaccccuucagcuccuugggugcuuucucuagcuccuccauugggggcccuguguuccaucuuauagaugacugugagcauccacuucuguauuugccaggcacuggcauagccucauaugagacagcuauaacagggucccuucagcaaaaucaaucuggcauugugcaauagugucuggguuugguggcugauuaugggauggauccccgggugggguagucucugaauaguccauccuuuugucuuagcuccaaacguugucucuguaacuccuuccauggguauuuuguucccucuucuaaggaggagugaaguauccacccauuaaaacccaacuuuuuacuugugguguagcucagcacuuagcacacaacuuuaaucccucuggcuagaacacagacacguucuuagaauucaccucucauuucaucccaaacaauuaagguaaaguuaguuuguagaaggaagcaccuguguuugaaagugauuucuaauugaguggcaaagugaugaaucagagaaagauuugacaggauagcauaugcccaauucucauggggaagaaagggaagcuacuugagauagagcagagagagaaaaaaaagagggaggagaaaggcaguuuuacaggaagaaacugguuccagacagaacaaacuagauauagaugaagacagaacaagccagaggaugagaaggcgccagauuagaacagauugccaguaugaguuugaggccaagcagauuaauucaggagaggcccagacagaagucugguugagagaggaguuugagccagaacagcuaaguugaaccagccagccagaguucagggaaaaaaagaacagaugagcuuauucagcaguaaguuucagaggcagaaaacacucuaggucuaguuaagacuguacagaggccagaagcuuccaggacuaggccuagcuaaguuaacagaugguggcagcaaauguuuacucugagaugacaauuacaagaggagaauaaaagugauguaacaggaagcuaauaaaaguccaccagaucaaacagagauugggcauggugaagugagcuuuccguauuugggggguagaaacaggaguucugugaguuugagacccaccaggucuagauacugaguuacaggacaccuggagcuacacagugagacaccaucuugaaaaacaaacaaaaauaaaauguuuaagugguggucugcaugaugcuggucacaucuaguuguuucaggaguggugagcaaggaugggugcaagcagucagaagguaaaccaggaauugccagggaaacaggcuggguuuucaaaguugugaggcccuauuucaaaaaaccugucacucaagccaggugaugccuguaaacccagugcagcucaauuggugaauucaauuuuuaaacaaaccaaacccaacccaaccaaacaacaaaaacaaaccucaaacacaauaccaaaggaaaaacaagggcuauggguagcucaguaugcaaagcccuggguuuuaucuccacugcuaccaaaccccaaagaaacagugacuccccuucuucauggcuauagcuagugcaaaguuuugauggccucuuuguaguugucaggcccuuccguggcagcaggcugacagcacucaaagguaucauguccuaauccauguccaauaggaccacagguguacagaaggauguucaaaggggagguuuuccuggguuacauggugggcccucgugaauuacaagugaccuuauaaaaggcagagagagaugugaauacagaugaaguggcaauaugacggaugaccugcagagauugcagugaaagggccacagccaaagaaaggucaguggguagacugugcggccugagugugauccgcagcucugcaaacccagccaccuggaagaggcaaggaguguagucuaccuuugagccugagaccgaacauucuaaauuucuaaccuccgagcagcuuaagcauaacguuggggguaaaguaagccacugcguuugugacaaugucuuagaggagugaaacaaaucaacuuaacuugauaacacacugguuuuggugcugggauuugaauccagggccucgugcaugcuggccaauguuuuuacuacggagccacagccucaaucccacaaucuuuugaguuuacaaucuaaagcuguagcuacaugucaguuacagccuggccugagguccucuugcaauggauucaaaugaacuauuauuuuaaggggaaaaaaaaguaggauccauagggcccucaacauguccacaggcagccaguccuugggaaagcagcaccacagaccggugcucuugccacaugcuaccuacggguuuccccuguagaucaaaggucuuugcaaucccgugguuccacaaacaaaccaaaaagacuuaagggaguggggggugacacugcugauggugucacuccuuaacuuuguugaguaggugacaauuccugugucauguccucucagagaacacaaggcacaugucauuuugcagccaccauugagaauuuacggauuuaagauuaagaacugcccugcaaagaagaaacauuuaaagagcauuucagccauuucaaacauuuagguggauaaguccgucaguagauuggagaggcaugcuuaaucuugaccuuaaaaucgggucaaagaaugcucuccaaagcgcagggaacgguagcucaucuucaaacaauucaaaacugacuuggaaaagcgacauuuccucaacugcuccucaagcuagauccagacccagaaggaguguaugaaugccacgagcacuaaccaagggcuaacccuucagucauuuuauucuacuacgcaggacuuuuuuuucuuucucggcuuacacuggacuuuuaaaguccauccaaacgcaauagauucaacacgugacagacacugguucacccaggcaacuucccucagccaacugccguaguuaaaaccaugggagcgaaacacacccaggcaaagguuuugcaaaggauuggcgaguacauggggcucaaacccaggaccuccuaggcaugcgcccuaccauuggguugcacccucaguuccgcucugaaaaaaacaaagcgguggucaacggcuggggacagccggcuggggccgaagucaggcacggagccaacagaaaucaggacggccacguggggaccccugagccucaccuccugcggguauaguucgggcggcagcaccgccugcaggucgaugaacagcgugauggggaugugcgagacgaaguagaggcccaagagccacucgacacagcgccuagcugccagggcccccauguucccuccuguccguugggcuacgacuggcaagccggugauagaagccugcuacgugguuagaagccccgcgcccgagcugugccgucccgcccccggcucacacaggccguaccuauuggucg

SEQ ID NO: 6208 - RNA, 4110 nt, Mus musculus
uuccggggcggccugcugggccucauggaggcuguucggccagacagcugcgaaagcgggccggcggcgccgcgagccgaggagaggccggcucccgaggcgagggugcacuuccgaguaacccgguuuaucauggaggcaggcgucaagcuaggcaugcaguccauccccaucgccaccgcuugcaccauuuaccauaaguucuucugcgagaucaaccuggacgcauaugaccucuaccuggucgccaugucuuccauuuacuuggccggcaaaguggaggagcaacacuugcguacucgugacaucaucaacgugucgcacagguacuuuaacccgggcagugagccauuggagcuggauucccgcuucugggagcuacgagacagcauuguacaaugugagcuucuuaugcuacgaguucugcgcuuccaagucucuuuccagcauccacacaaguaccugcugcacuacuugauuucccucaagaacuggcugaaucguuacagcuggcaacgaacccccaucucaguuacagcuugggcucugcuacgagauagcuaccacggggggcuaugccuccgcuuccaggcucagcaccuagccguggcugugcucuaccuggcccugcaggucuauggagucgaggugccugcagagggugaggccgagaagccuugguggcagguauuuagugaugaccuuaccaagccaaucauugacaauauugugucugaucucauucagauuuauacuauggauacagagauccccuaaggcccuggccgaggccggaccuaagaccaggaugaucggaggccugggguaucguuccaccaaguugcugugauggcgugucuccacucggaggacugguugugcuggcagaggaugucauuggugacugcaaugacaugcugucauuuuguccccagcagcccuuguucaaauaaugcuaagagcuuccaugugggcaggacauauagagcuuucuagaauuggcugcaucagcuuuugcccuuugagaagaugcugcauuugaggcauggaccauugcaggucgccaacaggaaaguuaaagaauagaacugcacccuuaggggaaguaugaauguguaacauagaaucuuauuuuguauaauaaaaauuaugcaaauaaaauauaggaaagguuuaacgcaccagagucugccuuaugguauuucuaaguuacaguaggagagauacuggaaacugaucaauauuggggaaaugguuagugaagcaugguacauccauacaauggaguauuuauuauucaaccacuaaaacauauuuguaagggguuuaugacaauguggguaaagguucauauuaggcagcauagaagauaacaagguuauagaugcacuauaauuucuacaaaaaagaaguauacaaagauaggcaaaguaugaguuggggaauguuaaacguaugauaacggcuguaagaauuucugucuuucagcucucuggauucuuacccaucaucucaugauaauggaccuuuauggugagaucuugcuuaucguuguggguauccauuuaaaaggacaaucaucauacuucauuauccccagaaguucccacauaguggacuucccuaaaucauaagacaguuguguuagagcugccuccuuuguccuggcuguuagcauccggaagagugaccagccucuugaaggucaagggggaaaggcugagcacgcugagggcaggaggauccugaguuccagaccagccuuggcuacggagugagacccuaucucaaauuuaacaaacaaaugugagcaaggaaaggagguguugggacuccacggacccaggagucauuuaacccuucaugcucucaacagacuuuccccuacgcgugucaggcaccaauaaaaacacagcagaugcuuagaccugccuaucacaucaggaaauaggagaaagagauuaggcauguagcucaauuaguagaaugcucgcuuagcaugcaugcuagcaugcaugagauccuggguuugguaccuaccacugcauaaaccagcuuggugguauagugcauguaccugcaaucccagcagucagguggaggcaggaggaucagauuuucaaugucaguuuaaaauuauacugggcuacguaaaacucugccuuagaaagggagaaugcugguggcucacaccucuaaucccagcacuuggaaggcagagguaguuggaucucugugagaucaaggccagccugaucuacaggacagcuagggauacccagagaaacccugccucaaaccaaaaaaggaagaaugaaagaaaaauaggaaggugaggucaaacucauaguugagguaauguuaugaguugggaaauuaacuggagauggagucaucccacacuuuaaaaugaaggagagggacagcuggggaauaugacuuguuuuugcuggucugugauggcaaccucuguaauaauggcccuucugcaguguggaauaugguggaaugucguggaaugaugggaacuguagcuugucuuccagguuuguucccaggcauucacaaaccuucaaacaccuggcccaucaggugguuggcuaacuuguuuguggagaagcagcaggcagcuccuuuauugguauucccugacccacucuccagggacuuccaugccaggguaaaagcacuagguaaauaaacauggacucuaccucuaucccccauguagaagcagaucuccaaguuacucugauuuucauacaaggccuccaggagcggagcuuugaggcagaaauaggagaaugacagaaaaggaucacagccuugcuugggaaaagcucagccugacuuuggagccacacgggguuaggccacugcuuccaaaggccuuucagacgagaguccuagcucaaggcuauucaggcagugugcccaccucagugacagugagccugugagagagugguauuuuagcuucucacacucaccuccucuuaagguaacaaggucuacuuuguccgacaccugagcaguagaggggcucugcaggcuuaggggugcagcugggacuccagagauauauugcuacagauccugggccuuaggaugagagaagcccuggaaggaaacaaaaaucagagcuccgugaugcccacaaugcacgcugggccagaguaggauuucccugagguaaacggccacuuacacugcucgggccuaggaggauggaguuaugagaaaggagcaaaaccagaaggcacaucucugggagaaucagggaauugguaacaccugggcucuggggccagaagaaaauggauuuugaccaaguguuauuaaucucccaguaaguuuuacagcaagaaucuagggaacccgaccgggcaugguggcucaugcuuuuaaucccagaaauccagaggcagaggcagguggaucucugagucgggggucagccuggucuacagagcaaauuccaggaauccaggacugcacagagaaacccuguuuccaaagcaaagaaacaaacaaaaauguaaggaaccacauucuuugauaggaacaagguaugcucugguccuagacguuagagggccacuccuagggaagaccaagugucucccugagaacucucuucuucucaagucaccacagucgcaagucuaucuaauggccugggaaauuccaaaaccuggcuuauuggaacauugaugauccauuucccugagcaaaggaacuggaaccuuaaacucagaaagccagggcagacuauaucggcucugaacauuggcucaggaaagagaagagagccuuauuuuuuucuuugguuugguuuguuuuucaauacaugguaucucuguauaguccuggcugucccggaacucacuguauagacagaccacucuggccuugaacucauggagcucugccugccucugccuccccagugcuggggcuaaaggugugugccaccacugcccugagguauaugauuuaacugaauacuuuuccuugaggcugggaauguaguucaguugguagaguucuuacccagcacuccgaaagccgcagguuuagucaccagcucuauauaaacuagggaugaug

SEQ ID NO: 6209 - RNA, 2346 nt, Mus musculus
cgaggacccccggagccggccucggcgcgccggagcguuucuccuuccggggcggccugcugggccucauggaggcuguucggccagacagcugcgaaagcgggccggcggcgccgcgagccgaggagaggccggcucccgaggcgagggugcacuuccgaguaacccgguuuaucauggaggcaggcgucaagcuaggcaugcaguccauccccaucgccaccgcuugcaccauuuaccauaaguucuucugcgagaucaaccuggacgcauaugaccucuaccuggucgccaugucuuccauuuacuuggccggcaaaguggaggagcaacacuugcguacucgugacaucaucaacgugucgcacagguacuuuaacccgggcagugagccauuggagcuggauucccgcuucugggagcuacgagacagcauuguacaaugugagcuucuuaugcuacgaguucugcgcuuccaagucucuuuccagcauccacacaaguaccugcugcacuacuugauuucccucaagaacuggcugaaucguuacagcuggcaacgaacccccaucucaguuacagcuugggcucugcuacgagauagcuaccacggggggcuaugccuccgcuuccaggcucagcaccuagccguggcugugcucuaccuggcccugcaggucuauggagucgaggugccugcagagggugaggccgagaagccuugguggcagguauuuagugaugaccuuaccaagccaaucauugacaauauugugucugaucucauucagauuuauacuauggauacagagauccccuaaggcccuggccgaggccggaccuaagaccaggaugaucggaggccugggguaucguuccaccaaguugcugugauggcgugucuccacucggaggacugguugugcuggcagaggaugucauuggugacugcaaugacaugcugucauuuuguccccagcagcccuuguucaaauaaugcuaagagcuuccaugugggcaggacauauagagcuuucuagaauuggcugcaucagcuuuugcccuuugagaagaugcugcauuugaggcauggaccauugcaggucgccaacaggaaaguuaaagaauagaacugcacccuuaggggaaguaugaauguguaacauagaaucuuauuuuguauaauaaaaauuaugcaaauaaaauauaggaaagguuuaacgcaccagagucugccuuaugguauuucuaaguuacaguaggagagauacuggaaacugaucaauauuggggaaaugguuagugaagcaugguacauccauacaauggaguauuuauuauucaaccacuaaaacauauuuguaagggguuuaugacaauguggguaaagguucauauuaggcagcauagaagauaacaagguuauagaugcacuauaauuucuacaaaaaagaaguauacaaagauaggcaaaguaugaguuggggaauguuaaacguaugauaacggcuguaagaauuucugucuuucagcucucuggauucuuacccaucaucucaugauaauggaccuuuauggugagaucuugcuuaucguuguggguauccauuuaaaaggacaaucaucauacuucauuauccccagaaguucccacauaguggacuucccuaaaucauaagacaguuguguuagagcugccuccuuuguccuggcuguuagcauccggaagagugaccagccucuugaaggucaagggggaaaggcugagcacgcugagggcaggaggauccugaguuccagaccagccuuggcuacggagugagacccuaucucaaauuuaacaaacaaaugugagcaaggaaaggagguguugggacuccacggacccaggagucauuuaacccuucaugcucucaacagacuuuccccuacgcgugucaggcaccaauaaaaacacagcagaugcuuagaccugccuaucacaucaggaaauaggagaaagagauuaggcauguagcucaauuaguagaaugcucgcuuagcaugcaugcuagcaugcaugagauccuggguuugguaccuaccacugcauaaaccagcuuggugguauagugcauguaccugcaaucccagcagucagguggaggcaggaggaucagauuuucaaugucaguuuaaaauuauacugggcuacguaaaacucugccuuagaaagggagaaugcugguggcucacaccucuaaucccagcacuuggaaggcagagguaguuggaucucugugagaucaaggccagccugaucuacaggacagcuagggauacccagagaaacccugccucaaacca

SEQ ID NO: 6210 - RNA, 241983 nt, Mus musculus
ucaagcucgcucgcucucccucuccccgagccguggaaaggaucccacuuccgguggggugucauggcggcgucucggacugugauggcugaggggagacggcgcuaguggggagagccacccacaggcgcccuccccuccccgggcuccccuccccaccccucccccagucuccucgccaacgcccccuuccccugucccccucccggcgggccgcgcgggcccccguccccacccccgugggaacgcuagcugcccgcacuccucagccgcucggcucgccgcugcccucaccuccgcgccggccgcccgcccgcccucaggcgggccccggacgccggcccuccaccgcccccgggucgccgggaggacauggccgcacacaggccgguggaauggguccaggccguggucagccgcuucgacgagcagguaacgggccgcggcgggcaggaggugggagcggguggggguggggacgcggugggugaggggaggaaggagcggcugccucucgggcugccgggggcuccgcagaccgaggaagggcuggggugggggggcgacgcuaggggacugcccggggauucggcugugagccggggcucuccuucccuccuaaaccggggggguggggccuugcccgugaccagcccuccauccccuuuaucccagcccuuccgcuugcucuuggugcggggaugagugaccugggggcgcuuucagggccacuccaucuggauuuaaugguucucucuuaacucuccccuuuuagaaggagguagauagggguucccucuucccuuaacccccucccccccauccucguaacuggggauaaccgaaggaacccccagucuguguaugcauccccaguaggagcaagauaauauccugccccacccccauuuucuguagcugccccuugggggcaggaguagggaaagcacagguuuucuuacuuuucugcucggggcgucagcuugccuggaugauguucacaccagcauccuugauagccggaugacacaagguugccuuuugcguuugcaggggaaaccguaguucugaaaugacuccccucccccuuccuugcuugaugaucacaccccccucuccagucccugcuugccagcagccccagaaugaaucuuggcuuuccuaagugagacuccaagaguaaggggagaagggugaaagcaaagggaaaaucuagcuacagacuagacagcagagacagacagcuaggaugugguccuagggccaauaauugugaccaugguuuguuguuguuugacuuguuuuugacucuuugaacccucauugagacuacuugggauggagggaaaaguuuuguaguuuaggaagguugcuuuuuauucgcugaguuuuccacacauaaaauucuaaggcugaugaguagacaacccacacauagccuuuuguccaugagaacuaguuuaauuugaugcuaucuacagauagcuggggcugguuuaaaggaugguugcuuuuuguugcaguucugccaggggguguccucuaaugagagaauuguuuagaauugaaccaaucucuuuuguuuauuggguuuaaucacaaaacugauuaugggagcugacagguaggggaaggguuucuucuuuaauuugaccagcagacauuuuuuuauaggacucaaucuuuugaccuauccgacagaggaagucuacccagaggacacugggaaaccuacacagagcugaauguggugguuauaugacuuuugucccagcacacaggaggucagaggcagguagaucucuguguguuggaggccagccuggucuacagacuacaugccaggaugucaagguuacuaagggagauucugucucaacaccccccccccaaaaaaaacaaaccuacauagauaaaauuuuguagcuaucagagacuucauucauuugguuuccagaccaaaaggcaucaaaacaaacuguuguuguaacccgccugaagaaguaaauauuacuguguaaauugguccaguuauagagcauuagauuucaguagaacauuaaguagaauguuagauucuaaacuugauagaaaagaauugcuguguagaacuuaaaaaaaaaagggauuuaaggggcuaaagagguggguuuagcaguuaaaagcacuuguugcucgggcagaggaccuggguuugauuuccagcauucacacaguguucacaguguaguucacaauugucuguaacuccagucccaagggaucuaaugcucuuuucugaauuguggcaccaggcaagcauguggugcacauaaaugcaaacaaaacacucauacacauaaaauuaaauacauuuaaaaacagauuuaaaaugugccuagaccaguggcucucagccugugggucgagacccuuuugggauugacagacccuuuuacaggugccaccuaagaugauuguaaaacacaagauauuuccauuaugauucauagcaguagcaaaauuaugaaguaguaaugaaauaauuuuaugguugggggucaccacaacaugaugagcuguacuaaaggguugagcaucagggggcuugggaaucugcuggagacaaaccaggacugaacucacagagagcagcaucuuaggggagggcugggaaccacucacuuuaccauuuaccuugauuucuaaaaaaaggcuauauuuuuauuuaugugcacacaugcacacauauacucucucacaccccucacacacacacuuucauacugucacacacacucacacacacacacacacacacacacacacacacacacucucacgaagucacacacuguggcaaccugaaaagugccagaucacuuggaucuggaguuaaaggcagcuauguguugcccgacaugggcgcugggaagaaaacuuggaagaacagcaagugcuuuuaacugcuaagcccucucucagccccaacuuuugcuaagcuuuaaaaguuaaauucaaauuuucuuuuuucuuugcuuuguagcucaggcuguuguggaauuugcuauccagcugaugguagccuugaucugcugacucuucugccacugcccucuaagugcugggauugcaugcauuugcuacuccuaugucuggcuuuuuccuucagcucuuaccuuuggucucuagaccauauuuaucauauaaggaaaagaaaaugcucugaauuuuaaaauuagaaugaugaaugguuuaauaccauauauuguuuauauauguuguaguaucagacucauuuccauuuauuaaaaguuaaggacauuaguuuuuaaacugccauuuuugccaucucuuauauuguaauuaagagaaagauacauaaaauaaauuauucgguacaauguuuucuuacaagcuuucaagaaaugcaguaagaggcgggcuugguggcacacaccuuuaaucccagcagguggauuucugaguucgaggccagccuggucuacaaagugaguuccaggacagccagggcuacacagagaaacccugucuucgaaaaaccaaaaaaaaagaaaaaagaaaaaagaaagaacuguaguaagaagcagcuggccgcuccuugaggccagugaaacaacuauagacaacaagaaaacuaaaaacuuucaauauuuauuuauuuauuuuauguauaugaguacacuguagcuguguagaugguugugaaccuucauguaguuguugggaauugaauuuaggaccucugcucgcugcuccagcccaaagauuuauuuaucauuauacauaaguacaccuuagcuguuuucagaugcaccagaagaggaugucagaucucaucguggauaguugugagccaccaugugguugcuggaauuugaacucgggaccuucagaagagcaguuggugcucuuacccgcugaacuaucuccccagcccaacugaaaacuuuaaaacaguugaaauaacuaagauucucauauacaaaugucaguacacaguagacuuuuuucauccuugguaaauuauaaauucuggcugucaauaguggcacaugccuuccgucccacaugggcucucugaauuugaggccaaccagauuuguauuuggaguuccagagcagucaagacauugauuuugagaugcaaaacaagguauucaagguuuaccuucagaaauuuuuguuaauuuauuauagaagugauaaauggucaguucaaauuagguucaucuaaaauauuuuuuauuauuuguguguguguaguacccucagaggucagaagaagguacuggaucuguuggaccugagguuauagguggguaugagugucccacuuggguacuggaagcaaacucugggacucugaaagagccacaagcagucuuaaccauugagccauuucuccagccccucucccacucaaguuuagcuaacuguugaagagucccccccccccccugcccccuuuguuuuuagugaaaaacagagagacuaaauggcauagcagacgcagagagccuuccugugacaugugucaaaugcuagaucauuagagaaugcuauuucuaagcaucucauagacuuuguuuuaauaacccaugaaguguaguuagaagaguuuacuguucuguuuugcuuuugaggcaagguuucacuauguaguccugaguguucuggugccugccuuuagucucagcacucagaggcagacaaucuuugaguuucaggccagccuggucuacaaagugaggucugggacagccacggugguuauacggagaagcccuaucuugaaaauuuuuuuuuaguuaugaguauguaugugagugugugagccaccuaacggguucagugacucagguccuugggaagagcauauguauucuuagccacuuggcugucucuccagcucuaaagcuguagcuucauucagugagcugcccagcaggugaaagcacuuguuccaagccugaugaccuggguuuggauccucaggacccacuugguggaaggggagacuugauucccuuauauuuguucugugacugcuacaagcugcacugagccacucgagugccccaaaguaauaucaauaaguguaauaaauuauuuuccauauuuaggcaagugaaccaauuauggaaguaaaaaauacuucgacaacuuuuuacauaauaaaauccaguuauuuucuccgauaaggucucacuuuguagcucuggaucuucuggaacucagccuggagagcagccuggucuugaacucacagagauucaucugcuucagccgucuccuccccccaggacugggauuaaaggcauauaccaccaggccugauugaagaaaaccuaauuauuaaauuuauaauagcauguuguuauccucauacauugaauacuaaucagacuauucuuugaauacaacgugguagagaguucacaguauaaaaugaugagcauguaucuucaauauuauaaaucccaugcuaauuggccacaaagauuuguaaaaauucaaaccuacucuggguuaauaaaaaggaucuauccucccuaacuccuggucugcaaucuuuauuaggcauuaagaacauugaaaaaaaauaaaaaauauaaucuguuauguugaaggcauaguguuuauucuuuuggaauuccucuuuuagaguaauuucuucuugcuguuucucauuuggcaucccagucuuccucuuuauuuagauuuuauuuuauuuuauuuuuacuuuuaaacuuagguuuucuuugggaaggaacuguguccuugguuggcuuucuccugugaacucugcuucccuucccuuccuugccagacacugccuaucuaucuacugucugcucacuccucucuauauagcugugacaacuggcucugcuucaucccuccuagacugcugcguuuuugaaaaggauuucuuuuggagaaacacaguggucuuuucacaguuguaauaaccacuguaauguaccucucccucaaguucccaagacacagcucuuucucauauguacaaauucagauccuucugugucaguaugauaaucagcuugagcagagcuuauccccuuccucuuccuucccuuuccccuuccucuuccuucuuugagaugguuuuacuucguagccugggcugacuuugaacucacugaguagcagaagcuggcuucuaccacccaagcuuccagagugcuagaguaacaguggugggcugcaccuggccagaugcgcucuuucuuuuucuaacagguuugccugucacugaacuggagauucuaaauaggagccugaguuuugcuguuagucaauguuucucuucauaugccagcuggugggucucacaaagauccuauuuguccucauuuauugaaagggaauccagcagaaaagccuuuaaaguucuuuaaaguuuaaauauuggaugaucuuaauaugcuaacaggauuucucuguguagcuccgguuauccuggaacuugcucuguaggccaggcuggccugccuuugccucuacaugaugggauuauaggugugugccaccaccaccacucugcugucuuuuuuuuuuuuuucuuuuuuuuuuuuuugagacagggucucucuuuguggcccuggcugucuuggaccuggaacuuaccagguagacuaggcuggccuugaauguauagauucaccugccuuugccuccaugcuggcuugaaucuauaucuuacuagcauagucaucugaauagagaaugugagcacuuugaaagucuauaaugguaaccaaauauaagcuuauuaugcauuuuccuuacaucuuauuguuuauugcauuuucacuaaggagagugacuaguuagucucuauucccugguaugcuuguugguuagaauauuauacguuauuuuuuagcauuuauuaacaaauauuuaggguacugguaacaucuuuuguaauuuuuggauuccaguaauugauccacuuuuuucuguuuuaucaccuaguuuguggcauacauauaauauggucuucaaguuugagaaguaaagcaaggcugugugaguuaggccggcauugagccaguuguacuuuauuuuaaauauuccaguuugguuuuuuacacaauuuuuacuuggcucaaaauuauuauuauuaucguuaucauaauuauuauuauuaucaucauuacuauuacuacuacuacuacuauuaguguguguguguuugugugcuacaacaugcagaggucaggacagcaguugguucucuucuucugucgugugaguuccagggauugaacucaggucugcacucuuggcaguaagccacugagcuaccuugacaucccaggauuauuuucuucagucugcuuuugaaaaaaggugcuuaacaugaagaauucuguucuuaacuugaaagcuuagugcuaugauaccuaguaagccauuaucaugccuuguuuuuacaucuuauucuuuaacuuacucagacugcaaugggcauguguugucacuguaguguucagguugguguugugaccuucuuucuguacaagccauauuacugaauuauaacagcaugcuucuuaacgauaugguguuucaauugaaaaaagguuuuuccuguauaugucaugcuuauuuuucauugggaguuuuguguuuauguauaagacaaggaaugagagguauaggaaggcucuuguuuuaaauggaaguuuaaggaggagaauguucuauaaaagaaguggaagggggaggauuguggucagcuuaaacuguuaaaaggcuuaggaucaauacugaaguagaauaugagcaucuuaagcuauuugcagggauugacuuguuuauaaaagcgcuggguuguuucauccaccuucucguagaauaccccauuuuguuagggaacggaaagaucagacaaagcuuguccuugagaauagaaaaguuguagugaaugugaauuguugggugguuucagcaaccuguaaauccuguauuguuaugguauagucuguaguugacaguagucagaggugugcugaagagcuggcuuuuagugcaccccacugaagugucuuagaguguaugcaguacacuggauauauuugaccacuuaaaauguuacauguaaguugguugugguggcccauaccucuaaucccagcacuccauagguugagacagauggaucucugugaguucaagacuagccuggucuauauggugaguucugggauagccagggucauauagaggaacccugucucaaggaaaaaaaaaaguuauauaccuaagauaugcaugguuugaguguauguaaaagugacuuuugagccauugguuauauuaucaaaagaacuguugagacagauagccccaagcuaauuugcaauugcaccuauuuuuaaugaagacuuaaguguuacauucccccacccccauagauuguauugauucccuugcaguagcaaugacuucggaugcuaacugaaguuuaaguguaucuuucuauagcgcacagaccauaguccagagccuccaauuugguugagguuugcuacuacagccagcaagcuggugccugcccuuacucauggcuugcagcuuuggaugucuuauccuauuaaauuuuagagaauuuucugagaggaaauaguucccuuacuucacccuccccucugcccaacaaccaaguaagguuguauaucuaguguaaaagguaugauguuaauuuaggcaaugacaguacaauucuaaauaaaaagaauggcuaauuuuuaaucauaauuguauacugagauagugaucuuuucagugauuaugucucauaacauuuucaagugaugcuuuucugcuuguugacagauuuucuuagauuguccucauaaggaaaugauucuuuacaccuuggguuuaccuucacuguguguagcagugugaccucggccacuuuaccucuguaucaguuuucuauucuuucaucuguaaaaugggacuaacaccugucuuagucacaucuugggcucauuuaguguccuaagugugaaucuuguacaugguaggaaguuuuagucacaagaauguaucaauuuauauaguauuguaucucuccuuucaaguuugguaaugaucauuucugcauauaagauauaagaugagggauaccuugaagcugcuucucucucagaugugugcugcacagugagaauauuuauucuuguuuguguggaugagcacgugccacagugcauguguggaguacagcggacagauuugcgggugcauuuccuugcuuccaccuuugugugucugaacuuagguugccaggcuugcauggugugugcuuuaccugcugagcugccuuacccccacccucuucuguugaguuuugagguaggucuaugauagccuaggauggucucaaccuugaccucuugcuucagcuucuugaggcugagguuauagguguguaucaauaaguugauuuucuucucauuuuuaagauauggucuuagguugaugaccuagaacuugugauuuuccugcuucuaugucccaaguguugggggagggucacagaugugcaacaucacaucugguuuguauaguacauuucacuuagaauuugauauacuuggagcagcucuucaaaauuugguaguacuaaagugguuucuggugaguucugggguggcuuugcuuuuaucucugauucucugcuuuuuucaguuucuauuuuuuuguuuagcaauucucuaauauucauuuguaauuguuacauaguugaggauaacguugaacuucugauccuuguaucucuaccaccagagugcugggguuauaacccgugcggcagguaccccugguuuuauguggugugacacugcuucucuagucaugccaggccagugcuuuguaaacugggcugcuccccagcucauugucuugauuuuuagaguauuauuuuuauucuauuuuacuucucuacuacguuggggcuagaaaauaguuuuuaugugucaggcagaucuuucucuuuucauaauucauaagggaguagggaaagaggaacauuuguguuucuuguuuuggacucuuguaagugaaugaucaggaaauggggagagaaaauaggauuuauuuauuuauuuauuuauguuuuuuuuaagaugguuucucuguguaaccuuggcuaccccggaacucauucuguauauucgaaacguaugccuggcuuaucacuuuuauuuuggucaacuguugguagcaaaaaucauugaagaccagaguucucauuucuaccacagcucaaaugcuguauaauucuuugaauguauuaauuuuugucccuauuuugagcuagccuucugauugaaaaaguauccucaucacuaauaaauuagucauagagcuguaguuuggacucugaaauuauauguuauguuucugcuauaacuuuaacagauacuuaucugacuccuuagauuaaaagcaaaguaguaauucauagcuaaggauaugggaaguacagggcgguaccgggggaaaugaguuauuugcaguaccacaacuuagaagcauuguugacuaauuguuuuuuuuauuuuauuuuaauuaauuaauuaauuaauuuuuuuagagacaggguuuuacuauguagcccuugcuagucuggucuagaguagacuggucucagagucacagagauccuccugccucugucuccugagugcuagaauuaaagguauguacuacuaguggcccuacauuguuuuguaauucauuuuuuaaaauuuacaauguuaauauuuuuuaggauuacuuuuuuuuuuuuuuuuuuuuuuuuguuuuuucgagacaggguuucucuguguaucccuggcuguccuggaacucacucuguagaccaggcuguccuggaacucagaaaucugccugccucugccucccaagugcugggauuaaaggcgugggccaccacgccuggcuggauuaccuuuagaaguuuuaagggauuacauguaguuuaaaaaauuuuuuaaaaaauuuuuuauuauuuauagauuauuuuuuuaaagaucuauuuauuuuauguauaugaguacacuguugcugugcagaugguugugagccaucauguuguugcugggaauuaaacucaggaccucuguuccauccagcccugcucacuccggcccaaggauauauuuauuauauguaaguacacuguagcugucuucagauacaccagaagagggcgucagaucucguuacagaugguugugagccaccaugugguuucugagauuugaacucaggaccuuuggaagagcagucaguacucuuuacugcugagcuaucucuccagccccagauuucuuuauuuuuuauuuauaagaguauacugcaguugucuucagacacaccaaaagaggacauugaaucccauuacagaugguugugagccaccaugugguugcugggaauugaacucaggaccucuggaagagcagucagugcucuuaaccucuaagguuaagaaccucuccagcccuaaaaaaaauuuucaaacacauuucauuuuuucuauacugaacaugaauuuuuaucuugaacuagaggguauagcucagugguagaggauuuuuguaguaugcacaaggcucaguguuacuccccaccccccaaaaaaauucaaauuuaaauuccagcaguguaaguuuaaugugagagugugauuucagugagauguauaaauaaugaaaugauuaggguguagauggcuguuaccauggcuuuggcacuaucuagaccagaagcugccacuagagaugcuuaguggguaaagaugcuugcugcuaagccucaccaccugagcuuggucuucuggauccacaugauggggagaaaggacucccccagguuuuccugugacauacacaugcucauggggugcuuccacauaugugcauagggugaauguacaguuacucacacacacauuguuaaaaaaaaacaccaaaaagauuaagaugaagccaggagcugugguaccugccuauaacccuagcauuugggagcugaggcaggaggacaagauuucaggaucaggaugggcuaguuaaaccuugucuccauucuuacgugugaggugacagagauggagggagcuugcuuaaaguaguuagggaaaucauggccugguguggagggaggaaggauuggggaagcagauggaacggguuaggacuugagcaguguggacaguauggaggcuuuuaacugaauguugagguccuaucuuuguuaauggucaucaacuagaguugagauaaggaaagcugaggacaguguuagauagcuguucaguuaacaaguagggguagauaaugucuacuuuaaaagaaaaaagguuuuggcagguugacuucaaauucaguuuguaguccaggcuggccuucaccuugugauccuccugccugagccucgugaguacuggguucuauaggcauaaaacacuaugccuugcuacccaguuaaaauugaauguuauauuaaguaauaaaauuuuaguuuaaguaucccuuagcuaugguuuaaagcuaaacguacacaguacucauguuuaucugaguauuaggaacaauaauuuagguacuaccuagguggugguggaugugggacagagaaacugagccaggacauagacuuuuuuuuucuguugauaagaaaguaucugggggcuggagagauggcucaacagguaagagcacccgacugcucuuccgaagguccugaguucaaaucccagcaaccacaugguggcucacaaccacccauaacgagaucugacucucucuucuggugugucugaagacagcuacaguguacuuacauauaauaaauaaauaaaucuuuuaaaaaaaaaaaaagaaaguaucuggaagauugcuaggugaacgcaacaguguuaguggguacugugugagacauggaccuuacuaagaggggguuuuuaaaaagagaagaagaguuggaauuuuaccuucuuuagucuucuauuuaguguuucuaauuuacccucuacaacuuaacaguaaguuuguuuacuuuaaaaaguacuugagaguagguacuaagcauuugccagaucuccuccuccauucucuuguguucuucagccauuuuauagccauuuaguuaugucaccauccuaaaguuuugucugucugucagucugucagucuauuugucuauuuuuggugcaguggaggucaauaauuagcaucuguguguguguguguguguguguguguguguguuuugagacagggucuuaguauacaguuuggcugagcuggaacuguguguguguguguguguguuuugagacagggucucaguauacaguuuggcugagcuggaacuguguguguguguguguguguguguguguguguguguuuugagacagggucucaguauacaguuuggcugagcuggaacuguguguuuguguguguguguguguguguuuugagacagggucucaguauacaguuuggcugagcuggaacuguguguguguguguguguguuuugagacagggucucaguauacaguuuggcugagcuggaacuuguuauauagaccaggcuggccuugaacucaaaaauccaccucugcauccugaguguuaaaauuaaagauaugucacaaugccuagcuucuugccaguauuuuacuauaagaggauguuaugagacuuaaguaaaauuaaugacuuaaaaaauacugaggcaaaagguguaguggcacaggugugcaauaauagaccagcagagguagagagagaaauccugacuuuuaggcuauucugggguuaauauagcgaguucaagaccaguauuuaaaaaauccaaggugugcugggcggugguggcguacgccuuuaaucccagcacuugggaggcagaggcaggcggauuucugaguucgagggcagccuagucuacaaagugaguuccaggaaagccagagcuauacagagaaacccugacucgaaaaaacaauauauauauauucauauauuccaagguguaauaguauuauagcuuaucaguagagcauuucacuugucagccggcacaggaucuuggcuucaauucccagugcuauggaaaagacaaauucagguaacauuauguuuuuauauuugucuauugcuaguacaauaaaacuauaaagugucaacuuuguacauuauuuauuuaaaguuuauuauaaaaaucuauaaaauuaaaagcaagggacuagagagauggcucaggaguuagaaguguuuguuguucuuguagagaucugggcucaguuccugauggcucauaaccaucugcaacuauagaucuagaguauuagacaccuucuucuggccucugagggugccaggaauguccacgacacacagacauucauccaggcauacacuggaacacauacaucuuaaauggcuguauaugcacuagcauuaagccccauagguaucuuuacuuagcuuuuacccaguccaaagugguuucuuccacauugcuacccauuugcugcucgcucacgaccucuccauuguuuugaagugauccuguaugugauuucagcauagcuuagccuucccucaugcucaguuagcaguuagaaaacuucacuuauuuuuugugcucuguguguguguguguguacuugaguaaauauucuacuguggaggccagagguugacuucagguaccuuucucuauuggucuuuaccuuuuuaaggcagggucucugacugaaccuggugugcuguuuugguuagacuggcaggccauguaacccaccugucuuuccucuuuagugcuggaguuacaggcacaugucaccaugcacugcuuuucucaugagaguguuuggggucuaaaucagguuggcgugcuugcauggcaagcauuuuacccacugagccaucugccucaucucgguuuuccugauuguuuuuuaaugggaguaaguuauaccauggucagucaagcuguuugagcccuauugacuauguugaaggaugugcugguuguagaaagacuuagcccuuuuuuauagaucaggcuuugugagagucagagauaggaauauaugugaagauacuuuauaaacucuaaacucaaaacaaaaaugcucugcucauaacugggcaugauggugcucacuuucaaucccagcacucaagagguagaggcagcuggaucuuugugaauuugaggccagcguggucuacauagcaaguuccaggacagcuacaacuacauaagaagggguggagagaaagcucuacacauguaagauuucauuauuagaaguaaauggcaaauuccuguagacaugccaagaaguaaucuguguaaugaacauaaagcccacaguacugaaagcaccuugucaccauuacccgcagcauuuagacauuugaagcagccguugcucauuccacgucuggccugcuuuuucugcaugacuucucaaaguucacugacaucucccucccauauuuucaaguuucuuuuauacccuuggauuaauuuauguagacuugaacuuagauaaagcagauagaugggcucuuugugcuuuauguaagcauucuguugcuguuuagcaaugauuuuccacaucugaagaucauuuuguuucuguuagaauagaucagagaaaaauacaauaguuauguguuugggucaccuaguuuaugugcucuuuuggggaucgaggugcucugcacaugcucagugagugcugccaucauuaauauauauauauauauauaugauauauauauauuauauauacacagaagccaccaagggcucgcauuugucuucacgucuguagucacuuugaaauuuugagcauuuuaacucgucugccucuuuauuuauuguguguaguguauuuucuuuuaaaaauauccuuacaaguacugagcuuuggagggggagcaagaagucauggauguaggcccagugguuucuuuagaaaugcuaccauuaaauaaauucucuuguaacuuuaaaaggacuggcuuccuggauccacuagacacaguaugaguucugaaugcuuggaagugguuauaagucucccuagguaguuuuuuuuuauagcgcuggguuuauaaaccauuguuggauuuauauaugcaggauuccuagcuucuagguaguauuuauuuaacagacaauagcacaaccauauacaccauggcaacaaguucaaagacuggaugaacuuuaagaaccaacguuuuaaaaaacacuggaaggcuguuggaacagugacgaccaaaugaauuaaaguuucagggaugcaaagacauuuguagugggcugauuauggacacaugcugaaggaaaaagguaagccagagaugaacagaaucuuauuaaaaguguagcguagccgggcgugguggcgcacgccuuuaaucccagcacucgggagguagaggcaggcggauuucugaguucgaggacagucuggucuacaaagugaguuccaggacagccagggcuacacagagaaacccugucucgaaaaacaaaaaagaaaacaaaacaaaaaguguaguguaucccuggcccacuucaaccacugguuggauuacagagaucaucuuucucaacccuuuuugcuuaaugaagaaauaguaauucucacugucuaagaagauacauucuagaguuuuaagauuuuuuuauuugcaauauucagaguagaaccguuucuguggauguaaaaugaugaaaaauugugguccauacucaaaaaucaaaaguaaacuguagaaguggauucagaaaguuggcagcagacaaagacuuaaacaacaaaaacaacaaagaaacaaacaaaaacccugcaguguggggcuggagagauggcucaacaguugcugcucuuggagaggauccagauuugguucccaggaccugcuuugggcagcacacagcucccucucuguaacuuugauuccaggugauucagugucaucuucuggccucaaggacaccgguuacacacauguggacacuuacagauaagauuauuuuuaaagauaaaacaaagucauuugcugagaaaauaagggaaaagacaauugugaugacugggaauuucuuugaagagcuggaacccauagaagggaauagagaauaggucaucuaggaagcaguaacacaguuacgaguugcuuaaggucuuucauccguguucuuuuucuugacucugccucuucccugccccuuuuuauuuccuuuugggaaacaguucaguugaguacaggcuguuuaaacagauccacgaggucuuaggcuucugucgguuuuguuugcuguauuggugauagguaauggguggaucccugggccucucuggcuagccagucuagcuuaauuauguaucuccagguucuagugagagacucugucucaaaaagcaaggugggagcuguggaagauagagaaaugacucagcggaucugagcaguugcugugcaggcaugaggguuagaguguggagcccaaagcugaugaaaaggccaggguggccacauaugugccugcaacuguaacuucagcaugauaggggaguggagacaggggauuguuagguguaauuucuuucuauugcuuccugauucauauauucuugaccaucauuuuggaccucagcuguugugguaauccaaaccuuuaucacggagaauaugagucuguccugggugccugcugcauguguaugcauguaguauaguauacugcaaugcaguguaguguaguuuacugcaguauagugugguguaauauacagcagugcaguguacugcagugcagcauagugcaguguaguauacugcagugcauuguacuauagugugcugcaguguaguguagcauaauguacagcagugcaguguacugcaguacagaauagugcaguguaguauacugcaguguagucuacugaagugcaguguuguguaguguacugcaguguaguguaguguaguguagugauuuucauuaacuuuuggucuuacacaauaugagguuagagacauuucuuagauucaagguuccaaucuucuauguuuccuuuauaugguagcagugcuuuaucuccuugguuauggcauagguuacaccauuuaauggagugaccuuugacuauggauauagugcagugauucucaaccaggaguuuccagaggacaguugacaauaguuggacauauuuguaauagguacaaguuugagaaggugaggcuuaugguaucacguggguagaguggguagaggucagagaucugaccuggaucugacaguguuugggggagugaagaacagaauuaauccagucaaaaaugucaguacugcugagguugagcaagccugguuugguggcuaagcagugucaucuuucaguggguuaugcugguacuguuucuuucucaggaaucaaagcauguaaacuacagaugucuaaguuggaaguauuagaagccuaacugccaggagcguuuucagacugugugagaacagcuccugcucuucuuuauuuccaggcuucuguucucuggcuauggagaaagcacgauugauucagagaguaagugcgcucuguuagauaggagcgccagcccuguggaauuaucucucaacucccauuuccuacuaggacacuugcuuuugggggauggcccaugccagaaaccaggucaucuuaaguccagagcccagcugcauuccuucucguaggaagggaguuuguucaggggcacuguuagcagugcguuuagucacaaacagugugucuccgaaggccuuuaaugaugcuggcagaagcauuucaggaggagaugcaaagcugucuagaacauguuuauaugaacauauauaugcuaguucuauguguauguauacauaugacuuauuuucucccuaaaaguauguuacugccgggcgugguggcgcacaccuuuaauccuaacacuugggagguagaggcagaggcaggcagauuucugaguucgaggccagccuggucuacaaagugagguccaggacagccagggauacccagagaaacccugucucgaaaaaaccaaaaaaaaaaaaaaaaaaaaaaaguauguuacuguccacuguaauuaguaguuaacuuucauuaauauuuugugaacauuuuauuuuuuaauuuaggggugggagcaagaccuggcugguuccucgcccauagucucagcacucaagaugcugaguucuggaggguuggacuacauaguaacacccugucucaaaaaaagaaagaaaaacaaaguaguuauaaguuauagacuuuaaaaaaaguuaaauugcccuaugaacaacauagagcagagcuuccaaaaucuuuucuccuuguuaacauggccagagaaaaauuuacacagcccauucauauauaugaaugaaacauuuauuccuaguaaauaaaaaaauuauuuuaaaaacaauucuuuggcauacaugugauuuuaccauuuauuuaacaugaaugcaaggggcuggggagauggcuuagugguaagagcacuggcuguucuucuguuggaccuggguucaauucccaguauccauauagcagcucacaacugucuggaacucuaguuccaggguaucugacacucucacacagacaaacaugcaggcaaaacaccaaucugacacucucacacagacauacaugcuggcaaaucaccaaugcacauaaaaauaauaaaacuaaaaucauuuaaaaugaaugcaaauaugcaugauagugcaauggauguguuuauuuuuauaucaaaguaaaccuuggaguauuugauaagcagagcauagaacaucuucauuguguuucagagguaauugacauuuugauuuauaauugucauguucaaaaugcugauuugcauaaacacauauguaguucaaaaugacagagauauguuuagggucauuucagaauuguuggaaauucucuuguaauuccaaauggaauuuuguaugugugcgcauguguguguguguguacguguaugugugcauguaugugugggugugugucuguguguguguguggggauguguguggguuaaaacagcaacucaaagaaaaguuguauguuagaggaccaaugucagguaucuuccucaauugcucucagccuuaauccuugagauagggucucuggcuuaaacuuguaguugaucauuuugaguagcuuggcuguaguaagccucagugguccaccuucuucucccuccccaacacugggauuuuuagauguaugcuguggcuggugggauagaauucuauuccuuacauuuucauggcaaguguuuuaccaacugagccauccguagcucacuccaagaauaauuuuuaaagucaaacauucuaauauaauucaauccaaagauaugcugauuugauauuugcaugaugagggaucaugguagaaaaacauugcaagccauuguuuuuuauaauuaaaccauugcguuucuauaagaacagaaaacuuuguauguauaaugaaaagauuacacuuaauaaugcacaguaaucuagauccuguccaagguauucuaaguguuuggcaugauggcaugugcacuuuguuucaagacugcagugaaguuccaugaugcaacaggagugaguaccaccaauucauuuuugauuguugcaccugagaaaauuuuccuuauugccagcauuuucaugauccccaugacucauaguugaagaauuagucgggagcuacaguaaguguaaacuagugaauuuugaauuauauuuuacccauacaaauuuaucuuuguuaccuuucuccuuccuuccuuccuuccuuccuuccuuccuuccuuccuuccuuccuuccuuccuuccuuccuuccucccucccucccucccucccucccucccucccucucuuucuuucuuucuuucuuucuuucuuucuuuuuuugagauaggguuucucuguauagcccuggcuguccuggaacucacuuuguagcccaggcuggccucgaacucagaaauccgccugccucugccucccaagugcugggauuaaaggugugggccaccaccgccaggcucuuuguuaccuuuccauuguuucaaauuuuguagaccucuaccuguuaaaguccauuguuaugaauuacauuguugauacuauuauagcuugccaaaucuaauuuuuuguacuuauauuuauuagccuguguauauguuaccauguaugugugugcuugaugaaugcaaaggucagaaaagggcacugaauacuggaacuggaauuauaaaagaguugugagcugucaugugggugcuuggaucugaacccaaguccucuguaagaacaguaacugcucuuaacagcugagccgucucucuaggcccuacccuaccaaaucucaaaaggcuuacuuuuuuauuauuaguccuagucauuuucaacugaagaguuguguauguauuucagaagaauaauauaaauaauugggcucugagcaucuagcuaguuagaaccuauccaccuugccugcuaaaucacaguggaaaucuugagagaguuggaacagaagaacuuaaaacuauaaaguucucuucaaggaucuauuaagacauaaccacuuauaaaaccguacuucucauuaguguuagggaauuuucauuuuagaacucuaaagccauguuugcuaauuaucuucucuacuaaacauaguccagaaagacaaagauuugugcuccccucuauuguauauguggcaugcacauagaagaaacuaaaaauuuacugaaugaauuuaugagaaaugauuuucugugcuuuuaagagaacugucuggcacaugucaagucuuaagagauuaaaaaauggcucuuaauuuuuuagaguuuauauuuuuauuuacuguuuuguauuaauuauuauaacaugugccauaacgugcuaguggaggucagaagacagcuauggaaguuggucuuuuggcuuccaacaugugaucccuggauugaacucagguucucagacaugcacaguagcacauucucccacugaaccaucuugcuggcccuagacuggcccuuucccccauucucaucuuguucuaaucaaaucaucauaaauacagucauuugacauuuaaaauaaauaaaaguuuguaucaacacuuguagacuagaauuugguugaauucuaaaaaaaaaugucuuucaaauaugguacaucuguuaacuaauaugaacugguuuuuacuauuucaaacuaaguaaaaauaauuuuauucaguguuauauguuuuuaaucuacauguugucuuaugaauaaauguuucuaaaugcaguuugggaacuagaauuugaggggaacuuuuuucuuuagcuuucuggauaaucacaaaauaaaguggauucuuaaaagugucaguggaccugguaagguggaaguguuccagccgcagcucagauaguggaaacuuucugcgaacaauuuauuuuauuuuccuuauccuacagaaaucacucuaggucugaagaaugcaaguuuuuaauagugcccuauuaaucucgcuagacacagcacaauucuagcuuagaugauuugugacaggcagucaacuguugaaagaguuugacuuuauugugugugugacagagacccauugaaaggcuuuaaguaugaaugccauggucacauguuuuaaacaguuucuuuaugguuauacuggagauggauuugaggagacaguauuaaagacaaugagaauaagaaauuguaaugggaauggaguucugaaugccauggucacauguuuuaaacaguuucuuuaugguuauacuggagauggauuugaggagacaguauuaaagacaaugagaauaagaaauuguaaugggaauggaguucugaaguagggaauugaauguaggaauuuagagagccuaaaugugagauuuguguaggagaugauauuggaaggcuuagaugauuaaauaaggaaaggaagaaacuaaugggaguaagcuaguugaaaauugggaaaaguugugaaugacaggacuuaaaaaaaaaguuggugggggagcgugugggcgacuuuugggauagcauuggaaauguaaaugaaauaaauacccaauuaaaaaaacauaaaaaaaagaaaaaaaaaguugugguggugcauguucguauaucugcagauguguacaugugcacuuaugugugagagcagaggucaaccuaagguaccguuccucaggaacuauacaccuuuuacuuuauuuauuuauuuuacuuauucuuugguaguuuuauaccugaauccuccaacucaugccuaccuucauguccugccuuuaaccuccugccugccugccugccugccugccuuucuauccccacugagucuaauuaguacugccugugugugauguaagaccaaacauuggcuuauagacaacauaccauggaccauacuccaaaagaaaauucucccucucuaucuuguuaguccugguugguuuuuaauuauuaccauuuguuuguuuguuuguuugcuuuguucuguuuuugucaccuugacacaaacuagauagcuggaagaaccuuaguugagaugccccuccaucagauggccucuaggcaagcgugguuaguugauaugggaggauccagcccagugugguuggcuccaccccugggcaggugguucugaauuguauaagaaagcaggcugagcaagcagugagaagcaagccuguaagcagcuuuccucuaugguuuuugcuucaguuccugccuucagguuccugcuuugaguuccugccuuuacuuuccucagugauggaguaugaccugagaguuguaaaaugaaagaaauucuuccccaaguugcuuuuguaauuguguuuuaucauagcauuagaaaucuaauuaagacauuugguuuuucucaacugggucucucacugggacccagacugguagauugggauaggccagugagcccuugaaucuugcuugucuccaccuccgcagugcuaggaugcaaauguacuccuugggcuagagacccuuucccuuugauuauggugcuggagauggaccucagaaccuugcucaugcuaggcaaguguucuuucauuaauccacaucccaacuuucaacuuguucagaaagagucuugauaauugugcguuguuuuauuuggcuugacuacauauuaacuucaguucacaauuucauccuuuccucuucagucguugaauuguuugcuuauggucucuagcaaugguccuuucuuaacuugugggucaugaccacuuuggcaaaccucugucuccaaaaauauuuacaaugcaguucauacuauuauauuuaugaaguagcagugaauguaauuuuaugguugaaggucaccacaacaugaggaacuguauuuaaagggccacaacauuagaaagguugagaaccacugguuuagaggaauauuuauuuccuuuucaauaguuucacuugguuaguuuucagguaaguuaaggaugaaugucuuauauaaaacauguuuucugagauagggauguagcuuaguaguagagugcaaggguuugauuuugaucucuugcaccagaagacagacaggcaggcagguaggcaggcaggcaggcagguuaggcaagaaggcaggcaagaaggcacacgcgcacacacacacacacacacacacacacacacacacacacacacgguuuauuuuuuaugcuuugacuuugagucauguccuugaaguugaagauggccuugaguuaacuguguauuggggauuccugugacucccgauucucccgucugugcucuucucaaagauuacaggcguaugcuacuguuagagaaagaauaaaucaucugugcacugagcuuagugaggugaaggagaggcuucuuaauagcacuuggcugacucuggcuaaugcccaaagaccggccagccucaaauagaagaugucacuagcauggacacauuaggcuuaugcauuccacacacucauccuuaaguccuuuucaggucuagccccagguuacacuuggaacggaugagagauauugucagacucguaaguacaguagugcuguuuuuuuauuuuauuauuauuauuauuuuauuuuauuuuuuuaguagugcuguuuuuaaaaauaguuguuacccagauucuucugacccaccugcagaauuauguuuucucugugaagcggacaggggacucgguggcugaccaggacuuaagauagcugugaucuugagcugcuccccagagcugucccuuagaauuauguucuuugauacagggaugggccuaauggcuguuuguaagucagaauugucucuuuguuaugggaauggagccucuuuggagaucaaucuuggugaauaaacuucgacagaaacauucuuagcaaccccaaacuucaauuacaguacaaaguuuucuuucucacauugucuaacaagucugguggaguacaccaaucuuccaguccugcuggaggcagcaguccuuuagcuaaauucuuuguucuguaacauaauauuuccuaagcaaguuuauuaguaauuuuuuuuuucaaaacagugauuuuucucugucgcccgggcuguccuggaacuugcucuuguagaccaggcuagccucaaacucagacaucuaccugccucugccuccagagugcugggauuaaaggcgugcugggucacuauguauauguauaucuuuuuaaauggguauggggcacauaaguucucaguauuuccuggcuccuaacuuguaauccaccuguuucaguucuuuccaguguuaggaauauagguauuuccauggaucccagcucucaacaccucucucuccccguccauugacucuaaugguauuauuuuagcauugggguguuaaaaguagacuaguuaaaaauagacugagugugaaguugaaagggcuuccagacucaggccuggaaguuaaacuuguucuggcucuguucuccgugauuauuccaaguuuauuuuaaucugcaucuugccguuuuaugaaugaaguucucuuucauucaguccaauaaagaaaauggccauuaacacacugcuaaauagcuccagcuucugguuugaacuaaguuauaaaaauuagcauaguggcaggugcuucaacuguuauauaugccauguuacagguaacacauagcaucuuuguuaaucagaaccuacuuucucggcuacugugaaggagguaaaaucuagaugagaaucuucacuguugccuuuuguuauuuuagcuuauuaaaauugauaaauugugaacuuugccaguguauuuuauuaugucuuaaaaauuugaaucccaccgggugguggugguacaugccuuuaaucccagcacuagggaggcagaggcagguggauuucugaguuugaggccagccuggucuacagagugaguuucaggacagccagggcuacacagagaaacccugucuugaaaaaccaaaaaaagauuuuuuuuuuaaucacacguguuagcuucauaaacauugaacugucccuguuugguuuuguggugaauuaacaaagcacacuuauaaaucugauuaaaugugguuagccuuuuagucauucuuuuuaaaaaguucucuuccagccuuccucucugcucuuuccugcccgugugggagguuagaggugaccucacugagucccccacgucauuugugagguaggauguuuaccugacuaacagucgagcccuaggcguccuccugucccugcuucccaagugcugggauucucggugugugcuacuuuacucagcucuuuguaaagauucuggaagaagcaacucaggucucucgggcacugcacuaacggagccccuccccagcucuccgucuuccuuuuaaccucagugacagacagggugucuuauguuaaugugaccagaagaggaaugauuuugaaauuuguuggcuggcuuuuuaaauaauaauauuaggaaaauauuuguuucugagugaagauaaugggauaauuaacuaaacugguaguuuuggaggcaguuguuuuggaaaguaucuuugucuauuuauuuaacgugcuguaguaaauuuaguacaauaggaaguagaaauucauccaucacacuccugguggcugagaagggugaagaguaagacacagcagguuuggugucaaagggcuugugccuccuaaaugucccuucuuguccuuucuucacacaggccucauuuguauuuuccaugguucuggagauuaagccccggacuggccuuuacauacgcuaggggagccuuaucccacugagcacaucuuuagcucucuuuuauuuaugucuuuuugagguaauguugcuuaggcuggcuucuugaacuugcuguguagcccaagcuggccuuuaauucacaguuccucuucguucugcaccuccaugugcuaaaauucgaggcaugggccaucauguucauuucacuugggccucuuaggacauaaucauucuuugagggcucuauaaccugauuuccauucuuguaaaaccuucaaugagggcuaaguuucaacauaugaauagggugucuuuguuauauguagguagaguauguuugcucuauuccaguagcaccauaugucugaagucuagagucguuucauucucaucuaagugagcauaggcgagagucaagaugcuguucaucuugaggcaaguugcccagcugugaauuugugaaauuaaguuaucugcuccuaagaugcaaguuuggggcaggcagaagauaagcauuccuauuccuaaaaggugagaaagaggaaagaagaaagggauuguagguguugcauaaggaaauccaaagcccagcaguguaaaauaguguaucuuaaggcucaugaauaacgaguuuuacuccacaucuugccuuucacacccccugguguagaauuugagcuuuuaaaacuuuggcagucuugguguuaauagcucugcugggugggugcagccuguguggcauggguuggaaugcuggucuguggcucuuccaggcuagagucaaaaguuuggccacccaaacccuucuuuugacaggaucuuuuccaagcuauggguuucugagccugacaggaggaggaguacccauaacuuccugaaugccuuuguggcuauuucuguuaccuugauggcuucaucucuggccccuacgaaucuguuaaaaaaaucgucauagaucugugggaguugcuuucccagacauacauucucauucuuuacaucauggccaggaagaagcucccaaauaacauguuugcuuuccuuuugauuguaaauuucaucuuuaagucacuuuucuauuuggauuuacucggaugcugucaagagaagccaugcugugguuccugcuuuuguuuacauaguucaucagccagacaucuaauuuuaccacucaugaauccuauuuccuguaaaacgucaggauaggacucaguucauaauggcucuuuaccacuuuuuauuuuuauuuucauugcuguauguggaacccggauccucgagcaugcuggacuguuuucugcuauugcacaguaguccuugcuucucuguaacaggcucuguguucuucccguuggcagugacauguuccucauuucugcgaccucaucggaaugaccuuuacuguucauauuucuaucaacauuucauucaaaagcaucuguguaaucucugagaagacagaggcagucuguguagugagcuucugugcggucgcuuuagaaucauccagaaggcucuguucauagcgacaaggcuuuuuuuacacacaugucuagauucuuccaucuuguaccuauuacccaguuccaaaguugcuucugcaguuagauuuauguuauaacaacaacucuacucuuugguccuagcuucugucuuuguuugggcuacuauaacaacauaugcagaugugaaggcuggucuguauagguggugcuuucuugggcuacuauaacaacauaugcagaugugaaggcuggucuguauagguggugcuuucuugguaccuuacccugauagaccaguugucuacauuguuuuuguuauuuuggggaauauuuuuugagauuggcuuuccauauuuuacucagagugacuucaaacucaagcuuauccuuuucccacacccuggagagcuaggauuauaggcucagcaccacagugcuuuucuacuucuauauauuuucauuuauucucccugccuuuucuuuguccauacauacauauaauuggggggacaugaagagaaacauuugaugcuuaguugcagucauagugcccugucccaggaugccucaggguaccuuuaagaguaagagcuaacaucuuuaagugguaauauaaauuuuaacucuaggacacuuaacaucaaaauaguacuaaacuauacuccaugccuauauuuaaaguuugcuaguaguaguugcucaaauaauucauguauauuuuuuuguuugcuuguaauuuuuaugauugcucaacuguaucuacaucuacuugcaugccagaagagggcaucagauacccauuacagaugguugugagccaccauaugguugcugggaauugaacuuaggaccucugacagagcagccagugcucuuaauugcugagccaucucuucagcccccaauucauguauuaauaauuuucaaaguggugcuuuccuuaucuucuuuggacuuaaguguagggaguuuucaauacuuuaaucuucguaaauuguauauuguguuuuguaugcugaggcauguauaucucaugucuaacucauuugaguugcuugguuuucaguacauauuuacaagucuuuucuagaaauauauuuuaaaaauguuuuuggaaaauauuguaaaauuuaagcucauacagauauauuauagaaugauauggaaaaauuucauccuauggaaguauaccauaggauuuaaagauuauuuuaccucucaaauauagagauaacugguccaaauuuguucccauauacauaauaaaguggcaugccucuuuauuggguugauguuuuggggaaaaucaccacagcucuauaauaagaaaacuacccauaacuagugacgguuauaauaaugaaaaugucaggaguucaugccugucaucccagcacuuggaggauagagacagguagcucucccggucaaccgaguagucuaaggccagccuggguuacgugagcucguuaaaaaaaaaaaaaaaaagauuacaaucccaaaacaauaauaguaaaagggguaguuccauaugcauuuuuuuauuuuuugauaaccaaaaguauuugucuaaauuguagaucaaauuuuguagcgaguaccccuuccccuuucuguucaguuagagaauaguaauguaugcucaaaauaguaauauuugauuuaguugaugugaaucaaaaauuggggaguuaauguuuuuaaaaacugacauucacuuuuaauaaguuguuagaagcuacauucauguuuguaugguacaaguaacuuccaugugggguggcauuugcuuuugagaaaaauuguuuuucuuuggggacagaguaucucucuaguuuaacuucuggagggugucuuaguuacuguucuuucuccucucugugagaaaucaugagagagggcaucagauggucccuuagaguguguuacagacaguugcaagccaccacauggaugcuggggagggagccuggggccucuggaagagcagcuggagcucuuaccugcugagcaucucuccagacuagcauucuucuucucagugagugugcaaccucugcuaauggaauggugguguucacauucagggcgggucuuccugccaccucaaaccccucugagacccucccacauguuggaaaggguucuguagcuuucagucuugucagcuugacuauaaagauugacuaucacagacccguucauuauuuugaaaaugggucugacugucuaacacacccugucuggaacuuaauauuuuccugccuuagccuauucaaugcugggauuauggguguguuccaccuaaccuagguaauaaaaguauuuuuauuuuauaaaauguuguacauaaaguucaagguuucuuuguacccucugauccccuuuauuccucucauuuuaaccacuggccugaaguuuauuuguauucugugucuccagccagguauggaaguacauaccuuuuuuuugggcggggggcagggguucagggaacuuuuauugaugguauucaagagaguaggaugggggucuaggaugaaaaaugugagggaggagaugcuuacugcugggggucgaguuaggaaagggacuccucugcaacugagagccucucucuugcucucaguguccuugcuggggugggugguccaagguuucuuacuccuuggaggccauggaggccaugagguccaccaccuuguugcuguagcuguguucguugccauaccagaagaugagcuuuacaaaguugucauugagaacaaugccagccacagcaucaaagguggaagagagggaguugcuguugaaguugcaggagacaaccugguccucaguguagcccaggaugcccuucagugggcucucagaugccugcucuaccaccuuccugauguuaucauacuugucagguuucuccaggcagcaugucagauccauaauggauacauugggaguaggaacacagaaggccaugccagugaguuucucucucguucagcuuugggaugaccuuacccacagccucggaagcaucaguggaugcagggaugauauucugggcagccccagggccaucaugccacagcuuuccagaggggccauccacagucuuuugaguugcagugauggcaugaacuguggacacgagcucuuccacgaugccaaaguuguuaugaaugaccuuggccaggggggcuaagcaguugguggugcaggaugcauugcugacaaucuugagugaguugucacauuucucgugguucagacccaucacagacaugggggcacuggcagaagggguagagauaaugacuguuuuggccccacccuucauguggccuucuccaugguggugaagacccaguagacucuacuacauacucagcaccagcaucauuccauuugauguuagugggaucucgcuccuggaagauggugaugggcuucccguugaugacugccucccauucucagccuugacuguccuguugauuuugccuuggguggagucauacauguaguugaggucaaugaaggggccauugauggcaacagucuccacuuuagaaggcagcccugguaacuuggcguccaguauagccaaaucuauucacaccgaccuucaccaacuugucuaugggacaagacugacacagcugucucuggaacagggaggaguagagagccaaaaguguauaccuuuaauaccagcacacguggcagaggcgggugauuucuuugaguuuuuuuuuuuuuuaagauuuauuuuuuauuuuauguauaugaguacaccauuacucucuucagauacaccagaagagggcaucagaucccauuacagaugguugugagccaccaugugguugcugggaauugaacucgggaccucuggaagagcaaccagugcucuuaaccgcugagcuaucuuuccagccccauuuuuuuuuuuuuuuugaguuuaaggccagccugggcuacauaguaagaccuguuuuaaacacacacaaugaaaaaaaauuuuuauauggaaaauauauggggaauauuuuuuuaaaugcuuuaaaaccuuuuuguauguucuuguuuuuaggcauagauacucacuugauuuaaauuuagcuguuuuaauaaugucaguuuaucuauuacaugaauucagacagaauccaaacucacugcgguccuccugccucagcucccaaaugcugguauuguagagcaugugcuucuauguucagcaaaucaauuuuuguuuucaacuacagaggaucaguuacacuucuacuguggaggaucauaguauacaagaguauauaaugggguggagagauggcucagugcuuaagaccauuugcugcuccuucagaggacccagguuugagugcauccacaugggagcuuacaaccaccuguaaccuuuucuggccuccgaggacuccaggcaugcaccuugugcauagguuuacguauagguaaaacacacauacacauaaaaaaaaucuuguggggcugaagacauggcuuagugguuaagaguacuagcuguucuuuuagaagacccaguacccacauaaagacuuaacacugaacuauaacucuagcucccggggauccagugcccucuuuugguuuccaugggcauugcaugcacgaggugcacagacagaaacuuguacacuuaagaauaaauacauuuuuuaauaaaagauuaugugaaguguguuuguacaguucauagcuaaacaguaauacuguggacucuuguauugagguuagggaagaacauugcuggugucuucaacuuguugauaaccuaaaucacacugguuuucuuagcauuuacuguuauccugaaucguguuuagaaaauuucccugcuuucuagugagucucuccaaacacguuuguuuacuugucuucgacauuuuuuaaugauacagcaauacuauagguguugucuuucacaugcauuuggagugucauuucuguucuuuguggaguccauuacugcuacagauuauuucauacuucacuauuuauacuauugauaauaaacaguuaguacauacacucucuccuucccuucuuuuuuucugguagugcugggggucaaaaccuaaggacuugcuuguuccuucuaggcaaguguuccaucucugggcuacaccccguguugcauguuuuugcuguaacuaauaacgcugcuucugaccauuggaaauauaugucuaguaguagaccugcucagcguuagcguauaugagaauguucaguuuuaccagaaaaugccacauugucuuuaaaagucuuugauccccagugcugcccccuucagcaugucuuccuguugcucacuguccuuggguuguguauguaacauuuguaucuacccgcuuagugauacaucacuucuuccuagcagauaguaaaagauuacuuuaaccauauuccauauuugaaauuucauuauuuuuuuauuuuuaaguuguauuuuauuauuucacaugaguauguugcuuguauguuuguauguauguauguauguauguauauguauauguauauguacauguacauguacaauguauagcaccugucgaggucagaagagggcauuagaucacuuaggacaaaaauuauagacuuauaaugugaauuauauagcugucaugugaaugcuggaaauuagauccugguccucuuguaagagcagcaagugcucuuaaacugcugagcuaauuaucuggcucccaguuuuucuuucuuucuuucuuuuuuuuuuuuuuaauuauaaauguguguguguguguguuuacacagaugcaggugccuguagaggccaaaaguggaaguuggauccucugaggcuguagucauggcaguuuguuagcugccugacauaggugcuggaaacugaacucagguccucuaaagacuaagcacauguuuguaaccacugagacaucuuuuuugccaggcuuuuuauuauuuuucaauuuuagguguuuucguuuucugguuaugauuuuccuuuuuauccaggauguuuuauugucuuugagauguuuuccuagcuaucuuuauuuguguguuuguuuccgguuuucaagacaggguuucucuauguaguccuggcuuuccugggaaaaacucuaggccaggcuggcccuaaacccagagaucugccugccucugccucucuaguaugaggauuaaagguguucaccaccagugucugguuuuauuuauuaauuuauacuucaguguugaagaucaagccauucaaaauuucagcauaguuagggaggaacuugagaggccccacugcugacaagggagcuauuuguugguaguggauagcuacugugggagggaaagaccaucgaagguguggccaguguugguugcccguguuucaauagcucuauagcuaugcacauauggucugcauuaaauggacuuaguagacuauuuuuuaaaaaagggcuggcgagauggcucagagguuuuuuuaaaaaaaagucauaaaguugggaggcagacauguggagaucuggggcauuggagggggagaaauggggcuggacauaaucauauuucauuguaaacacaugaaauucucaauaaaaauuaaauaaaaguauuucuauuuuaauuguauugucagcaaauaugguuuucauguuacuaguacuuucaaauuugaccuuaacuuuuuauaguugaauauuuuauuacuuacugcuguugcaaaaauuuucaaaauguaguacauguuagaaaaguacuguauccugggcuuauuccugauccucuuuagcuuuuacauuuuauuuauuuuuauuuauuuauuuauuuauuuauuuauuuauuauuuauuuauuuauuggguuuuuggagacaggguuucucuguguagccuuggcuguccuggaacucacucuguagacuaggcuggccuugaacucauaaaucugccugccucugccucccaagugcugggauuaaaggugugcgccaucacugcccggcuauuuuguuauuuuuaaaagaagauuuauuuuuaauaaauuuauaccuaguagcacaauuacagauaguugugaacugccuuguggggccuagggauugaaccuagguccuuuggaggaguagucaguacucuaaacugcuaagccaugucuccaacuguacuuuuuacuuuguaauuuugaagcagauucucucugaguuucuugggcuugcuuuacacucucuuacacaggcuagcauuugagucaugagucugagccuccuuaguagugggauuacagguucaugccagguucaguuuaaaaaacaacagacaauuuuaauaucucaaaguucugcuuuucuaaaauccaugagcggcuuuaugauaauagcuuuugcucacuguuuuucaaaagauugcagaugagcagcagucaucuaaagauuugacauguacuaauuauucacuuccagugacaucauuuacauagcuauagggggguggcuucaauaucuauaucuauaucuauaucuaucuaucuaucuaucuaucuaucuacuucaauaucuauaucuaucuaucuaucuaucuaucuaucuauccauccauccauccaaucauccaucuaucuaucuaucuaucuaucuaucuaucuaucuauccauccauccauccauccauccauccauccauccaaucacccauccaucuaucuaucuaucuaucuaucuaucuaucuaucuaucuaucuaucugucuaucuaaucuaaccuaucuaauccaucuaaucuauuucuagcugcuugcaaaagggcucaguuccuguugcuaggccuucuugaacacaugacaauugacauuguggaaggugaauguuuugagagaaucagaagcuaugucuuuuuuaaagacccuuggaaguugauacacccucccuucugcuaucuuauauuaauuacccauagagaacaguuuucauauagggugcaagaacuacacaaagauacuacaacauuggaauaauuaugggccaucuuggagucuagauagucaugaaguucauuuuauaaaguuuuuauauguucuugaaaauaauguguaaucucugguucuuggguauaauucuuauguguuguuuuggucaaguucugcauucuaauuuuucccccuuacuacaauguauaacugaaagaaauauauguuaggcagucuugcacugaauuugaugugauuuaauuuuuuuacuuuuauuguguguuuguguacaugugguaugugcacacaugcuuauaccaaugcaugugcacacacauagaccagaggaggguguugaauguccugcucugucacugcuuuauucuuuugacacaggguuucucacugaacuuagagcuagacugguggccagcaaaccccaacaguucuccauucuuuauaccccuaacaucauugagguugcagguacuugcacagccacgcccagcuuguuaccugaguaccagcagcagaacucaggcucccaugcuuguauagcagccaucucucuaggccaaaguaguagauaugccaguuuuguuauguguauauaauuaggugcucagaagucagaaucucaugcugugaggucaucuuuuucagguccucccucccucccccucccuccccucccucccccucccucccccucccuccccucccucccccucccucccucugccuugcacguguuggacaagccaucugcuauaugcauuccacuucuuguugaguuucuuuaguaucugcugggucuucuuccauucacugaccaugaaucuuuguguauguuugugguuuaaguuuuucuuauaaauaguacaauggagauaguuugacuuuuucuuccaacuggaauguuuauuuuauuuacauuaaucaugauuacuggcauauuugaacuuauuucuguuacuuuauaagacuuuuauuuuccuuuuuuucacucuacccccuucuugaauuugacuuuuuguuuuguuuuauuuuauuuuauuuuauuuuauguauaugaguacacuguaguuguuugccuucagacacccuagaaggcggcaccggaccccauuacaaauaguugugagccaccauguugcuggaaauugaauucaagaucucuggaagagcagucaaugcuuuuaaccacugagccauuacuccagccugaaucugacuuuucuuuuaggcuuauuuuucuucugcuugaagcauguucuuuagaacuauuuuaaauaagggucuauugcaguaauugcucuuuuucuuuucuuaaaaauaucuuaauuuccuccucauuucugagucauaauuucaccaguauguagaaaucuggguaguuguuugccuccuaagucuauuaaagauacccuuuucuuacuuuucugcuguuguugagaacucaguugucauuauaauugccauuacucuauaggugguauuuuucuuucuggcugcuuuaaagucuuuuucuuuuucaccuuuuguauuuucccucucaccaaagguaauuauguugaguaaugaaugcauuaauugacuugauuauugucauaguuacuuuucuauugcugugauaaaacacagugacgaaagcaauuuauaaaaaacuguucaggggugggggcaguggggguggcggggauggcggagauaucagcaguggaguugguggcagcacacgccuuuaacuccuagcacuugggagacagaggcagggggaucucuaugcauucaaggcuagcuuggguuacaaagugaguuccaggacagucaggacuacccagagaaacccuguuucaaaaaaaccaaaagaaaaaagaaaaaaaaguuuaguuuggcuuaugcuuucagaggguuagaauccaugaugucggagcaaaggaauagcugagagaucacaucuugacccauaaccaugaggcagagagagagagagagagagagagagagagagagagagagagagagagagagagcgcgcgcgcgcgcgcgagagcgagcgagcuagcagcacugggaaucucaaagagucuuuuugaaaucggaaagaccaccccaagugaugcauuuagacaguucuaccagcugggaaccaaguguucagauauaugaaccauggggauaauuuucauucagacuaucacaauugugguuaugauuucacaggauauugaaaucuuguuauguaaguuaaauauauaaaauuuuauuugcuaauuaugccuaagugggaaaacaaauguaaaagucugcuuuuaaaugagggauaauugggaguucuuguacaugcgccuuucuguagggcagguugguagggagcucacuucaugguuguugacccuccagauguguuucaguggagauccacuuuaucuggacgaauauugccucacugguugccuggguaguaaugcuugauuaaaggauuaagccaagagccugguagguuuauauuauggagauugucaccuauuaaggaaguaagaggauuaucauggaaagguuauuuuauaguucagguuuuaaaauauaggcaaaggaaauggucauugugucuuuaccucugaauucggugaacugucuguacuuugucuguagccuagcaggggcaaccuguugcuccuggaccacagucucaggcacauugcuccagguaauaaaaggugguuguuaaaggcaauuggaaaggcaguguaauguuacugguuuauucuuucauucaacaaacauuuauuaauugccuuuauaaaaccuccuaaucaaaggauaaaacgacuuuugagaaagaugucuuucuugcuaccauggaacuuaaaaugcaagagugauaugcauuaaacaguuuaucauguggcuaauuauauuuguuacaagaaucauaaacauccuggggauguggcuuaauugauauagagaacuuguuuagccuccaugaaguuauagacaucuguagcacuguaugaaacugggcauggugguacaugcuggcaacuuuaguaauuagggaguagaggcagaaggaucagaaguucagggucaucuuugauugcaauagagaguuugagucuaggguagaugagacacuagagaaauagagaaaaauuuuuuugagcaaaauaauuguauuugagaguuuuuuuuuuuuuuuucuuucauggcuuucuuuucagugagcguauauuacuuucacaauuggggaaaagugaauuaaacuucaaaaauacgcuauauuacaaauaucuuuagcuauaguagaauauagagauaucuuuggacauaauagaauauaaagggcuuagguugccugaggaaaaaggaaaaagaagcaccuuugaauuaucucuauuuaaagcaaaauaugaucuacuauaagaucucaacaaauagggaguuauuuagaagaaagcauaacauuaaacaaagaacugugaacaaugaguaguuuguuucuauuuucacucagaaauucuuugaaaggucacagacuaaaaugugugcuucuguguacauucuaaugaguuucuaaaaggccucucagacuguaauggaaguuaggggugauguuacauuucacuuaguguacacacaggaagaaagcaaaggaaaaauagcucaugaggaggaagaacaccccguaugucaucuuuagguauuaggaaauacacacauuaaggaggugucuucucugcuggagcacaggcugacugaugaaaagcaccggcugcuuuuccagacgacccguuugauuccagcagccacauggcaggcaggcagcucgugaccaucuuuaaacuccaguucugggacaucugacuuccucucuuuuggccuccaagggcauuguauguacauggcacauagacacacacauuauuauuaauauuuuuuaaaaaauuaaacuacccuugacuauuguagcuuauauuaagcacaucucccagaagagucuguguuauugguuacguauuacauauguaauaguccuuuauguaguacucaaugaacuuaaaauuaugaaguuuguuuuuauuuuaaugucauuuuaagucuauaauuggcaaucaaacaaagcuauuauuccuuuagcaaaguuaaaugaaaaaggugagcuaacugcagauuguuaagccaggaauccaugauacaggauauggcuaagcuaauaauauaugaaucacuaaaguugggcagaguggauggauaagccugaaauuuaauccugagcucauaaaacagguauuacauaauuaccauuuuuaaaaccauacagauauaaaccaucuguaggcaaagguauuugcauggagccaaacuaguuuugccaagaagcgaauuuccuugaauucacuuuuccuugaaagcuugaguuuuaguuuauucuuuuccugcuauucugaauagccaccuaaguuuucaugcacagaagcauuaagucuuuuuuuuucuuuaaagauuuauuuuauuuauaugaguacacuguagcugucuucagacacaccagaagaggaaucggaucccauuacagaugguucugagcuaucaugugguugcugggauuugaacucaggaccucuugaagagcaaccagugcucuuaaccacugagccaucucuccagcccagaagcgucuuauagaaccuauuuauacucacuucaccccuauuuaugcaaccacuauugaaacuccaaaagcuaauucccaaaugucuuuucagcaggagcccgcuucuuaccagccuaaacuacaguuguauuauuugcacagaaaaugcuggcuccauuauuuccuucucucccucuguaaaguucaaaagccauuagguaaaacagagcaaguaggcaucucuguacaugcuuggguaaaagagccugaucagagugaaaaaggcauugcuguggaggagagcagcauaagacagaaagaguguccacaauugccaggcuaggcagagucagacaaggagagacuacucuguagaggguggccagacagaacauuaguucacacagggaggaggggacaauaggccacaggaugacaaggccccagugggauaaggauagaauuuauaagaaagauaucccuagauaggugucaguaccugagugggccuagaaggugcuggugggcuguggccagagcaggcguguacuagcucuagcaggugcauauggggaagcaguguagcacaagcagaguguccaagccuggcacaguaaaggaggagggaacaagagaguccagggggacagugugcugcugacugagccgcagaggcgcucgccaccucagcuggguuucuguaacccagcuggugaaguuaaaguucauaaaauuaaaaacauaagauggcuucauucuuuuggaguucucuuggcuuccuuuuccuuacuccuuuauuuaaucccauuaauugucuacuuuucacccuauggucaauuuggaguuuaauucagcauuuucuucucaaaauaggcugcuuuuggauuaagugauucuucaguugggugguuuagaacauugccuaauaggauuagauagcugcaucuuauauaacuauuaaauuuaaauaaaaucaaacauuugauuccuuaucuggacuagccauacugcagauauuuacaauagcaagguagagcuggcuaguggccaagguacugaucauugcggauacagaauaucauugcagaaaauucuauuauuuguuauuuagaauaugccacaguucuucggacuugugcauaguccuguuguguaugucuauuccaacaucccuguuguguguauguguguguguuuuccuauauaagccuucuguguuuucauugagagugcauugucauuugggaagauuguucguucaucaggcuuucuguuuccuguuguguguauacguauacuccccuaguguuguguuaaguggguccuauuuguacacacauacacaucugugaauguguguaaguuugcagcuuuauucuucuggauuuucuauugauuguauggaagggcuggggaaauuuagauuuacaagcuguauuguuguugccuuaguuaggguuuccauugcuaugaaaagacaccauggcuauaguaacucuuuuaaaggcaaacauuucauugaggcuggcuuacaauuuuagagguuuaguccauuauuaucauagcuggaagcauggcagcacgcaggcaugcguggugguagaggagcugagaauucuggcguccucagguagcuaggaagcucuccucugcaauggguagaaccugagcauaagagaagaccuccaaagcccacccgcacagugacacacuuauucuaacaaggccacaccuccuaacguaccauuuccuaugggccaaguauacuuaagccacaguuucacuugugugaaaauggcacaguugacauuuucaccuucuaaaauuaucuuuuuuugaguuuucaauuuuuuuccuccauagucuucuuuguuuguuuuuuguuuguuuguuuguuuuuuugaugcaugguuucucuguguagcccuggcugucuugaaacucauuguauagaccagacuggccucgaacucacagacaucugccugccuuugcuuccugauuuaaaggcaugugcuacuacuguucagcuuccuccucuuuauggucaguuauguaauucuauaguuucugugcacugccuuccuuacaucugaaccucauccccucuguguuuguuacuucucugcugucaagcuaauccugucuuacugacuacaacugucuggcaugucacuuguuccucccaccuuuacuugcaccaccucucaaguggagagagucguagguguggucucacagaggagccuccuugguucucucucaguaucaccagggucuaagaauagugcauugauuucugaugcuuacguacagaauuaugcuuuugaguugagaugcauuuuuacgcagugaaguugaacucauccacagguuaguguaaaugugagccuccaaagaauuuguuuuuuugugagaugaauuucuagguuguguugcuacugccuugguugugugguugguuaucuuuacugcggucaguuuuaacucuguuccugauuuuauaguuuauugaauuugaacaauuugcucuuauuuccuauugauuagugcuuugcagccuagauuuucuuugucuguauuucauucagugcauacacugaaggacuguguguauuucuugcggaauucucuuacuuuguagcuagagggacauagcucugguuccuaggucaucauucuucuuggaaaacacuggauagaagauuugacuuuauagauacagguuuauggcuuacagaagggaaacugaaaauuaaaacuaacaggccacuuaggauuugcucuaaauucuagguugcauuguacauuagaguuugagauauaaauauucguagguaugguugauaaagauuuccuaaaaaguugugauuuucacugaaaauacauguuuagucuuacuauuuuucccuuuuagcuuccaauaaagacaggacagcagaacacacauaccaaagucagcaccgagcacaacaaggagugucugaucaacauuuccaaauacaaguuuucucuggucaucagugggcucaccaccauccuaaagaauguuaacaauauggugaguaucugacuuacaugaucucugcuuuguggugaauuugcuucauuuucguugugauuuuggaaguuuggagagcauguuuuaaaguauggaaaacauauucuuaggcuuucagacacaaguuauuuaauggacaagcucaagaguaacuuugaaauuuugacuucagguuuuuauucccguugaagcuucucuuauuaauuacucuguuauucgggaauuagaauuuuauaucucuuuuguauuguauguaaaguuaucauaauauagauuccuucccuccuuccuuccuaagcuaugccuucagcuggguaguacaggcuuuguuaauaugcuuucuguuagcugcuuccuuagauguauuuauugauugucccuguccaaacuacguggugaaaaagaguaugaccuuucacuucuaaagugagauuacuuuuucccgcuguauuaaagaguuuucucugccuuccccaaaucugaagcaggcuggguaguguuagcgacucaguguuagagagcagcguucucuguaucuuagcagucagcugacuucaucaagggaguccacugcugagagcugccaguccuucuuccauccuucccacccggccgccucuguacuccaacagcuuuuaacaaucuacuucauacuucuccagacaguagauggacgucuccuucucucaguuugugcuguuugugcugagcugugaagcagccacuuuuguagauucugaggauuaguuuucuagucaggucagcuuuggagaauuuccuuuuaagaaggcuguucaauaccagaguuacagaacugaugaauugcggguaugggcaguucaauagauucuuuucuuugcuaaauuuaugcuuuuuuuuucuucuaaaaagcauaggacguuuaauaaacuguacagugauuuacaggaugcacuuccuguugugcuguagcucuucgccugcuguggagcgcaguauuaguguuucuucugucugagcaugcugcugccgucccaggcgcacugcuguaguuuauauuugcaaucuucuuuagaacucuagggauguuggcauucauguagaccucacugaaaaguuacagggccuguaagguggcucagugcauaaagguaauugucacugguccucggagcaaacugguugaaggugagaaccaaccccugaaaguugucauucucugacuuccacauggacacuguggagugcccacagccauacuagcacauacacuacauguacaauaaugauaaaauagaaaacagaaaaauuuaaaagaaaaaauauauaaugaaagucaguuuuuuuuuuuuuuuuuuuaaagauuuauuuauugguuauauguaaguacacuguagcugucuucagacacuccagaagagggagucagaucccguuacagaugguugugagccaccaugugguugcugggauuugaacuccggaccuucagaagagcagucgggugcucuuacccacugagccaucucaccagccccgaaagucaguuucuuguuaguagguaggugauacaggguucaguuugaaaguaaugaaugcuuaagauucacuguaagcgauguaguagcauucuguuuaauaagaauuaagaaguuaauuguuuugcaaaggaggcgauagcuaaaugcuaauucaggacagguacaagccucuuaacucaugaguuauuuuaaacucuccuugauucauuauuuacccccacacccuucuuccuuuucuuuuuccuucccugucacucccccaccccgauagaguguauaacauacucugggcuggcgccucaaacuuacuucccuagugcuagcauugaacuucuaauccucuugccacuauuuccauaguguugggacuaccaaugucuuuucauuaugucuggccagcuuauagauauuaaaaaauauaaagcaucauguuuuacuguuauauagcuaacagcaggcuuuuauaaauaccucuguuucuuugguuuuuuugagacaggguuucccuguguagcccugguuauccuggaacuuacuuuguagaccaggcuggccucgaacucagaaauccaccugccucugccucccgagugcugggauuaaaggcgugcaccaccacuccuggcuaauaucucuauuucuguuagcuuggaaauuuauuuuuaggguaaaggaagaaaugauagauuuaaguaucauugaauguaaaagacaaaguggaagaguaauacuuuuucuugaucuucagucuuuuauauuucaugugugcuaauuuguagugaaguguuaaucauauuuucugaauauauuuuuuagaggauauuuggagaagcugcugaaaaaaauuuguaucucucucaguugaucauauuggauacacuggaaaaaugucuugcugggguaaguaaauucauucuaaagaggcagguuuugugaauucagucuugagaaugagguggaacacugaaaggucagugugggacacugaggacacacuaagagucuuugugguagaugaauaugaauucuguuaauacagaugaccugauagcucagucuagagaaaauuauucucucagcuuuuauaaaucccauagauauuuaaguuuacuuaaaauguuaaguuugagccccauuucugucucuuaagauuuuguuuuaagaaaauauuuuuaugaaggaaucacuauuccauuuaauuauuuuucagauaucuuuagacccgugccuuuguauaguuggaagaauguggucagcacaccaaggguagucuuacuuuccugccuucaugauaugguuucaacuuuauacagaccccgacaaugggaucuauccuuucuuuguuugaagcuguccuucugaggauagcuacuaccagaagauuuguguaaaugugagcauuuucauaggcauguggaggagucauugaguaccacgcaguucuuucccagguugccucugagucgcugugucuacuuauuucaauuaagacuuucacuuuuucaagauguuuucugcugcauacauuauuuauauucuucccuaaucuuaauuuuccccaaacauggguagguguuuauauaaauacaugaugaauauuuguuuuaaaauugucuacuccauuuaugcuaguuagcuuauuucuuuuuauucagcacagaauacagaauuuugcuuuuauucagaauagcuuuucucuuaugaguucucuacaguaaaucuagagggaagacacuuaaaacaauuuuugaaaagguauuuuguguggaugaguguuuuggcugcguguguaugaguguguguguaugacuggugccugcagagccagaaggggcaucagaucucccgggucuggaguuacuagugguugugaaguaccacgugggugcuaagaccauauucaaguccucuagaugcuuuuaaccacugagccacucucuggccacaagaaggaagagauuuuaauguauuaggauugaugauguaguugagaagagaaagaauguuuagaagugacgaggauuaugcagggaauuggaaaacaaaaacccaaaacaucucacucacacaaaacuuucucuagggaaguuugugagccagaaacaaaaaaaaguauaugauuuauuuauaguuuuuaaaguuuaacuuaaaaugauuuaaauuuguguguguaugcuuacaugugggucugugcuugaguuuaggugcccucaaagggcagaugcuuccgaucccccuggagcuggaauuacaggugauggcaaaucauaauccuacgugggugcugggaacugaacucagguucaaguucaugcaaggagagugcgugcucauaaccacugagcagaaucuccagcuccuguaauauuuauuuuuauuuaugugcauaugggguacauauauggaggucagaggacaacucuuggauagucaguucucuucuuccacuuugacaaggauuuuagggauugacuuuaggucguugguuuuacacaguaaguacucacuaauggaaccauuuuugccagcccagcauaauacuucaaacucuuaaaauuaaaaaaguauuuaucuauuuuauuuuauguguacgaguguuuuaccuucauuuaugaauguuuauauguaugugcgugcaugccugguacaugaggaggucaaaagagggcaucagaucccuugaaacugcaguuacagaugguugugagcuacugugugggugcugacaacugaacauggguccucugcaagaacaagugcuucaaaccacugagccacuucucuagucccugauauuuugaauucucauugaucucuggccauaguccagaauuacagcauuuguaaguuuuauacuuaaaaugguaggaauaccauuuauacuaaaaugguauuuuagcuugguguucucuguuaaucugugaaauggagaacaaaaacacuauuaucuaguggggcggaauugggaguuuagacauugaaaccuuggcagugcucuuaguacuuuguaauuuuugcuguaucagaccaaccaugauugaguugggaagaaugguguagugccucuuuaaguuucacaacuuuuucuucauuaacaauuuuaauugagagguaauguuaucuuggagagugguugcugauauucuuuggagauauccuaauuacaaugaugccauauuuccacaguauaccuguauaguuuacauauuacuuugacuuggucugcuuugaaauuguuucuuuuugguuucuuuuuuucuuuuuucuuccuuuuuuucuuucucuuccuuuuuugcuuguggaauuagagauuguauucagggccuugugcguauaccacugagccacagcccuagaacuaugucagguuagugaguuagcugcugcuuaggaaauaauccaauaaucuguaagacaguugggccaguuuuaaaaguaaauuucauggaauguaaaaaugagauauguggaguaugggggugggguggaaauugcuccagaauaaagacacugaaggacagaauagucaugcugugaccucugaaucacuuuugggucuucagugaauaaaaagcuaugaagacauuuucagugucaugcaguguggauuggguauuugauacauggaaugguguuauuucuuagaauguuaauuguguugaaauugcguuagagaauauccucauuaggauaagcugacauacacaagggcugagauauuauaauguuuauaauguacuuggaugugauuuagcucagcauuauuugaggugcauaguacauguuuuggucagauuauacagaggccaugugcucccuaccuaauuccucuggaaguuaaaugauauaguguacucacagugaauaugaauaaaguuuauugagaacucacagggaacugcaaguuucuaaaaaggaagggaucgggcuagugagauggcucagugguuaaaagcgccaacuguucuuccagagguccugaguucaagucccagcaaccacaugguggcucacaaccaucuguauugggauccaaggcccucuucuggagugucugaagacagcuacaguguacuuacauauaauaaauaaauauuuuuuaaaaaaaggaucaacugauaaacuaggaaaccugugaggcaagauggagggucgggcuucaaugguaaagauagggugaugaugucuucuuuacugaccagguauaggacgauguggcaaauucaaggaaacgauagcagguguugaauucgagugauagcuguguggcuguuccuucuauuccagcuucucugugugcuugacacuuaacugugaauguuugcagguaaaggaaaagccuuauaauuaugugauuauuuccauuuuagcaaccaaaggacacaaugagauuagaugagacaaugcuggucaaacaauuacuaccagaaaucugccauuuucuucacaccugccgugaaggaaaccaacaugcagccgaacuucggaauucugccucugggguuuuauuuucucucagcugcaacaacuucaaugcagucuuuagucgcauuucuacaagguuagugccuaaagcaugugggaaauuaaguaaaaucaauuuuagaauucuugucugcauaagagugguuaacagaaugacaucuggguuuuugaaggaauucuauauauugauuuuucuugacauuuuaauuauauaauauuagaaauuacuuuggagauagugauauuuagacaugaauacuauuaugaauaauguuacagacuuggagaagauaucuccauggccaucucucucucucuuucucucucucucuggugcccgcccucccucccucccucccucccucccuuccuuccuuccuuccuuccuuguggugcuaagguuugaauucagggucuuguguauguaggcaagugcuccaccacagagcuacacuccagccauggguaggcacuguaaacauauucuucagauuaaacuaugcaaauagguagaauaguugagaagaauagcagacauucuaaugaccuaauucucauggcuccuaaauuuccuuaaaaauaaucuaaguaauauagaaacaaaaggaaguaauuacaaaguuggaaagugagguguguuuuagugacuaugaaagucccauuuacugaggauucacaguuuaugccaugucucacagugauaaugaaagguuguuacaggcaaauaaauugauaccccucaaaaauaaauguauugugcugguauaguggcucacaacuuuaaaaucugagcauuugggagcagagacaggaguucaagaccaaucuuuaaugaguuugaauccagccagggcugcacagugagacuccgucucaaccccccccccaaaacuccaacaaacaaacaaacaaacaaggaauugugucaaauaauggaauuugacacauuuccaaauuucuaaguuggauaggccucaagaacuacguuaguuucauuauauuaguuuucaguauuucuauuuuaacuaucuuguggaauuuuaaaauacuguacauuuaauuuagugauuucaaaaaugaaauagucaggagagaucgcuuaguaguuaagagcacaugguucucuugcagaggaccugaguuugguucccagugucugcauggugccucacaaccuaaaccguccaguuuagggaauucaguacccuguuuggacacuaggcacacauguggugcacauacaugcacaguacauucauauaagcaaccauaugcauaaaauaaaaacaaacuuuuaaaaauguaauuucggugaaacggaaaguaaagaaaauguuggcuggggaaucacuuggucuguaaagacccucacagagcaagccugcuggauguggguuuuaucccugggaccaagaaucacuaccacagugucguccucugaccuacaccuccuaacacauaaagcuuaaaaaugaaagaaaauuauuguuuaaauauuuccugaucagucaaaaucauaaccaugauauuacagaugagaaaauuaguuuaaaauggugcucagugggaugaaaugauaaauaaauugugacugauuugucuucaugaaaaugauuugccugucuuguauaaguacacucauauggguucuuaauuaugauaaaauaaaaaguauaaaacaacccacguaaagauuuagugacuaaaagacaaauacaaacagagaaaaguaauccuuuuuacucuuugguuccucucucugucacuuacuagaguuacacgaauggguuucuauuauguucacucuuguuucccagugaggugaaugggaauauacauuaaaauucaagaauuuauggcccgcuauuuaagaacucacuugcaauaaaaaaaaaagaacucuuuuuaauaaaaaguuguucuauaauuaugaugguaggugacaauauucuaugauauuguauccuacagucuuaauaaacuaugaaaagaaaaucaaaacuuuauuuaaugauauaucauugguuaagguuuauauaacagaacauuuccaugauauuuuuuuucuugguuuuucgagacagaguuucucuguguagcccuggcugcccugcaacuugcucugcagacaaagcuggccuuguagauuuauuuuauauucugagucaccauacacugauggagccaacaagguggcaaacagggaaauaggauucugggcgguuauacaaaguaaaacacuuucauuuaggucaguacgagauuaguuuuauuacuuggaaaaaaauucuuaaaaagaagauaaaaagcaauauagaaaaauacaguuucuuaguguauccaugcaggaauuguuaauguuuuuauagaacuauauuuccauaaaguuuuugaguaaguguauuauucuguaaaauagaacaaaugugccaucuuugaaaacccuaaaguugggcuggagagauggcucagcuuuuaaggacacuggcugcucuuccagagguccugaguucaauucccagcaaccacaugguggcucaugaccaucuguaagggcaucugagguccucuucugcuuuguagguguacaugcagacagagcacuccuacagcaaaaaacuuaaauaauuauuuauuaaaaaaaaaaaaaaaagaaaaacccuaacucacccaaagcugcuuccaugaaguuuggcagcauuaguuaauuuauaggcaacuuuuguugauuuuccaagucuaguaguuuguuaucuguugccagaauagaaguuguggcuagaguuucauugacuucgguggcagauuagccagaaaugggaucuaugagauaaaugcuuaauacagcuaugugucuugauuuacuuaguaccagaauuaggaccacucaccuaacagacugcugugaugguuuaauuuacaugggggcaucuuaugauacuauucuuauagcuacuauuccuuuaucuauauauucuguauauauagaagauuugagccagcccucccucccucccucccucccucccucccucccucccucccucccucccucccuucauuguuuugauuguguagacagacuuugucuguguagcucugguuguccugcagccagcucucuguagaccagacugaccuccgucucagagauccuccugcuuccuucuccucagggcuggauuaaaggugugcaccaccaccacccaacuacauuucauuuauaauuacgaucauaaaaaugaguugaacuuuaccaguuucuuugucagcagauguucuuuuuggcggugggcggggcaguauuggugguugaacccagggugucauauguucuacuacugagcuacagcuguagucuucuuuuuacuuugaaaaagggcuucaccaagcuuuucaggcaggccuggaacucaguuuguagaugaggcuagccuugauaguguccucccucagcucucuuagaagcugucauuacaggucuguaacacccacaacagcuuuaguuguuguuuguuuguuucauuuauuaauugaaaaaauuauaacauagcuuuauucugcugaacugucuuaugcuguaggcuuauuacacucuuuagaguuuaauuuuauauuguuuuauauauguuacuugugugucagugccuguggaggccagaagaugguaagggauccauccccugaagcugagauuacaggugguuauaagcuaccauguggugcuaggaaucgaacuugaguccucuggaagaacagccagugcuuuuaagcaaucucuccagcccucauuguacuuucuuuucuuuucuuuuuuaaaaaagauuuguuuauuauuauaucuaaguacacuguagcugucuucagacacuccagaagagggagggcaugagaucucauuauggaugguucugagccaccaugugguugcuggaauuugaacucaggaccuuuggacaagaaguccguuagcugagccaucucucugcacccccccuccucccauuguacuuucuuacauagaaaauuguuuuuuuauaacagacuugauaauacuuaauuuggugauuuauuuauuuuuguuaaauucuuuuagagacagguuucuuaagucauccaaucaguuguuagauauagauauuaucuggacuauccaacauuucccauaaaaauuuuaccuacuugauaaucucuggaucgauuauuaauuggaagugggaaaaguaaaaacauuccccacgcacgccccacgcccccucuuuugacuagugaggcagggucgcacuguguagcuucagcuggccuggaacuugcuguguagcuuggcuggccuugcuguggcuugcuuggagcucauggaucucuccuuucugucucugacuccagaaugcugggauuaaaagugugugccgccacaucuggcuggagucuaucauucuuuauuuuuaaauuggacauacuguauuucuuuauggguuuugugauugugagaauuaaaauccagagccccuugcauuaaauugugcuuucucuuuauuuucuuccuucuuuccucuuuccccucucuuccucccuccuuucucaagaccaggcuuuacuuuguagcccacacuaacaguaauucuccuguguucuccugucuccaguuucccgagugcuuggaugaugggcuaugauaggcaugagccacuaugccuagcugaaacuagauucaaauguaaacuauuucauuuuuuuccuguaaacuguuuuuuuuuguauauuuauaucauuuuaauauaauauaaucuaaacagggaaugcaggguagaggccuguuccaccauuauuccuuuuuagauugaagugauucuaaaaguuggaaaagcucaccugugaguuucuucucucaguaacuacugcuccuccugcccccauguggauugcaguuguagaaaaaagaaaaguuggggcaggggcaguaggauggcucagcagguacuggugcuugcugccagccugguaaccugaguuucagucccugagacuuguaugguggauagagaggacaguucuguuuuucugauugauaaugcaugcucacauauaauaaauaaaugugauuuuuuacaaaggaagaaaaucugauacuccaauugucccaguuuaacaguuauagugucugauuguacagcuguaugauuuuggacuugacuauaauaguugcuaauuuccuugucuucaauuucagggaaaccuaaauacauuugaaaauaugcuccaaucuuagaauuaacuaguuuuuccagaagagccauggcuaaugugagaaauacaauucagaccucaguguuaaagauacaaauacaaaguuuacuggaauaucacuuuuugucaugacucuuaaaucgguugaauuauuuaguuuuuuuuaaauaaauauguucuuauuuuaugugucuuucauucauaaacccccuuucuauuaaaucagaaucuuggacuguucuaagacuuaaauugauaaauuacuuuugauuuuuacuuuucagguuacaggaguugacugucuguucagaagauaauguugauguucacgauauagaauuguuacaguauaucaauguggauugugcaaaauuaaaacgacuucugaaggguagguuuaaauagauaugguuauaguaaacuuguuugaacuggauaucaaaauagauuuuauagugugcauguucuugugaaauggccagaaauguaugugcuugacuggauuuugggcauuugaaaauaauacagcagaacaugaauuuuauuuuuugagacagggucucucuguuuaucccugguuuuccuggaacucauuuuuguagaucaggcuagccuugaacucagggauccaccugccucugcccccugaguucugggaucaagaagggucuuuacugucauguucaucugagaauauggauauuuaaaaucuuggcaguaggaaguuuucuuuuuucuuuuuccuuccucccuucccuuccuucccuucccuucccuuucccucucucccucccucccucccucucuuuccuuuuuuuuuuuaaagauuuuuuaaaaaguuauuuuauguauaugagugcucuaacugcauagagaccugcauuccagaaaaggacauggaaucacauuacagaagguugugagccauuaugugcuuggugggaauugaacucaggaccucuggaagagcagcuagugcucuuaaccaucucuuaaccgagccaucucuccagccugggaaguuuucuugagcuacaaguuuugcuuuuaauaaggagaauguuauccuuuuagaauuugaucccuuaagugacucuaggucgcagaaucaauuuguuugguuguccaggugcuugaagaacauggccuugagcugcuggaguaguguaugccuguaaucccagcacaugggcagaugaggaaggagaguucaagaccaguuugagcuauguagugaguucagugucaugaugggcuauagaggaagcccuggucuccagaaaaguaacaaacgaacaacucccuccacaucaaaggacggagugaaaaucucaaacaguggcuuaauuucugaccugagagacugagcuugaguuauguaagcuaugagaaguuuuaauaguuguguaauacaguuuucaaaauacuuaauauuacaaaacaugcuauuaagcuggauguaguuauauacaccuuuaauuccagcacuugggagcaggagcaggcagaucuugugaguuugagaccagccuggucuacagagcuccagaacagccagguuucuguagagagacccaaucucaaagaaacaaaaacaaaagcaauacagugacagaaaacuuuuuucuuuuuugccuuuaauuuaguacacaaauuuuacauguguucauggaaucuugaauucuuugaaagucaguuuuaagagaaaaaaguuuauagacaugagugucuacuauuuaaaaagucagaaauaucccagauaaccuaaugauaaccucaaggucuuagaaaagcaagaacaauccagauucagcagcaggggacagcuggaaguaacgauggucagagcagaaaucagugaacugaaggaugaaagaacuguguagagggaaacagagagucggcuccuggaaaguucagcaggauuggcaaguccuggcuugucaagacuccaucaaauuagagaugaacaagcugaguuaacuacagguccuagugaagugcagagaaggaggguauauucuaaauaguugguaaaccuagaaaaaaaauggguaaauucuuaggucuaucaaaacugagucaguaugguauuaacagccucaauagaugcauagcaaucaaagacauugaagcagcuauaaggcaauucaaguaguaauaaaagaucucccaacaaagaaugcaagagcagauggaauccacugccgaagucaaacaaaaauuuccuuuacagaaaaauagcaaaggaaggaguacuaccauucugugaagccagcaguacagugauaaauacgcaacaaaaagaaaacuugaauucucaacagaacuccagaagcaaaacuccagaacacugugguuuccuuccagggaugcaguguugguuuaacacaacauagaauaaaccauagaguaaaccagcauguagguuuacgagcagaaauuacccgguaaucacaggugaucagaaaaggcccuugcuucagaaguucagcauuccuuuauaauaaaagcucagcgggcauaaaugaaugcaccaaaacauaaaaaaggaugcauaugaauaaaacccauagccaacauuauacuaauugaggggaaaauaggagaaguuccuccaaaaucuagaaugagauuaagguucagacuuuguguggugcagacuuuuaaugccaguacucagaaggcagaagcagguggaucucuuugguuuaagccuaguuugaucuaguuccaggccagcuaaaaccauauauugaaacacugcaucaaaaacaacagcaaaacaaaaacaaacaaccuaaaaguuuccaguucucuuuuagaacuuaguuuaguaugccaaaucuuaccuagggcaguaagucaagagagagcaacaaaaggaauucagauggggagcaaaaguccaauuuccccagugcugaggcaacaugucuuguuucacagcagaacugaggugggagcucccccugcuggcuaguuuucacagugcagaaguuguaugugggagacuggaggagaaaggcauuaaugaggaucgcaccgcagagaucucugccacccauaauaccaacuuguaggcaagauguacucauugcaguaguggcacaaccauacggaaacaaccagaugcucugugcuugguuuugaagccuguuccccaagagggaguccaugccuggaacugugaaccuaguuaacuuccuaugccugaggucuuugacccuggaagggaacuuacuguuguuguuuaguuaaauugauaaagcgccaagcugccuuuaaaauacuuagguuuauguucgugaguuaaacacuacuuugaaaaguauaaugaauaaggaaaauuuagagucacauggcugcugaagauacugagaguaaguagugggcaagugcucagcccucaaaaaaaaaaaaaaaaaaaacaaaacauucaggcuaccucucugaggcucagggagcaguguagaaugaggagugggaagaguagaagagcuggaagcuaaugagaagagcugcaaaguacugucauguggccgugacacagccaaugaaaaucaugaucucacagcagcagcagcagcagcagcagcaauggaccuauacaagacuggucccaucuacagucuucauauaucugagaaggguccauuugguccuccccuuccuugcugaacuaugaacuacuaauggauuuggguugggggagagcaaacaauguuaucuuuuguguaccaccugaucagccuaucguucucugaugaauaguagcagaccccuggucacacaggugacccuaauuaaacucagugcaucacugaguacaaaaauguaaugugugaauaggauucuagggagucauagagguaauagugaaauaagagggagaaguuugacaggagucagaaauaggcuacauauauguaugaaauugucaaaagaacaaaaauaauaaaguaaugaauagaaauaugaguaaauacaauuuuuguuaagaaagaaaaaaauagacuuuauacacacccaaaaggggauuuauuagaguaaccuauagguguggcccagauaguccagcaauggcugucuccugacagaagggccaagaaccagacuggaugucccagcgguccuaauauuaugcuggaguccuagagaagucuuagaaagcuacugguguucaggauauguuggaauacagaagaaguagcaucaagagaugcccuaaaggaucugcuguacucaagacauggccuucagagcaauccaguuagccgcuggaagucuagaggggccaccccuccuaacacuguuguuguugugaugaugaugaugaugucuguugacucuaaagggcaccaggagcccaaaguuuucaggaagaaguuuaagcuuccaguucaauggaauguauguuaugccuugggcagaaaaguucuccccccuucuggaacacaagcuaguaggccagcagacuuaagguugugguaucagaaaguaaaaguuuuuccuguaggacuguaggggugauagugaguggaaccauuuccauuucuaucccuugaucccuggauuccugaauccuggcuagggagaaacugaaccauauauuagaugcugaagcacauacugcuuucuggagaacccugccccagucuuccaggguucugucaccgauauccauuguaacuaugucuuccaaaggcuauucacaccauucugucaaguuagcugcuucaggagguagggaacaugguaagaccagugaauuccgugagcauuagcccacuauuauauuuauuugccugugaagugaguuacuugguuagaagcaguucuguguggaauaucaugaugauggauaagacauucuguaaguucauggaugauaguuuuggcagaaggaaaagcaaaucuauaaccagaguaaguauucuaguaaggacuaagaguugcccuuucuauggaagaacugguccaguguugucagacugccacuaagucucuggcuggucaccugggagaauggugccauaucuggggcucagaauugggucucugcuccuggcaggucuggcacucagcagcugcuauaaccagaacagccuuggugacuggaaguccauguugucaagcccauguauaacguucuuuuuugccaacauggccacuuuguucaugggcccauuggacaguaacagagauggcuggggaaagaggcugacuguguacagaaugggucauccuuucuacuucauuauugaauaaccccucugcaaaagucaccuuuugaugaacauuuauaugggccacaaguaucuuuacaucauuuguccauuuggagagauuuguccccaucuucccuaguuaaccuuucucacuaacuuuccauucaugcuccuaagucccuaaccauccugccaaucuguuggcuucagcccaugaguucaaaaacagucacaucuggccauuucucauuccaagcagaauuuacaaccaugugaccugcccaaaguuugcuuuacaaugaagauuucucuucacuggcauuuuuuaugguuguucuguaaagagguuauaaugcagcagcuuuccacaccuggguggugccugcauagugugcagaaccaucaggaaaccuuggucuccaaacuuuucuuuucucagucaguugauucuaggaaacaccccaugagaucauagguacaugcuuguuaggaaaagacacuuuaacagaaguagaaaacaagcacuuggacaacuucuucauauaucuugcucaggaccuacuggagccugaucacaauauauucuacuuucauuugauaaugguuugcuguuauguucauccuacuucauggcuugguauuauggcugguaaaaccaaauacuacucagcucaugauagguagcucagauagcauaguaacuugguggcccauucaauagcaggcaaagagcugucucuuaaugggagaaugguugucugcagauggcaauagauccauguucuaaaaucccaagggucuccucucaccuagaggagccuaccaaaggcuauaaacugcuacugccaucuaaagaaccauuuuagcgggucuccuggaucacaugguccaagugguagagcagccugcacagcagccuggaccuguugacgagcuuucuuguucuagcuccccucaaagcuagaagcuuccuuccuuacuugaaauaacaaaacaaagugaggaguaugcuccucuggaauccaaauaggcccaccaagcuuugugcugcuuucuuggucgugggaaagaccagaugcaauaacuuacccuucaccuuagaaggaauauuucugcauaucaccacuggacuuguagaaauuuccuugaaguugaaggcccuugacuuuugucuggauuuauuuaccauccucccauguacauaaguguuaccaauauuuccaaagugguugcuccuuccugcucgcuugguucagucaacaugaugccaugaguauacuggaccagggugauauuuuguagagagagaugcucaagcucccuucauacuaaguuaugacacaggacuggagaguugauaaguacuaaccucgagguaaaacuguaaaaaggcauacuacugacuuccagcugaaagcaaauugcuucugguugugcuuauggacaggaauugauagaaagcauuugcuagauccauagcugaauaccauguaccaggagcugugcuaaucuauccaaguaagggcaucacaucuaguacagcagcugaaauuuagucacugcuugauuaaguuuuaauggucaguggucacucucuaugauccaucugacuccugugcuggagaguuaaagggagaugugagaacuaccaucccugcauguuucaaguccuugaugguagcauggaguauuauauuugguucacuauguucccagaggcaaugccagucucuucaauuugugauuuccaaccauaauagcuuucaguucacaggucaaggaaccaacgugggauuuugccaaugucuaaguauaucuauaccaauuauacauucuggaacuggagaaauaaccacaggaugaguuuggggacccaguagacucucugugauuuggguuucagucaaaauuccauuaaucaccugauaaucauaagccccgauuuaacuggagggccacagugcuauuugggggucucuuggaaccagugucaguuuaaaacgaguguccaguaaacccuggaaaaccugauuguuuccuuuuucccagaguacauuuacccuuguaaaaggucauaggaugggagaagggcuaacaguaaaacuuuuagguauuuuagcaagguccucagggggaccuagccuucucaucauucaaggacuuuggggucugcaaacuagcucaagucuggaaauugauugauaaguugagauaccccuuugcuacucugcaguauucuuuuuguuuguuugagaauuuuuuuuuuugcuuauauagauguaaaaacaaacaaaacaaaauaaaaacauauauuccuggaagcauuauuagccaguacaaaaagauccguaggagucaugccaucauaaaaguuacucugucugugcugcccuucaugauaaauauucucgccuugccuuuggcaaugcagugcugauaccuggcccugcuacucugggggccuaauuaagcccaucccauuuaacuuuuuggauugagcaucagugucuccaaccuuaaggucuggcacaaagagaagagcgggggcaaagcccuucaaauccuggugccccucuuaccauuuugugccucacaggauuagugaagagaaugucuucugggccuucccauuguggaggauucgguuuuauacagcacacccaucauugcaguuucucugaacccuaaaaucccuucaucaauacuaagucaagggacaucagguauccacaguucccuuucaguagaguauggcuagugcuuagccaaccagucacgcuuuugauaccuuuuuaacuguaagaacgucuguauugaacuuagaaccuuaacucagugggcccauaucaauaaauucagcuugauucaguuuuaugguuuuuuuuucaccauuauuucaugcccuuaaaaauccauucucauauauauugcccagacuacggcuugaaugaauucacaaacucaguaaacuuuaguauuguaccacaccuuuguugugaauuucacuuucuguuucgcuccuagaagccuucuuagccuugauacugauuauaguucagaggcaauuauugucgacagacacugagcggcaucaguauugccuugcuugauguuucucuuucagugaaagucacugaaauuuguagacaacaaaggauuaauuuccucaggccaagguacaaaaggaaauauugcaaggugugacaguggggccgcacccuacacuaagagugggcagacuacugccacaggugagacagacgcaucagaauuugaagggucaaaguccucagcaccuguccccuacacuucuccaucucaaguuacaggaucccaccccuuaccagccagugccuuuaggcuccuauuuaccuuagcaacaggagaagugcacuugacuagggggagugcaggcaggcaggcaaaagugaaaaguuucuccuuccauguuccuucacaggugugauuccagauauagucaaguugacaaacaagauuagccaucauauuaccuaaguuucugacaaagcuaucaaaaacaugcauuggagaaaaggugcccucuuuaacaaguggugcugggaaaacuggaucuuucucucuuucuuucuuucuuucuuucuuucuuucuuucuuucuuucuuucuuucugauuuauuuuauuuauaugaguacacuguaacugucuucagacacaccagaagagggcaucaaaucccauuacagaugguugugagccaccaugugguugcugggauuugaacucaggaccucuggaagagcaguuggugcucuuuaaccucugagccaccucuccagcuugaaaacuggauuucuauacauauugugcaacaauaaauucagugucuuaguuagggcuuuauugcugugaacagaaaccaugaccaaugcaagucuuauaaaggacaacauuuaauuguggguggcuuacagguucaggggucagucuauuaucaucaggggagaagcauggcaguaaccaggcaggcaugauacaggcagagcugagaguucugcaucuucaucugaaggcugcuagcagaguauucauuuccaggcagcuaggaugaggguuguaaagcccacgcucacagugacacaccuacuccaacaagaccacuuccugggccaagcauauucaaaccaugacauucaguauaucaaaacucuaaugaaagaagaagacagguaaaaauauuugaagacauaggcauagacaagaauuuucugaaaaggacuauagcacaggaaacaauaccaagacguggcagagagaguuacaugagauuagaaaucgcuaccaagcaaaggacacagucacuagaguaaagagaccauuuacaggcuugggaaaagaaauuuccaggcuuacaucuggcuggggacugguaucuaugauauauaaauaacugcuaaaauuaaacucuaaaaucauuuuagagucuguagauaggcucaugagcugaauagagucccuaauaggagaaauacaaugaccaguagauacuuggaaaaaguuuucaacauucauagacaucagggaaauggaaauuaaaaccucuuucagauucugucucacuucaguugggacguugucaagaaaacaaaagacaacagaggggaaaauguggguggggcuagugggauccugaguagcuacuuuuuauuuuucuguuuuuuucuguuuuuuuuuuuuuucuuuuuuuuguuuuucgagacaggguuucucucuguagcccuggcuguccuggaacucacucuguagaccaggcuggccucaaacucagaaaucugccugccucugccucccaaguguugggauaaaaggugugcgccaccacugccuggcagugaaacuccacuaugacaguuugaaggguuccucagaaaaacugauaacagaccaugugacccagauauacuacuauauuguauagccacagaaauucuuguacauccauuuuuacugccacacaauucacgguggcuuaggaaauaaaccagccugaauguccaucaugagaagaauggaagccggacagugguggcacacccugucucaaaaaaccaaaaaaagaaaaaagaaaaaagagaauaauggauacagaauauuugguacagugaguggugguggcugcaacaguaggcauuugugugguggaguggaggaaaacuggaaaggcuaguggaauggccaaggcuaaguuaauuucuugcucauagagagcuggcuauguaguuuccugugggccaaaucaacgaacacuugaagaugcacaucaugggccauggguaugugggugccacugcugcuuuguacagggcaccuuacugccaagacauuggaguuggcacguaaugcuuucaaaggucucacaaggaagccuaucaguugguaucacuugcagcucacagucuguggugaggaagauggauucaccaauuaaggcuaccacuguugggcauagugugauucuuuacagccacagaugucagauugcaaaauaaaguucagcagaaagcugcccaggaggguuauuuuaaccaaccuacuucccaguguucuguaacuggagcagaagauaacggugagcagauguggaaguuuguuuguuuguuuauuuauugcuuaugaauauacuuuagcugucuucagacacaccagaagagggcagcagaucccauuacagaugguugugagccaccauguaguugcuggaaauugaauucaggaagucuggaagaacagucagugcucuuaaccacuaagcuaucucuccagucuggaauuuuaaaaaauaguuaaauggaaaaguauagacaauuacuauagccaugauaaaacaaaacaaaacaaaacaaaacaaaacaaaacauuuguauguucuuggagcagaguuugguaaagugccuuuuuaugugguagcaguucuguguugauuggccagacuucuacuucguguuuuuuauuaaaaaauauuuuuauaaaauaaaaaacuaaaaugcuauauuaugauaauggaauuuuauacagcugaaaagaaaaaugccaucaugacaauuuccagaaaauggauucaaccggaauuuauuauguuaaguuaaauaagcuugguucagacaaacaagucaugcuuuguuuucuguagggaacuugaauuuaaagguguguuuaugugcauaugcgcacucguguacacacacacacacacacacacacacacuacagauagaucaugaaacggaaaagaucuuaaguaaaggggaaacagaggguauggaauaugugcaauauggaagcagaagguuggacugccugguuaggaagaaagggagccagcuaggaggaggcagguaaaaccggguagguuagggauaacaauggagagcaacauagaaugacacauguuuaugaaaugucacgauacccaauucuuugcaugguaacuuaaaaauuaaaagaauucaaagauaaaguguaaucuaaguauucagauuaucaaaauuaaagcuguccuacuagacagugauggcaagcauguggcagaucgucaguauacagcucaguggacaacuuuucugaaaagcagcucuguagauuucaaaauccucagaaaguauuuguuccuugcugacacaguugcuuacguugaagaaaaagaugguggauaaaacuuuacuuaaguauaaguauuuaucaguacuacucaaaauacugaaaugcuagagauuuguuaaauguaugacugaaaaacauuuaaauaaccagugucuguuuuuuuuuuaagguuuuguuaugugugcauaugcauguagugcccucagacagcagaagaggguguuggauccucugaagcugagguuauagaugguugugaacaggugcugggaacugaacucagguccugugaacagcagccagugcucuugaccacugaaccaccucuccagcccauauagguuuuuguuuuuguuguuguuugugggacaaggccucucuauguagcucuggcuguccuguaacuuucucugcagaccaggucuuuccuugaacucacagggauccugcuucuacaucuacaagguguugccaucaugacugacuucugugucauuauuuaauagacuuaaaaauaagauguauauuguuaucguaugugugagggugcuuuggcugcgugugucuguguggcgugugagugccugguguccgaagaggacagaagagggcgccugaugcugagcucccuucugggugauggguaucaaaccuaggcccugugguagagugucuaguguucuuaaccaccaagccauuucucaguccccauguuuauaguuuuuguuuguuuuguuaaucaauuuaaaaauagagcaaagggaaaacuugauguucaagacauguuugcuuuucauuuacuucugucucuaucaauguagcucauggguuuggggguuuauauuuauuuuuauuauuaaauugcuuauuaauaauacuggaagcaaaacaguuuauaaaauuauuuuauaguaguucugaauuuuauuuguuaaauaauugagaguuaauaaagcauuuuuuucccuccagaaacagcauuuaaauuuaaagcccugaagaagguugcacaguuggcaguuauaaauagccuagaaaagguaagcuucaaccucuuggguaugcaaguuuugauuuugauuaugaccuuggcuguauucgguaucuugaguauaagaaagucaagacuugugugguacuuccucuuaaugggaagaaugcaacacgauauuugugugaagaaacuuaaauucuguguuauuuaauauauuggaaaauugacugcuuuccuauaaaaacauguauuuuuguuacuuguaggcuuuuuggaacuggguagaaaauuauccggaugaauuuacaaagcuauaccaaauuccacagacagauauggcugguaagcuggcuaaagagugacuggguguggggugaggggcggcauggcaccuugugaaacucucagagggaaaugugcugcuuuucaguuuauuuuuuucaaaaguguuuuuucuguuuucuuuguucagcucuaacaggaauuacaguuuucucuccuguuucuguauuauuuccaguccuuucccuucugagcaagugguaaaagaaguuugaagugaagcucuagucuuucauguugugauugaauacugguggcuuucucacagcgugcaugugugugcuugugaguguguguuuccuagaauucuauauuuagguauaucuaaggaggaaauacuauuuuuacuucugaauagcaauuuugggggaacgccugcauaguagaggcuagagacccccgggaaacuaucagccuuuuguuucucugugagacccugagacugugacaacacacagcgauucuaaaauaccaaugcuucuaggaugugucacauuagcucuucuuacacuucucuuagacugugauaguugaguguuuuaauaauucuagguuuuaauuuaaugcaaggauuuucuugccuaauauaaucauuuaauguuuguauuuuucacagaaugugcagagaagcuguuugacuugguggaugguuuugcagaaagcaccaaacguaaagcagcaguguggccccuacaaaucauucuccuuaucuuguguccagaaauaauccaggacaucuccaaggaugugguggacgagagcaacauaaacaaggucaggagggaaacgaguggcugccaucuccugaugggagcagcuuguuuauucaagguguacauuuuaguuauguccaugcuaggucaaacaguugguugcccuuagcagagauuacucauguuauagucaugacugaaaggcucugaccucucuugguuuuaaugcugaauaauaguaaaccagauaaauucuguuauuuaagcuuguauucaccauuaaaauacauuuagacauauauaauuuaccuuuauguuuaugaauuaaauuuggcuggcuauuugcaaauaaauuguauagcuaacaaugcauuuucuaaggcuucagcacaaugacuugaggaaauguauauugacuauguuuuuucauuaugaaacauaacuguccuaacaauuuaauuucugcaaaacuaagaauaaaaauuggaaauuuucaucuuuuucuaugggcugaaauaaccuaguuagauaaaaaucaguuaaaaucaucaggucuuggugauucuaaauuuuccuuauuaucauuaguuuaaaaaagcagagauuuucaagaugguuauuaauugguuaagaguacucucugcucuuccagaggaccugaguucacuuuauucuuauuuauugauguacaauuuuuauauaaucauguuacagcccuaccuggcuuucagagucuuuaaugucaccacauuuaguuuugguuuugguaauuucagucugcaugcaugcauaacacuugguugguuggucuguagguuggcuggcugcucuguguguaugugugcgugcgugauggguagcagguuccagacucauggcacacauaaagcaagcagacacacaagcaugcacagaaacuaaaaugaaucuuuuaacaagaucgacuuuuuugcuuuuuuauuacuuauuuuucaguaaaaaaaugugugugugcucuguguguauguuuguguuccaacagaggcauaagauccuuuagagcuggaguuacaagcaguucugagcacucagugugcgugcuauaaacugaauucuuguucucugaaagaguagcaaguggucuuaacuacccaaaaccauugcuucuggguaguuaauuuuuaauaguuuuauuucuugcuggugcugcuuuuuaaaauuaaaacauacaaggacaaaggccuggcacacuuagagauucuuugcacaucuaguugguccggucugucuuccuccuuugauuggucaggucugauuuccuagugaucuucauaaggucucuauaaccauuugacccaguccugaacuguucaggacauaucacaaaagcagugcacaggugacuggacaacgucacugggcgucaucaucauccucaguaucauuuuaauucugcauggacugccuuuuuauuagcugucaagucuguuagauacuggugcugcuuccaucuucgucuaggucuauguagggcccugagcuccuaaggaacaucuuguuucagcuggcuuuaauuauggcuuguggcaaagcugcauuuaaauuuuuuuuuuuuuauuucuagaaaugaaauuuagauaacagaauacccuuggguauauuguuuagaagacuggagguuucuauacucuagaguaguagaaaaaaagucuaccacaaccaauacaggcuaaugauuaagcuucaaagguaacaucgaaaggaaagauauagucaacuaauacuuaguucaaauguauaguaaggaauguuuccuuucucuauaguaagucaacagagaaaguagagaaaaguguuucaugcauuuuuaaaaaagugcuuacucuuuaaauaugaaaugauagccaaauacaagccauuuguguuuauaguuggaguuuuagaguuggcuaauuugcuacuuuguuagauuuaucuguaguaguacaaacuagguguuuugucuuccuguauuuccauucuguagaagcuguuucuggacaguuuacggaaagcacucgcuggccauggaggaagcaggcagcugacugagagugcugccauugcuugugucaaguuguguaaagcaaguacuuacaucaacugggaagauaauucugucauuuuccuacugguucaguccaugguaguugaucuuaagguaauaugcuguucuuucccuucuauagacuuuaagaaaauuaaguggauaaccuucuuguauaaauauucugcugaagauaauugcuaacucuaaauuuugaguuaacuuagauguuguguucagaggaccugcuuuuguuguuacugugcucauuagacugagaacaggaagacugauaugcacuggguuuccuuaauguauagauagaugcuuggaucguagaugauaucgauagacuauaguaaccaguauuuagugcuuuuuccggcgacuaaaguuuauuauaaucaaugugacuaauguugauuauguuuauauuccuuguuaaguaaauacuucaugacuauuuaaaggccauuguuuucuauugggauuuuuauagaaccugcuuuuuaauccaaguaaaccauucucuagaggcagucagccugcagauguggaccucaugauugacugucuugucucuugcuuucggauaagcccucacaacaaccaacacuuuaaggucagaucguuguuuuauauaaccaugcauauuauauauauguauuauauaacauaauauugaugugguuaucucuauaaaaugcagaaacuauaaagaugaauagguguacuuucauuaguguuucuuuuuuuuaaaagauuuauuuuuauuucaugcaucuggauguuuuagcugcauuuauaucugugcaccauguauguguaugggggugacggaggccagaagauggcauuguguccccuggaacuguaguucuagacaauugugaacugcugugugugagugcugggaacugaaccuagaucguuuuaaagagcagucauuggucuuaaacucugagauaucuuucuagccucuuacuaauauuucuuaacucuaauucuugauguuaauuucaacaccuuaaauuuauuuuauugaaaguaacuuacuuuuugcuguuuuuuucucucuguuuguuaauguacuuuuuuuuuuuuuuuuuuuuuuuuuuuuuuuggcagaucugccuggcucagaauucaccuucuacauuucacuauguguugguaaacucacugcaccgcaucaucaccaauguaagucuaaagcuaguacuguacuacuaacaaguaaaguaaaagcuaguacuguacuacuaacaaguaaaggucucuuuguugauuuggguuauauguucuuuucuuuuuaaggaagauucugguuuuaucaacuguucugaacuuagaccuuucuguaaagcagagcuucccuaagaugaucccacgagcaguugauguccagcugcagcuguauauucagucucuaccugaggcuuuuagugagagggauggaguuaauagaaucuuuuguaaggaauaagccuacaaagugucauuuaaaguucaaaaucuguugagaacaaugccacugaaaaacaauuuagugcuuucuuucuuacuaucuuuguuaaguuggaaggaagaguaauuguaguacagccuagcuaugggcauuuaaaauggugaagcuucauuugauuuuaccuuuucauccccuuaauuagaauaaaacacaugcuuuaaaauaaauaccacaagagacaaaagcauuucagagaaaauagcugacuucauuagagguauuugugcuguguguguacuaaauggaaagcagacaggaagguaguaguagauguggacugcagaauuuaaaaucuccauguauggacauucuuagucauguauguuuuucuuaguacuacuuuuacacauuggcagauaugauacacuuaugaguaacuuguucacuuuguuucuuuuuuuccucccuuaaagucuuugaugacuaauacuuuggaguauuugucuuacuucuaaauucuguuaugacuugugaauuaaaauaauacccauuccuuuauuugccuuggaauuaucaaauuaaaccuaacauuacucuuuuuuaaagguauuuuugcaggggaaaauaacugcugaucaagcuacuuagugacauacucauuuugcuugguggagugcuaguagcauuuuaggauguugggucucuguuuuagccuggccuugcaggacauccaucauucaugaaacggcaaccacgcucuaucuccugcauuaugaacaacuaaaugcuuaggaauaauacagcccucauuugaauaucacugauagagguauaaguuacacuuaauccaguuaguuccaaugaggauaguauugugaaucuaaguguagauagaauauguuuauaucaaaaccuguacauuugccaguguaaugacucaggccaucgucucauugacucagcacauugacucauucuaagcuuuaguuuuaaauuuaaaaaacaacaaaaaagaugauuuuccuaucccauaaguuuauauguaauuccaaaauacuaguugccuaccuugauucaaaauauugaaaguauuccacuuaauuagauaacuuuauaugaaugguuaacauuuaauaaauccaaguuuauagucuuuggauauucugugauuaguuacuuuaauugugaaauauuuuugucuauaauugaauacauagagcacuuucaagcauggacuuggcacugcuguaaguggcugagcugcuucuuucuggguuucaagcaugccuggaguguuaguuccugcaugccuccguccgucugugugccuggugaaagcguguucuccccuuucugaggagugcugcauguaugaaggcagagugugucugcauccggggacauuuguauauaaagcacccauacugacuagucuuuaaauacaucaacaucuguugaguggaauagcuuguaaacaacucagauaaugccaaugugacuuuuuguuuguuuguuucuugagacaaggucucaccauguaguuuuagacggucugaaacuauguagaccaggcaggccuuaaacucagagagcuccaucugccuccugaguggugggguuaaaggacugagcuacuguacccagcuuccaaagugacuuucaguuauacuuuaguuauaccucauccuuagagauugcugaguaaauuguguuuuauuagaguccacacuaccaagacuugaggccaaaaaauacugacuuuaaaguacuuuuaauuguuaaagacuguaacaguaaauaugcagauuuauacaguugaguuuuauagaguuuuacuggaaacuuuuaguaggaaaauguuuguuuucaaguaauaugaauucuuuccuagauucauggagucuagaucuuuaauuuguugguauauauuuucuuuuuaaaugcuuugguucaguauaccuccucagcgcaccuuuuccaugucuacuaagccaguuuacagcuuuaaaaaauuauuauguucuccuaaaagauaaaaguuguaaucuuuuuguggguuuauauagaaugagaaauuauguuuggaguuuuauauugcuucugugagauguccucauacacaauuuauaaguacuauguuuaaaucuaaaacauuccaauuucuuuuagagauucuuaaagucuauucacuauuugaauuuugaugcagugguaauuuuuuuuuuaguaguuucuaaagugguauuuauacugucacuuuuugaaaaugaugugcacuaagagagaaacuauaguuuuaagaucuauauuacaucuguaucaucuuuauaggcuuuuuaaagguuaaauuagaugugcagcuaggaaauuuuaaaaauauacauguaagucaacaugcuacagauaggacaguaguucauugcagauuuuuuucuuguagcaguuuauuguaguuugccuuuuaauaguucauauauugaagguaaucucuggcaagagaugguuaaagaaguauuucuaggguacuugaaaauuauuuaaauaaccuugaggaauguacauaauucacuuauauuagucuuaauauuuuuaauaaacuauuguuaaggggaaaugucuauuucauugacuaguuucagaaugcacacacuuaguaacugacuaaaacacuaaaguuuuauuaacucagggaugucuaaucuuuagugccuauuuuauuugagaauauagccuuuacuuugaaauaaaugaauuaauuccuuaugaaaauagaaaauuauaaaaaauuuuaaaucuuaagucuaaaaguuaauauauaguugucuuaguuaggguuucuauuccugcacaaacaucaugaccaagaagcaaguuggggaggaaaggguuuauucagcuuacacuuccauacugcuguucaucacuaaaggaagucaggacuggaacucaagcaggucaggaagcaggagcugaugcagagaccauggagggauguuacuuauuggcuugcuuccccuggcuugcucagccugcucucuuauagaaccuaagacugccagcccagagauggucccaccuacaaggggaccuucccccuugaucacuaauugagaaaaugccuuacaguuggaucucauggagacacuuacuuccccaacugaaccuccuuucucugugauaaccucagccugugucaaguugacacauaaaacuagccaguacaauagugcauacauauuacugugguacaguuuugcaguuaucaaaaaugauuacauaguaaggugguugugguggcuuaugcuuguaguucuagcauuuaagaggcugaggcaggagaaucacagguucuagaccaguuuggacaacauagugaauuccagcaagaacaugugucaaaaaccaaacagauguaaacuaaaccaaaacugaaaauagcaaccccccacucccaguaguuugauaagauauuaaaggagaugcuugucuauuuaguuuauugauuucugccaagauuuuaugcaguguauaggaagaagucaggacucaguguacucuuuuuuuuuaaaucauugagcauuuuguuacuuucaggugauuaacaaaacauagaaaucugguuacacugaucacugauggccuugggcagaucagugccucaaaucugagagauguguuauauuuugugaugguuaguguugucaauaaagucugaagaugagccuuugagcauauccaugaagauugauaucaugauuacguuaauugagauaggaaggccccugaccacugugugguaccauucccugggcagugagcagagaaagcucuuuguuccugcuuauggauuugaugugaccagcucucuccagcucuugccacuuuaacuuccuugccacuagaaccuggaauugugagcuaaauaaauucuuucucccugaaguugcuuuugucagaguaucuaauuacaacaacaugaaaagaaacggagacaguaaacaccaccaguguguaggaauuggcuaaaucaaauaacugagagacagcauaaccacaauaguuuaacauuuauauuucuuaaauuaaugaauuuuuaaugugcaugguuguuuagccuacuauaugucaguaggggcuagaagaggguguuggauccucuggagcaggagcugcagauagaugcgaacugccauguaggugcuaggaauugaaucaggguccucuguaagaguagccagugccccuaacugcugagcuacuucucuagccucuaucuuacuuauuuuuuaagaugaagucuuucugugaagcccaggauaucauugaaguuccucaugccuuaaccucccuugugucaggauuaaagguguacacuacugugcuugccuuaguuuuucuguaaagagaguuuguaacucaaaauacugugagcugugagaaacuuaaauguuaagacuagcuugauuuuuuuuuuaaaugaagaauaaacuauaaguaggaugaagcuguuaagucacauguauuuacuauaugacuguguuauuuaauaucagauuuuuaauuaaaguauuacaaauugaaaauuuauauuuagagcauauuguuuucauguauagccuauauaaguagugaaaguuuauccagucacuuuucuauaaacugauaaacuuuaaugcuuuuucacaauuauuauuuuucaagcauuuaaaauugaaauauauuaauuaaauuuaaagcaaaagucauuuaaggauacacuuaaacagauuuuauaaaucagcuagauuggcuaaauggaaauaggaaaauaucuauauagaauaauuauuuuauaaacccuuagcuaggucuggggauguagcucagugguagagcacuugcuuaacauacacacaucccaggguccugacuuuaaugucuagcuuuguaaaaacaaagauacuuagcuaggaucagcugucuuuguuuugggugaccauuuagucuuccauguguugugccaucugcuuaucaauguaaaagauuauugauauacuaauggcuuuauuccauuuacuaauuucauguuaauuguuguuuguaagcacuugacuaaugguuuuacauagucuuucaacauuguguugaaccacuaaucucauggaaaacugugaugauagcauucuuaccuggugaaaaauauauaauguaugcauguguuucugaaauuuguuaauacuaaacuuuuuuaaaagauaaaaauugguugaagaauuuuacaaauaguuuuuaaauuuaauauggcauuguugagaaaggacaaccucauuugcacacucaguauucuauuuuaacaugugugucugguuaguguuugacuuaaagauaucauuugaagacuuugaaaaucauauuguauguuugcauggucuuagaaaguuuuucagaaaaguauaaaaguguuuaaaaaaaaaagaagguauacagcaguaaaagaauguguacagcccgugugauuuuuguacucugaucucucguuuuuucuucagucugcguuggauugguggccuaagauugaugcuguauauugucacucaguugaacuucgcaauauguuuggugaaacacuucauaaagcagugcaaggcuguggagcgcacccagcaauacgaauggcaccaguaagaaacuaugagcuuugaauuccaccuguguacugcauuuccagucuucucauuccugcugauggaguuaacggguugacuggguccuuccuucucuaggaaugcuguauugccaugccauugcugcccaguuaacaguaguuauuuuucacuaaacuuuauuuuccuaaaguuuucuagaaaaugcuaacaucuuaaugaaugucaucuuucuuguguuuuugguuuaacuuuuucuuacucaguuguuuuaauuuguuucuuacuuucagaccuuggguuagagugaguguccugaugcugaaugguauacggaaaauuagaaaccgaguaaaacagcuauuauuuaaaggauuuauguuuuaguaaauaugaucauuuagcaaaaauugauaggaacuugacauugauguuuauugaaacuuaacaaaggcuuacuuugaaauuguguuccaagagcuuaguuaauaaagacuauaaauccauagagaguggguuuucauagcuaaugauaagauugugcccaugguuuccuuacucauguguaggaagagcauuuacauggcgacucuugauguugacugguggugcuuugucuucugcuuacuuuccgaucuuauuggcuguuguugcucacguggucaggugcuagccagucacugugucacagugggcuucuguggcuggaaguacauaugauccauuguaacuaccucagaaaaguccuugauuucuuugacuuuuuugaauauaguuaccauuauagucacaucaugucauuucaaaugaaaauguaucaugucuucaccuguugguuuuaucuaauaaacuaugcaucuuacacgaaugguuaagcagguggcucuccagcaugcuuaucuuuccaagaugcuaaggacacagcacuuuccuuuauacaguuaggcucaguccugcccagcugucagaagcaguuucuaaggauuuaaaaaauaugccagguguucaaaugaggaaguuuucuauacaagguaccauuguauuuuuauccuaaaauauuuauuuuugugcuaaaaauaauagcugaaagggcaugucauugauuuuuuuuuuccuucagugcugaagaucaauaccagguuucccauaaacgccuaacauauacuauacuacacccccugccucaaugguauuuuauuaaauaaaauuuaauauucaagcuuacuuagcuuacuuuuugugaugguauguauacaauaccuuuaauguaaaaaaauuguuacaguauauauguuagugguaacauauagaguagcuauguaaauauuucuuaacuagacauuuucuuuaaauuguaguaauuccuugaaucuacccccaccuuguguuuugcacuaggagggcaugcuaacugucaaacccaggagggcuuuccucuguccagcuguaccacucacugaucugugucuccagccucagcuugcugugugcugggccauagcucaguguaaagugcuuucuuaccucuuauacugauaggaagauaauuggaauugguggaaaaccauauuugcuuccuguuuuauauucaacccaacaccucugccacuuaauuuuuaugcacgagugcugaaaugaaaugaaccucauuuauucuuuugaacggccacagauuugguugguagccugacagaugauaaucuauacuuuuaauuucuuagauuugguuguuaguuaacacuuggaggacuuacauuaugcuauggucacuguuuucuuaaagcuguagcuaguaaggauuucuuguggcucaaugacaugauaaacauuuguuuuauuuauauuuuuauuuauuauuuuugguaguaucaguauacauuuaguuuucagagucacuuuuaagcuuuuuuuuuuuuucuuugagauacaggcuauguagcuuuggcugaccuugaacucacugucuuccugcuucuaccucaguggucuaaaagauucauuuuuuuuuuauuauuuuuaauuauaugaguauaugugucggugugugcacaugaaaggccagaggcauuagauguccccuggagcuggagucacaggugauugugagccaucugauaggaguuccuucugguaaagcagaguacacucuuaaccacugagccacuucucuagaccuuuaaagucuguauauuuguauguauaguauugugaauguauguguaauggcuguaggaaaacuuucuuucuguuaguguuuccauuagagaaaauggcaaauuaauguaacccaguuguauaaaaacaggaaguuuuagaguuugggaaaucuuuaagguaaacacuauucuuuguuaaugugugaauagaccacagauaugccugguguuaaugcuaggaucauggguugugccuuguuuacauugccugaaaucauuuugguagcucuuaggaauugagcuaugccuuugcuuugcuguagacauagcaaugcagaaguucuagcugagcauaaugggcaugccuuuaaucuaaggucuuggguggcauaaacaggcaagucaggacuauacaagauugguugauugauuauuuaauauguauuuauauuuuuugagacaagguuucucuuuguagcccugguugccuggaacuuacucuguaaacgaggcuggccuugaacuuaagagaucugccugccugugccuccagagugcuaggauuaaaggcgugcaccaccauuaccugccucauaguaaaaucauguuucaaaaauguucugucuaugaaaagguaaacuauuauguguuucaauauaguauugauuuucuaauaaauaaaucucaagugugggguugcuucccgccucagugguuuauguuccugagugaaagacacccacacagccucuauauuuuaauacacuuuaaacagcacaauagcugagcgacugccuaaucucugugauguuagauuguaccucccgccgauaauuccaaguuacuacucacuaauuucugaguuccaucuuggccacauuaguucaguuagucaacccucugggccacauuuucuuggcccagagccugggguguucuccuugcuucucuauuccaugguggccucugugucucuccucucuccauacucuccugaagcauggcggaugccuuucuuccucuuccuuguggucccaagucugggaaaccuaaaacccuaucuuuuucuucucccucacuauugacugcucauaucuuuauuucccaaucagaauuagcuggggccagguucccugaugcuacauguagacccucuucuguagacuguuuuggaggacccaaugaguauuugaauacaggcagcuauauuucaaagcuugacaacugcugauauuuuggggauaaguuacuugguagaaaguaguaguuauuugaggacuggagagguagauggcucaacaguuaggaguacuuguugcucuuagagaagaucugaguuugauucccagcucccacaagguggcucaggaaaauccuuauauuuaguucuaggggaagaugauacccauauaagcaaacaaaccgcacacaugcaaaaacaaauuuaaagcuuaaaaaacuaacuacuuggauuuuuuuuuucaauaagaugaaaauauguuguaguugaagccaucccaguuccuuucugacucuucuacagaguacccuugaagauguuuugaaugaaguuaaaacccaguuuccuaagaguuguuauuauauauagcuuguguuggauuggauuuuauuguuuuaacucuuugaaaguuuguuugauuuguuuugauaacuaagcaaacuaagaccaaaugugguuacaggaauuagaaugucgcauggcccagcagaguuaggucugaaguuguuuugacgccugccuagugucugcucagcuccucaguugcccuccuucacuagcagguuagcuggguggaugaugacacuuucacugcuucaacacagacucauaagcucccagagcagcgccaggcaccgugggcaugcugguaugcugugugccaggcaccgugggcaugcugguaugcugugugcauuugugagugauuuuuguggaugaauuuauuugauugaacuaaaaauuugucuauuuggguuauuuaucuuucacaaaaccaguuuaauaaauuuuuuccauuaauauggcccuuuaaagaacugccuucauaauguuugucugguaccauuucuagguuuuggucuaaagcugcuuuugaucauuggaacuagcugcuuucauaugaugauuauacccauguuuuuuucuuucuuuuucuuuuucuuuuuuggcacuuuaguaguaauuuuaacuuuuugaaauuuuugucugagaguaauaauuuauauuuuaaaacuagaaauaugcuuuaauuaaaaugugaaguuuuaaauuuuggucuuagaugauaucuuggcauagauguugcuuaccaugccguaaagucagcccuaaaguuucaaguuggcagaugguuuugguuccuaauaaauaacuuaggaauuucuugucugacauagcugacugucuuuaaucagagcauaugugucaguuuagauccuacuaauuuuuguaguacagaagauaaauuaguaaaugaagucuuuuuuuuucuacuuaauaaacaguuuguuaagcagcugauuguuccugacuuuauauaacccacuaauggccauuagauugaaagagguaauuggacuuucucaaguuuagauuuccuacuagucaauuauacuauagagcaaaauuuacauguuaguaccugacauuaaaccaaaaauuacuuaaaaaacaauuacugaaucagauguauuauguauugcugguuguccucugacuguguacuuccugugcagugccaugucacucuccgucacaucauagugaguuuguucaguaaaaggcuucaccuugauuuccuauuagaccuugaaacauacacaugcaugcacaugcaagcacacacacauaucuauagagcaaacauuccacagaacuuauuaaauacaucugacaaacauuuccuuuaguguuggagaguuuggauauuucauuucuuaaaugcuuaaaacuugagcacuguguguguugggugauauagauauagucaucuucaguuguuaaaagaaaauagccugucuacagagacauuugcuaugguugaauaaaggcuucauagucugccaucccuguaucuuucuauguacucacuguaggcauccaggucaaaaguagauugugugugugugugugugugugucugugugugucuguguguguuaguuaaaggaaauagacuggagagggauagagcgacagugaaucaagaaugcaauuguuagauuuuuuuuuaaaucgacuaacauucggaauuauguugaucuauacuaucucuguaauugaacuacauuuucaccagaguucuguuuuaugaauauucuuaggcaaaaagacaaaugcaugcauucuauuaacuuaaagaggaaaugccgucaaaauaaaagagcaaguuccuaacuaaagccaugacugcagaguugccuacagagacuguuucagcagcucuaaagaacauaccuuuacuucuaucugaaaguggauguuuauuuuccuuugugugauaucgaggauucacaauaguuuuucauuucuuugugugauaucgaggauucacaauaguuuuucauuucuuuuaguccagccaagugaugcaucuuacaguguauaguguauuuguguaugugcaugugauauauccagagauccaucccauaauuagccuccaaacgaugacaccauugcauacacuagcaagauuuugcugaaaggacccugauauagcugucucuugugagacuaggccggggccuagcaaacacauaaguagaugcucacagucagcuauuggauggagcacagggcccccaauggaggagcuagagaaaguauccaaggagcuaaagagaucugcaacccuguaggugcaacaacacuaugaacuaaccaguaccccagagcucuugucucuagcugcauaugcaucaaaagauggccuagucggccaucacuggaaagagaggcccauuggacacgcaaacuuuauaugcuccaguacaggggaaugccagggccaaaaaaugggaauggguggguagggaagugggggggaggguaugggagacuuuugggauagcauucuaaauguaacugaggaaaauacguaauaauaauaaauauuuaaaaaaaaaagaacauaccuuuacuucuaucugaaaguggauguuuauuuuccuuugugugauaucgaggauucacaauaguuuuucauuucuuuuaguccagccaagugaugcaucuuacaguguauaguguauuuguguaugugcaugugauauaaguauuugcuaauuugaauucucuaguauguauauucaugugugauauagauacauuauuuuuccucuuacuauuuucauauuugagaaccaguuuuugaacccaagagucaacuugauauuaugccucuaguguuuuagauuauuauuauuauuauuauauauuacuagauuguuauauaagaaugauauaaaugcuauaaaacauuuuuaaaaaaugcaauauuaaauguaugcuuguuagcuuauguuucuaccaguaucauacauuuggugguaugaaauguuuuuuuucaaagcauuuuaaauaauuucuuuuauaaaguauagcuauuauucugaaucugaugucugauuguuucuaaggugaugccauguuuuugauuuguuauuagagucucaccuuuaaagaaaagguaacaagccuuaaauuuaaagaaaagccuacagaccuagagacaaggagcuacaaaugucuucuuuuguccauggugaaacugauucaugcagacccaaagcuuuugcuuuguguaaguauuuuuaaugaaaugcuuugaaauuauuccacuaaucuauuugaacugaaaggccaaaauacauuuaaauuaugaguaaccucuaaaacauugcuaagaaagccaauuccaggaauucuaauauacuuagaucacauuuucuaaccguucccuccgcauugaacuguccauaguagcaucauuugcccuuguucugcauuauaaucagaccuauuucuggggucaggugggacaaaugacuguaaaaucggugugcucagcaucugaacugcucacucuuuuugcuauugcuaagcgaguuaacuucuauagcuagcucccuguguguuccuuugaucagccuucuauuaucauuggcucugccuguaaccauauuagaagagaaaguuaaaaugagagugguuaguauccaguuauugccauagcucugcuuuuuauucccgcaaaugguauuauauuccugagagcuucacuuuggugcacagaguaauaaagaacugauguaaauaguguaaccaggugagaguaaaggauuaaaagcacaggcucuggggaaggacugcuuuacuuagucucggcaccuuaggcuucucaucugaaaagguaggcaguaauauaguuccuaccucagagagaccauuaagagugaaauagauuguguaaggcuuuuaggaacaauucguaguguauaguaagcaauaaaauuaguuacugcuauuuuuaguaagauacaguuagcguuagcauucuuacuguccaaguaaaacaguuugaauuguucacaggauggucuguuuaacuuuuaucaagucucuauaguccuagacuguuggggucggccugcugcucucaugucuggguucgagccugggaggcagccuggaacugaaaaagaagagggaaacuagguggacaagagagagauauggaaccaagacaguauucugaucaaggcucaaauuuuuaauggcagacacgcuuuauaaaggaggggggaagcccauuccugccaaaucauccuuggagccgagcugcaggugaccacguguaggcggacucccagcagguagcagcagaggcaguggcugaacagcagagugauccagggaggcaggcuccacccuaggugaucuccuuaguggcauagcaaagucaaggucuggcucagcuugcuucaggcuugggggaggcuacacuaggccuaucaagucucuagaccaucagguaaagccuucugcuuuacucagugucaggcucauccuuuggugcuuuaugguuuugcagcuaugcucuucaaauuacuaaaaugaaggcauucaugacuaaguggcugugguuucaagaauucuaugaaccccacguuuugagugugugugcacacacguguuuuuguuugauuuuugagacaaaaucuugcuguguauacuagguuggcauugaauuuauuauguaugacauacugaccucagauuuguuggguaucccaggcuggccuugaacuagauguugcugagugcuggaauuacagaaauguacugucaugccuccacucuagaauuuuaaaaaauauuuacauaugaauaguuuuucugauaaugagagauaauagagccagaguggaugaaguuccuaaaguauggguuaccccaaaagaagaccuauuaucuuuuuguguuuuuugaaaaguccacccaaauuugagaguuuaauagaauaaacaguuaaaucuuuaguuuggaaaaguuuuaaaaauuuuguuaguggacucugaaaauuaacuuuguucuuuugguuucucggguguguggcaugaacuguggugacaucucacugugcuugcuacaggaugcuaggguuacucuguuuacuuggcugcaguuuuauguucaccagugaaccagggucaccagugauuuucauguuaaauagguuauuguuugaagaacaaggguugaauuguuugagggaaaauaguuuuuaaguaaaauuugcugucuuccaagaguuauggaauccuuuuuacuucccuugaugaggaugauugaaccagaaucagguaguuuuguaaagcaggcaaaagcuccacccccggccuacuccugcguuuugugggcuuuguuuuguguuugggggaguugagagggugggugggguuuccuuugauaggcuaauugucacuacccaggacagcugccuagcuucauggacagugcuuucuuugcugccaucuagugguuaagugacuuuccucaguaacccaggaaaguaaaacaauauuguacacauaaauucuaaaccuuaguuacuaggagaaauguaaagauggucuccaucaugggaucuuguugaaguaauuugauugugucuuguguuuguaccaucuuuguccugguuccugucacucuauguguucccagcuacuaccauuucuuacauuccccaaucauuucucugcacuguguuagaauggucucuuuaaagacuuuugucaugccugguccaacuuaaauaucuuuuagcuaacguugcucuuggauaacagguaaguggaucuuugaguucaugaccagccuggucuagagugagaucugggacagugagggcuauguagagaaacucugucuuaaaaaacaaaaccacccccacccccccaacccagaaugugaagauugacggggccggagagauggcucagugcuuaaguacuuucugcuuuuuccaaagugccugccuuugguucccagacacaggcaggcagaucacuacugacuguagcuccagcuccaaggaagccaacacucuucugccuccauggccaccugcacccauguccugucuacacacaugcauauaaauaauaaauaauauauaaauaauaaauacaguuauuaaaagcaaaacugaaguuuguuuuucuccuacagaauccaagaaaacagggcccugaaacucagagcaguacagcagaacuaauuacagggcucguacaacugguuccucagucacacaugccagaggucgcucaggaggcuauggagguaaaggaagugaauucugggcuuuugaaagaaagacuguaacugucucugaucuuuuucugagaacuuaauuuuuuaagcaauuauuugacucuuucuaugugcuuucucuuaaaaauauauuuuaaaaauuuuaaauuguuugugugugcauaugaaaaucagaggaaacucagguuucuggucuuggauagcaaauaccuaaccagcuguagguuauucauuuguuuuuugagacaagauuuuuacgcuauuguccugccuggucucuaaauccuaaaacaauccuccuccuucaacuguaauacuagcuagaauuuuaguuguaugucacaagucauguuguauuugaauuacauuguguaaaaaauuuuuggaaguuuguaguuucuuuauuccuuacuuucuuuuuaugucugcauaauggggguagggugugccugcacucgcaguggcacgucuggagaugaggggagagccuguggcguuucucuucuccguccaccuuuauauggguuccgaggauugaacucaggugcucaggcuucuguaacuguuccuuacugcugagccagguaguggaugguagacguucagugugguuucuguuugaggauuucuacaaauaauacuauuaaaguuacuguaucauuuaauauuuccauuagcaguguauugguguuuugguauuucuccauuguugaugacacucauuauuguuuguuuuuaaauuauaguaaaccuacuguguuaacaaaggugacuuuuuaaaaaauuauauuuguagcuggaugguuguggugcaugccuuuaauccuaguacucaggauacagaggcagguggaucucagaggcaggcuaaucucaaccaagccuacauagaaagacccuaucucaaaacaacagaaaaauuacauugacguauuuauuguaugggaggaugugugcauagcacagcauauaggaagaggucagaggguaacuuguaggaguugguucuuucuucccaccacuggguccuagggauugaccucccguugucaggcuucuacugacagcagugccuuuacuuacugagccagcucaucagcuuagaguuuacuuguuuuuaaaauuaucuuuaaucuuuuucuuuuuuuuaguccaguuguuaucccccuccugguccgcccaccaacaguuccuccucccauacgccccucccccaguuuucaaaaggaugucuccaccuccaacccaccccaagucucuagaggguuagugugucuucucucacugaggcaagaccaggcaguccucugcuguauauguguccagggccucauaucagcuaguguaugcugccugguuggcggcucagugucuaagagaucucagggucuggauuagaugaaacugcuggucuuccuauggggucacccuccuccucagcuucuucuagcuuuucccuaauucaaccccagggguccccaacuucaguccacugauuggguauaaauaucugugucuugcugcuuuuugggccucucggaaggcagccaugcuaggcuucugucuguacaucauagcaucaguaauagugucaggccuuugagccugccuuugagauggaucccgauuugggcuggucacuggaccuccucagaguuuacuuugaaguguuauuuuuguacugacaaccuaaacauacaccuuuaaucuaaaugaaauuuauuuuuuuauaauuaacauauacgacuaguuuaagacuuaagaauauauucagcccagaaaguuuccuuucugcaguuaauacuacccuuauuuuguuaccucccuuaaguuaggaaaagaauuuugacacucuuguauugucacacauguuaguucccuuuuccugguuguugaugaauauugcacuggcuuguucacuaaugggcucaauugguagacaacaugcacuucuauugaaugucagccuuguauuccuuugccguccccaucccuucuuaccccgugucuuucccuuggcuccuuuguaauaauugauuugcuuuguuaauguaauuaguuugcauuuuaaauaaaugaaauaaagguuuuuauuuuuaguucagcauaauugcuguaauuguauuguguuagugguugguuuaucucaagguuccuccuguuuuauucuguuuagugucccauuguaugaauauagcacaacuuguuugcucauuuaucuguugaugaucauuuguguuuugcuuuuggcuauuuagaaguacagcuuuugcuggguauggugguguauaccuucauucccagcauucaggaagcagaggcaauuguaaauuugaggcuagccuggucuacaugucgaguuccaggccagccugcuacaaaguaaggcucugucaucaaaaaugaugaugaugaugaagaaggaaaaaaauugauagccuguagguacacacacacacaaugugaacagauuuuuuuauuuuucuugaguaaauucuaacugaggcaaaaaucuuacuguguggucucagaagagauauagcauagcuauaagaacacuggaagaaagauaguacaagcauagaaaaguguaguguaguacauagaaaguaaaggugucuuauuuauguguaaggauguguaucugugaauguaugugcacguguguguggguacccagggaggccagaagaggauauuggcucccuguaguugagguuacaugcaggugguuguucaccuacugagauggaugcuaggaaccaaaggcaaguuuucuggaagagcagcagcaaaugcucuuagcuguugagccaucucucuagccucagauucacuggagagagagagagagagagagagagagagagagagagagagagagagagagagagagagagagagagagagaaagggagagagagagagagagagagagagagggagggagggagagagagaugaagaucuuuuugcaaagguucagucuaggaaguaaaagugcaugaaguuucuaaagcuucaggauauauaaaacaaaauauguaaagaaagaagcuguuuacagugcagaugcagugguguuccugaguacuuuccuaacauccgguggguaaggauagggugggguuguuaucauucaguagaauacgacacugaauucagacaguacuuuuuuuuucccaagcauaccuggaagauauuuaacauagggguaggcuuaaaacuaucaaaguauugaaauauuauuuuauugccauaguagaauuaagauagaaaucaguaagaaaaaaguuuauaaauuuuaaaauguugauacuguguuuucguuuacauacuacugaguauaauuuaguacaacuaccauuaaaugccauuuuauaauaucagagcuaaacauaaaugcugacaguuuacuccgggucauagagccagcagaagugcacaugucuacuuacaaagcacacaaaauggucagcagugcagcuuguguuguaucuuccuccaaaguaugagccauucagaugugucagccgaguagacaauuccuguuauauugauuuaacugaauucuaugcaguagugaaaauaaaaugaacuggauugguggcacacucauuuaaucccagcucucgggaggcaagagacaggauaguugugaguuccuggacagccuuaucuacauggagaguuccaggucacccggugcugcagaguaagacccugucacuaaaaugaugaagaugaugaagaagaagagaagaaaaauugauggccucuaggucacuaauacauaaaucuaaguugugaacagaguguucauuuuucuugaguagauuccaacuaauguaagacaacaacaguaacagcaacaacagcaauaaccaaaaaccccaaaagaggcugguuuacauagagaguuccaagacagucaaagccacauagaccugucugaaaguaaacaaaaccagcaugaguacugaugagugcagaagcugcaugagucucacugacaugcugcucaguggaaauaaccaaaggccaagugcauucugacagcuccguuacccgagcuucacaggcagagagagcagcuuggugagggcaggcagagagccgaugccugggaagggggggcugaagggccuuucuggugugggcgguguugauaggugguggugggacaugcagccagugaaaaaaucucugagcuuuccucuccaaaugaccuccugcuguacucugugugugugugugugugugugugugugugugugugugugugugugugugugugagaucauccuagaaauugcuacauugcuuauauugucuuuggaggaucuauucaaauauuuugauuauuuucacuucaauaaucaauucuuacauuucuugucuuguguauaauauauaauucaagauuaaaaaaauacauguaucuuccucuaauaaucaggaagaccuuaauuauucauuaguaagcgaauggguuuauauuuaagagagugguauuucaacuuggcaugcuauuaaacauccauucaaaccugugugagucguucagccguguuggagaaugcuuaggagauaaguguaauauguuuggagcuagcugaagcugucagucccacacuguguagaauuuauucaucaucaacaaaccacaauaauaaggugcuucccaacaaauuguaucaucuaaugacuccauagccaucuuuuuaaugucaguguauucuuugauauuggcaugaugacauagucaccuuugagguacuucucagugucuaucugucagauaacauauagcaguauggaaaauuaaagcaaaggagaacaugaaaagguauauaauuucauugaaaugcaaaaaacuaauacauuuuuauucagauuaaacaaaaaacuuuauuaaacagggaaugugucaccuaaaaaacccuaaaauaucccagucuuacuaaaugccaaaccauuugugagugacagaaauaaagcuaggauuugggucuccgcuucuguucuuuguacuauaccagaacacugccuucucuucuuuguaugcauaauaugaaguccuucaaaaacacagaugugccuuggcaguucaacacccuccaaaagagaaccucaguaugccuuagguucuuuucuuuucccaucaaacacuuugcccaaguuucuaugauaggccuagagccccugaagcaguggagcucauaaagacugugccccacugaugcuagcucucucuugucacaagagaaagcaacugcuuuaaauucccaaccaaauugaugccacuguaugaaaaacaauagaaaacccuaaaguaccaggaaauuguaucaaguauuuguacaguaaugguaaacugaauugcaauuuguacuaucuguuuuuuuuuuaagugcuaacuauaaguuacuuauuuguuucagguagcaguucauugauguuuuaauaacaggggcuuacagaucccauauguauuuuuaccauggacugacuguacugagcacaauagaauuugcuagggaauggggaagcauuguggaauugcagucuagcuugagcagguuugaugaaagggucuuugcuuuaauagucuuugauaguuuuaauuuauaaguuagcauauuuauauggaaguuacuuauuuaaaaugaguuacuuaauucuggcuagucgucauuaaauacuuuaaaauaaacuguuauuaaacauaaaguuugcuuuguuuuugccucucugucaauuuuagaaaauaacuuuucugucuaaaauguuuauguaacaagcaaguuaauuucuacuauuucauuguguggguuaauauugcuguguguguuaauuuuaggggagauacuuuguucuagaguuauuaauuauugaaaccucauuguuuauuucuugaagcagcuuuguguguguauauuguucugaguucauucacagcucccuguguacgccauguagaguaaugauggcaggggcagagggaguuaguucgggguugguauucugacuggcucucaaaaacauguuuuucacuguucuuaagacagacccagcugaguuuguuagcauuuguaaaacgagugcuccaguguuguuuuccuaaagcacuuucagugccuucuccuuuguacauuucaggcuuugcugguccuucaucaguuagauagcauugaucucuggaauccugacgcuccuguagagacauucugggaaaucagguauauggauuuucacauuuuaauuuggcuauugucuuuaaauauuagcuguauaauauuuaguucauuguuauauuuauuguuauaaguagauauuuuucaauuuuguuuuuaauuugaauugaaaauguuagaauauuuaacugucagagaacuaacacauauaugcaaaaaaguuuaaaaaugguguuaauuuuuaucagcuggcuacaaguucuucuacuucauguauuauccuuugugguguacuucuaagcaguuacaauuguguuuguuguuuugagacagggucuaacuauguagccuuggcuagccuagaacuuaacuguguagaucagacuggccuuaaaguccaagaaauccacuucccucugccucuggagugcugcgucuaaagguguguccuaucaugccuggcuauaauuguguguguguguuuaaguuuauuuauuauuauauguaaguacgcuguagcuuucuucagacacaccagaagagggcgacaaaucucauuacagaugguugugagccaccaugugguugcuggguuuugaacucaggaccuucagaagaacaaucaguguucuuagccacugagccaucucaccagucccauaauuguuguuuuuaauagauuuuuuucaguuauaagacuaaaaguauugacauuuuguaacuuagcuuuucauuuuuaaacuaagcacguggcucaguaguacaguauaugauaugcauugaaggggggagcuaugaucuuugucaaucuucuguaugcacuagugguuuuagugagucaguuacagacaggcauauauguauaaauaagaaaauauguacaggauuucacuauaccuuucugaagcugaguagaugguuuucuuuaauaagcaugagggcacuacauuaggaagauguaaaucuauaaaccuaggccccugcuauugucucaucauagacaugguguguuagguauguggagaccgaguuaaaaucuaaccucuuauaaugacauaguuauuggagacauauguaauuaacuuuuaauuuaacacaucauaaaugcauuuauuuaacuuuauauauacauauauaaauacgaaauagugaagcauauaaucaauuugaauugucagugagauauuuuauauuuuucuuuucauaaagucuucaaaauuuguagugugucuuacuacaguacauaugaaaacacauuucauuauggacaagcuucauuuaaaguacucaaguggucacacgugggcggcucguagcuaaacagcacaauuguauaguaucauagaguauacagaacgaauuagcaaucuuguucucuaaagggugggaaauggaccaggugucuuggcucacccauucuguugugagucuguacuuucacguuuggagcaagaaagcaguuacagacugggaaugagggacuguggcuguguuccauugaaaccuccuuuauagauguuagaggaggcauggcuuuguccuacaagcaacaguuuuuaggcccuggcuccagacuacucuugcucugcagucuuugcugugcaugugaauuuauaauuuuuuuuuauccccaccgcaagaauagaauuuuuuaaaauguguuguuauuaacauuuggauaaaaccuguaaacaaguaaaacuaagccucuaaacguacaccuacuaugaaauaugucacguuauguaugauuacguauauguauuagguucgugaugauuuuguaacagugaacuuuauguuacugcagcucacaaaugcuuuuuuacaucugcaagaaauuaacuagccaucaaaugcuuaguagcacagaaauucucaagugguuacgggaaauucugaucugcagaaauaaauuucuucuuaaaaauaagguaagcacagugacuuuuucuuuugguuuucgagacaggguuucucuguguagcccuggcuguccuggaacucacucuguagaccaggcuggccucgaacucagaaauccgccugccucugccucccaagugcugggauuaaacgcaugcaccacaucugcccggcugcacagugacauucuuaaauuagaaauaucugaauaguaaggagauguguuuucauuuuacugcuaugauaaacaccaggaccagcaacuuggguuggguguauuugucuuacaugucuugauggcaauccaucauugggggaagccaagacaaggaacuaaagcagaggccauggaggaacacugcuuacugguuugcucucuggcuugcucauuauacaaccuaggaccacugggugacaacugccgacaguggacugagcucgcccacaucgaucauuaauggagaaaaugucccacagacuugucaacaggccagccuuaaggaggcauccuuuuaucuaagguucccuuucuaagauuacucuagcuuguagcaggugacaaaaagcuaaccagcacagaacaaguuaaaaaguuuuuauuagcuagauuauauccuacuucaacuccucacucaaugacauacuuaagagaaauguaaguacagaagguauuaucugguaguccaacauuuaaauauucuagguuuuaaguugguaaauggaagguuaaugaauucuaguugacuuaaguaggauucugggucaggccuaugaagaguagaggcugcugcaaucaaagaugucucaaauaguguuuucucuuuauuuuuaaguccucaugacuuggcucucggagcuaaucuaguccgggaaauaaucuuucaaaaagcuaaagggcagaaguuuuaaauuuagguuaaacuuguaugucucccuuaaagauuuugucuguuagcuggguaugguggcacaugccuauaauuccaguacuguugaggccagccugagcagaguggauuccaggcuagccuggaguacacauugagauguuguuucaaacaaggccugaggauguagcuuaauaguagagcacucaaguucuguagaguuagggaugauuucaucuuuuaaaaaaagaccaggaaucuuuuuuuuuuuuaaauuagaauaaaauuuuuugguccugaacaguugaaacauugaaguucuggggaacaggaacgaaccuaacguuucuuuuaacauguaauuuuuauaaucaauuucaagguuuuucuauuaugacauaauugacauaauuuaaagaauacuugauuuaauuaauuuuaauccaggccuagaauuauagcuauaagaaaccuuaccaagcaucuugauacaauuuuguuuagaggacugcugauggagagguaagguuauuuguaucuggcuuaucuuguguuuaugucacagaacaaaguuuguccugaagauuuuagacuuaagaauuuugugccuuuggcauauugucuagcauggucaguguuaguaaucuaguagugaauccgaggugcuuugugagggcuggagagagcacucagcagugcugaguaccccgacaaggcaaaacuguaaucuguagauucguaaagucuuacaguuuucuugugauagauuuuacaucaucaucuauauuguacuugguuuggagguuggacaacugagagguguuugaaagaaagauagugcacaaaccuuauuuaccacaaugggguagugagugcuucuaacgggaaagcuuuuggagagaagguuuuccagggcugccuuaaaauagaaagucaguucccacuaagcacucugucagugucauugcuucaggaggauacgucuucuuuccagcaggcagauagaagcuccugucauucucucuaccuuuauggaguaggaugugaaaugucugcuacuggaaauaccacucagaugucaguugaucaugaugaguuccugcgugccuguacuccuggagcaucucugcggaaaggaagagggaauuccuccaugguagguaacucccucugugacucuccuguaucaucaucucugcucuuccuuucugaguggauguugguaaauuucgauuaaauaauuuagcacauuaguuacagacugcucagaauuuaguuguagugcugcucacuguggaacccugagcaaauucuucauaacucugugccuuaguuucucagauugcaggagaugauagcagggcaugguggaauacaccuguaaucucaguguugcagaggcugaggcaagaggaucacaaguuagaauuuuuguuuuguuuuuuuaaagacaggauaucacugaauagcucuggcuauccuguaacuuacuguguacaaagguugaccucaaauugagauaucugccuguaccaccaugcccagccuuuuaaguuuuccuuuuuuuuuuuuuuuuuuaaauguguauggguguuuugacuaccuguauaucuaugcacucauguauaccugaugccccacagaggccagaagagggcuucuggucccaugaacuggagucccagaugguugugagcugccuugugagugcugggaagcaaacccaguucucuggacgggcaggccuugcucuuagugcucuuaaccguugguuuaucccucugucccagaggggacaaguuugaagguagguuuacauaguaagacugucuuccacaaaaugaauaaucagaaagcaauuaauaauaguaguuaauaacaaauaauaaaaccaguauaagauuguugcuccagaguuuugaggauucgaguagguagaauguaaacaguacaugauuauuugaccguguggcugaccacucuaaucauucugaugugaacaagccauucagauguaggaguugaauuaaaggaggcucaaauuaauuaaaaauaaaacacaguaguuugcuuaauuuuuggauaaguguugcuaagauguuauuucuuucucucucucggcuuuuauuuuuauuuauuucuguauacauacauguauaucuguauugacauagucgugcuuugcagcacaggcuaccuugaauuugcuguaauccuccugcuucacccuugcagguacuguaauuaaggucagucgugcuuggcaagauuuacauuuuuagacuaggucccaaauaugccaggcuggcuuugauccucuugccaauuccacacgagugccaagauuauagaucuguauugcuauguacagcaggacauuuauuucuguauguaaauguccuuaacauaaaucaaaauaugagcagaauuauaaaaucauauggaagguuuugucuuucagacagagagccuuguuaugcuuaaguuucacuguauguagccuguugaggcagaaaccucaaugagcccuguaggagcugcaaugugugcuucgccuguguccuuggcauuggcuuuccaaguguuucugccucaguguuaguuugugggucauuguuucagucagugcuuccggguguuuguuucuucccuauagaccucuuccuuugucauuaugguugacccacaaguggaucaguuuuacugcauuggacucucugugucuuuuuguuuguuuguuuguuuguuuguuugagacaggguuucucuguguagcccuggcuguccuggaacucacucuguagaccaggcuggccuugaacucagaaauccgccugccucugccucugccuccugagugcugggauuaaaagcgugugccaccacguccagcuucucugugucuuaauuguauauuuguuacagacuaucugcauuucuggaaucuaggauaauaucuauuccaauugaaaugcaguaccauuauaugaaccauauauugguucacaucugauuuagaguaaggcacaucagaaaaagaucuuauuauuagaaagguaaauucuuauuuauuuugugugcuaugguaaaugguacauuguugaguuuguaaauaaagucaccuaaguugcagauacaucccuccuuccucccaggauagcacagcagggugcaguggaaccccaccuauaugccgacaagcccagaccaagcuagaaguggccuuauacauguuucuguggaauccugacacugaagcuguucugguugcuauguccuguuuccgccaccucugugaagaagcagauauucgaugugggguagaugaagugucaguacacaacuucuugcccaacuauaacacauucauggaauuugccucagucagcaauaugaugucaacagguaaauguggcucuuuuuuuuuuuuuuuucucuuacucuuuuuaaccauguuacuuugacugacaucuaauuauuuuuacaguggagucuauuuaaagaacaguuugaaaguuuucaggacaaauucauacgguuuacuugaaauccuuuucugaacaagguagauguaauucagugacauuugaaauuuacugaauuuuuaauauucaaacuuauugguaacuggcacuguaaguugauguuaguuauagauuauagaaauuacucugcuugaauuauaaaugggaagauuuuaaacaccuaggcauauauuuccauaaacauaggugggaagauggcuguuuuauguuguagaccuuuuggaguuggggaucaaugaauacucuugcagagguuggugagagcacgugcucaccucgaucaucagaaucauuuguuucauuccuucacucuacucuguguguggggcaggcucccagaugugaagauggcucuaaacacuaacuggguuugcuugcugucuuugcuuaggaagagcagcgcuucagaaaagagugauggcccugcuaaggcgcauugagcacccuacugcaggaaacauugagguauggccucagcagcugcagcaccucccccucccuauguuacuguuagcuaugugaucagaacaacuugagaagcaaagcugaguuaugugcauauuacaaguaggguauucucagaaccugcauuacauguugacuuugaauucaccccuaaaguugcucccuagugauaauugacuucauuuuaggccugggaagauacacaugcaaagugggaacaggcuacaaaacuaauccuuaacuacccaaaagccaaaauggaagauggccaggugaguuguuuuuuucagugaauuuuuguguauuaauagaucuguugcuucacuuaaguaauccuugaugagcuacgaagaguaggauauuauauggaguuguuuuaagaauaccuguggucugucugucuguuugccuacucuuguagauauuagccacauguaucuguuagaaugucacuuuuaacucauuuaauuaaacaaguuagacuuacuuuuucaauuuuauaguagccaagguucaguauuuauuuacucaguuggauaguagagauguaaaagguuacaugacuacaggaauauuaaauaucucugcuagaaaccacuuaguugagagaccaguuacucauugauguucuuuguccuuuguugaaguauucaaagaacguuuagaaaagaucuaauagcuguagauagagaaagagaauauuucuaagaauucucguaacguguguuugcuuugagacaggaucugguuauuuaccuuugcugccuagaacuuaaaguauagaacaggcuguccuugcccuugcagugauccuccugccuuaacuuuccaaagcugggguuacagaggugugccucccugucuggcucauuaugcuguauucuuagauacucuaauuaaaggggcugcugagcacauaaucgagcgcacuuuaagguugagugcaauuuuaaacuuuggacauuuuauuuaacuauuaucaucaagugaaucauuuuauucagcaacuaccaccaauucucuauuacccuagaaauuaagaauuaacugguuuguguauaacuaauuuguauuacuauacugcuuucauuaucaggucuuugagacaaacuguuuauccuccaauugcuguuuuucuuguuauggucacuuagagcaaguaaaaguuguuuugaggaaauaauacagccuuagucaugaaaguuuuucuuuugagggugggaguguggguguugacuguuuaaaucagcauagaauucauauacuguagaguuaucuuucauaagguggucaaccuaaugauuguuuuuaguauagucacagaauucuauaacugucaguuuauacacaaucaauuuuaguacauuuucaugcucucacagaaugcccccucccaccaaaccugcuccccauuagcuauuucuagcucuaacuugcuguauuuccuaccucucugucucuaccgcuccagccuugaguagcugcuaaucuauguucuauuucuacaaaauuaccuucucugaguauuuuguccaauggaaucauaggugauaugggccuuugugacuagcuuuuuuucuccuuaaauuguuuaagguucaucacuacacaucagagauuuuuaaaaaggaauuugacacuucagggugauuuuauucuagcuaugacaaaaauguauuaaguggcucucuaauguguguaugguagggauuagagagauggcucaguguuuaagagcacugguugcucuucagaggaucugggugugaguucuagcacucacaugauagcuuagaauggguuguaacacuaguuccaggaaaucuaacauccuccuuuauuuagcuuuuaggcaugcacaugguacacauauauacauacaggcaaaacauuuauacacauaaaacuaaaauuaaaaaauaauaauguaugugguaguuucaaguuuuuuuuauuauuauuauaaaauguaccuuuccuacugguagaaauggauaagaguaauuuguaagauuuuuauucagucuauguugaauucaugcuuuucacaaaaauguuguguuuaggcugcagaaagucuucauaagaccauuguuaagagacggaugucccaugucaguggaggaggcuccauagacuugucugacacagacucccugcaggaguggaucaacaugacuggcuuccuuugugcccuugguggggugugccugcaacagagaagcagcucuggccuagcgacauacagcccaccuaugggcgcugucagugaacgcaaagggucuaugauuucuguaaugucuucugaagggaauauugauucaccugucagcagauuuauggaccggcuucuguccuuaaugguguguaaccacgagaaaguggggcuucagauacggaccaauguuaaggaccuggugggucuggaguugaguccugcucuguauccaaugcuguuuaacaaacugaagaauaccaucagcaaguuuuuugacucucaaggacaggugacgucuucuccacuuuguuuuuuaccuuucuuuaugaauauaauaauaguuugaaauaaaucaagacuguuucuuucaaauuauuuaaauuauagaccaacaugauaauucacuuacaacuuuaaaaccuuucauaauuacagaaaaaaaaucauguaaccuagggaucaacuugcuucuaaagaacucaggccuguggguaugccuggaguuaggagucuuggcugugugccucguaccucuguguaucuguguguuuguuuacuugccuguagugugccugcgugugaugguuacaucaguuucauugcccugauaaugguuucuguucauugauguuagaucgcuaaugggcuguuuuuugguuuuguguguguguguguauagguauuacuaagugacagcaauacucaguuuguagagcaaaccauagccauaaugaaaaaccuacuggauaaucauacugaaggcagcucugagcaucugggacaagcgagcauugagacaaugaugcuaaaucuggucagguaagcauucuguccugaaucacagcagagucuuguuuuaagagguaagaccucguaugcccugauaauggggaugaugaaguaguuugccauuguuuuacuacagacccagugugacuauggcaauaagauaaucagaaguuguauauguuccuaccuaaguaaaauuuaaauauuauucacgucuaaaauuacauuuacuuaaguuuacuuaaagauuaaauuuagaauaccuuaucuuuuguccauaucugaucauuuuuuuuaauuccauguuuaauuagauacguucguguucuugggaauaugguccaugcaauacaaauaaaaacaaaauugugucaguuaguugaagucaugauggcaagaagagaugaccucucguuuugucaagagaugaaauuuaggugaguucucagaagagcaaagcagggucuuguaaguauuauguuaaacaaaguguagaaaaguagcagagcuuuuuguguggggaggggagggagguacauauuugugcauauuuguuuuuucugauuauucuuaaccaacuuucucaaagcucugugcccacaagcauuuguuuuucuguuuuguuuucagucuuucuuuuuuuaaaaauucucuccuuuccuggaacuaauuaauuuauggucacuaaaaguuucuguuuccacauugcaaagggacagugcaaagaaccagcaucugaauuguaucuguguccuucugacuuuuauuccaucaccccugauagcgguaucuguuguauaaagucacccuagccccucagcuguuuucacuaguagagcgcuguuuugguucucagcauaugccuacaguuccuucagucagaaagccaaggcaaaaguucagggccaaucugggauauacaacuauaugauaaaacuuuugucuaaauaaucaguaaacuauguguuaaaaacuuacuuguucuuuuccuuuuuucauucugcaggaauaagaugguagaauaucuaacagacuggguuaugggaacaucaaaccaagcagcagaugaugacauaaaaugucuuacgagguaaaauaaaacagaacaaaauggacagagagagagguggggaggggaaggaaaacggagaaggagagagggaaagaggcgguuuuuaaaguucuaucauguuuuacuuuacucaugaaaaccaguacagagauagcugcuagguguguuaaguuguuuuguaggugguaagcuuuugcauuugagauauuuaaaguuccuuuuauuauuuuacuggaaggacuuuuaguugaagcaugugagguagucuuaggaaagugguauuagcuuaggaaguaugguuaacaguuauugagagaagauacauaaagcauuaggcuguauuacuuuagauaaaaacauugauugaggaacauaauuaugagucuuuguaaggcauaauugcguacaugcuguaaugacagaugcuugauauauaucagaaaugguaacugugauuggaugauaauuucauccauuuuuuguucagguaugacuugguaauauguacuauuuacugauugguugauuaauugaguuucuucuaucaucaucaucaucaucaauuuauccauuuggccacuuauuuauucguuuauuuauugaugguuuuucaagacaguuucucuguguagcccuagcugucuuggaacucauucuguaguccaggcuggccuagaacucaaugaccuaccugccucucuaccucuggggugcugggauuaaaggcgugcaccaccauugcuuuuucauuuuuauauugugauauuggagcuugaacccaagacuuguagaugcuaaacuggauuacauucuuaaccccauaauuuugauuuaaugaagauauuaugcuuaagauuacuuauucguaaguuuccccaccaguuuuaggucuuuguguguguguucugagcuuaguauauuuacugauguuauuuagguuguauuuauaguuuacuaagugaaguagagagcgccuuaguuuccugucuaaaaggcucauaguuucuaaaugacuuuuuuuuagagaucuggaccaagcaagcauggaagcaguaguuucucuccucgcuggucuuccacugcagcccgaagaaggagaugggguggagcugauggaggccaaaucacaguuauuccuuaaguaaaugucagccgccaaaaaacagcacaaaacacaaauacagcuuucucccucccacagcaguguaaccaaaguagcuaaauauuauauuuaaaaguagaccuaauugcuucuaauuuuggccauugacugcucucaugaaaauaacaugucuacuugugaaaagacagaaccaagauagaaaaauaauuuguguuguguuuuuuaaagaaaacagugggauaguugaaauuuuccuuguaaugaaucuagauugccuguuaagucauuuaaaaugacaaugucuaacugguuuggaccaugaguuuuguagcuaaauauuaaaacugacuuuugccagcagacaaggugcauuuucugugcuuaugucaggaaugaacacuguacuuugucaggauaaaauaaugcuaccagcaacucaauaaugagccacguugacuucugaccccaguauuauaaaagcagaugcuuacaguggcccacauaaucauucagaauggaugguuagcuugcugguugguguggccuucaugguguaaggucagucucuguauuuuccagguacuucacauuauuuaugaaccuuuugaaugacuguagugaaguugaagaugaaaaugcacaaacggguggcaggaaacguggcaugucucggaggcuggcaucccugaggcacuguacagugcuugcaaugucaaacuuacucaaugcuaauguggacaguggacucaugcacuccauaggugagaucaaaugaaagcuacauaaaaaacuggccuagcauggugcacaacuugaaucccauuaaccaggaggaaggaacaagaagaucucuaugaguucaaggucagccuggucuacacagugaguuccaggacagccaaggcuaccagugacccugucuguaaacagacaaacaagcaagcaagcaaacagaaccaaagcagaaauauaaaaccuagagagcugggugggaaggguggcucagugguuuacagcaccggcuggucuuccaugggaccuagguuuaauuuccaggccucugugguaaccaggcauacaugugauugauacccagacauuaggcaugcaaaacacucauagacauaaaacauaaaaaucuagaguugacauaacaugcaaaaugaaaauugcuucagccaggcuguggugguaaauuugcaucugucuauccucaucaggcuuagguuaucacaaggaucuucagacaagagcuacguuuauggaaguucugacaaaaauccuucaacaaggaacagaauucgauacacuugcggaaacgguguuggcagaucgauuugagagacuuguggaacuggucacaaugaugggagaccagggagaacucccuauagcuauggcucuugccaauguggucccuuguucucaguggguaaguuuauugagaaaguaggguaauagaaugcuugacauacagcuagugcuucaaaauaaguauccucagaaguguuuauuaagugaauugacaaaauuuaagaacuggaaaaaauuacauaauggagagcugagacuguagcucauugguagaaugcuuucccuagcaccacagaaaauccaucaugauugugcuugccuguaaucucagcagcuuggagggugaaagcaggagguucagaaguucaagguccucuuuguuaauagugaguuucaagccaguuagagcacuguaagacugucuaaaaaaauaauuaaccaacuugagucauuaaaccuuuuuucuuaauguguuuugcuucuaacuauugagaagugguugguacuccuaccccugacuaguucuuucuuuccaacccagugacaaacguucauggaaucaccaaugggaagaaauguaaaacagcguugucucuuaucuuuacguauauauaaaguaauaguuaaccuaacuauuaguuguuaauaguacuaaaucuauaaucugcgauuugugcucaauaacuaucucugccuuacacaccuuaauuuuuacuugaaguauuacauuacauuugaaauuugcauuugaaggcaugcuggaugugguggacacacucauaauucuagcacguagcaaguggaggcaagagauagaagacucauaagucaucgacggcuacagagcaaguucaaggccagcuugggcuguauaagucugugucuccaaacaaaauggacugauaaaauaccauagaaauacaugacuauuuguccgucuacauuuauuuuguauucuggggauugcugucagggccuuacuuguuaggcaagugcuuuaucacugaguugcacccucugcccaucaaacuacaacauucuugguaauacauuugaaaacuuugaggaagcuuuuguucauuuucauuuaaaaaagccauguugaucccuauauuuuugcucaugccuuuagucccagcauggggaggcagaggcaggcaggucuaccugauaaguucuaggccagcuauagcuuaccuagugaaucccugucuucccccccccccccacacacacacacuuucuuaaagucguaugguuuauuuuaucaaaagaggaaggaaggaagaaagcaaggaaggaaaagaaaaaagacuuuaguaagaguaaacuucuaauuacuaaaauaauuuuuuuuuuuugccuaaaaacuguaaugagagggugaggaacuggaaacugguucaggagucuuucagaagacugggguuggauucccagcucacauggucacuucacaaccacuuguaacuccuguuuuaggggacugggugcucucucugccucccuaggcaaagcaaccauuuacauaaaauuaacaacagaaaugaaggaacccaccuguagcagaggcuggaagggcgguuuggugcuuaagagugucugcugcucuguaaaagaaguggagccgaggucccagcacucccaacagcaccaaaggagaggugcuacucaugugcacgugcguugaaaauacacaguuaaaaacagagagccugugagaucaugguuuuuguaucuaaaaauaaagcucauauuuuuugcccuauaacccugcacuuuaccugggcccugccuuaacugucuucagcugaugcugaggcucuucuguguacucaucucaaaugugauaacuguuucugcccuagaguacccuugcuccugcuuucuaaaauacuucugugguugcuuugauuugauucaauucgguauuaguaaaauuauuuaacaugagcucuaucgucuuagcaauuuuguugguuugcuuacuugcuuuaugacaagagauggucucaccuugugggcucuggcugaccugaagcucacuguguagacaggauggcuuccgacuagagauccuucugccucuguuuuccaaaugcugggggcacaggcagcaucuccacagcugacucacuuacaauuguacuuuuaugcccauuuauuagaguacuccuaaauuauuuucuucaaaccuaaaauuuuucacacaucuucaaauguauuaucaguaaauauuaugaacuuuuuagcauuuaacuguaauuaaaagucauuuaguaguuuucuuaaugaagagugaaggucugaugaugcaaccuagugguagaguucuggucuagcacgcaugagacccuauucuugaucccuccuaacacaagaaaacaacuguugauguaagucugugaagcucugacuaauauuucuaagcuuuauagcacaugacuuaaaauaccucuuuuucuucuucuucuuuuucuuuuucuuuuucuucuucuuuuuuuuucuuuuuucuuuucuuuuuuuuuuuuuuugagacaggguuucuuuguguaauagugcuggcugucuuggacuugauguguagaccaggcuggccuugaacucaaagagaucucugccugccucugacuccugaguacuaggguuaaaagcaugcgcuaccauuccuggcuugacuuaaaaauaccucuuacguauuuacuuuuuuggagauaggaucucugguguagccuagcuggccuggaauucauugugcagaacuaggauauagccucaaaugcacaaaguuucucugccuccuguuacagggguuaaaggcauccaacaucauaccucgccucaauuacuuaaaauuuuuuuugagauuuuauuucauauaaauagguauuuugccuacauguauguuugugcaccauguguauaaaaugcccaaaggggccagaaguggcuguuagaugcccugaaacuggaauuaaaacaguucuaacugcauguggguacugggaauugaacuuggguccucucaaagagcagccaaugcugcuagucccccaaauuauguuuuuucuuuggcaauuuugaacauauaaacaaucucucuugaucacaugcaccaguguuucucaaccuucuuaaugcugugacucuauaauauaguuccucguguuguggugaccaccaaccauaaaaucacuuucauugcuacuccauaacuguaauuuugcuauuguuaugaguaguaauguaaauaucuaauaugcaugauaucugauauguaaccccuaugaaagggucauccaauucucaaaggggucucaacccaugaguugagaacugcugauauacccguggcuccccacuuucccuccccuucccuucccuucccuucccuucccuucccuucccuucccuucccuucccuucccuucccuccccuccccuccccuccccuccccuccccuccccuccccuucccccuucccccuucccccuucccccuucccuccucucccccuucccccuucccccuucccccuucccuccucucccccuucccccuucccccuucccuccucucccccuucccccuucccccuucccccuucccccccucccucucucuuucuuucuuucuuuuuucuuuaaaaaaagacaagaucucauuauggccuguaacuuuuuuuuuuuuuaacuuuaucugcauuuauuugaugcugaauuuauucccgggccuugaguuuuguuucuucaguuucuuccaggauuucuuuuucuucugugcugccucuucuuugggcuuuggaacaaucuguugcuucucagugaggaucaucucaguguggcagggggagcucauguaugggugaauucggccaagagcucuguagguuuuuucggcaccccuuagguuccuuguucaccuggcuguguucaaugacuagagcauccacgucuaaacccagcauucuuuuuuggccaccauccagccuguuuggcccacuguuuggccugggcugcaccuaccaacaccaccauuauuccgccagaauggcacacauugcuucuuuaaaguggcauccuucagauacuugguggcuuuguggauaugcauacccuugauggccugggcaguuucccgaguguucuuaaagugaacaugaagguuuggaccucuugauuugcgugauuuugugggguuuuuuugggucaagagaguagcaaaccaucuucacaggucucuucuggccgcuuacaggaagaguagcuuggaacuuuuuaaaagaaaaacaaaacaaaacaaacaaaaaacucaagaccaaccuuauuagcagagcuguugaggaaucacggauaucuacuaacaaugugguggguuuuucuccuuguaacucuuacguaacucaaccuggccucaaauuuccacucuucugccuuuacuuccucaguucugugauuacaaguguguacuaucacuuucucuaaugaaauuaguuaaaaauuuaauuugauuauguaaauacauguuuuaaaagccagcuguuuagaauuuuggggguuuaggagaaaggaugagaguagaaaggcauuuacuauggggccuaaaagcaacagcuacugcugucucucuuuacuauugugcuggaauugaaacagcugacuuucugugcuagaaaagcucccccccacccccucccacccccgcuccugagcuggagcccaagcccggcaacuucaguuugucccuaaauucuuauccuuuuuucuuaacucauaauggaggggagaugucaaagauguauuguguaacuacagggggcuucugggguauuuauaguuuggauuauucaauuuuuucccuuacuccagugucuuguucuuagaaucuugggaccaggccaggcugagggcagggcucuggaccaugauggacuuuaguacuguuugaagguugagggcucuuuuuuuauagcuacugguauuuucuuugucuucucucaauguuggguuuaacagugaauuacaguuuuaauaauuguaaaacaaaacaaaaaaccacaaaaacuuuaaggaauuuggaaaggauguuguacaaauaauagaacuguuagccucaauccuaacucuaguuguauguaaaucugacuggauuuuggguuuuaacuaucuagccgacccccuccauucugauuuuuaaauaaucccuuaguauuugcauuuuuguuguuuauuuuggccuuggucauauuguauuuaaucauuucuaagaauacaguuuguucaaaacgaacacuuauuuuaugauguaauuuagccagauccugaugucuuucugccuugccuucugguaaagccuuaaaucucucaucuuucacuaguuaauuuuuagcauuagcagcuauuagaaacagguauuaaaagucaucuuuaauagacaaagguaaauguuaggaauaauaaguuauuguuuaccuugauuauuaugaguuuuagaucugccuuuuuucuauccuuuuacaaaauuuuaaaucuaccuaagagaaguaaaauuguucacagaaacacaauugugcuuuguuaccaggaugagcuggcucggguucuggucacucuguuugauucccggcauuuacucuaccagcugcucuggaacauguuuucuaaggagguagaauuggcagacuccaugcagacucucuuucgaggcaacagcuuggccaguaagauaaugacauucugcuucaagguuggugucauugacuuugugugcacacgugcacuagguuuguugagaagaaacuuagagacuguguggagggauuauguuuuaaauguaggauguguggcuguggcuauuggccugacuguguguuucuuuagguguauggugcuacuuaccuacaaaagcucuuggacccuuuauuacgagucaucaucacaucuucggauuggcaacauguuagcuuugaaguggauccuaccagguuugucaucuugucacaguugcucccucacuccuccccaguacugcaugaggucaccuuuaucucauguuccuguccuugguuuucuggugguuuucaugaagacgauaugucacuguguagcccagccuguccuuaaaccugugcucuuccugacguggcucacucuccuggggcuauagcccuucucuucacuuuuaaaagguuugcaguuuuuacacuaaagguuauaugcaaacaucuuccuuaaagaauaaaaacauuaauagauaucauuaaaggcaucauugauuaccaccuauggauaccguugugguuuacuccggucuguccuuuucccauucuuuuguauaaacauauauguaauuuuagaagauguauacuuuauuguaauugcuuaauuuuaaaagguaauaaaaauaaaucugugguuuacaacccaauucuuuugguuuggucauaggccuuagaucuuucuguggaaguggaugaagauugcuguuacucuuuuauacugcugcacaguauuaaguaguuuagcgcuguuacuguuugugcagugcaguagcauagccuuugacuuugccauaacuuccuuauuauugggguuuugaaacaggaucucacagcauaauuguggcuguccuggagcacgcuauguagacgaggcuggccuggaacucgcagagauccaccugccucuuccccuuaagugcuacagucauaugcuaccacacccagaccaacguccuuauuaguauucuaacauugucuuuuccacacucaagcuguuugcaguggaaaugauuuuucuaaauguaaauggggcuuuuuguuucuuuguuuuguuuuggugauguugauaauuguauuugagcccuucuacaugcuaggaagugccuagccacuaagccuauucccaaccuuagcagaaaucuuucugaugcuuauuuugugagacaucagcagcagucugcucuugucagcaaaaugcagcacagauuguugcuucaucugaaccaccuuuaccucacucaccguguucauuucauagucacucuaagcuccaaggaaaaguacauaguuuuaaauguucuugcacaagguccuaugggauuagagauaccuaauuaauuauguuucuuaugucuguuuuuaagaaauauuauuuuguguaugugcuugauauauguuugcgguauacauguaaaggucagaguauacuuccaagaaucaaacucagaucaacagguuuucuuggcaagucucuuuauacauugagccaucuugccuacucaguccuucauuucugaccaugauaaaaaaucaagaaggcagacuaagcauauggcuaauggcugagugguagauaacuugccuaguagaaugagcccuugguuccuuccauccucagcaaaacacacacacacauacacacacacacacacacacacacacacacacacacacacacacacaguuccuuccauccucagcaaaacacacacacacacacacacacacacacacacacacacacacagaguuccuuccauccuuagcaacacacacacacacacacacacacacacacacgcacgcacgcacgcacgcacgcacgcacgcacgcacacacaaucuaagaagauauaaggaagggagacauccauaaaucagcuguaacuuucauuuuagauaaaaaaugacuuucgagggguuggagaaaugacucacugauuaacagcacuugauguucuucuaggggacuucucucucuucgguucccaacauccauaucagguggcucauagcuaccuaucagugcaguuccaagguaucuccuggccuuagagggcaccugaauguguggcaugcauucacacagauucacacauauaaaugaaacccuuuagcuuggagaaagagaccuuagauccccagguacauaggauuguuuacacuugagccugugacccacucugacaagucaagauuuugaaagucuacucucuauguucacaggaagaaaaaguggcuaagaauucugaggggcugaggacauaguucagugauggaugcuugacacaaaugcagaaggcuuuggguuagcucccuagggaaagcuggaaauagaaaagaaaaggaaaggaggggaggggagaggagaggagaggggaugugggggaagauacagggccagaggaacaagaggaagaagugagagacagauuggcugaaagaaagaaaaacaccuagcacagguaguuuagauuguguuuggcuuuugccauucugggaaucaaacuaugggcucacauaugcuguagaaguuuucugccacugagcuacaucucuagcugucaauaacuugucagagagcugaggucccaaggcaaaccaccauuccaaaacuuguguagaaacagcugaauacagaguggcagagcuuaccacaggaaagagcugcuggagccaguaacuaguaggggugcuuagaccauaauuaguggacuugcuuaaacauuagacuuaauggggcccaaucugaaggggcuaccccaccuuuacuucaaaggcuugcugaguuuccaggaggaaggugagagaaacaaccuuugugcuuuggacaggugaaacagaaucauuucaaauaugcucauuggauucuguuauuccuaaccaacauauguuucaagagaaaaacacucuuuccuagccuuaucugaccuagagaaugggcuuuuagcuaccuuugaccuuccaccacacccacagccuuucugucucacauauggagaaagauauggacaaaagcuguccuucugaaggauuuaaggacuuugaaguucugagacuuuggcccagcauacaacaacggagcuagaaacuuagagcauuaaacagauugucagaaggggaggagaauauucuaaacucacacguuaggauguucaagggagaggagggcauuaacgcggguucccugggcaagcacaagucccagaucccaugugagcagccugcaggguagccugcugguuauugccuccucccuuccgacgcuugauggggccuuguggggcagugagagccaguccucaaguccugaguucuagauggagcaguucuguugcuuuagucuuuuaauccaggugaggcuuccgugagugagugagcgagcuguguuugcaucaguuccacuccagcuuuuccuggcuuccuccaacugccuacuggcaaauguaggaagccauuuagaauuguuuuacucuguguguguguacauguacgugcacacacguguguaaauuuuuauaugcacaugaccuacuucauccaauuacauugcccuuauuugcauauguuuagggcugaaaaguuaggauugaggucucguuuugaaauaaaauagcaauaccaggaaaaaaaaaaucugggucucccccccucaguaccuaucgguugccuguaguucuucuagaaguggaaccuuguuaaaaucuccucccauucacagaggcgugggcacgguauugucuuugcaggucucaagcaggcagccugagaguucaugagagcauuccugguuuguugaaaagacacuguuaagcaguaguugaccagguccucauguuuuuuacagucagucccccuuuuccuugauguuuccugagccuuaggcauaacguuguguuauaccuaaggcauaaccagacagcccaugcucacugacuuagucucugcguuuugaccacuuguaguucucucuaauaaccucaaaaacuguggacugaucccuaccuacuagauuagcuaagguugagcauccagaagucaaaaagauucuaagagcuaaagcuuuuugaacauggugcuggcacucacuaauguugacauuaccggcaugagcucagucugaaggccacacugugguggagagaggccugacgccuacaaguuguccuugagccugccucugccugccugccugccugccugccuuucugucugucugucugucugucuuucugucucucuuugucucucucuccauacaaaugaguaaucuaaaaaaauccacaaaaaauucucaaauauguaaguaauaucuauggcuguuuuuauguuaaauucugguuuccuccagauuguuuuugucaugguugcuguuguauuuuuguaguuuugaauggguccuguacuccaugcuggccucaaacuugcuaccaaacuaagaaugaccucaaggucauucuuuuaguccuccugugggcaccuucugaguuuuggaauuucaauuuuggguuuguuaguuuguucuagagacuuggccauuacuguauaguugaggcuggccucaaacuuauggcugucacugucuccuuaugaauauugagauuagugggagccaugcacuugcuguuauaacugcuccuuuucuuuucuuuucuuuucuuuucuuuuuuguagcaaauuuguuguuuauuucagugaggaucaggucuugugaggggugauuuuuguuucaauagucauguauguuugguuuucccuuuccuuuguuacagguuagaacccucugagagccuugaggagaaccagaggaaccuccuucagaugacagagaaguucuuccaugccaucaucagcucuuccucagaauuccccucacagcuucgaagugucugccauuguuuguaccagguaugaugaaaguuggagauugccacucuaaguccaaagccaacugagaggagugucgugugcagagucagcugcugaccaucauuuggacacguacuauaauuaggauagagagguagcuaaguagguaagagcacggcugcucucacagaggacccagguuugguguccgguacccacauggugguucacaaccaucuuuaacuccagucucaggggagcucgggcugucuucugacaucuucaggcacggggcaugcauguggugcauauacauacaaucaggcaaaacaccuacacacagaggauaaaauaaaccuaaaaaucaaucugaacgagcuaucauuagauuggcgucacauuuucuucagagauauuuaaagaacuuuaaggaaaauaaauuagccuuccuuguguugaaagcaacuaauaauucacuauguguacugaaaugagguauaguaugcauuuuugcuuaucuuuugccuaaauuacuuacaggaacuuucccacuggaggcaaguucauugcuuuuuugcaguauaaaugauuugaacuguaauuuuggcuucuccuauuaagagaucacugguuuaucuccuguuuucucagguuaggcuaauugucauauguauuuuauguagaguacugcuuguaagauagagaccacaccaugcaguagcuaacagacuuuuuaacccagucacagcagauagugcugcuaaauuuagauguccacaaagauucuuucuguguugaaagaacaaggccuguguucuucuguaacuucugauuuugaauugaguaugcaguuuuaggaauaauuuauuuauuccgagggauugccuauaaaucuguauuaauuuuucaaauagggaaaagaaaacccagcauagguccugaauuuuggaauaaggguacaaaaaggaaaggacuuacacauuuaccagaacucaugcauuucucugacuuugcaguauuuuuuuuucuuuuuucuuuucuuuuuuuuuuuuuggcuugcagcuuuaguugcuuagagacauuaacaucaucagugaaacaccauuuaaaaaagcugcaugaggcugcuaugugaguuuuucuccauugcuauuuuaaaagauauaucucagugucuauaaaaagaaaacuuugcauacauaaaaauaugauaaaauauacuuagcauucaguuacuggacguguugugacuuuacugcguuuucagaaagcucugggaagcuuaggaggcuccacauaggucauccaccuagucgggugugcagcuacaggguggguuaacuagacuguggugggucaucccccuagucgggugugcagcuacaggguggguuaacuagacuguggugggucauccaccuagucgggugugcagcuacaggguggguuaacuagacuguggugggucaucccccuugucgggugugcagcuacaggguggguuaacuagacuguggugggucaucccccuaguggggugugcagcuacaggguggguuaacuagacuguggugggucaucccccuaguggggugugcagcuacaggguggguuaacuagacuguggugggucaucccccuagucgggugugcagcuacaggguggguuaacuagacugugaugggucaucccccuaguggggugugcagcuacaggguggguuaacuagacuguggugggucgugcugauuacacuguuugccacuagacuuuaauaaaaacucuucauguggcuguucccauaaugaaaaauguauuuguaucaucagcaaacuugggcaccaguuugagagcacuauacuaguaaaguaaaaagaauuggacacuuaauaaguaugugggaaauauuucauuaaggaauaaauuuuaucauuucuacacauuuaaguaagcaggauucuugccagccuuccuaguuagguuuguaaggaaccaugaacacaaggaagugcugacugguggcucacucugugcuacccugcgcugugcugcuuagugcgcacuugacagcagucugcauugccugcacugcaguuaccacauuaaagcuucauggaaacaccaugcagauguuacuuacguaagcauuacuuuguaguggguaaaguuagugcagacuaccauggagcagagguuuuguuguaagauuuuuuuuuuuuaaugagcaaauauuacagugaccaaagacaaagauagaaauaaaaaagcuucagacccaaugcauuuuucauugagucucuggucucuguccuuaacucagcuuccucccucccuccagaucucccuccagaucuuccucccccccucccuuccuuuguuccucuuugggcuuugcuugcccuuguagcuuuggcagugacauaauggcacccuuguacuuuuaugcucugcugggaaggaugggaacccauuuuuucuuuuucuuaguaaacauagcuccuuugaggauuuacuggggaaacuuuggaagcuaagugaguauauugcuagcugauuuuuacuugaguucagauuugguuuuucaggcuuuuuuguaucuuguaaucagcucuauauauuuuccuucuuagaaaagaugguuaaugcuauguaacaauaauacauaauacaauaauaguuauaauauguaugacagauuuauuuuuugucucuucuaaccuucuuuauuuuuuauuagauauuuucuguaugacagauuuauaauuaaauuuuuuucauauacuauuucuuuucuuucugauaaauuuggaacaaagagaaaauaauuucuagagugaauguucaguucuggugagaaagaugggaaauagcuacugugaucuuaaguaagcauugucuuucccacuucacgugagguuauauauguguguuaaagcucaaugguagcugcauaccauaauugaaaaaaaucuggauauuuacaugguuauauuuuguaaacugccuuaaagccugaagcaaagcacacugagaugagcuuuuaccucugcuuccuaggccuaggauggugcuggcgucuagguauacaagagcugcuagauggauggguggaugguggguggauggugggugauggguggauggauagaugauggguggaugguggggggauggugggugauggguggauggugggugauggguggauggauagaugauggguggaugguggguggaugauggguggauggugggugauggguggauggauggaugaauggguagauggauuuaaaacugaaggguuucaauaucuuagaaaucuagaucaaaaauuuguauuaugguuagugucuuuuuugcccagguuugccuugaacucuugauuuucuuccauucaccucccaaaggcuaggauuacaggcauuuaccaccauaacuggcucuuauccuaaguuuuuaaaauauuaaaaaaaauaguugguauaaucuaaucagaaguuuuaacuuugaagaagucuuuauucuagagauggagcuguggugagacugacaccuguguggguucacauggaugguuugggcuuuugcaugggagagggcagucugguaaaucgccauccauaaugaaugacauuuuaaaucagauuuaaauuugaaucuacaauauuaucuucaauuucuuaacuuugguauuaauaaacuuuuuuuccuaguugaugcuaacauucuuuuuccaaauacagcggcuuucaauaaacuuagcaccauuucagggaucacucugugggcauuggaagaugugagauuauaacagcacuccauuuaaaagauggaguucagagucucuaaacuuuguuuucugcauaucuauccauuuaauuuuuuauuuaauaacauaauuaacugcuagguguuggaaaaauaacucuuaagucaauugaaggauacacagagaaguauuuuauauaucagaaaaaauuauguagacacaauguuuacaguguguggucuacuucauaauaaauauuuuaaguaaaauuuaucaaaagcuaggaauugacucaaguauaaauauuccugagauugcuugaggacagcuuuuccaugacuuauagccagaaauaguagacaugauugggucucaccauuucuugcuguuuauuuuaugcuuggcuuaaaaguguaauaaaaauuaaaauccaggauuaaacuucaucccucaaaauucaguugauuucugccuuucuguugguuccauuuguguuacauuuuaccgugaaguuuguguacaagccaacauuguuuuuguugcuguauguagccggugcugugacuuguuugugcucaucucuguucuguaggcaacuugccacucccuacugaauaaagcuacaguaaaagaaagaaaggaaaacaaaaaaucaguaaguuuggagaacuuuuuauuagcuguuucuuucgaagcaaaccccaaaucuuugcuauuuguuaagaacaucuucacuucagcuauuugaccuucacugugaaaucauucuacuaauucuggcacaaaauagcucucauuucgauuaacccuggaauuaaguuacauugaaacauucucuguguuccuuugguuugauuuaccccaaagguauuuuuuugugcauugauuuauuacauugaauauccuugaucuaauuuuauuguuauuuuuaaaauuauaaaugaaugcgaaagaaacuuaauuucaaggccuuaggggaugcugacugucuucauucuugcuucucguuugcgggucaugugagugguuucuuuuucuagaaacaaaagcauuucuugauaaauacauuguggguagaaaugugaccuucuccugucccaacagacauuaaauucaggacgcacaugcuagagcuaccaaaaccaaggaucauuuccuaacucuaaucucaaaguuacuaaguuuuaauguuuacuccuuauauuuuuaccuugauaguaucagccaccccugauuuagacauuugugcuuagaucauagaaauuuuaaugcugauguuccuuuuaccuuagaggaaaugcacauuacaucucugcagugaggaggaggcucagugaggccaugcucacacaggagcccacugugcaaacgugaccugaguauauugccugcuucugacuuggccgucuugugaaaggaagaaaguuaugauugccauaauuauuuucuuccuacgaauaucauuuguucacaguauaacuugcauucauuuuuaaaauaacaucaucuguggaugugacuuaccauuauccaguuuaguccugucuuuguucacuuaauccaauugauuauagagaaugauguaauuaaagaaaacccccaaaaaacaaaacaaaaaaaacccaaaacaaccuuucacaaguuguagggaguuuuauuaaaaaggaauaauuuaaagucauauuugucugguuucaucuuucauuuucuacuuuuacauauaauaaagcuuuacauuuauaauuguauucaaaauucagaacuaaauuaaacuucagagacucauacuuuuauuauguccauucagaauuuucuuuuugaguguacuaugugaaauugaucaucucugaacaaauggauuggauuggauggcucuccugcuuaaaacauuuuccucuaaugcuucagccuucuaauucucagcauuguggguuuaacauuauacaucaucacuguggaaauuaauuugcuguuucuaacauucuuguuuacuguuacacuaaugucauuguguagcauaacauaauuaaagucaggcuuucuguguuucucuagagcauguauuauagcuuuccuaacauuauuaugguuuuauauaaaaauuccuuggaauuuuuuaguagauauuucauauauguaugaaauuuuggaauguauuucucagcccauguggcaguccuuaggaaacuaagggggucuaauuggcaguacuucagaacagauucuauaguauaaagacaugcuaaucauuauaaauuuagaaugucauguuuugaaaguuguuuaacggaaucuaauucuuucuccuuugagagcaagcugaccuccuuuguaauaagugaaagaaaguuucgaguuugggugauuagcuauguugacagcugauucaguugauuguacucaacauaguguguacuuagauuacuggagcggcugccugccuaacucaagacuuucaggauuucaccauguauagcuagugauccucugcugauauguaauuuauuauaugauuuuuguaguucaacuuuaccuagggaagaguguguauguguguauguguguuaggggcaagggauagcugaucauugaccuuacauguagaauaucauuuacauccaaauuagauuuuuauacacuuggaaauaaagaacaacaugccaggcaugguggcacaugccuuuaauuccagcacucagaaggcagaggcaggcggaucucuugaguuggagacaaccuagucuacaaagaaaguuucaggauagccaggccacacagagaaauccugucgcaaaaugccaaaacaaaacaaaacaaacaaaaaacuuaaauaugugguguuggauaaaauuccaaauugauguuaaauagaagugaaagaaagaguaguccuuuuauaaauugacucaugaaacuuuuuauacaguaucucuuuauuaauuuuaauuguuagguuuuaguuccaaaaauauagauaucacugucaaggagauacauauuuacaauaugugaaacuuuuucuuuuucuuuuuuuuuaagauuuacuuauuuuuuuauauauuuuaugcauaugaauacaucaccacuguuuucuucaggcacaccagaagagggcaucagaccccauuacggaugguugugagccaccaugugguugcugggaauugaacucaggaccucuggaagagcagucagugcucuuaaccgcugagccaucucuccagcccugugaaacuuuuucugaaacaugaaguuuugauaauauuuuuuagagaucuggaaaggguuaaaaguuauaguacuuucauauuaauuuuauaauacucuucuuagaagauaauucagacuuucuuaugaucacaagcugaguauuuucaaauauaaacgaggagacaauguaaguugugcuuuuauaagaucuuuauuucuagagacaacgagcaaguagcaaguuuuuguauuuuuaaaacaggucuuaagugcuauaagcacccaacagaccuucauagcaggcuggccugaacucaaggcagugcucuuaccuucgucucuccuugcagggauuacaugugagaacuaccacacccaaccucugaaacaacuacuuucaaacauacauuauaaaggcugugugcagccauugcuaauacuuauaaagacacuuucauagaaguuuaauaaaccaacuccuuccuuaagggcaaacucugauguugguugagccuauuaaaacuauuucaugauuuugguggguuaaauugauauuauuauuuuuaaaacaaccugccaaaaaggguuggagagauggcucaacgauuaggaacacugacugcucuuccagagguccugaguucaauacccagcaaccacaugguggcucacagccaucuguaaugggaucugaugccgucuucuggggugucugaagacagcuacaguggacucauaaaacaaacaacaacaacaaccccacccugcuuaagauaaaagcacugauggacuaggagcaugacgucccuaaagggaguguuagucuucuuccuucuucaugauuugcucccaaaacacuucauggucuuguuagcuuacugguauuuuugucucaguuuggaaauucuaaauuuggaaauucuaaaagaacuccaugucaacguuggucuuugcacauguugaaauuauaugaugaaucugauauuugcuuuuuuuuuuuuaaucagaucugagauucuaguaccucaaaaguuuaaaaacuguccuagaaaaguaaacuugaauuuucuuaguuuuauaugcaaaacucuauuucagcuaaaaaaacacagcuauauuuagccaacuccccaauuucucaggauuuccuaagguucucccugggugcuguaagcacacaaaagaacuguaacccagagaagcuccccgagccacggcaccguauacaaagggaacuggagcucacaaaccucucugagcucguuccuacgacuaccccccaaggaaucauuuucugaaaucuuuuucuaauuuuuuuuuuaucagaaacaauagaaaauuauuuugagauuuuugggccuuggguaaggacacauuuaugauacaaccccuagggcuggagagauggcacagugguuaagaaaaacuggcuuuucucccagagggccagguucaauucccaguaaccaucugugauaguaguuccagcagaucugacacccucuuuuggccccugaggguaucaggcuuguaagugguguacagacuuauaugcaggcaaaaugcucauauccauaaaaaaagacauaauaaauaaauacauaaauaaauauagauaacacaaagcacaaaguggaucagaauaaagugaaauauucaagaguuaaucugcaguugagucugugaauuaaagacaaauauugacacccaguaaagaaaaauaaaaugauaaguacuucugcacauaaacccuguuuucucauuucuccaccccaggagccuuugagaugcaggguguccuuguguucccauuauugugagugcuacggcuccacuaucacaguuagccacagcaaaugagaauagcuuuugacuauugcauguguucuuuuaaaaaaagaaauauguauauggucuauacaaaaauuaaauucuaggauaauucaguuuccaaguguuagcuuaaaaugggaaguauuaggaagaggucgaagggcagccaguucuaugccauugcccccugucuggcgugccuguuccuuugcauccuaugcagaacauuuuuguuauagagagaauagguccguuuacauugccuuccugugacuuuucaaggagagcagcuauuuccugggcccugaaagauuuuguuuuguuuuguuuuugguuuuaauuuauuuuauuacuugcuuggcagaagaauaaauugagguauguggagcgugggggaucugucuucugguaggauccuuuuuucuuuuagguucccaagaguuccuguuucuccugugauuuaaauaauagguagguccuuauauuaggaagcaugcuuaugaagaaaaguggcuggcaggaacauggcuuguaaguaaguuuuuucacucaguagaaaucuaagcagagauguguaugguaaguugcacugaaaugucaauuuuaacgggugugcaaaguguuagcuauuccucuuaggaauagaguauguaggaggugcuguuagaaacucagcucuuauaaaagucaacuguacuuuuuaugucuguugaugauagaaaaauauguuaaccuuugugugaaauuaagucuacuuuuguuggcuauaaugauuaugaaguaaaaucuuuuuucagguuucuuugaggagauuuuucuucucuuuuaauugugucuuuaaaaaaaaucacacaugauuacaguuaaggauaaaccguauuuucugguguuuugggacaaggaaaaaaguuaaaaacagaucauucaaaagauugauaauuggaauuuugugcagacuuugaccuugaagccuuuguuuccacuuauauuucaacacaaacugucugcucaacucucaacuccuccuccucaggugguuagccagcgcuucccucagaacagcaucggugccguaggaagugccauguuucucagauucaucaauccugccauugucucgccguaugaagcagggauuuuagauaaaaagccaccaccuagaauugaaaggggcuugaaguuaaugucaaaggugaauuauuuugauacucuuacaacguuuaauuuuccuuauagcuaauuuuucaguguuucauauucaaaguacuuugucuucauuuugcuucaguuaugugccuuuuguuuuaauuuguuuguauugcagaggaacuuuauauacacacacacacauauauacauauacauguacauauacauacacaaagugggcacuaugaggggaagguauacaagcaaauaaguaucuaauuugucuaaucagugaggguuuucuguguaacugcuuugaaaaauuugagguggaaauaaagaugcagauuguaggauuucuuuagucuuuauuauuguuguuguuguuaacagcauuugaaacugugaacaugagccauguguaaagugccuaccaugcaagcaugaggacuguggcucagaucccccagcacccauguaaaugucagggguucaugacauucagccuauaaucccagcaugcuggaggcagaggcagggucccuggaacaagcuggcuagcuagacugaguccaaauacuccaaucaugugaaagaugcuguaauauagaagaugggcaaugauggggggaaauagcgucaaacucuggccuccauaugcuugcacacauguaccaacucacacuugcaaacgugugcauauaugcacauaucacacaauacacauguaauagauacuuuguaucuauaacauguauaauaauauuucuacuugaaaagaauuaaaacaauauuuaggauauuuuuuacaauaaugaauaauugauuugaacugccaguagaaauaucaauggaaaauuuauauuuuaaugacuauauuaauuuauagguuucauauagcaaauaaucugacuacucauaaucuuguuugauuguuuagguacuucagagcauugccaaucauguacuguucacaaaagaagagcauaugagaccuuuuaaugauuuugugaaaagcaacuuugacuuggcacgaagguaagcagccagagucuucaguggccaccaugucuccauuuuacugcaguccguguaucuggucuacauuaaauuucuguaugugauuccccacccccccaauccuuucuagacuaagaccacauuuuuguucuguuuaacuuuaagacacugagaaaacucucuggaaccuguaaagcacuguuggcguuuucucacuuaggcaaugcugcagaaugggcucaagaagauuccucguauuaaaaaccauaaccaugcgauacagguuaugucagggugcuuuuauguuaauaauacuuuuguuucugcaguuuagaagugucucugaauuuaaaacaauacuucauauaccaaaauguacaaaaauauaagauuuugagugcgaagaaacagauaauuguagaggcuuuacgacugaauuuucauaacugauucuucacuuuaauucucugaauuguugguuuauuuguaaccuugggguaguacugucuuugccaggguuacuuuuuuaaaaaacaagugagaugauuccugggaaagugcuuugugaaggugcugauguucagaagucauuugccagcacgagaaacugaagggacuggaaucugcacacagccaccacgaccaagugcucagcacagaugagauuuauuucucacagagggacagagagcaggaaaugagagacaaagacaggagauagaggauaagggagagggagaagggauguuugucccggggaacagggguugggcccuggaaugaugacaaaggccugccucuggauagagaggagacagacauagcccauaggcaaauggcaguuuauaaagguaaaaaggggacacccaguguuaggaugagguguuugauuuuaguggccaaagcagggcuuuugacugcuggacuuccaauacauagauaauagucagccucaagaggaggaaguggccaaauaagggacuagaccuuaguggcuacuuuuaggaauguaaucuaacaguguuuagcaaaguagaggggauggggagaagggcaaagucugccagagccacguuugcaggcuugagcuggcagaaucccuucagaagccuagcugaugucacucaugucacgcauccuucugcagcugcccuuccaguuuguugucauacagugcuuccuggccuuuggugucuucagguagaaaauaacuauuaugacuacucacagaugguuaagacuaccaaaguuccacuccuggcucugacaggcagcugguguaacuuuaagagaagucuuuaccuaggccuccaugucuuuuaucuguuaagauacuagcuuguucuccagauuuuauccauauaaauuuauuguucuccaacuucagaagacugcucugcaguugaaguggaaacuaauaucagaaaugggaagacaacuuucuccuugugcuucucauuuacacugagggcauaaggcccccuccuuugcaaucacagcuacuauauuacuagacucuauauaaauguaaugcauaaguauaccugggguuaaaaauucuaauggcuuuguauuuuugcagguuuuuccuagauauagcaucagauugucccacaagugaugcaguaaaccauagucuuuccuucaucagcgauggcaaugugcuugcuuuacaucggcugcuuuggaacaaucaggagaaaauuggccaguaucuuuccaguaacagguauauuuuccaagucuuggggaaauuaaacacuuaguuuaaguugaauuaauaaaauuauugauccuaaauauugaucuucuauuugcacauuuuugcaguauuaugauuuggaaagagaagcgcagauucacaugcauauggcaaaacuuaacucauguuauaugauucguagcaccagcuguggaacuacaaguuccacaaucacagaugcuauuuauuaaguguaugaaaaccaagcagcauauagaaaguacccagucagucaggcacagugccaugcuuuuaaucccacugugugcaaugcagaggcugguagaucucugugacucugaggccagacuggucuacgugagcucugggccugccagggcuacgugguaagaccgugucuagagguaaggcaaacuagagagaaugagacgagaugcaguaacucaaaguauuuggaaauuauuucacuagcuuuuuaguaaaagcuucuagugacauaaauuaaccugcuguccuuugucagaguuauuuccuuuuaaguuuauauagaauuguaaagggcuccaauuucugugucugaggagaucacuguggcuaaacaucuaggagauggaaguuuaaaaguaaacuuguuaauccuuuauggaguguuuauggguugauguaggcauggacauggcugacaugugccccugaagcaggagaaggaaaggacuuuauccuggcaguacccaaguagccuggagcuuugcuuagcuuuguuuuuuguuuuuguuuuuguuguuuuaagacaagguuucucuguguagccuuggcugcccuguagaccaggcuggccucaaacucacaaagauccaccugccacugucucccaagugcugggauuaaaggugugcaccaccaccgccuggcuaauaaccuggaacuuuuaaaaaugaacauucucuucuuuuuucaugauuugaauacauaugcacaguuuguugaaauuuuuaaaugugcuacuuuaaaaaugauacauauuucaaacaugaaaauauagacaaugauuugauaguuucaugucugcucacuagcuugaauauccuguaauuuugauauaaccacuaaggaauaggggguuggggagaacacacacugaguauucagacauauaagccuauggggcuauucuuauucaaacuaccacauugcucuuccaguuuguuuuccagcacccauggcaaguagcucacaacuccucuuaauuccagcuccagaggaucugauacaaacuucuggccucauacacaaauacacgugaauaaaaaauaaaucuuuaaaaacaugauaugauaccagcauuugggaggcugaggcaggaggaucaugaguuugagguuaaccugagcuaacuauaauaagacaaugucucaaaaaaaaaaguccauaaaagaucaucaguuacuaugguuacauaggcucaugucccaaacacgguuuucacaagauagagucuguagaugagaauguuagaacuaucaauucuaaaaaacaaaaacaaaaacaaaaacaaaaaucgaacuuaaaacaguagguuuuacaggugggaaauaauuguguuucuaagaucugaaaucuuucgaugcugcaaacuuacaaaucaggcaggaacaguaguuagaagaaaagcaagcgguggcagucuaaaggaaggucagacuccccaauuaaugugaagugccauuuaauaagcauuuccuguuguuaccagggaucauaaagcuguuggaagacgaccuuuugauaagauggccacacuucucgcguaucuggguccuccggagcacaagccuguggcagauacacacugguccagccuuaaccuuaccaguucaaaguuugaggaauuuaugaccagguaaaacacaacuuugaaaggaugaauauguuuugggaggugugaaacaaaguuuauuaccaaaccacuuacugaaugugcucaugcuguauuaauauagcauguuuuguuuugcuuugauauauugauuuucuuauaaaaagaacgaugucuuacaaaaaagccagcuuuuuuuaaaacauuuguuuagugugugugugcuugcgugcgcgcuuguguaccauugccagugugaagucagagaacaaucuaugggagucaguucucuccucacaccgugucccacgggaccaagcacaggcugucaguucaguggugaguacuuucagcugcugagccaucuugcaaggucucuuuggcguagucuucauuuaauacuuuaaagaacauauagagagauaccauuauuuucauguuauaguuuuagaaaauacacuaagcagacauaacuuauugaccugaauucacaccugcuuuaugguucuuuuggauuuaaauccuaaguucuuauuaccguacuaacccuucaaaaaguccaugguucuaauuuuuuuuuuuuuuuuaguuuaagacucagaaaauauaguacacuuaaauacugcuacaacaaacauuguuuuauaucucauuuagaggacucuaaucuaucaacuaaaagauucucacuaguagacacacacuugauuauauuucacaaacaguacauugugaacggcugugaguugguuguuuuauucauaggaugugccaaugacagaaggaaaacauucucaccugauguucagaaguuaauuuauaaaaguuaaguuagacaguaagagccuacuuuggggagagagggaaagaaagggaagauagugugagaagauccaagucuguaagaagaaagcuuuguucucuuuaguaaggcuaagccuugucucucuacugcauucuccucuucuugcucucuccuccugcucugaugucacaguaaugcucuuacucucaaugccuuuucucccaaugcuaugccuuuacuugugaguuuuucuugaguucaguucugucuaaaaaguucuccuuuguccugacuaaaaaauuauccucaauucuguucuaaaaaguucuguucagauaagcuaaaaaauucugucuaaaaaguucuccucagcucaguucugucucuucucugugccucagcacuuauacaucuuuuugaauauaugaucacaugguaaaaauuucaucacaaguuuacacauaaauucaaaucauaaauugaaauagaaguuuacaacggagaauuuugacaugcauauccauuagaaguaauuauuuggcuaaacauucauuaccagucauggcuccacagguucauagagaauugaaaaccauaacuaaguuauuagugaaguuuuguauagauaaacccaguugacaucuucuguccuaguaucuauaauaaaucguaguucccuuuuuaugccuuugguuaaugguuuuacaacuuuacaacuucuuggaauauacucuugaauaguagacuaucuguuuacuaucagaagcaauuaacugguggcacaugggagacuggcagaguucucauugcaguuuugacuaucagaaaaaaaucuaauaguugcacuguaaaagagcuuaauaaauacugauacaauuuuagaauuucucauaguaucagaaagaauuaggaagucaucugucuauauagcauuacuacaagacaguacgucuucauagaucugcagagaucugcucaaaaggaugggcuaauaucuagugauuaaaauauauguaauaauaacaggagaagcauaguaauagcaggaaucucuccuaaaauuauuuucuucugagcugugccuucgggagcaaauauguuguggauuauauuaguccuccgaggaacacuaucucaggaagaucaccugcuaguuauuagcuuguccugugaugaauucugacacuuucucaccuuucuaaaaaccauaaaugagaggauugaugaacugaacuugcaaggaaaagcaaacuaaaaauccuuuuaucugaaaaaagaaguagcauggguaaaaggcgagcaaccaccaugcauguccaggggugguguuaaguaaucccaagagagucauccugacucaggaacacaccuugacauuuugcccuucagaaaacugguugcuuuuuagguauuuugcuuuuugguguuuuucuuuuuauuguugauuaaucacauuuuucuuuaacuaggcaacaauuuguauaaagacucuuaagugacucccucuuuguuuuaggcaccagguacaugagaaagaagaguucaaggccuugaaaacguuaagcaucuucuaccaagcuggcaccuccaaagcugggaauccuauuuuuuauuauguugcacggagguaagaauacauuuuagucucuuuuaauaggguuuuucaagugauagcaauugcagaaacgugaugcgauuuuuuuuuuuuccuucuugaauuaauagcccuuaaagccaugccucccuagauaguaugcuuacuacuagguauuuguuugagaguaugcacuucauaugucuuugcuacaucagauguuaaggcaccaccacaaggaguuacuaucagagugaaaagucuuucggguauauucugauuuuauaauaucugcaacacaaaaaucagaacccucccuacacacacacacacacacacacacacacacacacacauuuaagaagaaagaaaagcuaguauauuguaugagacuguaucagagcaauuuuaucagagcgauuuaagaaagaauuacuggagcuauaggaaauggcuauaaagauggauaggguggccugggaaauagacugugauguccucagccaugccaugagcuguucuucuuccucuuccucuucuuccuucuccucuucuuccuccuccuccuccuccuccuccaucuccauggugaugggcuugccuugcuuucccugccaugugaaaacuaacauguggugguacuugguuaggcucucuucuucccaugagaauggcacaacccacaguggcugaacuuggacaaaaagugauacuacauaguggcccaugauaacgagauguuaagggcaguccagcagcucuaggacuuagucuucucaaacuuaacagaaauaaaggaauuauguuuauugacuauggucaugcaaaaacguggcagagguugagaaaucauacaaagcaggagaaggaagaagaaugagaaacgugaaacuuuuuaaauuagauacucagcuguccagaguucugaguaacuggggaauagaaaaggaacaggaaaacacgcuuaccuuuguccuuuuuuuaacaacuuuaaggaauaucuucuaauucuaggcaaauguguuaguccauuuuuaaauauagcauuuaagaggccaaggcaggaggauuauauugaauuagaaguccacccugggcuaucucaaaagaccucucccaaaaaaugggaggaaaaaacgacccuccuuaucucuccacaaaacuguucuugucuugguuguucuuucuaagauaauuuuaguuuucugucuuuuuuuuuuuuggagacaggguuucucuguguagcccuggcuguccuagaacucacuuuguagaccaggcuggccucgaacucagaaauccgccugccucugccucccaagugcugggauuaaagugugcaccaccucgcccggcaauuuuaguuuucuauugcauuucagccuuguugguauuucagcuuuaaccuuuaguacuaucaggguauuuugacuuuucccugcuauaucuaaguugugaggacugguaaggaguguguuagaugugugccucacucccagcccccuuugaauucuuuguaguuuaaagguagcagaauguuggauuuuaucuuccccucuuuaugauaaggaacuguaaguuuguggccuuuuucucugguggccuagcagaggaaaagcagauuggccuggccuuucgacggguuuccacagcucuaaaucaggccugcacaccuuagguuugcaguugccagggauccccagucugcggcuuauuagguguucugacucuucauuuuugagaaggaagaaaauaugcuugcuaaacuucugugucucuuucgguguaauuuuguaacaaacugaguuucguguuuucuuuuucuggauaugauauugccaaaucaaauuuucaguacuuaggaguuuuaguuuuugcuucauguuuugaaauguggccuuaccaaguagccugucuggccuauaacucaagaucauucugcuucagccucucgggugcugggucuuugggggcuuuuuuguuuuuguuuuuuaaauguacaugaacaugcuugucuaucuguguauccugcugccuucaagaggcuucccuggagcugacguuauaggcaguugugagcuaccauggggguguuuggaauugaaccuggaucuuuuggacacauagcuaauucucuuaacugcagagccaucucugcaguuccugagugcugguccuaaagccaugugucaccaugccuuuccuuucugagaucugggagagcuucugcucucacuuucacuggguacaaugccuaccugcaggacaaaggggcacagugggaagagcagagagaggcccuguuucucauugugacgguaagugaaggccuuaucuguacaggcuucugugacaaguggcucuggagucuggcuucuuuggugucuacagacauuugaagucuaaaugucuuuuuggccucaucuucacaucauguguucuuucccugucaucguaagacucuccuuuucuuuccuccugcccucugugggaggcaccugugaaaucggauggauccgcugagguauuuaguguaggcuuugguuauuaccaagucucuuauuuuaucagaaagugggccuaaagaaaaccacgagucaagagccauaccaggaagaaacaucacuaagccauaauugcugcucuguuucuuggcuuuguguuuaacuccauuacaugguucucugauuucugugucauuucagcuuuagcucagccagugaccccuucauuaccucaauauagcuuaccugacguucuugauaugugguucagcuggaaaguaccucaguguucaucagugacuguccuuacauacagguuuacuuauuuuaaauuggaucuucaugaucuauucauuaucuaguauuaccaucuguuacuuuugaaaugucuuacauuaaguuuuauuuauuuuuauuauuuuauuuauguauaugugugaguauauacacacacauaugcauauacauggaccauacacacacacuccccuuguguaugccuuaugaccuuaaggacagaaagggcuguagcugucagugguuuguagucuuccagccuaaaaagcccuugucacccacuugaguagcaccucaggcuuuacuggcuugucuugaguuucuugucaguuucuuagacugucacguuagcaaggaacauggauuauuugguucgucaggccugggucaugagcuuaugcuuagagcucagcagugcauggauggcaauaguauauuucugucauuugccucguguguguguguguguguguguguguguguguguguguguguguaaguguaauuaaaauguuaaaaccuaagcauuucaguugagaguuuccucuuugggauacugugauuauucacagcuguuuggaggagggcauuaauacaaauuauaauucauauuuacuuaauacuuucuucacaucaaacuacauauuguauauuauauaauuuuuuauuucaucccaauauuguauaauuuuuuauuucaucccuaucauaaccuucugagguauuauuugcaaucuuugacaugacagaaacucaauccugguuaucagaaaaaucuaaauaacagcauuuucuaagcccccugagcuuccacaucagaaucuaaggacaaggcuucuuuuuaaauuuuuucauuaauguaucuauuuauucacuuuacaucuggaucacagcaccccuccuuccucuccucuuaguuucauccucacaaaucccucuccccauuaccccuuuucuucucugaggagaaggggagccuccccuccuuggguacuaccccacccugggacaucaaguugcagcaggacuaagaacauccucucccacugaggccugaccaggcaguccagauagggaaggggaucuaguggcaggcaacaaaaucagagacagcccaugcucuaauuguuaggggacccacaugaagaccaagcugcacaucugcuacagauguguagggggcucuaauuccagucccugcaugcucuuuucagccuuccaugggcccagguugacucuguauaucuuucugggguacccuugaccccucuggcucucucaguccuauaccccacucuuccacaaggcucccccaacuccuccugauguuuggcugugggucucuguaucugcuuccauugcugcuggaugaagccucucaggagacaguuaugcuaggcuccuaucugcaagcauagcagaguaucauuaauaguaucagggguuggcucuuucccaugggauggaucucaaauugggccagucagugguuggcuguucucucaauuucugcuucaucuuuaucucugugcaucuugugggcagaacaaauuuuggguggaagguuuuguggguggcuugaugccuccauccauuggaagucccacugacuacaggagguggccaccucagucuccauagccccaacugcuaggguugccccaauagacuuugggagccuuucccaaucccaggucucuggcuagucccacagaugccuccccgcuaauuucugucuucucuccccaaacuguccugccccuacccccaccugauucccaucccuguuccuugccuuacucuaucuccuauccaguucacucccucugucuaccuccaaugucuguuucauuuccccuugugagggagagucauauauccuuggggacaaggcuuauuuuguauauuuaaacuggcacucccaaaugacccaucuguagucaguccacuuggguucugcugugucauuuuacucuugauagcuuagcuaguuagaauugucacugaguuccaaacuaaucuuaaguuguuuuuuuuuuuuuuaagauuuauuuauuauuauacauaaguacacuguagcugucuucagaugcgccagaagagggcaucagaucuuaaugggugguugcgagcuaccaugugguugcugggauuugaacucaggaccguuggaagagcagucagugcucuuauccauugagucaucucgccagcccuaaucuuaaguucuaacucaccaugucaauaacugcaggaauuguuacuguuagcauacugaguuuguuaaguuaaacccauucuuguauauaaacauaaaaaucuagccaauguuucuuuagucucaguacucagcccaagguagaaguaguugagucucuaguuugaggccagccuugucuacauagucaguuccaggacagccaggacuacguacagagacucugacuaagggaaggagagaaagagaugggaaauggacagaaggaaaaggauggaaaaagaaggaaguggggagaaggagaaaaggggaggaaaaaaaguucagcuaacagucaagagacauuuuccuagguaaaaugaguucuuaguucuaagcaucugauuugcaaacaaucuuuuggaaccaagucaauauuuacucagaauacguuccuauuauuggaucaacuguauucugcuuuaaaaagguccuggaaugaucuacugcuaucauacuuucaugaaaguggugucccacaaauggguauguuuguaaaagacuguuguuuauacccuauuugugcuauucagucuauuuaauuaaaaauaauaaaauauaaaacagcuucagcuucccccauaccucucuuuaucucccagcuucuccugcccccuugcuuaaaugccucuuccauaauuucuucucuuaucuuuaauauagacauuugaguuugauucuauuuugcaaacauuuaaaacacaaaugugauguuuugcuuauuuuggcauuuaauagagcacugcacauuuauaggaaggaaaugauuauauuaauguaacauuuaaauuauacaguuaaaacuugccaugguuggggauuuagcucagugguagagugcuugccuagcaagugcaaggccuuggauuugguucucagcucaggagggguggggagugacaaaacuugcccaaacccaaaucuuacuagaauaauaauuucuuccacaguaaauuaauauaaauuuuauuuucuuagugugcuugucauuuaguaaauaauaugaggugcugaagugagcaggcauuugggcucauuucugccugaguauguacaaaagaguaaaaauacugcacagaaaaagggagugaguguugaagacuggucugagugccgugcucccgccugccacagucccugcagucguguuuaugcagggacuugaugaccuguuuccuugccaggugcucuuggagaugagcuccgagggcuuugucccaggauugaggcuuggucuugauauggccugugggcuccugggggaagacgagagcauuccaggacuuggguuucuuguagaauuugaggugguaguuguugugguugugguugugguugugguuguggucaucccaagacucaaguuuuuuguagaauuugaggugguauuuguuauuguuguugcugcuguugcugcuauuguuguugaaauuguucccauaauaugagcacacaugaggagcagggugacagugaaggaaugcuuggucaucguuuucuuuugcuuuaaagugaucauaaaauuuaauacucaguucacaaacacauagacaaucacauaucuuuaguuguaucucuauaguauauucacauaauauaaauggacuuuuaaauuauucauuaaugaccaaauaacaacccuccuuucugaaccucacccgauaacagacuuguuuucuaucuaggucacuaacuucaggaauaagcguucugaauacuagaaggagcuugauuuuguuuuccuguuuugcaaacaaguuaaccaugaggcauuugaaccaguaagaaugggguuggugugaggaacaggacagcagcaaagguucgaccugaaggacuggcugacagacugggugggagaggagaguagcaggaggaggaggaagcuucucgcuuaguaguuuaagggguagcucuacaaauuagaauauuacuuuuaaaucuuuacaacaaaguagaagaaaaaaaccaaccauaagucaaaugauuuccccaaugcuaagguuuccuucauuuuaaccuucuuuagggguagaagagagcaaagggcgagcuguuaagagaauuccauagcuuuuuaaaaaggaaaucuagaauugacuacaaaugagucugccauuuuacagcugagccuacacgagggguacauacagcaugucuagagaugccuauucuacaguaagcagacugagagccugagucugaauccuaguucagguucuuuagccgguaugaaugguaacacagagcaggcuccuauaccaaagggucaguacucucucuagaauuaggcuacuuuucucuuagcauguauucaaaucuaauagcuugcuauaccuguaauaagcagaccccugcuuaccaugauaaaauauuauauuuuuuguucaaaucuuaaacuuaaauuuuaggaauauauacaagaacuucuauuucauucuaauacauaguuaaccauuuucgaguuacuacuaccuuuugauuuggcagacuaguuuugaagauuaugaauucagccuuugucuuggguccuggagaaugauccugaagggaagucucuucucacucuccgaguucuaaauaauauagcuaggagccagucacgugcuuggagccucgccucuuuggaaguaucggaaggagcguuuccaaacaucuaguguaaacaggcagacuuugacagagauuaaggcauucaaauaaaaucuuuguaaagucuauguacuuacuuaaaggauccagugaauaccucacugcauuuaaucuuccugcaugcacccaaauggauugcuucauuggguugacucuaacuagacgaauauauaauuugcuuuguaauuaucaugauuucaaaccaaguaagagcauuaaugaugauuuuaaaauaauuuaggaauuuuacaucuuaagagauuaaauguugauaaauaaagauaaaaguacccucgcauggcacuuuaaagaaagaauuagacauggaagugauagugugagacucaauuacagaaguuuccuuuuaaaaaauguccuaagccaccucucucacgagcugaagucaguguuuuccggggaaauagggcuguguuguaguaacagcuucaucuucauggcaggcaccgugaguguagcaggaauggacacaaggugugguguugguacacaaggaagucacugcgagaguggcggggaacaagccaguacauguccuuacucugugcugaguuuuuccccuccuuugaaugaauaggcaaaugcuugcuaaaucucuaaccucacuuguggaggguaguugugaucauacuuagaaaaucaacaaaagaagccucuuggcaaccagagcagugcacuaagucacugccugagauagugagugucugcuaccaugccucuccuacucccugcuuauucugagaauugacucuagggaauagaguugaaaugguuguagugauguuuacuccuugagcuaacuguggcccaguaauuaauuauguuuuucuaacccugaccuuuugaauuuauucuuuuacuccuccccgccccucuuugagacagaaucuucugaacaucuggccuuaaacucaccauccucuucccucacgcuuccaagugcucagauuacaguguggccaucaagucugccuauucagcuuauuaucaagcuucuaacaacucaaucuugccuuacuuacuucaguguuuucucccuauuuuuucucagagucucuuuguuuuguuuugcuuuauaagauagggucucauguagcccugggucuucucguaaucuguuaauuucauuuaucauuuagccaaaugacuagcugucuaaccuuugguuucucacuaucuuauuuuuuuuauuaaccuuaaugaugcuaaacaaacaaaaauuauuuaccauuauccagccuugaaagaccuuaauauugucauugugucugaaguuuuuuccuuccuugcucagaguuccuccuguggaggccuaccucugaugucaguacccuuuuucuauguaugaacaugcccuaauuuuauggugaagaauuagucauuuuaggaaauugcaguuaucagagucuggguuuuuucuugcccugccuucaggucaagcacaccucuuauucuuuguauuuucucuaccuucuagcauaguaaguauuauuaagacuaggagacacugggauuuauugaaaagcugucaguuuauuucugucucuccaaugauaugauuaguaaugucugaaguagcaacuauuggucauuugacuuauuuccucugugucauaaacauacguucacgaaucaucagccuaaauuuaagagcccacuauuauuuucuggcuucuauuugguaggucauauauacacucaucuuugacaaccuaaaguugaaucaauagaaguuugacacucaaauuauuuggaacauuuuaccuggguugguaugagacuuggacuugguauauuugugcuucuugucuccuuccagcauaucgccauaccacuccugucagccuugugguuaacuaccugggaauguaccugagugcuggugacaugaguugugugacuuguccugggugaccuauuuccauucacucuagacaaagagggaaaugauagaccgaaggagcuauucuuccaaguugugcuaauaguguuccaggagcaucagugacucagugugcagcuucaccaaagcccuugucuccaucagugauggaucucagaguugcaugccuggagucuucucccuccagcaacuacuuaccccuagcauacccuucgggacagggagcguggcuccugagcauuccuucuguccacaugagaagguuaauagauccauuuucaugaggguuaucacgacugaucugaucaaguugacaaccaucacauccagcccagagaaaacaauauguacaucauuuucuggccugguguuuggcuuugaaccaguucuccaaaguuuguuggagggcuucuucaaaacccuagaagagaguagaacuaaaugacucaguagaggugagaaauaaacuuuuguugucauagcuggaaauacuugagggcuguuuauaauagaaacccaucugugcuguuugccaaaucccauguuacucuacuuuacauccugcuucuaccugagauguggaucugaauacagaaucuuauugaacuuuucucaucucugaauuccacuugacuaauagggaauacaaggagacugaagaaagaaaggguaggugagaauguauucucuuguucaccauggcugccugcauccuuccacgagaugaugguuuuguuagguaauccccucucuguauuuacuuucugguaacugcucuacuucagcugguauuucuaacuguuuuuguaauugucuaaagcccugccuuauccuuuucauggaaucucuugggucccaaauugaguuuucuaccaacuagaauuuuacuucuacagauuauguacuguaucuucuucuacacucaacuauuuugaauucauaaauuuaucuugcucugaggauuucaaaucagggucauagauauacacuaaauuugaagauuuuuguguaccuucuuagaaugaggcaccauucauuuaagaauauguuaaauccuuggguaugaugaugcaugccuuuaauuccagcaucugggagguacugggagguacugggagguagacauucugaauuugaguccaggcuggucuacuuaguaaguuccagaccagucuggccuacauacugaaauccugucucaaaaaccaaacagacaaaaaccauagcucagcaguuaacacuugcuccucuugcaaagggucuccuuugguuuccaacaccuacauggugccucacaacuaccuguaacuccaguuccagggaaucuggccucuauagacugcuaaauguacaugauauacacacacacacacacacucaccaagaaaacacacacauaacauaaaauaaauaauaaguauuuaaaauugcugaaaaaaaucugguaaauuauguguagaggugagagagagagugcacacacacacauguggguauguguacauuaguacaggugcucucagaggucagaggcaucccuggagcuggaguuauacguaguuaugagccaccugacuugggugcugagaaccaaacuugaguccuuuggaaaggcagagcauguuagccacugaaccaucuaacccccuguauuaaaagcuauaucaugcugcaaguguguaguuguuugguuuggguuuuauuguuaauuuauugacuuauuuugagacaagauauuacuccugcucagaccaacuuggaauucccuauguaggcauuauugacuuugaacuuaugggagcccuccaccuucugccucuuaaauguuucgauuauaaacauguacugcgaugcccagcuuauaaagaauuuuuacuuauauuuaaaaguugaacauuuaaagcauguugacaauauauagcacagaaaauggcuuuugguguuuccuguuuuaaagauguauuucugguuuuucuaaauauguguaggugcaugugucuguguggggguauaugcaugugggugcuugugcucaaggaggcuagagaagugagaucuggagccuggguucuagacaguugugaacugccugauucgagugcuagggacucuuccucacaaguaacaugcaaucguuacugcugagccaucucuugagaacaguauugcuuuuaaacaaaggauuugaaaauuucccaagguaguagauauacaacuaucccaaaaggcaggcugcuguuagauuuaauucuuaguaacauuuucaauugcacguaaaccaccauuuucuuugguuuagaaauauaauacagggaaaagacaugcuuccccugguuuagauagaucuaucuuagggccagggguauaucagucaguaaauggcuuuccccgcaugcauaaugugaguuugagaccagcaugggauauguaagacccuaucugaaaaacaaaacaaacaagcaaguaaacaaaaagaaagcacaaaccacacauuccagagcaagucaccacuuccaagcaaauuugguuuuuaccaguguaaaccuguaaguuucuagucuuauuuugacuuguugugacuuguuauucauaaccaauguaaacuagcucaguauuuuguuaaugucaugcuaaaagacuuucaagaaagcauauagccagggaugauagauacauaacucauuuucagaauuaaaauuuguuggaaucaugaauacagaaacaaauguggccugaguggaucuggguuagaguacaguucuucccucccauuguucccuagaaaaccaaaagagacacugcuugccaaggccacauuaccugugcucuccugaccacagcccauaacauccuagagucauuaagcuagacuagggcuuggaaucagaauuuagcaugacuugacuuugaaaagauugucuccucuuuuucauucccuuguggaugacaguauuuccaucucuugagcuuuaaauaaaguuaacaucaucuuacuaaacuaagucuuguuuguucugcuucagaagaaguuuaugcugcauucccuauauuauagacucacuccgcagccccacccauauucuuaucugcaaugugaagaaccauguagugaauguaagaaccuuuaguagcuuguuaguauuauugugcagcagcuauguugcgcugaccucuaggcuguugcuuuaaucucugcauccuugcacauuucuuccagaauguccuaucucucuauggccauggcuguguacuuccagguagaauguuuuauuuuauguacuauuaacuaagauuuuauacauaaggcauuuguuuuccauuucugaggguuuuccauguccucauagcuaucaauacuauuauuuucucaaaacuuuuuuuuuuaaaggaaaauguauguuaugcaugaaaaaccaggaaacaaguggcugagaguuaugguacacacguuuaaucucagcacucuagaggcaaaggcagggcaaguagauuucugugaguucaagucuauccuggucugcauaguaaagcuguaggccagcccaggacuacauagugagaucugucuuaaaaaaaacaaauagauaaaguguagaaccauuaucuaccuccuuuuuauaccauccaacauguaugugccacgcuuguaaacugugucugauuauaaacccuucauccuuagcaucucauacacguccuacauagcugggcugcucaaucugcucauaaaauagcuaaagcagugucaaaaguuguuugguaaggugcuacaugcuagcuugucuuucuggaagucugucgccuaguacauguaccugagcuuugacaagcuauagaagguaucaggccaguugucaggaagacgcuagagcagugguucucaaccuguaggucgugacccucuguguguuggggggugccuaucagaucuuguguguauguguguguauacauauacauagauauauguauauaugaaguagcaaugaugaacuguucaugguuggagucacuccaguauuuggaacuguauuaaaggaucacagcauuaggaagguugagggccagugcccuagagacgagcuaagcagcagagucugcccauagacuuagaaugcccaacacacauccuguguaucauaaccucugcugaagugguaauaaaguaguuuuaaaacuguuuucaucuaguguucaugucaugguagaagacuuguuagucaucauggugaguagagacaucuguaaacgaauguuccauauuugauacuccaugccucacauuuugcuccacuucuacaaaccaucuuacccucugcuuacccuggcagucugccauguuuaccuuuaauaagggcaaacuugaacuuuucacucuugaguccucuaagcagggucgccaccuccucaaauaagauuguauguaugugucacagauuauaaaauucagccucuuaaaguccauaguuucacgauuguagcacauucugaguuguacuuucauuacugcuaguuuuuuuuuauuauuguuuuuuauuuuauuuuuauuuauuuuuuaguauauagaauagaguuuauucaggacauggggaacggaguugagaggauaguagagacagacaggagagaaguagagcacauguagagggggaagggaauggggagagagggggagcagggagggagaggacagagggagaacaagaaggcaagagagcaagagcgagcacugcuagucaguuuuaaagaguuugaucaccugccccccaaauaaaccuuaaagccauuagcaagcacucccuuuccuugcaccugacagcuauugaucuucgugugucucuguggguugcauauuguagauacaucauauaagugaauccuacaguauauguuccuuugugacuucacacgaauuuucaagguuccucugugaugucucauucauauauauauauauacauauauauaugaacauauauauauauauauauauucacacacauguauacacacacacacacacacacacacacacacauauguacugcauuucauuuuauaucugaccaguauuccauuguguugcuauaucacaguuuaucuuucuguuauccgguaaugaauuuuucuccacauuuugaucacugugcauagugcugcuguaaauaaauauaugugguuuuguagggucuguguuuucagguuuuaaauuauauaucuagaaguggaguuguugaaacauggugaucaaauguuaaccucugaggacuaacuuuucuaagguacauaugccauuguauuguccuguguagugcauaagcauucaagaaucucugcaccugaccaaaugcuugcuguucccuguuugucuaggcaaauucugagaaaugcuuccucuaauccacaguggguucuauuacuauuuuacagugaccaugacagaauauaauguuauguuucuauguuggauguuuaguuccuagguuuuacauauccuuauauacccagaaaaucuaguauagagaugggauuuuacagagcaauuaaauaaaccuagauuuuguuuguuguauuuuguuuuugaaguggggcuugcuuuauaacuuaguuuaaccuugaacucaggauccugacucugucucgcaugugcuagaauuacagguuuguaccacuaagccuaaucugacuuguuguuguuauuauuguuuguuuguuuugguuguccaguguuucaagacaggguuucucuguguagcguuggcuguucaggagcucacucuguauauaguccaugcugaccuugaacucagagauccaccugccucugccucccuaguccugggauuaaaggugagguaugcaccaccacuuccuggcuggagacuuuuuuuuuuuuuuuuuaaagauuuuuaauuauauguaaauacacuguugcugucuucagacgcaccagaagagggcgucagaucucauuacagaugguugugagccaccaugugguugcugggauuugaacucaggaccuucugaagagcagucagugcucuuaaccgcugagcgaucucuccagcuggaguuguauuuuugauuacacacacacacacacacacacacacacacacacacacacacacacacacacacacacacacauucauugguaguauuuaaacuugucuaagauucacgcucaucauggucaacuuauuucgaucucaaaucuuuaaaaagagaagguggguggugggggaguggaauugaaguucuacagagauccagaggaauucuuaaaugguuuucuuuucugugauacuugguuuguagaaacaguugccauggugcucaguugcauuacuucacagggaugcuuuagugauuaaugcauacagacugaccuggcauuaguguuuauagucuagcugcugcucuguaaagauaggugguugaaucuacuuucuaaugcauccaguccuugaaaguaaauaauccuaagaauauuuucaagguuuauuuaaaaauauagagcaccgggcagugguggcgcacaccuuuaaucccagcacuuuagaggcagaggcagguggauuucugaguuuggcgccagccuggucuacaaagugaguuccaggacagcuagggcuacacagagaaacccugucucaaaaaaacaaaacaaaaaauauagagcaaguaugugagaauaaacacagcuggguuaauauuguucucuacaaaaagagucacuaauagagacaauguacuucaagcuaugccaccuucuaacacaacauuuuaggggaggaggaguguucuuaaaguuuaaagcacauucuuuuacaauaugauagaaaaacauacuugaccuuuuuugguuuaagaugacaaaauaccaaguuuaauauaguuuuauuuauagugagguuuguucuuuuuuguuguaaauuaaaaacugccucuugggcgcaugccuuuaaucccagcacuugggaggcagaggcagguggaucucuugaguuugaagccagccuagccuauagagcuaguucuaggauagccagucugggcuauucagagaaacccugucucaaaaaacagaaacaaaaaauuaaaaacuaccucuuaaaugguuuuguaaauccaauuauggauuuauuggauuaaguaaaaacacuuaugauugcuuugaugaacuauacuuaaaauccauuaaaggucauuuuaugauuuauaugugaaaauauuuuuccuaguuuuaaauaucuccuuaauucuccaaguaauuuguuuuuuuguuuuuguuuuguuuguuuuuuuguuuuuguuuuguuuguuuuguuguuguuguuguuuuguuuuguuuuuguuuuucgagacaggguuucucuguauagcccuggcuguccuggaacucacuuuguagaccaggcuggccucagagauccaccugccucugccucccaagugcugggauuaaagccgugugccaccacgcccggcuuguuuuuugcuuuuuaaaaaaccuuggcuuuuacaaguguauauaaguucauacuuaauggcuuauagcuuucugguacaguuuaaagucaggacaaagacuuagacucuuuuaugaaagcaagaggguuggguaugguggcauaaacuuauaauuccaacauuggguaggcugaggcagagucagaaaaugaauucaaagccagcauauguuauauaggagggccucucuuccaaaacaacaugaagcaagaaaagauuugauguuuucuuauagaaaagcuauaccaugagggaauauuagccccuacuguucgaugaaauuauuuuuuagacaaugacuuuacuuaauugccauugguaugaggaaguacacaagugucuacacaauaagcuggugaauggcuguggccaugcgccagauagucuuaugcuauauagugcucagauguguuaguggucauugaagcuuugguuggcaaauaauagcuuucccagugguuauugugguauauggcaucuuuguuuuuccuuacuggugguuuggugucuccuccuccucucuacuugaugaaaagccauuaaaucugagcuuauuuucuguugaggcaaguauuugaaagucauucaaacucccucagcuuuugaagugcucauuguguugaaacugugacuaugggcaacaaaauaaugcaaaauaaaggguuguguuuccuggugugauuagucugaugaccugaguuuagauccucagagugcacagagugguagcauuggaguacaucuguaauacucaacauuccuauugaaggauggaagguggaaacagggagauauccuggaagcucacaggccaguuaggcuaguguaugcaacauacaauaagugauacucugccucaaacaauguaguaggugaggaccaacacaugagguuaccugaccucugauuucuauacagauguacagauguauacacaugugcuuaaaguuaagucauauuuuuuaugagauaaacaauaagucagcucuuugaaguauaacugugaaagggaaacuguaugccucaugaguucaaucauaucucuuucugagcucauuagugauccaaaauuacuuacacauuaaaagguauauguauagacagaugacucagcaguuaccaauauuugcuacucuuccaaaggaccuagguucaauucucagcaccuacauugcagcucucaaauguuuguaacucgcauuccaaggaguccaaugucuccuucuagccucauuaaguacucggcaugcauguggggcauacaguguggugaacaaaauacaugcagcagaacacucgugaacauaagacagaguaaacugucuguaauuaaaacacaaauggucaauacauuugacuugaguucuuuccuuguguguaugugucugugcaguuaugcacauaacaugcagaggccagaguugauauuggauguuguuuucuauuacuuucuaccuuguuuuuugaaauauggucuuucuuuggcccugaagcucacugauuugacuagacuugcugacuagacaaguccccaggguccuccugucucuaucucuuagggcaaguauuacagcacacugcuauaucuggcuucuuauauaggugcuggcaguucaaacucagaucuucgugcuugcucagaaagcacuuggcugacuguacuaucuucccagaaccuaacuuauuccuuaaaauacccuuguauaauauuucuauauuucucuauauguuauauauauauuauauauauauuucuauacuuuguuaguaaccucaacaaauccagaauugugacccagggauucugaugaggaaacauaaguacguuucuccugcauuuugccacucaguucuucagcacauuuaacaaaagaaagacaguugagccaaaauggcauuucuuaaaagccgagcuucuuaaagaccucacuuuacacugcaguuuuuagugugugaaacaaaugaaucugcuuaacacauuaauacacugaggugacauuagcuuucacucccuggcagacuacauuugagcagcuugccuuacuaauuguucaggaauuuucagaauuaaugguaauuagcagcuaucuggaauuggcucacauguaauccuacccugcccugaacuaguuuuuuuuuuggauggcaaauaauagccucuccagagccuucauucugguuucacuuuccccucugagaugggugcucuugcuacguuguccaggcugacuuggaacuucuaaguagcagauacucuaaguacauuccauuacacuugacugcauucauucuuaacuuuucccuaaugucccuccggacuuugcuuugaccuaaauggaagaacuguagauucuagaguagacucugcguguccuaaguaggucauuguuugugcacuggucacaucuuugaucuguucuuguuccuuagaaauucagauaaagauaguuaauacaagaaacuuaggagaaauaaaaucaaaacugaaauacaaaggauaaauaggguugcuaguguaagaaaggggacauacagcauuccuaaacgugucguggccagagagagcauggugagagaagcaaaggaagucugguuugcucgggcuacgggacgcuguaugaggaugcuagguucugagucauggccaaguuacuguccaaaagaaucaugccagugugugaauguggucauuguauugucuuuucccgcacugauuuuaucccauacguuuuuaaguuugcuuguuauuuuaaagauuuuuaagauauuacauuuuauuuuuauugugucucucaguuauguggcuggccauauuuucauauuaauuaccacguuuccuguguuguaaacagucugcuuguguccuuuacucagauaccuauuggaagauuuuuauuauuuuuaauauuagcaaucuccuuuauaguauucuauucuaauauuuuuaucagguuugauguuucaacauaaagaauucagaagguuugacugacaaauuuauuggcaaucucuaguucacuuuaugguguguaucacaugaauuaaauguaaaauugaagugucuuccaauuuucuuauuuuuaaauuuuuauacuuuuuaauuuuaauguauaugaauguuuugccugcauuuauuuaugugcacuacaugugugccuggugcccgaggagaucagaagaggguaucagauccccugaaaguagaguuaaggaugguugugagcuaccuuuaggcccuaggaauucaacucagguuguuggcaagagcaacaagugcucuuaaccacugauccaucucuccaagacaugucuuccaauuuccccagcacuguaccauugaaucuuuccucaucuuuugaucuuugcuucuuuuuuucucccaaaguuaacaauguuuaagaaaugguaugugcuaggcacuauuuuaaaugcugugucaucuuauuuucuuccuguagcucuucuacuuugaggcauagagcuaauuuuuuaauauuauaaaaccaauaaaagcuuuuguugguugggcaugaaaauauaugcuugaaaccccaaagcugagagaggaagauugggaauuugagaccagccugggcaacagagugagacccaucuuuaaaacgugguuaaaaaauauuuuaggcacaugugccaaaacacccauacagaaaaaggugaggaauucuuucuuacauacgcucuacuaauuuuacuuuaccauuucuauauuaaugacugucuuaauguguguguuguuauauaugugugugccucuuggcacaugcucugcuacuaagacagacuauagccccucuucugucuuacuaugauugauaccaagguauaucuagcauuucuucuggguuuagggguggauuuuuugccuguuuauuuuuccaaaugacguaaguauuuuauguccuauuuuaaauucucauugaagugcuugucaaaaaaaugcuuaaucauuggcuggagaguuggcucagugguuaagagcaccgacugcuguuccagagguccugaguucaauucccagcaaaaaugugauagcucacagccaucuguaaugggauccgaugcccucuucuggugugucugaagagugacaguguacucacauacauuuaaaaaugcuuaauuaucauauacugucaacaacugcaguuuuauggcaacuagucaagauauguauccuauucauagccuuugguauguuccagauacuagcuaaauuugguugagggaaugaauaaauugggacaucugaacuuguuaccucgcauuaauguuuucuacauucacccauuucuguguggauauuauuuauuuggcauuauaguuuuuucuuauaguuuucuaauuauuuucaccaacauauggagaagucauguacaucuccacauuuauuucguuaguuuuuuuuuuuuuuaauuuaagguuauguuucugaaaguguuccccagguaucuuuucaauaagcaauuacuuuauccguuaagaauaaauuuaguagucaggcagugguggcgcacgccuuuaauccaagcacucaggaggcagaggcaggcgggucucugugaggccagccugggcuacagagugaguuccaaaacagccagagcuaaucagaguaacccugucuggaaaaacaaaacaaaaagaauauguauuuaguuucuuauuuaacuaaauuguuaucuguuuguguauuguucuagaauacucaaauuaugggauuuuuaaaaauuuaaauguacuauuuuucuuuuauuuauccuucuuuauuauuuguuuguuuguuuauuagauuuuguguaugacuacuuugccuguaggguauauaugcuuaccauacaugugucuguuacccacaaguucagaagaagguuucaggucuccuggaacuauaguuaugaauggcuguugugagcuacuuuauugaugcuacgauccaaaccuaggcucuaugcaagagaaacaaguucucuuaaccacuggggcaucucuccagcccgugugugugugugugugugugugugugugugugugugugugugugugucagcacauauguggaggucagaagacaacuacaugaaauuucuucuacccuugcauagguuucaaggaucaaaccuaggucuuuaggauugcauacuaagccuuguuacccauugaaucuuccuagcggccaaguacuguuuuacaggguggcuaaaggugcaagcucucuguugugcagcugagauuugcaguugcuuauccucuucagggggcuuucacaaugcucuagucuugugccaguuuuacuaaaauugaugucugugagacauaguuaaugccaaguaaauauuuuuuccuccguucaaaaugagaccaaccaaauaaaaauauuguuuuugucaguuugauguaaacuggugguuuaguauucauugauaucauuccuuaacuuacuuauuuuggagacagggucucucuacauaacccugucuauccuagaacuuaguguguagaccaagccagccuugaacucacaaggauccaccugccucucucugccuuccaagugcuagauuaaagguaccacacuuggcuuuuaauuuucuuuauacauaauuucucuaguauaaccuuauccaggauuuuaggugucgcuucucugacuucuuugguauccauuacaguaauuugcugucgauucauggcaucauuauacaagauuuaauaacacaugugaauggccaagacacuaugaaggcuuuauggggauuaugucaggagaaacauuauaaugucaacccauuuccuagaugagacuagcuuagagcagugagguguuuuguugauuguacagaagugacagagguaaauuacuuacccgacagaacauagccucagggguguguggacauauuaauacagaauagagacucuuugacuugggauggacuuauagaucaauaaaaaucuuuguuacuugaugacauccuaaauugaaaauguauuuaauacaccucaccaauuuauauguacuuaaaacccuuaaaugacuguauaauuggccaagacauuuaacaaaaaaauugucauaagucauuuuacaugcugacguauaccuguacuuauauguaugugcauaaggaagagauacugaggaguaacauuuuaaaguauuugaggguuaauauuacaguaacauuuagagaugugccuucuuugauuaguaaugaugcaaauaucaguuccuuagaggguaaggauuaucuaacuguaaggcuagguacuucuuccuaaggacaugaucaauguaguugacagauguuguauuuguaaauuuaccaaacuuuucuucugcauuuugcagacauguuagucaggaugauuuaauccauggguacugcuaauauuauaauccauaauuauacuuucuuguuacugucuccauuggaauucuaagauacuaagcuuuugguauccacaacuuaaaaguugguuguaaacaaucucguuuugugaaacucagcauuucuguuuuaaaaacgaaagaaaucaacucaaacuaguaugcuugauagugguagugaagauauuagaucauuuuggaaaggagaauggacaccaugcccauuugaagagguaaugcauuuuaaaaucaucuuagggacuuuuuucaugguaagauugcuuaguacagugagucaaguuuauagaggcagaaaauacucaaaacuacuauagagacauuauaagaaugcauuuuuauuaaaaauauaacuaauuuuucaugagcuuaagccuuuuaaaaaaaagagaaauguuuaggacaggccuggcagugcuugcguuuuaaucucagcacuuggaggcagaggcagguggaucucuaggaguaggaaacuagucugguguacacagggaguuucaagccagccagugcuauacagugagacccugacucaugacaacagcaaaaaagguauggagaagaggaguuugguagaauguuacuuucuggguagagguguuuuacauggcugagaagauggcucauuggguaagaauccuugcucuucaagcaugaggauuggaauugaaguccccagcauccauguuaaaaaaaaaaaaugaggcauggcugcaugugcguuggaauuagggugauaacagacagauccaagagcucacagcccaccuagccuggccaaaacagcaagcuuuauuucagugagaaaccaugucucaggccaguaaagcaaagagcaauggagaaagguaacagauacuuccaaucuuacgugcauacaucccgcacacauacacacaggcagggcaggaggcaauugaacuuuuaacccaagaaagaagacuauauggauuuuuuuaauuuuuaagaaaaaacacaacuucuucacucuccccaaauuuagaaaugcuugaaguuauauucuuuuuuuguaucucacaaaaaugagugccuccuuuguagcuuaccaccuuuggauauuguaguuuacacauuaauuuaguuaagucaucuuauguugauugcuaauucauuauaugaaguacuuuuauauuuuguccaaaauucuugguacuuuauucuaacuggaucccggugcaguugacuuggaaugucuacucuguccccugccuagcuuuguugucagucuacuuuauuagaaauuccaugguuguaggacugaaggaauaccacccacuccucgcuucucuccaucccacagucucccucagagugacccaaacuguuagacuccaugguuuuagccccaagcuaaucuuauuuuaaauuuggaagaucaaauuauaauuucuggucuuauaagagacaaauuucucauuacaguagcaguaugacuuuaacucuguaaauauuuaacuuugauuaaugaaugaucaauuaaauauacaagaaaacucuuuaacaaguccuuaaauggaaacuuuuuauucuuuuguuuuuuauacuuuucuuaaaugcaaagcaaaguuaaauuuucccuguuaagaugccaagcuaagagccuccuagccuuuugaagagcaguuguccauuauauaaucugcagacuagcaagagucccucagaagcaggacauuguuuagauuggaaguaguucugucuuguguguaaaacaaugauguggugugagcauuuauuuacagugacagccuugguuucacuuaaguggcaaaacccuuuugaguggcucacguuucauucaccuuacagacuucaucuucccuacagcaaaagcugugauaaugucuagagaccacgugacacagccaggagcauaggccuuuuauuuugucccagacauuugacaguguaaacauacauaaaauacauauuaaaguuuagaugcucuuuauaguuugugcaauaaguugaagccuuaaaaagaaaacauuucauuaaaaaaaaaagucauuaguuuuacuuaagacaggaaaauagcagcaaguaccaagacauugugcacuucuuuuaauuaagacaaauuacuucauuuacaucaaagucagaaauauaagacuggcuuucuugaauacauaauauagcuugaaucacugguuagauaggggcacguuuucccaacuguacaucauggaggaagguucuccuucguuucagaaacugcagacccucagccugccagcaugaccacagcauugagcauuaaaaggagcgaggcauuuacuuuccaagcacuagccgcagaagguggccgaguguuuccauuugcagugguuucuucccuccguaaguugaggguugugcuuugucgaggcauuucagagaaguuauuuggcaugccacgagcuaugcugagggucacggggcuugggggugacuuuguugcacuggugaggcuugcauuugaacucauuccauccuggaggugaauaguuagaguugcagcugcugcuucaugggaauuggucauuucugugggugugucuucuggguaggccaccacagcccuaucagugcuacuaaaagugguaucuuugcuuagagugacaccaaaugugguuuccuuuccucgauauuguuuggguguuuuggucacuuuggguugaguuaccauacucaaagaguuaaugguguccacugucugcaucucacucauaguaaauaagcuugagguaaacccaggaggugugggguacaugcucuguuccuuuagagaggauacuugcuuagaacaaggagucccuaucacaugggcuuucguuuccaucacccacuucaauaaguaaguaauguuuuguuuauggucacaugaccaccuguuauuaugaagaguuaucucuugcaacugcaaaaguuggucaaaagacuguucuggaaugaaugugaauuuauuguugugcagguaaagaugugugagauuugucagguuuauuaaugucccuggaaggauuugugucagugaguuauuagacagguccacgauaugcaguuuggaaggcauguugguuggaacuguccaaagcuuguuacugcugagguuaagaaccucgagacuucuuaggguauuuuuaaugagaacaaccuuuuccagcauauucuuagaaacauccagguauuuaagguuccacugauaagcaguaucagauuugucaagaaguuuaauauuguuguuagcagcagacauguuccagagagaccgagguaacugagcaggcagacuuucaagccuguuguuugaaauauccaggguucucagauugguauaugggguuaacugguuaugcagaucaguaaagugguuauaagacagguuuaaauguauaauguucuccugcaguccaggugguaauguagucaaguuucugccugaacaguccacaugccugugccucucugugcauguacacuggagaggacaaaugcauaagaugccaggcgugagaaacagaaggaugaacaggcaggaagacauuuucaguaucugauauuccaucaaagccugaaaacaaacagauacauccuucuuuuaauaugcaaauucacucucagcaucugcaugggucaguuagcauucggcaaaauuuucaauaaaccuccuuguuguugaguccuuuuauaauuguuccagugauuaaacuaacaaagcugcccuucauuuauaguccaaaugccuaauccuucaauuggggcuauguggugggugggggugggggaacugggggggagagagacagacagacagaaaggcagagagagagagagagagagagagagagagagagagagagagagagagacucuccuacauuuucucuuuauuuuuauccuuuaguauauucaucuuauuuaucuucucggagccuuuauaugauagaauggcacugucugcaaaugaggaguuuuauaggcuuacuuaggcuguuacuauuuuugauaauguuuuugauucagaaaaaaaauggcugucaugucuguuuuucuuaaaucucugcaguauuauaagacacaauauguuuguaguuugagauguuaaaacagauuaaaacaguuuuugaaauuucaucuucucauggauaacuauauccugguaaaaaacguuuuaaugaacuuggaaaaaucaagcccgauagcguacauuuguaaaaugauuuuuucccuuauauuucaguaccaauuuuaaaggaaaaacaauauauguauuuacaaagugaguggacauuaaaaugaaaaccucggcuauuacugcagcagauuuuggugcaugcacuuguuauugaauauauucaauccuaacauuagcuuuaaaaaaaaaaaaagcuaaagaaaaggaaaaaauucaaaauccgucuuuuaccaauuuaaacaacugcuuaccauaaugucgucuucacuaucaguaucucauuuucuccgggaaacuugcagcuuaaaggucgucuuguugugggagucggaaggguuucuggcugugggcucugcuugccagcucagcugcauuguguugcugugagccgaagcucugcaaccaccugaucagcaccacauaggaggacugcagagcugucauuggugcugacucaaauuuauugcaagaggugcauacgcaacaaaauggacuuuuuuuuuucuuuuucuuuuucuuuuuuuuuuuuuuuuuuuuuaauuuacagcccagagagugccuuacauagcuucaguucucugucggguagaauacuucaugcaaauuagggcugggcuuuacuucuguguauuucucugaguuuagguugcacauuuaacauuugcuugcuguaauuuuucuuaaagccucuacauucuuucuauguguugaaaaauguucuuugugaauugauuuccaggauauucauugaacuauuuuuaaucuccgcauuuuuauguucuuuucaaaaacaguuaaauugucucguaaccuuuucauauguaugucaugauagaaaucuugauuuuuaugucuuccuccaucguggcuacuauuauuauauuuaauuagcuuuucgaauuuaucagucaauuacguguuucaucuuaccuuuuaggaagcacaggaauacucaauaugauuacuuuguuuuugccuuccugauacaaaagaucguuugacuaaugcugcacacaggccagcugcguugucgucacagucuccuuccccagcacaugcacacaguccugccuuagugacagugaucaaauaagaacaagccacauguaaaauaaggaugcuggacuauaaaacaacaccagccuaaaauacguuucacugugucuuccuggcuggccuggaacucacagagaucuuccuacuucuguuucucacugcuagaauuaaagaugugcacuaccauaaccaguagauacuagauauuuuguuuuguuucuucuauuuuaauguucuacuuuuaauuaccagucaaaugguaaaauaauuguuuacauuuuauguauuugaguuagauggaguuguuugguuuugauuuugcuauuuuuuuucuuccaugaaacuuguuuuggaugguauggauagaguauugcuuucuccagagguauuguugggucugaacaaaagauaauuuuauuuuuaugaauagcaguaucaaagcuggaguggcaacacacaccuuuaauccuagcauucagcagguggaaguaagaaggccaggaauugaagcccagcuuugacuacacagcaagcucaaggccagccuagaauagaugagacccugucugaaaauauaaaauaaaaugcuggccauggcggugcucagcuuuagucccagcacucaggugacagaagcagggaaaucucuacacauccgaggccagccuggucuacagcgaguccaagacagccagggcuacauggagaaaugcuaccucaaaaaaccaaaauaaacaaaauaaauaaaaacuauuacuuuccaauuguuuauuuaguguuucauauuuauauguuaucuuucccagaaagucaauagacuuaaaaauauauguaacaauguuuguaaaagaugaaacuauaaucaaaauuuuuguaaaauaugacuagauucaugguauuuuaaguaaacuagauaaauaaucacuugaaacucaaaccuauauuacaaaaugaccacuuaucauaggaaagaaaaggagaaaauuaagacauacuuauuaugaaauugucaccauauaaaaaccagcaauuauuaguauauuacauuuuaaguaauaccuuguauugucuccugcuaaaucucaugggcuguaguuuuauuuguaucuaaaaaggaauugauggaauugaaaucuauagcuuaucuucuuagaacagaacuaucuuguaggagucaccuucuagguaaaacuaguguuccucaaaaaggaccuacauuuaagcagucugcaccauuagugacugcuauugguucagggcuuuauuaccgcuuuacguugaguguucauuuggacuuuagauucuguguauggguuucagaauuucaucaucaaucaugaucccugaaaauaauguuugaaguacuacguucaauuuguuuugggggugagaaugguuugcuuuugacaguuagcauuucaugucagcucauguauccaccaauacagauaggacuaaggaucaauuugccaagccuuaaaaucucucuuaggaagacucauucuaccauuauagaaguggaauuaccuaugugaauuacacugauaaguaccgucauuugaaagaaaaaaauaauuaguuaauuguuucaaaauuaauucaagcuuagucuguaucagagacuuuuugcuagcacuguaacaaaaucucugacagaagcaacugcagaaagaggaguugcucauggcagggaagacaugggcacuggaguagcuuggucgcuggcacaggaucaggucauauccagugguaaaugagaagcaaaaccaaguucuaauggucagagcucacccccaguggccuuaaggccaucagcucuugcucuaaggguuuaauaaccuccccucagcacuguccacacacauuaggaucggauucugcuaugcauauaauguuuuucauuucaaauuuauuuuguacuaaagaugaccauggguacucaaaaagaaaaagagguugucauuucaguguauuucaaauguagcaauuguaaugcuguuaaaggcucugagaaaauuaaauacuauauuaugcuuuuuugguuguuuuguuuuugagacauguccuauagaccaggcuagccucaacuuugccucccaagugcugggacuaaagaaucauuuguaaaagacaaguauuuguuaccacuuaucuuagaugcuauacagaagcauuaauuauaauuuagauagguucaccaacuucacaaauuauaucuauuuaggcaacugguuuagauuaagcauuaaucaaguugacauuucuuuuguauccaaggauauauugcucuagcauugugacacagcaaaccuccugcuguaguaguaacuauagacauguguguauguacauguaucuguccaagcuuggaaguuguuguacaauaguccauuagcaggaaaugcuucugucucaagcaguuuggaaaggggggaugcucaaggguagaggggcggcucagugugcagcugucaaugcagccuaaguuaugcgcuuauauaccugcauaguagguaguaaccacuccaguggaccuucauucuuuuuuuuuaaucaauuuacuuuuuaaaaagauuuauuuauuuaauguauaugaguacacaguagcuguacagaugguugugagcuaucaugugguugcugggaauugaacucacgacuucugcucacuccagccccacucucucuggcccaaagauuuauuuauuauuauauguaaguacauuguagcugucuuuagacacaccagaagagggcuucagaucucauuacugaugguugugagccaccaugugguugcugggauuugaacugaggaccuuccgaagagcagucagugcucuucccugcugagucaucucaccagcccucaauuuauuuuuuuuuuaauauuuuuauuagauauuuucuuuauuugcauuucaaauguuaccucuuuccuaguuuccccucugaaaaucaccuauucccucuccccacccccuucccccugcuccccaacccacccacucccauuccugguccuggcauuccccuauacuagggcauagaacaggaccuagggccucuucucccauugaugaccgacuaggccauucucugcuacaucuacagcuagagccacaaguuccaccauguguuuucuuugauuggugguuuaguuccaaggagcucuggggguacugguuaguucauauugauguuccuccuauggggcuucagaccccuuuagcuccuuggguacuuucucuagcuccuucauuggggaccuugugcuccauccaauggaugauugugagcauccacuucuguauuugccagucacuggcagagccccucaggagacagcuauauuaggcuccugucagcagucucuuguuggcaucugccauaguaucugugaguuuggugguuguuuaugggguggauccccaaguggggcagucucuggauggucauuccuucagucucugcucugaacuuugucucuguaacuccuuccauggguauuuuguuccuccuucuaagaaaguuucugagcuucugggcuaauauccacuuaucagugaguguauaucauguguguucuuuugugauuguguuaccucacaauccuccagaucuauacauuugucuaugaauuucauaaauuaauuguuuuuaauagcugaguaguaaucuguuguguaaauauaccacauuuucuguauccauuccucuguugaaggauaucuagguucuuuccagcuucuggcuauuauaaauaaggcugcuaugaacauaguggagcacauguccuuauuacauguuagagcaucuucuggguauaugcccaggagugauauugcuggaucuuccgguagaauuauguccaauuuucugaggaaccgcuaaacugauuuccagagugguuguaccagcuugcaguuccaccagcaauggaagaguguuccucuuucuccacguccucaccagcaucugcugucaccugaguuuuugaucuuagccauucugacuggugugccguggaaucuuaggguuguuuugauuugcauuucccugaugauuaaggauguugaacauuuuuuuaggugcuucucagccauuugguauuccucaguugagaaaucuuuguuuaucucugacccuuauuuuuuuuuuaauaggguuguuuaguuuucuggaguccaacuucuauaaguuucagugucucugguuuuauguggaguucuuugauccacuuagacuugagcuuuguacaaagagauaagaauggaucaguuugcauucuucuacaugauaaccuccaguugagccagcaccuuuuguugaagaugcuaucuucuuuccacuggauggauuuagcuccuuugucaaagagcaagugaccauagguguguggguucauuucugggucuucaauucuguuccauugaccuaccugucugucacuguaccaguaccaugcaguuuacuuuuuacaaaaauaauucauuuauuuuuuauuucuuaugcauugauguuuucuuugcauguaugucugcaugaaguuguaagauucucugaaacuggaauuacaggcaguugugaucugccaugugcuugcugagaauugaacccugguccucuggaagagcagccagugcucuuaacugcugagccaucucuucaaccaccuuuauucuugaauugaucaaacugauuguuccuguaauuaauugugagccaaaguacugauauugauacaaguucuguaucccuauuuuuaaguuuuauuuguuuuauuauuguauugcgugaaugccuuaccugcauguauuucugugcaauacaugugugacuauugcuagcuaaggucagaagauggcauuacaucaccugggacucuauauacaaaagguugugagaugucuugugggcacugggagucaaaccuaggaacucaggucuccuggaagagaaauaaaagaaaauuuucucaaccacugagccaucuuuccacccucagcaucccuuuucuaaaaugccugaaaccagaauuauuuccaagcuuggaauuauuaagauacguuuacagauacguauacauacaugucuauugagaguauucuuugggugaucucaacucccccaaauuuuugagcacucagaagauuguagauuuuagauuaggauuguauagucuuuaacacaguuaccuuuuuacugaauuuccugcugacaacaacagaauaauaguaugaacuaaaguguuguugaagcauagaagaacugacaaaacagaacuguaucaacauucaagucauuuuaccaucuuuaacaaaaaaauuuuuuuuacuuuauucucaacuuucgccuuuccauguuuuaaaucuuuuauuuauuuauuuauuuauuuauuuauuuuaaacuccagauuuuauuucccucccaguccauccuccaacuguuccacauccuauacuuccuccauacccccacccccaucuccacgaggauguccccacccucaccccaccauaccucuaaacucccuggggccuccagucucuugaggguuaggugcaucuucucugacuaaacccaaagcaagcaguccucugcuguauguguguugggagccucagaucagcggguguaugcugccugguugguggcucagugucugagagagcucagggauccagguuaauugagacugcugguccuccaaaugaguugccuccuccucagcucuucaagcuuaccccuaauucaaccacaggggucagcagcuucuguucacugguuuggggcaaaaaucugcaucugacuuuuucagcugcuuguugggucuuucagaggucagucaugauaggucccuuuuuaugagcauuccauagccucaguaauagugucaggggaggucuuagggccuccccuugaguuggaucccacuuugggccugucacuggaccuccuuuuccucagguuccccuccauuuccauuccugcaguucuuucagacaggaacaauuaugggucagaguuuugacugugcgauggcaaccccauuccccauucuucacuggaugcccugucuuucugcuggaagugggcucuacaaguucccucuucccaauguagggcauuucaucuaaggucccucucuuugaguccugagagucucucaccucccaggucucugguacguucugaagaauccccuccccccaaccuccuaucuucugagguugccuguuuccauucuuucugcuggcccucaggauuuaaguccuuuucccccacccaauaccagaucauguuccccuccccaccaccccuuuucucucucaggccccucccucccccuuugugguugcuuucuucucccucccaagugggacugaggcauccucacuuggguccuucagcuuguugaccuuuuugaauuccuuggacuguaucuuggguaugcuguacuuaaauacuugcugcuauuauuauuauuauuauuauuauuauuauuauuauuauuauuuggauaauauacauuuauuagugaaugcauaccaugcauguccuuuuggaucugaguuaucucacucaggaugauaauugguuccucagaaaauuggaaauagaucuaccuaaaaacccagcaaucccacucuugggaauauacccaaaagaugccccaccaugccacaggggcacauguuccacuauguucauagcagccuuguuugugaucgccagaaccuagaaacaacccugaugacccaugacagaaaaaugaauacagaaaaugugguucauuugcacaauggaauacuacucagcuauuaagaaugaguuuugcaggcaaauggauggaacuagaaaaugccuuucauuuuuaaaaacugugugugugucugugucugucugucuguguaaugugagugccaugauguacauguggaggugagagaacaucuuggaaaucaguuuucuccuugcaccauguauaugggucccuggaaucaaacuugucuuccaguuugacagcgagugcuuuuacccccugagccagugaguccccuucagccucucuagaguguuccugacuuaucuacuugcuuucugggaauguuugacauuguuauuauaucccugguuuucccauaguguuccuaacaacauugaccuaacugcuuauuugucuuauggaagagcaggcugaaaaggacagucacaugaaugcagcaagaugacagaccugucaugguucuggaguaucuuucauugaggagggacagucaguuuuguacccagaauuauuugaagucauucuuuucuguuugucauaaacauggcguaauguuaaauuaauuuucuucagcuacuuuuccguuuuuauggcugauuagucagaauacuguaacuguguauauagaggacuugugcuacucugguuugaccccuccagucuuuuuuuuuuuuuuuuuuuuuuuugcuccuauugguguggagaagaacugcuuucaauucauuugcuugcaguuacaucuuaauucuuuaaaaaaaaaaaagauuaaaauauguauguguauauuauauguuuuugucuucucauguaaaaguuugugugaugaauuguucuauaucguauucuguuuuucuuauuaguucauuuuaaagauaacucuauuuaaagagacguggguuugucucauucauuucuuguugccuuggggaauauaccuuaguuguuuuggucugacuuguccccauacuuccauuauugccaauaaugacaugcucugauccucgugcuugaagaguuucauauuuugccaguaacuuuuuuaaaacuucuuuuugucuuuuugagauaggguuuuucuauguaguccuggaugcccuggaacucacucuguagaucaggcuagccucagagacucaccugucucuggcucugagugcugugauuagagguguaugccaccauuucuggccuuuauguauauuuucaagaauaauccauguauauuuuuucuucucuggauguguuuauguuuuauaaaauucuguuguuuuauuuuuacuguccacuauccauuucuguuauccaucuuuaagaacuuucuuaacauuuauagguauuaguacuuugucuuuauuuaaaauaucucaauugucuuguguuugucuuuugacuuuuuaauacugaguuauauuuugguuuugacauuugaaaauuuucucuuuuguuuuuguugcuucuagacuuugagccucagcuaggaagauguuugcccauguuuggauuauaaagggguucagcagcaucuucuuguauuguguccacucuaugcuauuuauaucuugucuacuuaaugucuauucuaaaugugaaauguggauccaauuuucauuuuuccaaauauccauucaguugucucuccagcuccuccauuggcuacuguccugucuaggagguauuucucaauacccauuuuuucaagaggucaguaagugaggugcugaaaggaacaacuuuggaaagagccuuuuaguuccacaagugauaugagaggaguuggaugauuggcauucaagcugcuacaucuaauuacucuaauacuuaaauacaagaaauucucaaaauuccucagugacugcugcaauguaaauuagccuuaaaaucauauuugaagacacgugagaaauuuuauugugaaugacagaaaagaaccaauguaauaaaaugaaacgccaucaugcuugaaguagguguuucuguagauaaaaaaaguguuaucaguaagagguggcuuguaagaaguaagguaaguauuguauguaaaauaacacuuaagcccagugucuuuuaagguguuuaaaggucacaccguuaaucacaaagauugggagacagaggcagguguaucugugaguuugaggacagugggucuauagagagagagugccaggacagccagggcuaccagaggacuccugucucagaacacaaacaacaacaauaauaaauuuacauguauuuauaauauguauaauaauuguuuauugauaauuauauacuaaauaauaguaguaguauguaguaguaauaguagcaguaguaguaaaacuccacugcccgagaaccuucuuguuuuuauucuacaugggauuuuuaguauuugaacauuaauguuaccaauaaauacuauauacuaucuugaaaagugccaaaaucugugcucuaagcaacuguccuuucuuggacuuguaauaauaauaagagaaggauggcuuguugggcagaugaacauuugacaucugcaaaagguaggccaguacccacugccgccuccacuuuaacaaaaguugugcccacuucuguucugagugccucauacucaacaaccuucaggugaugauuacauuccugcauuuacaaaaggaggcuggggcugcagugaugggucaguacuuuagagaacuugcugcuguccuauaggacccaaguucaguucccaguacccguguuagacagcagcucauaacuuccugggacuucaguuccaggauggcugguauccucuguggucuccacagacacccucacacaggcugguaucaugcaugugugggaagagacacacagauacagcccacuucuauuuuuuucucccgucuuccauaucauuugauuuuugucuaagugguuaguuuaugcuucccuaacauuuuagaaaaauguuuacauuuugggggcagugagaugggcuuagaggauaaagguugcuugcugucaggucucaugacuugaguucugaauuuuauccuugagguggaagaaaaaaaucaacucccacaagucaucuucuaaccccaaauacagccuaucucuuugaccuccacccccacgccccaaacauuugaagaggaagaggaggaggaagaggaggaggaggaagaggaggggaagaacggaguugcaggggcucggugguuaagagcacuuacagaggacuuggagucaguuccaggacucacggggcauuggcaaauguuaguagugccaucuucugucuuauauauaugugugugugugugacuauaugaauauauacacacauauucaggcaaaacucuuauauacauaaaauuuuuaauuauaaagaaaaaagaaaauuuuaugguaagugcucacuuuuucaggguaaauguaucccaaacacagcacucagacuucauguuuuaauacaguuugguagcuguguguuuaaucucuauaaaugaaaauauuuacuuaauauuugaaguauuaaaacuuugaccauuuaaaaauuuccauuuuuauuauaccccaaauuuugagguggaaaaaauagaauuuuauuuauuuaagauauguuuauauacagcuuuucgggggaaaucuauuggguaauaauaaguauauguagaucauauguuuccaaagugauuaaguuauugaaauaucuaucauuaacauauauaaaaggcacucugauuuaaaaauuacuucuguagcugguaagcauaccacuguaauaaucuacccguguacgugggcuucagucaggggucagguagucccuaaagagucucucaggugccaggugucauguccugugugccauaccacgaagacaggaacgugucggugccaucucaggauggagggcagucuagaaagccagcugucacuuuacagcagcucuguagguggagguggcagggagucugugaggucuggauggaggucaggaguagagaacuccuggcauugagccucgugggccgacucuugauuguuuauaaaaucuccugcugacagaggcacauuaaaugagucaggggguggcgggaauggcucuuggaucuuggaaugcuguucuucacacacuugauuuagaccaucuggagaugguuggggauugauagaaucauuugguaaaggagauacaacugucacugugggcuuguuugguagguucucauccaaaucaagaaggggagguggcagggccagaucugcaucaucugaagacacggcuguaccaacuguugacccaucagcacugucuucugauaagccauuuauuugaacuucuacauuaucagucuugagguugcugguaucauuaauguguucacuugauucaaacaacuuaacuucuaaaucaucugcuagcagugugcuuuuacuugguuuccaggucauaagugagacaacugaugcacgcuuuguggaugccucacucucucugauguuauccauacacauuucugguguuucuccaucagcaaauggagaccuaccugcccaguuuugaucauuuaagacuggcuuccucaaguauuuccacaguauaaucaugaguauagcuaccaacauagaaauuauaauaguaccgauuaauauggcagcaauugcauugugguuguuuuuaugagcaguuccuuugccacuuggugguucugaagugaguggugguggugguggugguggugugucccuuuguaaauaaauaguugguguugauuuugugggcugauuaugaguagacucuacuucugguuuuccagaagagguaggagcaggugaugguggcuguuguguggaaguauagacaagauguuuuggugguuguccaguagaauuauagguagaaggugauggcugauuggucaaagugaacccagauggugauguuugaggcaaggaguuguugaccgcugauucugcuugucugguaauguuauaaguaagugggcuugaagagacauaaacagcugguguugcuuguucaggagugauuugggcaggugaugcuugcuguccagaagaaauguucuugaaucuuguugucugacucaaagcauucccugcuguguuuugagaaucaguuguaacauauaacgacggugugauuaaaguagacagugauugcugcucuguuguaauugcuucugucucugagaaaaacguauuguccagguauugacaaagcacaaugaagaccagauacuugaauuccauuucagauguuuucuccuuaccagugauuucacaaugaaagaaaaagaaauaugguuagcuaucaccuggcgucuaguuacauuggacucuucauuacagugucugacauacagugauuaggcauuugguuaaauuucauucuaguuucuacuugacacaaugugaugcuccgguuuauaguauagcaucuggaguuccugagaaguaaucuuaauucuuuuauaaaaucuguuuaaccuugcagccccucuagguuccucagcuucuacuccuucauuucauauugucuugagugugcaggcucaaccugaugccuguucgcugucuguucccagaaauaaaguggucugccuugcagagagagcacuggugaccacagugccuuacacuauugccuuuauguucuuucucucucucucucuccucaccaaauuugaccuuaccgacuagucccucgccaguauuucaguaacccuuguauuacaguuuuuccuuugcaccacuucaguuagaucuuuuuugcuccugucuccuaaauauagacacucagcauccaaucucucucuaccuuucauuuuucuuuguucuaguucuguaaguguccacucucacccuucugcuauaacuaccaaaccugugcaaccugaaccuccuuuguucugaguccauuuguaucaugucuuagugggcauguuuuauauauauauauauauauauacacauauauauauauauacacacacacacauauauauacauauauauauguauguauauauauauauauauauuucauaaucagcaaauucaguagaucuagucccaaggggaccucacaccucuggucuguauggcaucacacucguguacacacacucacacaugaacacauacacagaaugaaaguuaaaaauacaaucuaaaagaaaaaacaaaaaccaagaaaauccuaaagugauucaagucucucuagcccaguuggucaaauaagcaagcccauuacugcucucauucugauacuggacaaccaccuuugcacaucagacccuagucuagauuugauaaauuuaaaaaaauuaaguugcuuucaaguguuuuaaacucuuacgguaaaaauuagcagguaaaaaguaaucucagccagguguggugguucacaccuuuaaucccagcagaggcaaguaaucucugugaguuugaagcgagccugguaugcauagggaguuccaguacagccagggcaacaaagagaaacccugucuugaaaauaauuugauguuuccucauacuuaguagaugaacagaggaguuaacuuggcaagggggaacuuuggaaagguuuuccagagauauugaagcagauuuaaaucuuagaauacuauaaagagcuaguuaaacacaucugucucccagcuuagacagugugcacgggcaccugggcaaggcucagcauaggcuugacagcuaucuuucugcgggaugucauagauggugaaacuuugaaggcuuaaguuccgaaguuccggcugauacuguccacuuaacucagugugugaggucaccuauguguguuguuuucaguagccucacgcucuaaagugacauugucagugcugaggauaaugggcucuucuggacauccccaagcauagugucucucucugagagagcugagcugucucuuaacgugaaggagggacaagcucagacuguuagauacuaguuucuguguaugauaagaaauucauuuuuccaggacucugaagaugcaauagaagguuuugacaguuugaguaguuuguauuucuuuacccaguuaccacuagcauaguagaaugaugaugacaaaugacacccuucuuguucauucucucucuuguuuguuuguuuguuuguuuguuuuauguuuuaagacacucgcccaguuuagcccagguuggccuugcuaagauccaugauugcugagaucacaugcuugagccagaggaccuagacuuacaagaaaagauaauguuuuuuucuagucuguuucuucuuuauauuuucucucucaugcuugaagccuaaacuguaaaauagcucucugaagccccuugccuggugcagguuaguuacccuugaaccaugcaugaccugguugcuacuucacacaaggauacacaucucugucuggagaaaaccuuacaaaccaagcuuuagcuuccuugaauacuuccuaaacacauuaaauuaugccauuuugcugccuuuaguguuuucuuuuuuucccuaauccuuuuuucugcugacuauaugucugaaccugucuucaucuuguagaccucaauuuaaauuccccuucauaaacccaguucucugacugaccacaggcacagauagcuuccccugggcauccucggccugcuguccugcugguuucuuuggcccuacuuuguggaugugccucauuccugcuucuucccaccugaaugguuguuuuuauuauguuguuugcacauuuucuauuauuauccccauugccuuaaacgagauuauuuuaaaaaacaauuccacaaagguaggaaaaaacaaaggaagaaaauaccucuauagaguaugcuauaaaugggcuagagagauggcucagccguuaaaggguaggcucacaaccaaaaauauaagaguauucgauaaauuugagacuuacauacuuauuucauuuaaccuucacagaagcaaauuaaaaugaguugagcagcuugucuggguuguggcuguuagugacagcaugagguuguaccaugugauucuaaagucugauuugugucuguucucccuccguuucagguuuucuaacgucgauucuccaugccuuucauuuuaguugcucaguaaauauuuaaucugcgcuggccucuugguucuuuacugucucacuuugacuuucuguuaagccuucuaccauaauacaaagaaaacuuaguuaaauucuguguuuuauccaucuuuuaagguuuuuuuagggaaacauugaaauuuuuggcguggauaugagggucugacucaucucuagauggucaucauuccuaucguuccacacaguaauuuuauagguuacuuacccaaaaagcuuugguuagaaaaugguguucaaaguuuucuuuuguaaauguuuuuagaaaaugcuuuccaaagcaacagaagauauagaauugucuccaacuaaaaauguuuccucuuuugugacuuugcuuaaaauaaagaaaccauaugguuccucuuuuuaguuagcugaaaaaggaaacagagaaggaaccagcuaacacaggaaccgaauuauaaaacccagugugguuuguaagaucagcuuugauugguucaucaccucugaugucaguaggaagcuagaggcuucagggugaugcuuccacuugucagcaguaguaaaagcaaaacccacuuuuaaaauagcauccaacauuccccugcucaucauuucugucauguacccuccuaggaucugccacaggagaguacuagaaccucuuagaaucucacucuagcagcucugcauacucuagagaagcaucaagacaaaaagaagacauuuuggauuuaauaauuuugggggacaggaagccugacucuuuucagauuuaaugaagcuguuucuguuacuguaacaugcaagcuuauucaacauacuugccaacuuuguaacuuguacauuccuaaauggacacuguuucugcagagaaagaugauggucagcugauuuggggcaggggauaaaaaggggauuaaaauuuagaauagaaagaaugggaauaaguauuuuuuuucuuuuauaaaaaggagcacuaacaagaaauuauaaaaaaaaaagguuuaggaugcacuagauaugugggaaaggaucaguugauuagaaaagauauugaagaaaaagaaauaauuggaaaugguaguugcuuauuaacuaucaggaaguuacuaaagaagacugaaguaggucaaaugcaguuagagaugggggugggggugcuggggacuuagcucagugguagagcucuugcucuugagagagaaaaugaaugaauggacauagguaaagaggauuguugagaauugucauuuccugucauuggccuguaugugggaacaagaauuaacaaagagcugaccauccaggacagaggcuacaugaccaguccucaauccaggcuccauucagcuuccccuacccucacugcccugccacaacccagagguaacccugacaaccacagagaccuaggaacagucuauguaggaccuuucuuagaaagccuuuacucuccugcucagggaaagcuagauuucucaaccuuauuauagcaauacuucucucuauuuaaauucugagguuuaaaucugcauuuugguucuuuguuuuuuuuuuuguuuguuuguuuguuuuuguuuuuuguuuuuuuaaagggaaaauguacauauuuuuagugacuucguaugcaccgagacaaugagaucggaacucaugguggccugucgcauacugccagggcuacagugauugccugccaugcacauggcccugaguuugguccccauuaccacaaaauuaccuaagaaaaauuaaugcuguucaauuggcuaucauaagaaauacauaucauuuuaauaaggaauugaugaacuuaggaaaacauuccuuagggaaaaaagguaaguguagauaguuaugucagaguuugucuuugaacugugcauggugucuuaggccuuuaauuccagcacuggaaguagagguaaauggaucucugugaauuugaggccagccuggucuacuuaaggaggcccaaaccagccaaggcuagauagugauaaccugucucaaauaaacaaacaaaauuagaucuuucaguuauuuugauauaagaaaaauaaguauagcuggguguggaagcuuauaccuccauuucuggaggcagaggcagggaggucuuagaguuagaggccaaccaggucugcuuguggguuccaggcuaaccaagguuauauuguagggagacccuguccccaaaaaccaaaaucaaaagcaacaaguaaauuauaguacacauauaagagguaggcacauaguacuagugcugucucuaaacuagugagauuuuaaaaccauaguaggaagaaaccagaaaaggaaaucaaucucaaauuacaaguaguauuuuauggccauuuuuuaucaguaaaaauagcuaccauugcugaacaccagaaaauuccugaguaauaagauuuauuugcaugaccuaggugguuguauuuucaucuuccaaguuuuaaaaaaaaaagaaagagagagagagagaacuugguuaacuugacaagcugucacagcccuagugguggcacaguaugaaaccaugcugcccugagccuuggacuucugcuacaugcuggagccuuuguagaauuaugaacaagaaaggcagaggagaggcagagaggcagaggccuaggcagagccaggcagaucucucugugaguucaaggccagccugauuacagaguuccaggacuuuaauuaauuaauuaaaccaggaugcuauaaagaaaaguuauguugauaaaguguuaaaauaggaccuaacccacuuccaaauuauuuuucuuugggauugcaggucuuuggaagcucagugcauuuuuauuuauuuuauguaauuguuccauuuagucacaaggcaaguaucuuuuguauauaccaacaaguuuuuacaaaacguucuuucugugaauguuucuuucuguucauauucuucacuaacaggucagcucagaguauguggcauaagcacacaugugaauaugcacauacccacuuuaucauaauauuuuuuccuuauggaacuuuuaccuuauuuuuuuuuuuuuuuuuugguuuuuucgagacaggguuuuucuguauagcucugacuguccuggaacucacuuuguagaccaggcuggccucgaacucagaaauccaccugccucugccuccugagugcugggauuaaaggcaugcgccaccauguccggccuuauggaacuuuuaaaaugacauaauauaugucauaauuauuacuuaaauauaaaauuuauuuuauacaaaaaugacaucuaauuuaauuucucuuuaaguuaaaacgaaggugaccauugaugguuuauaaacuaaaguguuagacaaaaauaauuuaugccaguaaugguagugaaugcuuuuaauccuaguaacuuguguguuggagacagaaagaucugaguuagaagccggccugggcugcauguaaaagcacugacuuuuuuuuuuuuuuucuuucuaaauaguggggaaaauacugaugagauaaucuaaaucuauaggaauagacagucuguguagaaaguaacuuagacucuguccccucucuguuuacaaugccaggccaaaccccaggccuuauacauguggggcaggcucugccccagcuugagaauuuuuuaaacaauauuuuagagauuguaaauuuagucaaagccuguagaauuuaauuuuauuuuuaacucuugccuuacuuaaaauuauuaaagugauuuaacaaauauuuugacugaguaaacuucaaagggcugauaauauuaaaaucuugauaaaaaucuuucagacaguaucaacccugaguauaaauuuauaaaauucugcacagcaggaccacagaaacuuucuguagacaucuuuaaacuguugagagcugaauucaacuaaguaugaaacacuaauacuguuuuaguuuuuaaaauaaauaagcaaaacugaaaucagaaaucagagggccuguguccaggugugcuuaccugugaacuucuuucgcagaauguaaauucuuguucuaacaggacauguuggugauuuggcugagagagcaaagggguguuucagugcggauuaacgguggucuccagcgcacugagacggcuucugugcagcagaggaaguuuaucaguagccguuacaggaagugcaauaugccacagaaugacuaagaguuugcuccuucaccagagcguauuuugaaacacaaucuauauaacuuuaagugcuuguagcugauguuuguaacugaucccugacucuccaggcauggggauccauaaucuaaaaauuuaggacggagucuugccugagaaauuaucuauucugagguaaauucugagggauauuucuuauuagaagaaaugaauguuguguaggucucaggcaagucagugccuucucacucaccauuuccuccucuaaaaaccuacuguuuuggaacauugugagcacuggguaagaugacaccucccauggcaggugagccgugcaugugaguguuacuccuucaucgguagcuuaaauugacuccaugaggauaacugaauuauucugugucugccacccaacuucaucuuugauugcagaaaaugggagcaacugucugaagucauuuccaaucaggucuguuuuacccuugaagaagacaagcagagccuggcauaaugaugcaugccuguaaucucagcauuuuagaggcagagcaggaggcucucugguguguuggagaucaucacacacagugacuuugaggccagccugaauuacagaacaaacaaaaccccucacuccacccccagaccuuauaaccacaaaaggacuagggcagagcagccagaagagaugugagagaaagaaagacauucaugaugcucuggagaguaaaagugaaaggggaaagucugcuugcccucugugcuuuaauuuucauuuuaucgacacuuugcuuuaucugguuaugauuuacuaaacauuuagggagaggaacuuuuuuuuaaaacuaguaguaaauucaugagaaaauuuguaucagcaguuaagagcacugacuguucuuccaaacaaccaaguucagcucccagcacccacauggaagcucacaaccaucuguaacuccaguccuagagaggaucuggugcucucuucuugccucugugggcaccagacacauauguagugcauagacacauaugcaagcaaaauacccauacacauuaaaaaagauagaaagaaaauaauuugauuucaugugccucucaacacacaguucauuuaaagauguaacccagaauuugaaguaacagaguugacagagguaaaugugauggucaaggguaacaccaucgggcugcagagauggcucagcaguuaagagcacugacugcucaucagaagguccuggguucaagucccagcaaccacauggagacucacaaccauccauaaugaaaucugacauccucuucuggugcaucuggaaacagcuacaguguacuuauauauaauaaauaaaucuuuuauacgggggaaaaagguaacaucaucuaggaaguuaggaagaaacacccaguacuugacuugaaagucagcucaauauaacuggaaucagguggagggcgugagauuaggcauugauauuuuuauuugguucugauguguagccaggaugaaucacuaauuaagaggaaaauguuaagggcuuagagggauggcuuaauaguuaagggcauuugcugcucuuguagaguacccaagucuaacacccaccuggcaagucacagcugucuguaacucuaguuccaggggaucugacacccuuuucuggcaagggcacugcaugaacauugugcauagacauacauacaggcaaaacacccacauaaaauaaaaauaaauccuuacauuuuuaacaaaggaacauacagggcuggagaaaugacucagagguuaagagcacaaccagaggucuugaguucaauucccagcauaguagcucauaaccaucuguaaugagaucuagugacuucuucuggcacgcaggcauacaugcaggcagaaugcugaauaacagauagguagguaaguagguagguagguagguagauagguagguagguaauuagguagguagguucguagguagauagguagguagguagguagguagauagguagguagguagauagauagauagguagguagauagguagguagguagauuaaaaaaaaaaaagaaaaaaaaaaagaaacauccugcucuugcaaagacccagguucaguucccaggacucacauuaggugguucaacaucaccuguaacuccagcucuagagugauacugaauaaacuagauucugugagcaccuguacucacaaauguauacacacacacacacacuucacuuucuuuuauucaugcugcucuggagaguaaaaguggaaguugaucauuuauaaguuacuuagcauccuuagacucuaaacauuaaccagcuuuaaagcauuuguuauguuuuguuguuaaugcuuaagacagggucucaauguguaggcuaggcuagccucagaaaccucugauuugagcuuccaaaauguugggaauaguauaugcauuuauguuuguauaccauguguaugccuaguucccaaggaagccaagagcccuuggaacuggaguugcagccagcucugaggcuugugugagugcugggaaucgaaccaggguccucuugaagaccagucagugcucuccucucuucugagccaucucuccagucccuuuagauguuauucuugaacacuaaaacauuuuuauauuuauucauagccuucuguugugggagugaaucugaucuauuuugguuguguuguuuuucuuauuuuuauaacauauucuaaaacaacauaaaugaaagauacauagucagcuuuguucuaaagucuguuuucauuuauuguacaaaauuaaguuuuaauguguuauguauaauagaaaagcagucuugucuuacgccauauguaaagguaaaaagauguagccuaauauuagcuguacuaagauagcaacugguacagguucuaucucauccagugagaauguaccauugcguuacauaguugaauucuacacauugggaauuugacaucugcuuggcucuaagggcuuaaaagaacucuuccaaguucaaguacauucagacagaggucauucacugcugaacaggaauguuuaauuaccucauguuauuucuauuaguuucuuuagcugcuguuguuuuacuuucuuaaaaauaugaaguacgaaacagauauaaaccuugagcaagcauacaucucccuuucuggucugacgcuaaacaaagagcaugucagacuuuggaucaucugagcaaacguggaugggaaauaccaccagccagcuuuauuucuaacucugccuuccucauugcugcuuugcauuucccuuuccaacccacagccuaguugaguuuuucaguuccuucuucgugcuuucucucccuggcugcuguaagcacaccaggagauugcaauaggagguuggagccugugagcuccuuugcucuuuuccaaguguccgacucagcaguccagagcccacuacuugccagaaagucaccguugcuccgcggcuggcgcuugccuacuugcuuugaccuuuugagagaugagacuuuguuugccagaaccacaguugauagaaauagaaagguacagauaaggaaaagcacugcaauuacaauuaagcaaauuagcauggccguguugcugguguucuccucacagacuuccuuuuuaaacguuucccccugacuuuugaucucugcuguuggagaacuguuucugaaggcauggggcguggaggacuugaguguagauguggaagcuaaaggcacagggggagaugaugcaggcuugucuguggcgcucaccuugugacccacggcaggagugacaagguuuguguuauugucacucggaugucugcuggagccauucugauuacuggaaccugaggcagugacacugcuagcccacagguguguguaguuuggucuuguuccagaagacgacgaggcccacacuguugucaucaggaaaacaagaugcagguacuguccuuugugcuccauaccuacagguccacugcuaucuguugggacagcaauaucaguuguuaguuuguggaagaacagugucuggcacguggaguaauuguuguuaacaggcugcacuugagauagcacaaggacgccagagauccaugccuaccuuuuguuauuggauucuucucaacugaauuuguuguuuuguuuuuuaacugaauuuucauuucuguucuuagauuguacauaaaaauugaaaacuuuuguuguacauucuguaaugcuguaaguuagcauuacaaaucuauugaccauguuuaaccuugcaccauagcucuacaaauucuccuuuuaagggagugcccuggaccugggcuuggaguccgaugcuucugcuuuugugcugugcuuccucuuugaaggcuccuucucacagaaguaccacccucugacaagcacagccucaucuugaaggaaaggagaacauggccuugaaaguuucguuucaaguuuuaaaagauauaacaaguggcuuuuuuugugggagagggaggguggagguugguggagccugagagcaagugugcaucaaaugagaaugugaagugcguuuguccuuuccagcaugaugcuaagcagcuugaggacucugguccuaggaugcaacucugugaguaccgcugauuccaccucuguugcuguagcuggcuauggcuuuccaauagcagaggcacagugcuucucucaaccagaacccggaaaaacaaaagacuucuuugcucucaagagguauauaaagguggccacccuuauugucaguuuguaacugacaucuuuuucucccuuauuuuaacagaaaucuacaaaagaaauuauagagaaaaauuaaaaggaaucacucaucaggcuccuggggcccaagaacacagugcuugacugugagcagcucaccguagcauuagaaggcugagacagucaggggcagccuugugguugcgcaugcucagcccucgucccaccccuccucccagacauuuaguuuaguuuaaacaaaguuuaguuuggggcucagagcuuccuagaagccagugucaggacaagauucuguucuuagcucuuguuaucagcuaucugcuuagaggucucucugggggugucaugucugccccaagugcagcuaaccuagcaagagacauuuggcuacaccuuuagagaaauaaguuguuucuucucuuuaaaaagucagccuaccucugccuccugaguucugggagcaaagguggguagccaggaccagaugagguguuuauaauacuauaccuguucuccagagucacccuuggaaaaauauuuuauucagagcauaaaugagaggagccugagcaaacucuagacuguucuaagacucaaugaguguaguugucuuguuaagauuguuuuauagcuguuacuuucaaacuugacuauguggaggaguuuuuuuuuucaggucuagguuagggccuaagauucugucucuaaacuacuccuaaguaguacagauaccacccugcuggucacacuugagccagggagguuuacuaugguauaaucucuggcauucgacaauaucgaaaugcuaauaaagcacagaaguugagauuaacaguugagauaugcuaaguugcacagacaaaaauagcauauaguaaaugaugcuaguuagaaacuacaguuugauucauaucuuauacgcagaguggagaggggagcccccagugcucugggguccgaucacuauugagauuaugacuguugguagaugcuuaaagaucaacugcacuggcuuuugugcgauaguauuccgcuucaucuucaaguuggaugguaggauucucacgauacuuuauacgucagucacauaccaaaaaaaaaagcacuuuaaauugauuuaguaagaaguguccguccuuuccuaccagaguagacuuaugcagucaguguuaaaugacuuaauguaggugauuuuaaucacauuaguucauucacagugcuguauacaucacaguguuguacacgcuagccguguaccacaggacaacauaauagaucugcuguugguugucuucagccagaugugcugucaugcccuaguaaacaagcuguuggcaccaucagacucucucuuugcucacaauugccugagaacagaaacuguuccuacaucucuauuuuaugccccagaggccaaguuggcuuagcaaaguuuugauuuucugguuuugguuuugucucauuauuuuuagucagauaggucauuccucagcugcaguaaugagaauguauuuccuuaauuuaaaaacaaaacaacaacaacaacucaaagcuuuucaacucauuugaguacaaacucaagaccuuccucauccugauuuaaauuccauauuaauaauuauaaauuuuuccuagaucuaauugauuaugcuguuuacuuaauuuuucauaguggaauagaaaacacauagcgauucuacauuguuagauauauguauauaccuuugaaaaagcccuuccucucuacuaaccugaacaguuauaagugggaggaguaagagagccgcaugugcuaccuaccuucagagcucgcccagccgucacuucguaagccaccucaguucugcucuucuuauuuuaaguagaauacuuuggagacugugaaacuuaaaucugcaggguuuuuuaaagaggauauguacagcuagcuuuccacucuuaaaaccaaaccacagaugacacauuuccuuuccgcugcaacucaacuacaugucacggggaaagcaaagacugacuuguccagcuggcaaugggaugacaagaggcuuuguagcgccagucuccacccccugaauggggagggcuuuccucuuuccuuccccuucccccuuuucucucccaccuauggcuuauuguuuaugccuacuaucugcuuuugaaauuaguauuauucaauggaaauuacaugauggcaucuuuaguguggcauuaaaaucacuuuucuaauuuuauaucacagacugauuugaaaacauaaaugugggguccuuggagguguuugucagcuaggaggaucaccgaguccguggagguguuugucagcuaggaagaucacacacaucacugccguuucaagcugcgaacugcagcagugaucugagcagaauuugggccagagaaugcuuguaggguguggugugugcaguugugucauugccucagauuagacacgucuguucguccgggauggauuacacgguuuugugugaaaucagauagacuccucugaugaucuccuugguucugcugaucguaccgaagccugggucacagcagauccccucugauccugucucacuacgauccucccuucagguuuucugaggugcuuguuuccucacuagccccacacaugucacgcaucucuaacgcugucuuugaucaucuccucccuuuuucugaaugagcaccacacuaaucuccagggaucauuagacacuuucucaucuccuuaaaaagaugaccacuuuuaauuuauauaauuuaaauuuuuauuuauuuuuauggugucacugggacugaucgcaguuaucuacgccuaccuuuauguagguuuugaugucaccagguuugcaugaccagcaccugcugagccaagucuuucacaccuccccuccuuuuuauuuugagucaaguuuauuaaguugcccaugguagcuuugaauauuuuuggguuuugcugguuuuccuuuuuuuuuuaaaucuccucucacaguccaucccaaccacagcuuccccucccuccucuccucagucugccccguaccuccucuuucccagauccacugcuccuccauuuuccuucaauaaagagcagccugaaacagcuucuuguggaguugaaacuggccuagaacucaauauggagcugaggacgaccuugccuuuauggucaucuugccuugcucccaugugcugggaucacaggcuuuuaucaccacauccaucugagcgcuaggaauugcaccuaagcuuucauacauccacuaggcaaguacucggucaacugaccaaugccacagccuccuugauucuuacuaaaagucaaaaaaguugccuauauuuucaaaagugauuccaaaauauuugcaaaauugagaauauuguuuuaaagcagcaaagugucaugcucucuacauacauuuuuauuaguaggccugugcugguaccagccaguugauuuccagcaagcaggauagugggcucugacacuggcaguccacagagcauagcuugacaaauauccacccccaggcaaacacugaggccuuucugccccucacggcuguugccuuccuuuguuuacaucugcaucucuguaagcucaccuauguggaucucauucucuaguuaguguagaacacacucuuuccuuuccaccucuccucaagccccacuucucuuuucuguucagcucaaacuuccuucuaucagagucuacacuggauuuuuaaaauaucuacauaguuuucccuauauauuuguaauuucacguuggucuuaccuucuuuugaaugucacacuguuuuuuuccccucuguuguuucucuugugagugauauagacuacaucaugcaggcugaauuuguccaaagugcuuaaauccaaauauuugcagguuuagauuuccuucagauuuugcaauauucacauuuacauacacauaaaaugagauuuuagguggauagugaaugcuaaacacaaaauucgucuguuucauauguaccuuauacauauaacugaaggcaaaguugcacuuuaguguaucuaugguuugagcauuggguuugaauuguccacccuggcaucugauggcauucagaaaguguuuuucagaauaggaauagccaaccuguguauuuucuuuuucuuuuuucaacuuuuuguuuguuuauuugguugguugguugguugguugguguuuuugagacaagguuucucuguauaacccugacuguccuggaacucacucuguagacuacgcuggccucgaacucagaaaucugccugccucugccucccaagugcugggauuaaaggcauucgccaccacugcccagcuuuuuucaacuuuuuaauugacugugaguuucaaaucauguaccccacagucccaucuccucaugcccuuguauuugcccuccacgcuugcaaaccucacucccaaagauaauaaaaaacaaacaauaaaugaaguaaacaaaacaaagcauagaaaacaucucaucauggaagcuguaguaugucacagugugucccacaguauaucccugugcuucacacaucuucacuugcaaauguucauugcaaugagucauuggucucuuucugaggucccuggcuucugucacaccaucaguauuggauucucauugggacuccucccagacaucccauuguugcccucugucauggaguuccuucaggucuggaccaacaagauugucccuuucaugagcucccccaguucacagauaauaaagauuuagggaugggccaacucaaagcccuggaucugagccuagaugauagcuaagcucaucagcaugccaggucuuuuuuauccacaccaccaggggcaagcucucuagcacugcugcagcuagcccacuuaaugcugccgucgucaagaggcagcgucaguucuccugcucgcaagcccucagagaggcuuauccguacucacaccuccagagucagcccagcugaggcaugggucccacucucucaagugcugcagauagcaaagggucaggccaguucucacccucucagggcgggcccaccugccuucucugugagggccagcucuacuauauugagcaggcaaggugcagggccugcucucccaagugcugcagcuggugguggugccaguucacucucugucaugaccagcucucccagcugccucaaguggugggggggggugucuuuuaucauuuauucuuuuuaaucuuaaacuguuuguuucauuuuaaaaauaauuuaacuugucauuuuauuuuuugacaagauuaaaaguuuuuacaugaagauacuuaucauaacucagagauaauggagcauaaggaacagugggccugaguuagucaagcacagcacucuuccgagcuuccuucugugccuacuugugcucuuucaguugugagccaagugugccuggggaagcgggggaaacugcgggugaauguguaaggaccaaaucaaguccugaggaaugaaugguguuugaaugccucagguccauggcaguggcaaagcuucucucacacacccccauacacccauggugggcugggaaggacugcagagccguccucucgucccuaggauguuggcaggguguacaaauaugaguguuuaccaacaguugaccagugugugccaaaguuggcaauugcagcucucuuucccccuggucgguaaagcuggagacugcucacuuacagaagucuccugucaagacuagguggccucgcuguaccuaauacauuuccugaggguuaggcuugcugcaguuguuggugcagcaccaucagagugcacacagcccaccuccccccagcuugucugcuugugcauuugugucagcccuuucuugauuccuucacugcuccagucagauuuccaggacccaagccaaguggacgugguguaugaccuaaugugguuuaaucaaaacauggaacauuagcuuauacagcugaacagccuggauaaaucuaaccaugggggagaauuuuaucuaugacucagauuauagccaaacuccagacugucuuuucacuucucagcuccuucucuuuggguuuugaggaagacuuuuccuuccuaucccaagauaaaauuuauaaucccucggcugagcaguaaugaugcagcccuuuaaucccagcacucgggaggcagagggagguggaucucugugaguuuacaaagugaauuccugcauagucauagcuacaaagagaaacccugucuuugaaacauaauaaacaagcaaacaaaucccagggcuguguauuuucuuaauuacaaacauggagaaaagcucucaaacccccacaauucgaacuaugauuuagccugggauuuaagccucuggcuucauuguccugacuugagucuuuguguucauugcugagccaccuucuguucaaggucagcuccauggauuggccucagcuucugagcaucuuuuccagccacuggccucucugaggaguacccagugucuuucacugucuucuuucuugauaggcagauuuguugcuauugccauaauuuuuaaggaguuuguuucuucucucuuuauccuuauugcuuaaagccuggaaaauauaaaacaaaaaaauccauacuuugaagacuuguuuuauaucauuguucucuuuagaaaauuaaucagaaccagagagauagcucagcauuaaaggcuaagcucagaacuagaaauaugaaaagauuaacgauaaaauuuuucaaaggggucagugagauggcccaacaggugacgaugcugucauuauaagccugacaaccuaaauccagucugcacagcauaccugguagggagcgaggggagcugacucuugcccccaugggugugcuguguugucuucuggcuuccacacgcaugcacacgcucacaccgacaugcacacacaauuaguaaagguaaacaaaaauacuuauauucuguacauucagaacauuuuaacaaucuauccuuuuuuuguugccuuccuuagguucaaaacuggccagaucaauggugaucugcugauauaccaugucuugcugacuuuaaagccauauuaugcaaagccauaugaaauuguaguggaccuuacccauacugggccuagcaaucgcuuuaaaacagacuuccucucuaagugguuuguugucuuuccuggcuuugccuaugacaacgucucugcagucuauaucuauaacuguaacuccugggucagggaguauaccaaauaccaugagcggcugcugacuggccucaagggcagcaaaaggcucauuuucaucgacuguccugggaagcuggcugaacauauagagcaugagcaacagaaacucccugcugcuaccuuggcuuuggaagaagaucuaaagguuuuccacaaugcucucaaguuagcucacaaggacaccaaaguuucuauuaagguaaccucuggucuguuuuaaauauuuguugccuuuccugacuaaccagguuauauugugaucucuacaaauguucucauaguugcauaucuaauauuaguuccauccagaugugggaagaccaagacuucuaucuuuauugugguucuacagaaaauugcacacuuacaagacacucucauaaagccugagugguggcacagugguuaagagcacuggcugcucuucuagagauccaggauucaguccccagagcccgcauggugggucauaacugucuguaacuccaguuccaagggaucuucuggcucccgaggacaccaggcacacaugugaagcagagauauauaugcaggcaaacacucauacacacaaaauagauuaauuuuuaagguacuuaguuuggguaaggggcaaaaaaaaaaaaaaaaaaaaugcuauagacugaacucugcccagugguuggcuguguggaauggaaaggaccuggcgacauaguucuguugauugcaucaugguuuuucagaguggugaguuuuacccccuucaguauuuauaaaauucuuggccuuuuuuaaaagaaaaaugauuuuuuucuguuggauccaguuucuuuugagaguauuuauaaguaaguguuaaaguaaacuaaauaaucucauagcuaacauggcguggggggggaaugaguuggguuuuggagcuucugagaauucuguguaacuggaaucuauuccuuccucacaccguuucucagguugguucuacugcuguucagguaacuucagcagaaagaacaaaaguuuuggggcaauccgucuuuuuaaaugauauuuacuaugcuucugaaaucgaagagaucugccuaguugaugagaaccaguucacucuaaccauugcaaaccaaggcacaccacugaccuucaugcaccaagaaugugaagccauuguucagucuaucauucauaucaggacccgcugggagcugucacaaccugacuccaucccucagcauaccaagauucgaccaaaggaugucccugggacacugcuuaauauugcguuacugaauuugggcaguucagacccuaguuuacgguagguauuucucucccacccuuccuuuuuuuuuuuuuuuuuaauuaaauucacuucaaguugaauaguaucucacuguuguuaacugagugccacuguuaagggcaagggaaggccuaaaguuuaaugaaucggauacauuacugcguccuaccugugucaucucaggaguuuucucuaaagaaaucuucuggugcucuuccuuugccucagcaacagagcaacaugaacaaaaagaauauuacugucuggagagcaucacagucaaauaccacguucugucgcggcuguggccaagugcaaggcaauguauaccuggaaacugacagagaacacugcugggcaucgugcaugaggcgccuaggcauugucugcugcacagcucaggcagaagcacagcccagccuguagacucagcagaugugguuugguggggagcugcuauguuguaacacagcuugcuuucaggcacaguggggaacucuccuuuuugguaaaauauugguaacaaugccuuccuaauguaccuaucaggugaagguuugacaguagcauuugcagucaggucuauaacacaggccaaugguuugugcuuagcgaaugguguuuucccacuuccuauucccaccuccuuucucuuccuuuucuuuccauguguggaugauucuuuaucuucgguaucuuaagaaggucgagaauuucacuuauggagguagaacuuuccuagucugaauuccaagacgcuccagaaucugaaaucucuuauguacuuuguccagacuuucugacaugucacuuuauuaagacgagcucucucuguguagcucaggcuggccaagaacuugcuggaauuaaggucacuuucaccacccccaccccaauuucagagcuuuuaaucauagaugcucauucugcaaaaucuauguaaauauuucaaacccugaacauaucugaauauggucauuuuagauaagagaugcuuaauucucagauucaggaacucucccuuaggauauaacauaacccaggguuuaugcugggccuuauaagcuuucaaauuugccuuuauuuagaaggaaaaaaaauguguccagcaagaugucucaguggauaaaagagcucaucacaagccugaaggagagaacuaaaucccaaaaguuguucuuugacuuccuuguauguguccacaugcaugcgugcgcgcgugcaaacacacacacacacacacacacacaguacauaaaugaauaaauguaauuaaaauuuguaagucagauguguaacauauguaucugauaccuguacucagaagacacacacgaguggaucugugaggucugcauagcaaacugugggauagccagggcuacauaauaagacuaucucaggaaaaaggaaagcaggacaauagucaacagauuuauuuuuauuuuuauguuacuuccauaggccucauggacucucacagauggcuugguaaauuguauguguacuuggcucuccuuaccuuagaaggcucuuugacacguacccaaguuauggaagcccaguuuuuuaugacucuuagguaauauaaaauagcaucagcauaguaugacuuaucagucagagaaagauaagcauaaauucacagacaguaauauguauucucauguuuagggaaauugagcuauaaggccugucuuuacuuuucgauuccaaauagaucuuuauuguuuaucaguuggguauuuugucuuucuaaccuggaauuacaguccuccuggcgcugcuuccacugaaugcuagggguacaggccugugccacaaugccuugccacuugccaucucuguuaaauaaugcuaauggccaccuuggcuuaagugaaaccaucccacuuuccaaguuaguaaaggauagcaucccagagaaaauaaaacaccuuugggcaaacgucccaucuccauagcuuuuccuccugugucaacaugucagaaacucagacguagugaaagccugaaguucacugagaagcccagcuguuuguuuugcugcauuuuaaaacugagccugauggggguggguggguaugggggacuuuugguauagcauugggaauguaaaugagcuaaauaccuaauaaaaaauggaaaaaaaaaacugagccugagauuuggugggguggggugggguggggguggaaugacacguguuauuuugaagugcuagggauugaacccacaggcucauacauguaaggaaaccauucuaccucugagcugcuacagcgcaaaccucaagacuuuguuaauuuuuguaguuugcuuaaauacauauguauguauuuauaauauacuuucuguucuaauagaccauagguaauacauuauugguuccagugguuauagaucauagauuaaggucauagaauagaaaauguaguugcagcuuuuuaacuagaguuaauuuuuguuuuaaccucugguuuacaauguaaauuggacaacauaaacauuccgagguuauccuuacuuuaacacuuuaaacauuauuugauuaggugccucuuguggcccuggcuguccuggaacucacucuguagaccaggcugcccucaaacucagaaauccuccugccucugccaccggagugcugggauuaaaagcgugcaccaccacugccuggccuagaugccuccucuuaaaacauaaaguucucuugcuauguagcccugacugucuggaacuugauguagaaaaggcuggccucauauucauagccuacaucugccucccuagugccaagaugaaaggugugcacugccagaguccuccucacucuccuucucuguuuaauuggaucugugagcauaguguugacuucacucauaauacauggcaugccuuuauucagucauuuacuucuauugaucacccaagacccuaaaucuuuacugguuuaugcucccaugaagauuucuaggaaggccagcaccucuuaagaguguccugggcucuucucguccggcgcugacuucaggacugguuuuucucacucuccuguuuggggcuugccgcacauucugccucuagucaguuguaacacugagaaagaaucgaccgugcuuugugauaaaaccuagaguuguauguuguggggaaaauguaacuacaaacaaagaaaauguaaaacaaucuccuucaugucuucucuuaggucugcugccuauaaucuccugugugccuuaaccugcaccuuuaauuuaaagauugaaggucaguugcuagagacaucgggguuaugcaucccugccaacaacacacucuucauugucucuaucaguaagacgcucgcagccaaugagccacaccucaccuuagaguuuuuggaagaguguauuucuggauuuagcaaaucuaguaaguaaugacuuuccuuaauauuaaaaaugacuuuuaagacaauucaaagaaaacucuuuuguuugggaauuuacuaggagucucucacuugcuuuuuuuuuuuuuuuuuuuugucugugguacccuguaacuaaaggaccucugaaagaaaauccuggugggauguacaaagagaccuaucagaacucugugggacccucuucccuguaggcuguuggacagauuuccuucuuuauuucagcgccaugaacuuuaccacuucuuuuuuuagauaagauauuaaggaaauaguugcuuuuccuuuuauaguugaguuggaacuaugauuuuuauuggacaucuguugguagaugaugccagauccagagucagcacugaguuuguuuuaauaaauuucauuaauuuaauauuuauucuuuuuaacaucuguccuccuucauacccuguacuaacauagcugcugaucuuugccuggcuuaguugcugacauuuucuucuccauauaauacauacagcuuuucccccugcauucugcauucaaaaucauaucuuaauaucucaguauuaggugauuaagugcuuuaacaguucaucaagacugugucugauuggagcuggagagauggcucagugguugaaagcacagguuacucuugcauaggacccugguuugauuccuaucacccacauggcagcucacagccaccugugaagccaguuucaggggaucugaugccuucuuuuggauuuuucaggcacugcaugcacaugcugcacagacaugcauacaagcaaaacacccuuacauguaaaauaagauaaauuaguuaaaagauaaaaagacugcauagguacguuuuguucuauuuuuuuccgucaaguggaagauguaggaguguaacucugaagagagauuguacauuugagaaacaagaaaaguacaacguuauuaguaacuauaaaugcgugaagauaccugagugaguggacaggcauacugugucuugcacaaacagcucuucugggacuauuucauauuuaauacagucccaucaaagaguuugaaauucccauggaauuugaaauuuucaaaauauuuuaaauuuuacugaaaauaaacagcuaagaaaauguuauaaagaaagagagugcagaugugauaguacagaugucuccucacuuacauguuguaauggcauaguaaucaaaacaugaauguucaaaacucagccagcagaucuauuuaagagaaacagacagcucaagugucacaaacugauuagugagaugaaaucacuuaagaaauaaguuugaaaaguguagguuaccuacacaaaacauaccaguguaaguucugacugcauuuagaagcauugguagagguggggcuuagaugcuuuuaugugaguagugugugugagagcagcacacccaggaggaaggugcagggaggaaggaagagaucgcuucacgagacucuggaagaucuccacagaaaaaagaacacaccggugugugacuaagcugggcugggagguggcuucacugaacauggaaagauuaacguccuuaguucagggcuccucucuguagcuuaguaaaugagucacgguagcauaauacuaaaaaaaaaauauuuuuaaguuuguuaauaaaaauuacauauugaaagaauugugaaaaacgucuuuuaaagauuaaauccugagggucuguagcauuguaaacaagaacaauguuucuagaaagacauuuagaaguagauucgacccuuaagaauauuuccaucuggggcuggagagauggcccgguggauaagagacugguuguucuuccacaggugccagguucuauuuccagcaccaacacggcagcucacagcuguauaacuccaguucaguggaugcaguauccucacacagacauaaaugcaggcaaaacaccaguacauauaagauaaaaguaaacaagauaaaaauaaaguuaaagaauauuuuacauuuuuugacauuauaguucuacuuuuuaauauuuuccugaaaaaaaucaaugcuaaggaaccagcaagauggcacaauaggaaaagugucaugccacaaagccugauaaccuaacuucaaucccuggggcuuauguaaggguggagggaagaagccagucccacagaguucuccucugaccucaccaggacacacauacccuugcacacacauuuuuuuuaaaagaauuaaugcagagauguuuauagcauauuguuuuucuguugcuacuuuaaaacuaagauauaucuugucauaguaacguucccagcuguuaagugaguagauguuaauuaaugagcuuugacagggaauaaucaugaaaagaucuucuagaucauagccuauaguauuccuaguguccgucagcuucucucaguaccaccuccucaaacucagagauccgccugccucugccuccaagugcugggauuaaaggugugugccaccaccuucuagcuuggcuuucuuacuuuaaauuuaguuuuuuucaaagugucuuuaccucuuaucaaaauguuugucuaggccuaauucaagauaaaaaucuuuaucuucaaccuucucucugguccuuuguugugggaaauauuaaaaaagagagagagaccauuccgcgcuauacccagcuacucucuggccccagaggucucagucuugcugcuuccacuagccccagcuccaguucaccugccucagagccgcuuguaccuuuccagccaucuacgcccugcaacuagccaucacaaauccccuuaacccaguaaaucaaacccccccccuuuuuuuuuaauuggauaucuuuucuuauuuacauuucaaauguuauccccuuucccaguuuccccucuggaaacucccuauccuacccgcccucccccugcuucuaugagggugcuuacccacugcccacccacuucugccuccccacccuggcauuccccuacacuggggcauguagccuucccaggaccaaaggccuuuccucccauuaaugucugacaaggccauccucugcuacauaugcggcuggagccauggguuccuccauguguaauccuugguugguggcuuagucccugggagcucugggagaucugguugguugauauuguuauucuuccuauggguugcaaaccccuucagcuccuucaguccuuucucuaacuccuccauuggagacccugugcucaguccaaugguuggcugagagcacccaccucuguauuugccaggcucuaaaagaggcucucaggagacagcucuaucaggcuccugucagcaugcacuucuuggcaucugcaauaaugucugguaucuguauaugggauggagccccagguggggcagucucuggauggccuuuccuucagucucuguuccacacucugucuccauauuuccuccugugaguauuguguucccccuucuaagaagcacugaagcauccacacuuuggucuuccuucuucuugggcuucauauggucugugaaauguaucuuggguauuccgauauuauuuagucuaauauccacuuaucaaugagagcauaccauguguguguucuuuugugauuaaguuaccucacucaggaugauauuuucaaguuccauccauuugccuuagaauuucaugaagccauuguuuuuaauaacugaguaguauuccauuauguaaauguaucgcauuuucuguauccauuccucuguugaggggcaucuggguuguuuccagcaggcuuuuauaaauaaggcugcuauaaacacgguggagcauguguccuuguuacauguuggagcauccuuuggguauaugcccaggaaugguauagcuggguucucagguaguacuauauccaauuuuuucaagaaccuucagacugauuguuguaccugaugguuguaccagauuacaaucccaccaacaauggaggaguguguuccucuuucuccacauccucaccagcaucugcugucaccugaguuuucaaaacucuuaaaacuuauaauuaucagucaguuuuauauaucaaugaauucucaauucccaagaugcccauacaauaauuuuagagccaguugauaaugacacaagcugcccaccuagauuagacagguuaucccaaucauucuauccuucuaugauauucauagcuaucuguggcuauuuaaagccacauggaaucugaauccucuuucucuucuguucucucucccguugcuaaaaaucuccacccgccuuccuuuuccacugcccaaucacaggcuucuugcuggguuaauauuuaaauuaacuggaggaaaauucugcugcauccuucaugacugaaucauuccugaggcuagagagguggagcagcuguccuggcuguuccuucagaauaccuggguccgauugccaguacccauguaauggcucgcaguguuuauaacccauguaauggcucacuguuuauaacccauguaauggcucacuguguauaacccauguaauggcucacuguguauaacccauguaauggcucacuguguauaacccauguaauggcucacuguguauaacccguguaauggcucaguguuuauaacccauguaauggcucacuguuuauaacccuggucccaggggaucagacacucuuuucuggccuuauuggacaccaggcaaguauguggcacacaaacauacauguacacaacauacucaucauacacauaaaaauuaaaauguuugucauuuucuucuacuaucugugcuaauggaguauuuucuucacagguauugaauugaagcaccuuuguuuggaauauaugaccccauggcugucaaaucuaguccguuuuuguaagcauaaugaugaugccaaacgacaaaggguuacugccauccuugauaagcuaauaacaaugacuauaaacgagaagcagauguauccuucuauucaagcaaaaaucugggggagccuugggcagguauugaauuuacacugacacuuauccagugccucuuuugugcuaguaauucuugguuuccauguuacacagagcacccuguucugucccucagaagcauguagacacauacccagcccuguaaauagcuaaugcaucucagagcucucuuccuugcauaauuuuauagaguuuagcuauaggcaccugucgucauuccuaguaaauagcaucuaaauauguacuuagucucuaucaccacugaugucugucacuucuucucagugaugcuauuuacaacaucugcuugcauguauaguuguagcauagauacaacuuuccuuaaccugacaagggaggugcacguuauuccuucaaaauaaucacuuaaggaagcagugcccuuaacuuagacaauguuguaaacccuauaaaugauuuuaauuggcuuuggagccauuuuucugacugacugguauuauuaaaguaauuagauuggucauguguuacugucuuggagcacagacauagugucuaagcagcugaagauagucgugcaaagaugcuuaaccucugaaggagucaaguggcacccucuuccuucccugcaugguuuacaggucucuuaagucuagaacuuugaaagucucuaguaaaacaagauguccauuacuugggcucuuuugaguauuucuucauuaaaggcagcaugcuugacagcaacaugacuugcuugucucaccagaucacagaccugcuggauguugugcuugacaguuucaucaagaccagugcgacaggaggcuuagggucuaucaaagcugaggugauggcagacacagcuguggcuuuagcuucuggaaaugugaaauuggugucgaguaagguaaccacuuuuucuguaccucuuggacuaugccauaguauaucuauuuaucaucuugagaguuuuugucuuauaaccagcuaaguuuaaacagauuugagugagagugugugugagaguguguguguguguguauacgugugcaugaaugucuguguacacgcauguuguggcacacauggaggagucaggauaguuugugggagucaguuaucuccuuccaccagauggcccccaagguauggagcuggaugcugugcacccuaaccugccgagccgucucauccauccugaauuuauuuuuuagauuugcuuagguuucuuuuauguguaugugugccacauguguacaguguccgcagaaaucagcagagguugucagaaucccuggaacugaagcugcagaagguugugaucugccaugugggugcugggaaccaguguucccucuaagagcagcagaugcucuuaaccucugagucaucucuccagcacccucaauuuuacgugugauggaacuuuuagucuuauguuuguaaaacuuguucuucuuuacagguuauuggaaggauguguaaaauaauugacaagacuugcuuauccccaacuccaacuuuagaacaacaucuuaugugggacgacauugccauuuuagcccgcuacaugcugaugcuguccuucaacaacucccucgauguggcggcucaucugcccuaucucuuccauguugucacuuucuuaguagccacaggucccuugucccuccgagcuuccacacaugggcugcucaucaauaucauucacucucuguguacuuguucucagcuucacuuuagugguaagucccuaggaggugaucucgcuucaccaguucuuucucagcuuuaccuuaccagacugcuauagguuucucacuguaauaguauugacucaccaggccuacaagcaggaauuugaaauuuuaucaaacaagaaaauaauaaaaauaacuugcacaccauagaaagcuacaauaagggcuuucuuugucaugcagauacuuguaauuaucauauaaccuaaaaguuuauuauuaguugauaguguuggcauuacuagugcagguuuauuauauagccacuaauguaaugcaucaggaauuugauuuagggagcaugguugugugauuuuugcaugauauuuacauuuuauuuaguugaagaugaaacauacuacuuuagaguuaaaauauuggaauuuucuuuuucuuuuacagaagagaccaagcaaguuuugaggcucagucuaacagaguucucguuacccaaauuuuacuuacuguuuggcauuagcaaagucaagucggcugcugucauugccuuccguuccaguuaccgggaccgcuccuucuccccuggcuccuaugagagggagacuuuugcuuugacgucccuggaaacagucacagaagcuuuguuggagaucauggagguauagaaagaaaaaugacaagaaaccaaauuaaaaucguauuuaaaauguguaauaugaaagguauaaugucacaggagggagagacagguagauugugugaacuugaagccagcugaaucuauguagggaauucuaggccagccaagccuacauaauaacaccucaucugaaaaaaaaaauucuguaauauacagaagaaauacugguuuauucuguuacaguacacacuguccuuuagaauguguucuuucuuuacauuuaucuuacuuuauguaucugaauguuuugcuggcauguauguguguacaccacaugugugccuguuguccaagguugagagaagaauccagaagaggacaucaaauuccccagaaccaaaguuacggauggauaugaaccagucuguggauucuagaaacagaagucauaucuuuccucugccacaacaaguacucuuaacugccuagccaugucucuagccccuagaauguguuuuuuauagcagauaacacuuaaagacaugagaauauuaaauauuccuagaaacauuuauguacacauauauauuuagaguauucucuuuuucaggcauguaugagagauauuccaacaugcaaguggcuggaucaguggacagaacuagcucaaagguguguccuugguugaauaguaacuagaacuguguguguauuguugaaaguagcuauugcagcagcagcagcaaucucguauuauaaugugcauacacacaaagguuuucauaaguuccuuggcucuuuucauugcagauuugcguuucaguauaacccaucgcugcagccaagagcucuugugguguuuggcuguauuagcaaacgagugucucaugggcagauaaagcagauuauccgaauucuuagcaagguaccuauuccucuuuucccaaagauuuguuccaacuuacaguguauacuucaagguuuuaaaaacacacuaaaacguaauaaauguuauuggcacugcaauuauauauuuguuaagcauuuaaacuuuuuuucuuacugcaauucuuugaagugaugaaaucuuaccuaacuaccuuuaaguucaacauuguggcacacgccuuuaaucccagcacucuagauacagagguaggcagauuuauuugagagugugaggccaaccuggucuacguaagcgaguuccaggacguaauugaaagaacuugucucaaaaagaaaaagagaaaaaaaaguaucuucuaaaaggaguauuuaccucuuuuucuagucagguauacuuaaucagucuugaaagcuguauagcuuuaauauaaagcuaugucauuuguaauuacuauaauaacgcccuucuuauuagaauguaauauagaaauauuuuaaaaauaaguauagaguauucaccauuuguagaaauugucaaauaccuaaauguuucucagcuaaaucugagauuuauuauaggaagugauguuuuauuucaaugaaaaguaaaacaaagauuucuguuucucuaaaaggcacuugaaaguuguuuaaaaggaccugacacuuacaacagucaaguucugauagaaucuacggugauagcacuaacaaaauuacagccgcuucuuaauaagguaaucauugauauugauucugcgugugcuuuucuuauacagaguuuaggaaauaggguggauugaaaagaguauaaagaagaaauuauagucagcauggagccucuugucacagaguuagaaaauaagggguaguggccuagccugguggcccacaccuuuaauccaucacucacgaagaagcagccuggucaacauagcaaaucucaggacagccagggcuacauagaaaauacuugucucaaaaggaagggagguggguuggagaaagaaggauggggagagaggugggguagagaggaaaggaaaaggaaggguugauuggaaagagacaaaguagagccugugucacaagucuuaguaguuugaagaagaggaagaagaaguauagaguaucuuuucucccgugcuuguuugugauauuuuuuucucuuugguacuagaagaaaguugagcugggugguggugguguaagccuuuaaucacagcacuuagaaggcagaggcaggugaucuuugugauuuugaggucagccugaucuacagagcaaguucaaggacagccauagcuaccuagagauaaugcugucuuggggggugggguggggagaguugaguaucauguauggaucugguagugcuuagagauacacagaguucaccaguggccugggucuggguuggguauggaugcugagauguggacaaguaaaguagccuaccacucagugcguuguuagugaucacugcuggagggauggaagccaggagcagugccugcucaucagaggcgucugcaugcuggcuuaggguguaaucaaggaauaguacuuacucaguauguauuagacccuggguaccgucuccaccaagggagggggaagaguaggagggaggcauggaguacauaugaauaagaguuuauacuaguaagagugauacgaaguuguagugucuaacuagagcuagaaguaaguaggacaguggggugcuagauagaccaaccuuguagagaguugacagagaaaaguguaaagauugaguagaauuaacuagcauucaacagucuucaggaaggaguuugaaaugaucguuuccuaggugacaguaugguaaaaagcaggacacaggugacccagagaagggaggaagugccuguagaaggacgguuagccuggacacugucugcaguguaaccaggagguggcaggugucagucuacuauagagaaucugccaacucugggugguggauuugacauccagcauugggagaauccaggggaagcucaggcucucaggcuaacuuacgguacuuguaaucagauacacagagccagccaaugcgcaucggucuguucauaguucucagagaagaggaagcacauucacuuaguggguagccugcucugguuuaugcugcagcaucauggaagacagugugucuugguucaccucacucacuggagcggaucuuuuuuucuaggacucgccccugcacaaagcccucuuuuggguugcuguggcugugcugcagcuggacgaagucaacuuguauucagccggcacugcacuucuggaacaaaaccugcacaccuuggacagucuccggauauucaaugacaaggugcguaagcuguccucugaggucacauugcucacagugagucuucucuuccuuuucuccuauggcucucuagaugucagaagagguccauaaucuagauauuacaguaacguguuuuauugugaauauaguuccuuaguagcucacuaaaaacuguuuaauccauaguuccuauauaaaaauagccaaggacagugugcccuacaacuagugauuagaauagacauaaggagggccggaaagauggcucagcagcacugacuucagcacccgaauggcagcucacaaccaucucuaacuccagucugaggaaucuagugcccucucuggccuccuuggacacuacacauacaugaugcacaagcauacauggaaagaaacacccaugcacauaaaauaagcaaauacauuuuuuuuuaauuuuaaaauaauacugaagaggaauaauagcuaccacaccagguccugugcauucauuacugguuaucuuuaguagcauucuucauccuuguuuauuuuuauuuagugugugugugugugugugugugugugugugugugugugugugugugagagagagagagagagagagagagagacuauuuuuuucaguuaaucaauaagaaaacuuauuuuuauugacuguguacuugaaggaaaaucuguacaauuaguaacagauaagcaaguuggagacucgccagacaauuuuugccaagucucacuuuaaaguauaccauuagcagcccccuucacauugaucaacauagguagggguuggauuuugguuuagaguauagaggauaaaauaaagcagcccagaauugggcuagugaucuggcuuagcaagcagaggcacuuaccacccagccugacgaccuccguucaguucccaggccucacaugugugcugaguaaaugcaaaccguuacuucacagccaaugcaaaaguauguuccuuuuguuuuggagaaaaacaaauagcuuaagagaaaaaagaauguucuuuugaagaaaaugugugugcgcaugugcacacauucaaaauuaucuugaaaugaacugaucuauguggaaauagaacauggccugagugugaagauaccccggucuaaaguacuuguauguuuguauguuuguuuguuuguuugugguauagaauguuucccuucauguauaucauauguguaucacaugugugccuggucuggugcuccugagguuagaagaagggaacuucugaguuacaggugauugugaagugccauauaggaguucugggaagcguucucagguccucuguaagaacagcaaguacucuugacuacugugccaucucuccagccccuaagugcuugcucacuguacauaaugugauauagacucaaaacagcuggaaaucuaggaaaugugaaacuauguagcuguccagcagccacgugguaaacuggauuuaccugaaagaggggcuggaaauaagguaaggggguaagaaaaggauaaagccaagacaaagguucagaucaaggcucaaaguuuaauaauaagcauugcauauauaaaggaaacaaaaccacaaaauccacccccuucuucagcuggaguauguuguagagcaagaucaauacaagcagcugagacuucaaaguuuccaugggaaccugcaacugcagcuaaaacagaugucucuguccagguugauaagaccugucauggcgaauguucaaggucuguuuagucugcucaaggcugggaaaaaugcucagccuuuucaaggcugggaaaggccuacucaaagcugagaaggcuacaaaacuaaauuauagauagaagauaccuugaaguuuaucagucagaccucuguucacaaaauggaaaagaguaaagaaguuacuggaauaugucuggcucugagcuucuucccuucucuacuaacuucauugcucugcucuggaauugauugagaucauggugguugcaagugauggcuagcuauuggcuauuuguauguuaaggauauuuacaaauaaauaucugaagagauaauuucuuucuuaccuuuacaucagaguuaauaaagcuuauuaaaaucagcagacuauucucugggauguagaguuagaguaauagugcuuguccuucgguccugcuccuugagaggcugaagcagagccaguccuguaggaguuggauaucagcagacaaauguagcugggcauuugaugaguggcuguaauauuagcacuugagagguguugacacagaaucagggguuagucagucuuuucuacauagcagguucauauagcucagugguaagagugcuugccuagcauacuuaagacucuggguucgauccccaggaaccccugaccccaacauacaaaacacacacacacacacacacacacacacacacacacacccuguuguaaauuaaagcaauuugaguuaucuacuauuuuauuauuuaucuuuuuuacugucuuauaccaguuaaauauaguagcguaaauguucuuauaggugugucuguuaucuaaaaauaauuucucugaaacugaaaguacuacuuagccugugagagcuguuaaacacaaguaaaaaagugacuuuuuaagcaaaauaucugaaccaagaauacaaaguaugcuugggguucuaguacuggaaaacgagaaggaaaauuucugugcgaacuccaccaagugucuaucuccugauuguuuuuaauagaguccggaagaaguauuuauggcgauccggaauccucuggaauggcacugcaagcagauggaucacuuugucggacucaacuucaacucuaacuuuaacuuugcacuaguuggacaccucuuaaaagguaaagagacuuuuuguuagaauguuuuguggaauuguaucuagaagccaaaaguaacuaagaagaauugauuacuugagauaaauugcuguaaucuagcauauaugcuacacuuuaaaaugaaaaacauaucuguauaaguuguuucaauugguauuuaacuagaaucuaguuuacauaucagaccuuaaaagaacaaaguaguuaguaguaaaauucccccaagacuuaauugcuguguuacuaguuacuagaacacugcacaugauguuaugucagugugcauauugcgaauguuauuguacgaagaaggcuuagggaugaggucagucauagaacacuggguaacuuuccagcauugccaaggaauaaaagagauuuuucaguuuagagcacacugcuguuuggauaugaucguagacacucuuugacuuguuucuagcauguuuucuuuuauuuuuuuauuuuauuuauuuauuuuuuuuuuuuuuuuuuuuuuuugguuuuuugagacaggguuucucuguguagcccuggcuguccuggaacucacucuguagaccaggcuagccucgaacucagaaauccaccugccucugccucccaagugcugggauuaaaggcgugcucuuucuguguacauuagaguccugcuauucugguaccucucuuccaguuucauugcuguuucuauaguuaaccaucuccaacuagacuggagcuaaugugcuucuaccuagcuuuagcugcucauugccagcuucauaacuucagagcuaugcuuuaauaaggugcuuauuuauaaaauaaauaaauaauguuaaggcagaggcaggagaguucaaggccacccuaguccuuagcuuuauagugaaacacuaucccaaaaucaggaaaaagacaaaaaacaaaaauaaagaagcaaaaaaaagggggggaaauaauuuuuaaagauguauuuauuuuauacauacgagugauuugccuggauguauauauguguagcaccugaguacuuguuaccugagaacuagagguauaggcaguugugaaccccucugugggaaccaaauucugguccuuaauuucugagucauugcuguggccccaaaggagaaacacuuuuuaaauauuagcacccuuacuucaagugaaaucucaaggggagcucuaaugcgcaguuuuguuuguauuuauuucuaaccucuaugcuucuuuaggaaauggaaaagucaagaaugcccuuuguuuccuaaugccuucuccuuuaggguuucaaggaacacccucuucuacacauuuuagaguucuuaaucauauguauaauuaacuucacauuuuuauguuuuaccuucacaaacggcuauucuuggauggcaggaauuuuccuuuuguuguagaguuacuugucacagcauaagagcucaaacauuuguucauggacuaauuaacugguuauuuguuguuuuuuuucuuuuuauaggguacaggcauccuucaccugccauuguugcaagaacagucagaauuuugcauacacuacuaacucucguuaacaaacauagaaauugugacaaauuugaggugaauacacagaguguggcuuacuuagcagguaaacgcacguaauugacuaaaucagccugacuccacuguugucuuagaaucagcaaaugauguccuugccuagcuuuggccuuccagcuagucuuuaguccaguagaacacucacaguucaguccuuucguauuugaaaagguaaagguuuugccaaaauaguuuucauuauaaaagaauuugcacuggaaucugaaauauaucccggcaggccguuguagccuucucuucuguccucuauguaaauuucauaagcaucacuuguuauagucucucaaaauggacaugaugcuucggaccaaucuacugcugucuccacuccaguuuucuacagggcuucugucucuucaguaugaauucuuuguacuguuugaccugggcugccuguccagucccugcuauuuuuuuuaaagauuuauuuauuuaguuuaauuauaugaguacacuguagcugucuucagacacaccagaagagggcaucaguuuccauuacagaugguugugagccaccaugugguugcugggacuugaacucaggaccucuggaagagcagucagugcucuuaaccaugagccaccucuccagcccccaguccccacuauuuuauuaaagugcuuuuguaugucuucucugacuuucucuacuguauucuacucacagaaugcagacugagguaugguuugauggaagaugcccauucucucuuuaacaaauuuccgguuuugccagcuuguuuuguuugaagcaugcaaccuugaacaaaccguuuacauuccaaaauauuuuaucacugcauuucagauauaugccuugccuacuuuuugugauuauugaaagcagauaugcaaucaagugcuugagaaaguaagguguuuaucaaauugcuuuguuuuauguuuaugcagccuuucaaagcagucuguaaacucuugaggauaagucuaucccguguguuuauacacuucauccucucacucuccaggccuuuuuauguacauauaaaauaguacauaguaauaguaauagccucuuaaguuuggaagaaaugaagccuguuuuaccagcuuuuccuuuuccuauuagcucuacucacagugucugaagagguucgaagucgcuguagccucaagcauaggaagucccuucuucuuacugauauuucaauggaaaauguuccuauggauacauaucccauucaucacggugaccccagcuauagguaagugggcaggcucucaucauuacauagauggagucaggcuuuaguuuccaugugguggagaucggcagcagaggacucuaaaagggagcagaguggcagcuccagauggucuggcaagaguagcuaucaaaguuugcucuacaggucaugguauuuuauauaggcaguauuaaaguuauucuaaucugcucuuauauuaucauuaguucaccucuuuaaacacaaaacacuugaauaaggaagaaagacaaucuugaaaaguuugcagaaaaggaccuaaggaaaagccuaacaugaaauacaaguaccauuggaucccugaugcuaagaacuaagcgagggcaggagggucagcugaguggguaaaagcacuuguauucuugcagaggucucagguucucuuaguucccagcacccacgugauuguucauagccaucuauacccuaaguuccagaggaucugacauucucuuuggacuaccuuggauagcagacacauugcacauauacauacaugcaggcaagacacucauacacauagaguaaauaaauauuuuaagaaacaacgacaaaaagugauguaggaggguaaaaaacauucguaugaacuguuuauuauugucauuaccauuuaaaaccuuucuguaguguaguuuuauuguuauugcuuugaugaaagcucuaugugucuuuggcuggucuggaacucccuauauaaaguaggcugaccuugaacucagagagaucugcccccaccaaguguuaggauuaaaggcauucaccaccgugccugguuucugcaguguagguucaugugagagaaucauaaaauuaugacuacuguucuucauggcuuuauguagguuuuccccccaauauaacaugaaguuacauaaauuccaucuuugggguauuauucuauaaugugaauuaaacauaucauguuauuaaauuuacuaauaucuugcuuuuuuguaguaaaaagacuccuccccaaggacuugaccgagacugcaacaauguaugcaggcuuuccuaauaaacaccgugcugugcucagaagucuuauucuuuagccaaugccaugaguuuauuuuuuuuuuuuuuugacccuucuuuuggcuauggaaaggaaaaaguaauguuaccuguauucaggaaagcuuaauucucaaacuuaauuuuaucaguuuuuaaauaauucaguaauacaguugccuauuuagacuuauuuucucugauuauaaaauucaauguaauaaguucaagaguucuauuacucagcaucaguuaaugacaguguauuuauucuguauuugaaaagugcuaagaaaauggauguuacguguucucaccacaauaaaugacaaauauguaggguaauauauguccuauauuagcauauuuaggcauuuucaaauaccuuuuuaaaaaacauguuguucagcugggcagugguggcgcacgccuuuaaucccagcacuagggaggcagaggcaggcggauuucugaguucaaggccagcguggucuacagugugagcuccaggacagucagggcuacacagagaaacccugucucgaaaaaaaaagaaaggaagagaggagggagggagggagagagggagggaagaaaaaaaccauguuguucaguaaaaauguacaacuuuuuucuugucaaauuaaaaaguuuggagccauaugugguaguaaaugccuguggucccaacacuuacaagguggaacaggagguuuggaauucaaggucauccuagcuauauaucgaguuuuaggccaggcucagcuaccuaagaccuuguuccagugacaaacaaaauaggagcuagagguauagcuccguugguagaggauuuuuuucugguaugcagaaggcccugaguucagucccagugcugcagaagacugacugacuguagcaugcacaccugccugucucugacuguggggugcacaccugacuucuuggcaccuaggaaguagaaacaggaauggaagcucagugccauccuuggcuucauagcaaguuugaggccagccugggcucaaucaguaaauagauaagucguucuggguuucaccaguuuagggauagaauacuagccgugcacgugugagguuccggauucaaucccuguccugcagaaaagaaaaaaagcuuaauaaaauuaugcacuauaguucuuccuguuuaccugccuagggauacauuaagaguuauacacuaagagccagcuaucaugguacauaucuguauugcuagcauucuggaaacuaaggcaggaggauuagaaauucaagaccaacuuagagcacauagcaaguucugggccagccugggcaacuuaauggaaaguuaucuuaaaaaaaaaaaaaaaaaaaaaaaaaaaaggaagaaaaguuuuuguccuauggcucuuuaaaaugcaguuuuugaauuaauugauugccauuguuaggaaauaggacagcuauuaggaaugagugaacagugguuauauuuauuaucuucuuguuaauuaauucuucuaaauuguuucaauuuuucaggacacuaaaggagacccagccaugguccucucccaaagguucagaaggauaccuugcagccaccuacccagcuguaggccaaaccaguccccgagccaggaaauccaugagcuuggauaugggacagccuucucaggccaacacaaaaaaauugcuugguuaguuuaucuuuauuuuauauaaauuuucacauuauuguuagugugaaaaaugguuaguuacuuucccucuuggaaaauuaauugaaacuauuuagauugccaacuuuuuuuuguuuguuuguuuuuuugagacaggguuuuuucucuguguagcccuggcuauucuggaacucacucuguagaccaggcuggccucgaacucagaaauccaccugccucugccucccgagugcugggauuaaaggcgugugcaaucacugcccagcuagauugccaauauuuacuguuuugauguaacaaauucuugugacuuuugaauuuaauuuauuuuauguguaugaguguuuuaccugcauguguauggaugcauaccacauguguaccuggugcccauggcugcagaaggguguuauagcccuuggaacugaaguuacagacauuggugagcuuccugugcuugcuggggagugaauccucuggaagaggagcaaguguucuuacucacugagcaucucuccagcccuuguguggcuggcuccucuaagggaguugauuuuaauggaugaguuugguucagccgugucuucagacagagaauucagaaugagacuuuggaauggcuuugaguuugauuugguuuuuauuucuguguuuuuaaagucuauuuccaaguacuguggcuuuugauuugggggcccuggacggcagugaugagagugguuagcuaucuagaggagaggaagcacugcuguauagagggcugggaugcuaauguccccugaagugccauucagaaguagaauggaccgcccuaagagaucuggaaccauauaaucuuugaaacaacaaaacaagguauuuuuaauaacuauaagacaauauuccuuuuagaaauucuugucuguguauaugcgugcagacagguagagauuggaggcagucuuggacugucaguucucuccaccuuuaugugagaucugcgcauuggacucagguuaucaggcaacaaggcaggugcuuuuacccacuaagcuaucuugucgacccaaaauaaugauuuuugacaguucuaucaacauuccuaugagaaaugcuugcacaaugcuaagccuuucauguccaguaacugaugagugaguuccugaaagaggacacucgcugacccacagagcaagugugaggcagugcuugcuugcccuucauuggcugccacucuaaaucguuacucaaauuauugaugugucuaaccugugauaaauaauaugaguguggacucugguuacccauguaaacauacuuaguaucaugagauaguauuaugcaaagguuugcucauaaggaaauugguaagcaaacaacaaaguguaacacaaauaaccuuccaguaaaaguugaaaggagaaauaacaaaugccagccauuguuacaguucaguugagucugucgucucucuucuauuugaguucccuuaguuaauccugugucaucagugauuucugguuacuucguguuuugucauuauggauuuucauaccaaagaaguuguaagugaaaaacuaaccucagaaaaugcaguauugaauuccuucaaacucuguucuaaguagaaaaaguagggucuaugcucuuuagagaagggcuuauccuuugguaguuaugacuuaaaaucagcuggugacaacaguguauagcaguggcauuaaagcaguaaugcuuaacauuacugaggcucuuaggaaauuaagagguaauauuugagccagauuucagagauuuagaccaugcuagccagguggacggacacaggauaaggaaaggcaugcaugcaagaggaagcaugguaagggaagagagugugggagcaguggccgugggucagaacaucagagcaggugaaggaggcuggagaagcacagcguggcugugagagacaaaccagacagcuggcugcaugguagcucaacucuagucccagccuuucucuggcggcauuggagccagaggccggugcaucucuaugagggcaguauggucuaugcagugagugccagcagagccagggguauguggagagauccugucucaaaagaacaacaaagacuacagugauaggagauuuaccacaucauacauccaacagagaucuucauuaaggaaggaacaagaugcaucuguuuuauuuguuuguuuguuuguuuguuuguuuguuuguuguuuuccuacauuuuccugacagccauguagagaaaagucuuuuucaaggggaccauuuacaagauugauucagcaaccuaagaggaaaacccagagccagcacacacuaaggcaggagcugugugugaggucuguuuccaaaggagagugaccaggacagagagauggacggggugggagggagaagacuguaaacgauaucauagguuucuggucaggugugacugugcugcugcugagccucaugagguaaaggcaagcuagaggccagccuagccauguaauguguuucauggccguaccccauugguaaauaaaauuaaaaauuaacuuaaauggcacuuuuccuggcugagcugaaacuauuauuuucuacuacuaacuauauaucuggaggaaaucaaaccaguguguggaagaggccgcugcauucuguguggacugcaagacuugucacagcaacacagaaaggaagcagccuccguguccauccgcuaaugcacagaugaaggaagcauaguucuacagauccacaggcaguagccaugaaaacgaaauccuguaguuggugacagcauggauaaaauuagagauuaguguguuaauuaagccagacacaaaaugaaauguuacaugaugccccucuaaugugagagagaagauauggcucuuaugaguguuaaggacagagugaugucuuaggguuuccauuucugugaagaaacuccaugaccaaagcaacucuuauaaaugaaaacauuuaauuggaacuggcuuacagauucagagauucuguccauuaucaaaaaaggcaggaaacauggcagcguccaggcaggcauagcauggugcaggaggaaggucuaugucuuuuuccgaaggcaaacagaagacugaccuccagucagcuaggaggagggucucaaaguccacccccacagugacacacuuccuccaacauggccacaccuacuccaacaaggucacacccacuaagaguggcacuccuuggacgaagcauauucagacaccacagaugucaccagagacugguaggcacuaaggagcaagagggcuacugugcucuuguacucagggcgacuguggggagcuacagugcacaccuacauuucaaagcuagaaggagaguuuugagugugugucaccuuaaagaaccuaucaaugagcugggugugauggggcaugcccagaggcagguagaucucugugaguucaaagacacccagaacugugcguaaugugagacucugucucaaaaccaaacaaacugauaaauauuugaagaguuagauaauugagcuguaggaagagaaggagaugacagaguagaagaaaagggacaguaggacaagaucaguagcaucccuaccuccaagcacuguagaaagcacuaguaggcuucaggauccuuagcagugugaauacagucuaaccaccuaaucacucaugacuucuuccguuugcaugaaaggaagagacugaccugaguguagauuccuuuggccuugguauuugugauuugugauuauucauuagucuuggugcaugagggcaacagaacacugaacugucaaauaccacuugucagaucuuguaauaauucaauuaugccuuugaauucauuuaagauauauauuucagucuuuugccuuuuccuaugugugugcuucugagcauuaaaccaggggcauaagaauuccaggaagaccaacagagucaacuaacuuggucccuaugggcucucagagucugaaccaccaaccaaagagcauacaggggcugggucuacgccuccccauuuauguguagcagaugugcaguuuggucuucaucugggucuggaacagcugggucggggcugucccaacagcuguugugugcgcgugguuuauguucuacccaccaggcugccuugcuuggccugguggagagaaaaugucuggccuugcagagacuugaaaugccagggugggaguuacccagggggucucuauuugcuccgagaagggagggaggauggggaaaggauuucgggaggagguaaccuggaggggggcagugaauggaauguaaaguaaauaaguacgaaaaauaaaauuaaauuaaaacaaacaaacaaaaaauagggaacuuaacucacuagcaaguucucuaccacugagcuacauacucagccccagauuguuuuguagaacugcuacaagaagagacauccccugaguguaaugagcaaagguaaauaaaugcugaauaaugccauauaaauauuuguacuuaaauaagagaaagacguuuaaauaccagaguacaugauuggguauacccucaaagccaaggugagaugagacuacuuguugcccuuuugaaggguugugugucugcuuguuagcacuucugggcaugcauaucuuuacagauuaaagucacacuuuaauuuuucccuguauuuggagauugcucaucuguuagugacuguuucuuuuuuuuuuuuaagauuuauuuauuauguguaaguuacacuguagcuaucuucagacacucgaggagauagagucagauuuuguuaccgaugguugugagccaccaugugguugcugggauuugaacucaggaccuuuggaagagcagucggugcucuuaaccacugagccaucucugcagcccgacuguuucuugauaaccaacucaauuuccuuacuuaaaggggccauuuaaguuuuucuaugcuuugcacugaucaaaaucuaauccuuguauuuguuauguauacuugguggagucuaguuuauucuugggauagugaauauaaccuaaaguuccuuuuuaggcuaguaaagauccuccuuuucuggaaagcuguggggccagacgccuuagagaggaaacggagaauaaugcuaagaaacucugcuccagggaugucucagcuugcgcucaaaaguaaaagcuuaaauuauuagaauauugugauuuguagacacugugguuaauaaacuuucauauucuguaacuuuuguucauaggaacaagaaaaaguuuugaucacuugauaucugacacaaaggcuccuaaaagacaagaaauggaaucagggauuacaacacccccgaaaaugagaagaguggcagagacugacuaugaaaugggugagacacaaagcugauaaguaaugaagauggcugcaaaccacgggaagcacagugaagccacaguugcuuccauccaggccugagggcucaggcugcagugcagagcaugugcccuggcucaagugggcaggaaaagaaaucagccaguuaugccaguggaaugugcggaaggggcagaggcagcagguccacagaggccugggcuauacuugaagagacaggagaaucuccaugaguucaaggauagccuggucuacguagacaguuccagaccaguguguguggcacaacacugcaagucacuagcuguuauauugcugcauacauaacaacucuguaugauaguaauauugauaauuaagaugccuguuuaaggaacuguaacauuaagauguaacauuaaaauauguugaguaaauuauacuuugucuacuaauagaaguacuuacauuaauccauauccuacagcagaaacccaaaggauucccuccucgcagcagcacccacauuuacggaaagucucagucucugaaucaaauguucuuuuggaugaagaaguucuuaccgacccaaagauccaagcgcugcuucuuacuguucugguaaggggaacauccuccucccguccacucauucauucauucauucauucauucauucguccauucauucauuuuugaggcaggguuucacuaugaaacccuagcuguccuauaccucacucuguagaccaggcuggccuugaacucccagagauccaccugccuauaccucucaugugcugggauuaaaaauguguaccacuacuccuggcaggauuuuccuuuuugaggguuuuucguccuuaaauuuuuauucuaguuugcucuuagcaggcccuuaaauauggcaaacauggaagaaagauauuuucaugucauuaaaacaaaguuucaacauaaauuguuuaccuguuuuugcaucuuggcaggcuacacugguaaaauauacuacagaugaauuugaucaacggauucuuuaugaauaucuagcagaggccagcguuguguuucccaaaguguuuccuguuguguaaguaucuccuguuguugguuaaucgcccugucuuuaugucaggugcucuguaaagguguaggaaauguacuucucaguggugucuucugccuauagagugggcaggguggcuaccauuguuauccuagagagggaugacuauaguuuuccagguugagacuacgaagagcucuggagaggagcacaugcuuagcaugccagggccuggguuugacccacagcacccaaaacaaaacacagagcuguggggcuaaagggcugaaaagauagcucagcaguuaugagcauguaugauuuugcagaggacuugaguuccaguggccucagaggacacuaaacauacauucauauacccacacaagcaaacacacaugcauauacagaacugaaaagaaaaaauaaaucuuuuucuaaauucauacuuuaauaauggcuaaaguugcuuugggcuuaucuauuaccaaaaccaucuuugcuuuguuuguuuuguuuuguuugcuuguuuuuccuuaaucguauugauuuauuguaguggcuuagcuuaaugaguauuaauguacaguuuucucaagagcaaacugauagaucgcucuauuuaaaccagccuacaugacugucuugggguuggucuaaaucuuuuccuuuaaacauuguguuuauuuuagugcacacauacaugaauauaauggcacacauggagaggucagaggacaacuuuagggagucggugcucuucugccaccacagugguccuggaggacagacuaagcucaucaguuguggccgcugucaccuugcuccagugagccauugugcuaacccuugcuucucuuuuuauuagaauucuguacugauucauagcugagggaaaauagaauugcccucuucucuaggagguugguuuuacuuuuaauacuugaacuucaaagccuuugcucuaguuugguuucuguuacucugauaaaauacuguccaaaacaguuuggggaagagaccagagagauagcucagcaguuaaaagcaugccugcucuucuagaggauucugguacaacucccagcacccauacaguggcucacaacugucuguaacucuaguuccaggagauuugacgcccucuacuggccucuguggacacaggcacacauguguuacauagacaugcauauaggcaaaacugucauacacauaaaauaaauuuaaaaagaaaagaaaagcaacuuggggaggaaagguuuuauuucaccuauggguuacaauccaaucauugagggaugcuggggcagaaacuaaagcagagacuguggacuaaugcugcuuacuggcuuugcuaauuguggcuugaucaguuauccuucccgcccccuugacuggggcuggccuaagucucagugggcuguacccuccugcauuaguuaccagucaagaaagugguccacagaccauuuugauggagacggcucuucaguuaagaguccuucuuccuggauaugucagcugacaacuaugacagaaagguguuggcaaauuaaagaaacuuuaaaaggaccuuuguguggaacacagaacaauaaagagcuccaaggugaaggauaggucuagggcagaagucuggcuaaagccuuugcugugucaguguuaaauaucgagucguaucccuuuauacagugcaaagcuguuaggaaagcuuuaguugguagugagucgcugcacucugguguuaugcugagaaugaguuggaagaaacagugcagaugcgggaagauuguuguaaggauacuauuccaggagaccaauaucugcaauauaaggagagacagacuugaaaucacauauuggagguaaggauuacagaacuugauauuggacugaguguugacuaggguaguucccuaaagaggacugcuagauucauggcuugcagggaagaguggaugacaguggugacauacgucccagaagaaucccaugccuaugaaaggggaguagaaugaguuugguauuggacaucuuggaacagcuaugucaaacaaguaaagauacuauaguuagacuuugguuuaauaaacaugaauacaucacugcaguuuauugagcaucccacauuuguuguugucuaauuccauuuuaaaguuuaugaauuucacauauuuagguguugccuuuuuaaaauagauuuuuauuaauagauugcaagugaucuggaaaugguuucuuuguaagauuccccaugccaccccuuccaaauuaauuuuacuggccuaccuuggcacugguuaguauuaaaugucauuguaacccuggacguacauagaaacagacagccgaggagcuagagugcagagugugcucacgggcagacagagccaagccuguuuuggacaacguuuccuuguacaguuugacacggucgugugauagcuaccagguauuugcuuuacuguauuucccuaaugacuuagaaugacaacacacacaugcucauucacuggauaauuuagaaaagugccagaaagguaaaagucccugucuccaguuuugccauguuguucuaagggauauguauauuacacuuuccaguaaauccuuuuauuuaauguuccucuguuuacuuuuguuuuuccaggcacaauuuguuggacucuaagaucaauacccucuugucuuuaugccaagauccaaauuuguuaaauccaauccauggaauuguacagagugugguguaccaugaggaguccccgccacaguaccagacaucuuaccugcaaaguaaauacauauaccaggagcgggugcuugcugagccacagcugcggcccuguuggagaaugccuggcugcaguguagcugcgggauaggcuccugcauggcucucgcucuucauuucaucuucugauucuauuaguuacauguucaguauaacugcuugaccacuguaaaaaugcuaucuauucuaaggacauuuuagucgucuuugacacugauuuuaaaaugucuuauuaaauauaugcagaguuugucugucagcuauacagcuuaauuuuuguuacuauuuaaagcugccuugcuuguuguaagaguagcauuugauuuuuugcagguuuugguuuuaauggcuuauggcgguuugcaggacccuuuucaaagguaaacaauauuuuuuuuuucuaauuuuugauaagccagagucuuuaacuguacucaugagucuguuggagaauacacauuaccuucaaaccaaaguaacauuucaaaauaaaaauuguuuuagaaagauuuuuuccaaagaggcaauacauucaauauauugauauauuaauuuuauuuuaaguuagguuugaaaucucagaaggguauggaaaaccucuauaaaacguauucugccuguagaccucuguacauguggcaauaacucacacaccugucuugugacucgugaagagugugaugcaugguaaauacaccucagggacacauggcuacaucugacuaucagauuuguucuuggcuguucacuuucuuugacuggcauuuguugguauacuacaugaaauaguauuuaauuuuuuuguagauggucucuuaaaauaauugaaguuccuugaaggcagggcuucugccccacacccuucacacacacacacacacacacacacacacacacacacacacacacacaccauguccuagaugaagggcuguuaaaucaagaugaguuuuuuauacauuuuucuaguucuaagaguuggauuuaguuuauuuuguacugucuguugauaugcacagguugucauuaaaaagaugggccugaagucacagaagugugucaugcagggguuuuaacaggcggauggugggaugaugaugaugcucugccugucucaucugcuuugggacguuggcgagaugucacugccgaggacugcauugucuauaaaguagucaauuccucugucucugcauggcuuucagaaauugcagguucaucuggaagcuuuuaggggaagccaaauacaauuccuagcuguauguuccacaguucucucuaaauacuauuccagacgucccccuccccccuuaaugauuuagacuacaaaggaagaaagaaaaacaauccaccaagccccagauaucauuaaccuuuucuuggcuucagagggaacuuuuuuuuaauggagcuaaaauaauguccuauuuuccauuacagcaaacacaaaucccugacuaugcugagcucauuguuaaauuucuugaugccuugauugacacguacuugccuggaauugaugaagaaaccagugaggagucccuccugacacccacaucuccuuacccuccugcacugcagagccagcuuaguaucacugccaaccuuaaccucucuaauuccaugaccucacuugcaacuucccagcauuccccaggucaguaaaugugaucguuaugugauugugagcaaugauacgauaccaacauuaggaacucccuuguggucagagcauagcagauuuugguccuuucccuccugagguucacuucccauuucuuuccuauguaacugaauguuguuacucuucagagcugagugcuuuccaucaaguucuauagcagagggggaaaugcauagugauguucaguauccacagagauuuggaccaaaagcacaaacuaagcuauauuaccuacaagugaacaucagcuauacuaacauuacccuaaggccuuauaugccucuggugcaguauaagcaccauaaaacacacacauacaaagucuaguagucaccccacuuuguugcugguaacaacaggucagccauccaucagccacugacaagccugaaggucugggauuagguaaacaaccagacaaaaaguucucauaagaaaaaaauaacaucuuggagcugcggagauaacuagguugguagaguguuucccuugaaagcccaaggaccuguguuuaguccucagaaccuauauuuugaaacgguauuugugguggcucauggcuuguaaucgaggcacccaggagguugaggcagaagaauaccugugagugaauagccuacuuggagaguuccagccagugaugugcagguccacguguacacacacacacacagacgcgcacgcacgcgcaugcgaaaaggaaaucuuaaaccccaucauuauaaucuuuacuguagagucacuguuggaucaagugagaaaaguaggucaguggaauuuuggguuuuauuuauuauuuauuuacuuauauucucaguccagggucucacuguauagcccuagcuacccuagaacuuucuauguagaccaggcuggcccagacucauggauucaccuacuuugucucccaaugccaagauuaaaggcguguguaaucauagacaaugaaauuuagaacucuauacacugagcagucauagguaagaguccccgagguacugagagagaaaagcaggaacggcaccugcccagcuccaaguucaguugaugucugucugaauggcuucauaagcucugcuugagccuagaggugaugcccacugccuagugagcacaagcccugcugugugaacagagggaacagugugcacuggcccacggcugauguuugggucaggugcucaguugaaaagauuuucuucuaaguuaguuaaaauguuuaaaaaggauuucuuaaguuaccuaaguuccauuaccugaaaaggucaugcgguagucuauaaggacauucuuagaagugguguuuuagcaggcguuuucuuuauacaaaucaaaccauaacuauucugggcugcucgagauguauaaauagaaucuccauaaauacuugucucaguguacaugaacauuuccauucgugugguagucuggaagauucuaaagaaauaagccgguauaauacccaauccauaucauaaauuuacaguuacaaguucuaaacaguuacacucaguucuuacgcuuuguuccuaauuuacuuaccagucagggaauccuucuaucuccuagucgucugcccagcucuccucauguagucaguggguuuguuccaucacuuguucuguaggacaagugugaccccacacccgaauuagcaucaucugauguuagaggcauagcucuugagucuucccugccugcugggugaaaccccaaguauggagcccagucaaccuccucgggagcaugggugauucuucugcacacugggcuuugagaugcugccauaggcuggcugugcuccuggcccaugacuuauguugacugugacucacaucuggaaucccaggcaagagaaucacuuugaauuugaguccagaugggcuacagaaugagacucuauuuuaauuucaaacaaacaaaaaaacuacauagaacuauaugcacguauuacuuccugaaaaguaguuaaauaaagccauuuccaaaguaugaagaucugguuuagacucgacuauagagucgucgcuggcuuuuuacauuauuuggggagcauuugaagcaccccaggaauagcucccuggcugcccucagucucauggcaguccucagccucagccccuaaagucuugggauuacaaggugugugcuaccauacccagcugaauacuuaguuugugaguguauaggcacuuucacaaauuuaaagacuuuucuuagccaggcagugguuguacaugccguuaaucccaguacuugagagccagaggaagguggauuugucugaguuccagggcagccugguccacagagcaguucuaggacauccagggcuacacagagaaacccugacucgggagggagaaaaaguuuucuuuuacuuuuuuuuuaaggugcgugaauaauuuaccugugucuaugcuucuguacaugcauuucccgaggaggccggaaaagggcaccagauccucuguaguugaaguuacagauaguugggaacugccauguggaugcuggaaauugaacccagguccucugagagagcagccagugaccuaaaccucugagccaucucuuuaggcccuacuuucacacacuuaaagaugaaagaugccuucaauacagggacugauaguuugugccuguggguguuagaauugaguuuuaagugaaaguuauuucuuacuuauuuaguaguauuuaacacauucuaagacaguucuuuuuuuuuuuaaagauuuauuuauuauuauauguaaguacacuguagcugucaucagacacuccagaagagggagucagaucuuguaauggaugguugugagccaccaugugguugcugggauuugaacuuuggaccuucggaagagcagucaggugcucuuacccacugagccaucucaccagccuccucccccuuuuuuuucuuaaacauagaauuuauacuguauugcuuuguagaaaauaaccaaaauuggagccagugaaaggacuaacuggauagagauguuuguaugcaguucuguugccaagugugaaccgaccucaagaguugucuuuugauagccacacuuaaacucaugcaugaacacacacacacacagagucaucuucagcuacauaaugaguuccagaccugccugggcuauauuaugagacugucucaaaagaaaagaaaaaagugcauauauucacaccagcaggucuguuugaggccuuaccugccucugaggcucucaggguauuaaggauggugcaguguacucaagugacuuauuuuaaugcuuugugauacuucucauggugugcuuagaagagucaguaacuucugcuuauuuacagauuauuccuaggaaauuacugguuagaaucccauaaauaaagccagcuuccuucugcaaaccagggaagguagcaagugucuaacagcuuuccccugcuuuucgcuccucuggacaucauucccuucuuuguccucuccucaucccccugaagcuccucugcacgcucuaagccaacaauuugcauauagccucucccacuguggccuuauacagaacaucgcuuccucuaaacucaagcuaggcccacagcuugagacuuccccagucccuagaaguugaguugaaggcucagguacuugaaaacaggaacuugaaaagugguugcuuggugacauuucuggacauacagaacuauauaaucaguauggccuguuugguucaguugccacuucuaccuacccuguccuugguuaaccaaacacuauggggcaucagcagagaagcagaccgaggucuuugaggaagaggggauuuuagcuuagaaaauaguuguuucucccacccccaaaaauaaagcugaccccaucauaaaaccaaacccauccuaaagcuauccuaaaacuaacuguucugacucaugcuguaaagaaaguguccuuaacugacugucagcacuaagcagacauguagcagcacacugcugccugauucagagaggaccuguuggcgucuuguaaucuuuguauugcugcagagagaugaggaagcaguggggcagcaggagaagcccauccauucuuggauucccgcagugccgagucuguguguccagucauacaagggccgcuaaauacacccuugccauccaucucuccacagacgcuuuuuccacagcauaaacaucgccaaagcucucacacuuggcuucuuuuuaagacguuuuguguucuuuacauuagcuccgcuccaguaauuuuacaaauuccagcauuaaauugaaguccuauacauuuguccuaaaacuccauuugcuuauuauuuaaucucuuuuauucgagguauuagaaacaucuuagucuauuuuuaaaagauuauuuuaucugugcaauucagaaaaguucuucauauagauuguuacccaacuucuuagcagcccuguaagguaggcaguguacccuuaacccucggacugcgcagaggcgagagucagcauccaguggcuuaguggagggcaagcagcuggggguuccagcuucagcacccagaucuuucacucuuauuauagaggcagcgagaguucuccacccgauuaggacucagacuuugaggcuaagaaucuagcucagugguggagugcuguguguauacacaaggcccuggguucauucucugcugaaaaaagcagagcauaagcuuuauccuucagcgugcuugccagcucauacggagaaacguuuuccaacagguuugcucugcuguuuguagggaagugagcaaugcaguuugaacccaagugggcuccuauauaggugaugacaucuaaguucucccagacuacucagguauuuccuuacguguguuaguaucuuaucuguguguuauuuuccagacaggagcugcagcucaguaguaacacgauaagcauguucugauaccugccuucaaggaacucaggccauaguagggaagcaggcuagcaucugagugugauuuggcaguucuucucccagcucgugcgguccacaguguuagccaacaccugcugccucaucuucauccggagccagugcagcucgcugaacacugggagugcagguggucugcugcccugcgugcacguaacuggcgccugcccgagugcagcugcuuucagagcuuauaccagcaggcaugggacacagccgcuucagugugauguccuuuugguggcaccuucuggagucuuugaucucauggauuuuugcuuuuguacccauggaaggaagaagggaaggaggacuggugacuuagggauauaagaacacagaauaugaagcuuucaguggagacgugcaaggucaggccuuucucucaagugugaaguaaggccugugucagggcaggagccugcuccacgugagcagucugcgcccuucagcagcacauggaggcauuucuagauuccaccguagaggggagggaggugugagagaaugcugacaaauuaucagaagaaaauuaucugagugcuagguucacuccauuuccugggcccugcuuuccuaagacuguggguugguguaaauguaauucauuuuuauugcuuuuuaaaaaauaacucuccuagagcuuguuuauaauaucuaccuuuuauuuauucuuugacaauuuaauauacauauacagugcucuccaaaaauuuaugcaauuuuuuccuugauuuuuuuuguuuguuuguuuuuuguuuuuguuuuucgagacaggguuucucuguguagcccuggcuguccuggaacucacuuuguagacuaggcuggccuugaucucagaaauccgccugccucugccucccaagugcugggauuaaagacgugcgccaccacugccuggccuugaucauuuuaguaaaacuuuuuuguucuaauuaggcuuaggaauccucuaacacuguauuuauuugccuuccgacuuccucauuaggaaauaagauauagugaagagauuccuauuaaggaaauaaucucgguugaggaaacucgggccuugaagucacaggucacgugcacgugucaaagaugacagagugacaaccugugucaacuuccgagggaagcuggccgggaagcaucccucuuucuaauguacauggugccaaguaagggcugcacgcaugagggcugugaauuagagggccccagcuaucacauuuuaaaguggaaacauuuguugcaaaccaauaguuauugaaagugauuagcuagauuuuauaaagaaaaaaaaacaugaaugauaacuggucccuuucugggugguuucacuccagcugaagagauaagauguuuaugcagguuguuguuauaggcaaaagcuagugacuacaaggagggcauagaaggugguucugguaggagacggaugggagaggacgggaguggaacuguguugaaugaaggcugugucuuccagagaacagucaucccaggugcaguucuccucagccuacaaacugccgcauggaucugucccacuuccuguaacacaauaaauaucuuguggcuuaaaauaauacuuuauugcccaaaaauggaaauguuuccauucccaaauguaaugauucuuuuuaaguucaaguaguccauaaaguuaaaguuagaccugggauaacgcugcgggccaugacaugagcagaugguuuccugccuccccacccccaguuaaguguggccugcccuucccugcuccuccuccucgugugucugugaacaguuuauaucagcuaccagaaugccuccugccaauggcuaugcuagacaugaugaguacaguaucuauuugggaagcaaauucuuuugaaggguagaaggcagaaaaguacacaggucauaaguuuacaguauaaugaacuuuuuagaagcaaacccacucauaaugaagauccagggccaggcacaguggcacaugaaggcaaaggcaggcagaucucugugaguuccaggacagccuagucugcguaccaaguuucaagacauguagggcuacacagagagacccugucucaaucaacuaaugaucaaaauccuaccagggauugugaaggaacaugcucgcugccuaaacugccuuccucaccuccuucagacuguucuuuucuaucuuuauuuguaaccuuuaucaauaugcugagauuuuucuaaauuugcccuuuuguucugaucaccuuucugaaaauaacguuuacauuauuuguaaaauacauuauaggacccuugagugagguugagacaaguguagugacucuccaugauugaaaugaagccaagauccgggcauggccugcgugguaggucaccuuuucaggagaugcccucauuccuccagaacaggcauugaggccgauuaaaggagaaguauaugccuuuuucugaaauggcggcuaugcagaaagauggauacauggcuagaaucugcccucugcuggacacucaugguacaacugggagaagguacucuccuaaggcuuccuggauggccagccuuucacccuaccucccuccagcuguucuugcaacuucucuuuucucuuacgcuguuucacaacaaugauagaaaauucagcuuagcaaggugugaggcaaaguauguggcaaggccuuuguaaauguccuggcaguuuacugugaauguggaguaugcugggacugcucaccauuccaaucucacccacaagcaaugaaugagauuggguccugagcuagcgucaggagaggaggaguaaccagcuguugugucucuccaggacucgacaaggagaacguugaacucucccccaccgcuggccacuguaacaguggacggacucgccauggauccgcaagccaagugcagaagcaaagaagugcuggcaguuucaaacguaauagcauuaagaagaucgugugaagcguucuuuguuucacucuucaaaccaaccuaacauggcuucucacuagugaccccucaccuugcacugcugcacuucgugucuuaugaucccaucuggucgccgugucgccagacggucaucucuuggagcauugccuaaguuuaaugcugcuuuucuuugauguuuuuccuucuacuuuggcaugugucugguugagcacuuguucugaggacagcagagacagcaggcggucaggaggccugacugagagcguggaccguggguguggaugaacccugcagugcugccgcugccgcaagccacgggccguacgcggaggacggccuucuguguucccgucuugcagagugaaggggucgucuuaguuacacacuuauaaguuugggggagaaaucauauuuuaaccccaguguauuuaaucuucuagcuguggacuuuuuuuuuuuuuuuuuuuuaccuuauguaguugaaggaaccacagaggccaagccucaauaaagccacaggccagggacugagggaggggcaaacuaauauuuuguaacgaauucuuaagaaauacuaacauuugagucuuagcaauaaguacaggaaaauaagcgugacacacacaucuuaacauugcugaauuaaagcuauugguucugaggccuuauacauacuuggucauccaaccuggguaauuuuuuuccaguugauuaucuuuuaauuuuuacauaugaagguguucuguucuuuuuuuuuuuuuuuaagccaagacuauacuaaguauagaaacuacacuuguguuugcacuugcuuucuccucuuuccuaagugauucuaagcaggguaauuugcagacagaguggugagacucguuuccacaagguaauuuucauagcucuuuccauuggcuccguagcaaaauggaaugguacgugacauaggguaggugauauuuuuauuuuguuaaauaauuuuccaagaaacagaauaugcuguauauuaucauaaauuucuuugauaagauguauuuuuaaaaucuuuuaaucuuacuccucuccuccaaauaaaaucaggaaucucuagcaaaacauuuggauucuaucugauaggauugcauuuagucacugugaagucuggccggccugugugguauggacacaggaccucuaggaucgcugcugugcagaguggcuggaccagugggacucaggcccuuccaagggaugcacacccagcugcuucaugguacccgcaggaugcaagacaguuugacuuuagugagcacaguaguacauggaugcucucaguuaagauugaacuauauuuauuuuuaaaagguauuaucccucuacuuccagguucccuucauguauuaagacauaauggcuuugggagggaccaaaagaaacccaguaggguguggacagguccuguagugcuggcucacuaguggauuucaguaaguuaaacuccacagcuaagucaauaaauaaugguacauuuaaguauucugacuuuaauaauauaacacguuucacacuuauccauacaguaacaauguaauauguuaauguaaauaaaauugcuuuugauauucagaaauaacaauuuaauuuuuuuaauuuguuuacagcccugggaaaaguaagaaccauuugccaaaauaaaaggaaaccccuuaguguuaguagugauuuuaacauagaaucacuggagacuacuggagacagaugcagcaaacugagcucuuguaaaggcugccuuagaauaacugucagagcagauaaccaaggcugggaggcugagaugccagcugaguuuagccgcaggaggcccguggcuuagcugccaggcccggcuccccaccgcaguacugcuggggugcaccccgcucuggcuccugcaaccgugggcagcacagacugaggcugcuguaacucuaguugcuuggcuuuuuuaaagucauugaguuccauuacuggcccauuacuguuuugcuucccccaucaaaacaggacaacuuauaaaugugcacucuuccuguagcggguuuccccauaguucuuaaacugccccacuugagcuccuauggaaagaucaaacggagccacuucugaccaguacaucccaggaaacuggggcagcauuccaguuuuaucuaauagacagaacuuccagcuuuugaggaaagucuaucuuugcaagcaacugaaccuacagagcuuaaaguaucacuagcugccccucccccaaaggagacucuaauuacaggagcagcugaaggucugaguaaugucccauuuuacacaauuuggugugaguucugugauucauuuucaauuuguguuucccugacuuaaaagaaaacaaaaaaacacuaacggcuguguuugugcguuuggcugguacuccuccccugggcucccaugcccucacuguggggacacugcacucugcuggacaguuacucuugccugcauagugcugaggccggagccuggacagugcagacugccacagccccaguggggggacucgccccagcaaccacuuccuugggggguuuaagguugcaaguuuccucugggagaucuggcuuuuguuuuccagguuuggaggaguuucccccccccccuuuuuuuuucuacauuacuccccaagcauauugaagcaugucuuauucaauguuaugcaauggacuuccacaaaaauucacuuagugucagccacacaauuuuuuuuuaaugcgguauauuccccuguaaauaguuuguguaaaauuugacagaaaagucuauuuacuacauuguaaauacaugugaugauauauuguauuauuuugcuuuuuuguaaagcaguuaguugcuguacauggauaacaaacaaaaauuugauuauucuuguguucguauuguuaacuucuuccugcgacugcguuccaucauuuaaagaaaaugcuguguauugugaacugaccuuguauaugauuaacuuacuccccuccccaaccagggguucccugccuacaaccuuguugauaauguaaccagcaggagaaccucugccugacacacagacuccacugcuguggggaaacauguugacgucugucgcagagcaucggccucacuugcuccuguccuguguaugcccucccucccacccacccccccacccacccccuuuuuuuuuuaaaguaaaauguaaauucaaucugcucua

SEQ ID NO: 6211 - RNA, 2408 nt, Mus musculus
ugcuuauuuuggcauuuaauagagcacugcacauuuauaggaaggaaaugauuauauuaauguaacauuuaaauuauacaguuaaaacuugccaugguuggggauuuagcucagugguagagugcuugccuagcaagugcaaggccuuggauuugguucucagcucaggagggguggggagugacaaaacuugcccaaacccaaaucuuacuagaauaauaauuucuuccacaguaaauuaauauaaauuuuauuuucuuagugugcuugucauuuaguaaauaauaugaggugcugaagugagcaggcauuugggcucauuucugccugaguauguacaaaagaguaaaaauacugcacagaaaaagggagugaguguugaagacuggucugagugccgugcucccgccugccacagucccugcagucguguuuaugcagggacuugaugaccuguuuccuugccaggugcucuuggagaugagcuccgagggcuuugucccaggauugaggcuuggucuugauauggccugugggcuccugggggaagacgagagcauuccaggacuuggguuucuuguagaauuugaggugguaguuguugugguugugguugugguugugguuguggucaucccaagacucaaguuuuuuguagaauuugaggugguauuuguuauuguuguugcugcuguugcugcuauuguuguugaaauuguucccauaauaugagcacacaugaggagcagggugacagugaaggaaugcuuggucaucguuuucuuuugcuuuaaagugaucauaaaauuuaauacucaguucacaaacacauagacaaucacauaucuuuaguuguaucucuauaguauauucacauaauauaaauggacuuuuaaauuauucauuaaugaccaaauaacaacccuccuuucugaaccucacccgauaacagacuuguuuucuaucuaggucacuaacuucaggaauaagcguucugaauacuagaaggagcuugauuuuguuuuccuguuuugcaaacaaguuaaccaugaggcauuugaaccaguaagaaugggguuggugugaggaacaggacagcagcaaagguucgaccugaaggacuggcugacagacugggugggagaggagaguagcaggaggaggaggaagcuucucgcuuaguaguuuaagggguagcucuacaaauuagaauauuacuuuuaaaucuuuacaacaaaguagaagaaaaaaaccaaccauaagucaaaugauuuccccaaugcuaagguuuccuucauuuuaaccuucuuuagggguagaagagagcaaagggcgagcuguuaagagaauuccauagcuuuuuaaaaaggaaaucuagaauugacuacaaaugagucugccauuuuacagcugagccuacacgagggguacauacagcaugucuagagaugccuauucuacaguaagcagacugagagccugagucugaauccuaguucagguucuuuagccgguaugaaugguaacacagagcaggcuccuauaccaaagggucaguacucucucuagaauuaggcuacuuuucucuuagcauguauucaaaucuaauagcuugcuauaccuguaauaagcagaccccugcuuaccaugauaaaauauuauauuuuuuguucaaaucuuaaacuuaaauuuuaggaauauauacaagaacuucuauuucauucuaauacauaguuaaccauuuucgaguuacuacuaccuuuugauuuggcagacuaguuuugaagauuaugaauucagccuuugucuuggguccuggagaaugauccugaagggaagucucuucucacucuccgaguucuaaauaauauagcuaggagccagucacgugcuuggagccucgccucuuuggaaguaucggaaggagcguuuccaaacaucuaguguaaacaggcagacuuugacagagauuaaggcauucaaauaaaaucuuuguaaagucuauguacuuacuuaaaggauccagugaauaccucacugcauuuaaucuuccugcaugcacccaaauggauugcuucauuggguugacucuaacuagacgaauauauaauuugcuuuguaauuaucaugauuucaaaccaaguaagagcauuaaugaugauuuuaaaauaauuuaggaauuuuacaucuuaagagauuaaauguugauaaauaaagauaaaaguacccucgcauggcacuuuaaagaaagaauuagacauggaagugauagugugagacucaauuacagaaguuuccuuuuaaaaaauguccuaagccaccucucucacgagcugaagucaguguuuuccggggaaauagggcuguguuguaguaacagcuucaucuucauggcaggcaccgugagu

SEQ ID NO: 6212 - RNA, 3106 nt, Mus musculus
uuaaauggaaacuuuuuauucuuuuguuuuuuauacuuuucuuaaaugcaaagcaaaguuaaauuuucccuguuaagaugccaagcuaagagccuccuagccuuuugaagagcaguuguccauuauauaaucugcagacuagcaagagucccucagaagcaggacauuguuuagauuggaaguaguucugucuuguguguaaaacaaugauguggugugagcauuuauuuacagugacagccuugguuucacuuaaguggcaaaacccuuuugaguggcucacguuucauucaccuuacagacuucaucuucccuacagcaaaagcugugauaaugucuagagaccacgugacacagccaggagcauaggccuuuuauuuugucccagacauuugacaguguaaacauacauaaaauacauauuaaaguuuagaugcucuuuauaguuugugcaauaaguugaagccuuaaaaagaaaacauuucauuaaaaaaaaaagucauuaguuuuacuuaagacaggaaaauagcagcaaguaccaagacauugugcacuucuuuuaauuaagacaaauuacuucauuuacaucaaagucagaaauauaagacuggcuuucuugaauacauaauauagcuugaaucacugguuagauaggggcacguuuucccaacuguacaucauggaggaagguucuccuucguuucagaaacugcagacccucagccugccagcaugaccacagcauugagcauuaaaaggagcgaggcauuuacuuuccaagcacuagccgcagaagguggccgaguguuuccauuugcagugguuucuucccuccguaaguugaggguugugcuuugucgaggcauuucagagaaguuauuuggcaugccacgagcuaugcugagggucacggggcuugggggugacuuuguugcacuggugaggcuugcauuugaacucauuccauccuggaggugaauaguuagaguugcagcugcugcuucaugggaauuggucauuucugugggugugucuucuggguaggccaccacagcccuaucagugcuacuaaaagugguaucuuugcuuagagugacaccaaaugugguuuccuuuccucgauauuguuuggguguuuuggucacuuuggguugaguuaccauacucaaagaguuaaugguguccacugucugcaucucacucauaguaaauaagcuugagguaaacccaggaggugugggguacaugcucuguuccuuuagagaggauacuugcuuagaacaaggagucccuaucacaugggcuuucguuuccaucacccacuucaauaaguaaguaauguuuuguuuauggucacaugaccaccuguuauuaugaagaguuaucucuugcaacugcaaaaguuggucaaaagacuguucuggaaugaaugugaauuuauuguugugcagguaaagaugugugagauuugucagguuuauuaaugucccuggaaggauuugugucagugaguuauuagacagguccacgauaugcaguuuggaaggcauguugguuggaacuguccaaagcuuguuacugcugagguuaagaaccucgagacuucuuaggguauuuuuaaugagaacaaccuuuuccagcauauucuuagaaacauccagguauuuaagguuccacugauaagcaguaucagauuugucaagaaguuuaauauuguuguuagcagcagacauguuccagagagaccgagguaacugagcaggcagacuuucaagccuguuguuugaaauauccaggguucucagauugguauaugggguuaacugguuaugcagaucaguaaagugguuauaagacagguuuaaauguauaauguucuccugcaguccaggugguaauguagucaaguuucugccugaacaguccacaugccugugccucucugugcauguacacuggagaggacaaaugcauaagaugccaggcgugagaaacagaaggaugaacaggcaggaagacauuuucaguaucugauauuccaucaaagccugaaaacaaacagauacauccuucuuuuaauaugcaaauucacucucagcaucugcaugggucaguuagcauucggcaaaauuuucaauaaaccuccuuguuguugaguccuuuuauaauuguuccagugauuaaacuaacaaagcugcccuucauuuauaguccaaaugccuaauccuucaauuggggcuauguggugggugggggugggggaacugggggggagagagacagacagacagaaaggcagagagagagagagagagagagagagagagagagagagagagagagagacucuccuacauuuucucuuuauuuuuauccuuuaguauauucaucuuauuuaucuucucggagccuuuauaugauagaauggcacugucugcaaaugaggaguuuuauaggcuuacuuaggcuguuacuauuuuugauaauguuuuugauucagaaaaaaaauggcugucaugucuguuuuucuuaaaucucugcaguauuauaagacacaauauguuuguaguuugagauguuaaaacagauuaaaacaguuuuugaaauuucaucuucucauggauaacuauauccugguaaaaaacguuuuaaugaacuuggaaaaaucaagcccgauagcguacauuuguaaaaugauuuuuucccuuauauuucaguaccaauuuuaaaggaaaaacaauauauguauuuacaaagugaguggacauuaaaaugaaaaccucggcuauuacugcagcagauuuuggugcaugcacuuguuauugaauauauucaauccuaacauuagcuuuaaaaaaaaaaaaagcuaaagaaaaggaaaaaauucaaaauccgucuuuuaccaauuuaaacaacugcuuaccauaaugucgucuucacuaucaguaucucauuuucuccgggaaacuugcagcuuaaaggucgucuuguugugggagucggaaggguuucuggcugugggcucugcuugccagcucagcugcauuguguugcugugagccgaagcucugcaaccaccugaucagcaccacauaggaggacugca

SEQ ID NO: 6213 - RNA, 107006 nt, Mus musculus
ccgcgcugaguuccaaccaccccccaccccccaacuccagcucaggucuaggaggggcggagccuggggaggcucggguccuuuugucugcagccccgccccgccccgcccccacgcgggcccgcggcgcgcggcagacacgagcggcugacacgagcggccgccgcgggcggaggcugcgcgccgcagacccgggcggugcgagcgcgauggcgaaggcggcagcgcggggcuugggcuagcugccggcggcgcggauggcggguggcgcgggcugggcgggcgcccccgcggcucugcugcgcuccgugcgccgccugcgcgaaguguucgaggugugcggccgcgaccccgacggcuuucuacgcguggagcgcgucgcggcgcucggccugcgcuucgggcaaggagaggagguaaggagcucgggcgcguccccgggccggggaaaccgcagggaccccgcgcagucacauuccgggccucucuguggaucacauggcaugcccgcgguggccggccggcccaccugccguucccccuggucugucuccaaucccccuugauguuuggggaggggaagaggugcccuuaaaauccagucucugagcacccccucccacacacaaccaagucacagggcuaugugugcaccgugccaggccuacgggugacagggauaagcagggauguucugcagucucugguccuuagcuguaccuacccaaccuagaaaagaagggaugucugcuccgggccacccuggauucugguccaguuccuggugaccuuccacucaagcuaaaugggcaggccuagcuggcagcagacugugcuggcugcagagggccaagcaggaccaagccgggagugguuagcugagccucugguguugguguugggccgcauggguggcagagagcagaauuguggguacugucagccaaugugaaauggcagggucugaacugccaguguguaacgaauaccuaugcguugggcuaguguccuccugccauccucacaggggcuaguauccgugucugagagaagggcaggacaccguguuaaugaaacccugcaguguugagcgucucuggauucaaaagaccugguugaacuuuggguuucuaaggucaucugagacccucugggccuugguuucaacugcuguacuggauggcaagugggaggugaugacaaccccuuucuagguggcugggcacucgccagaaccuggaaauccccgagagcaggagguggaggagggaggcaggugucaggugugaggacucugguccccagucucagacagcuuacuacugcaguucuccuuaaaguccuuuaucuccucucugguuugcucgggagcaucuccugcugcuaccucagccuuucuucuacagaggaugccagcgucccacuucuuggccaauaccuucuaccugagcaggcugagcagcccaggaggcuacaggcugcugguguggagaauucuccuugcuuugggcggaaaccugggauccagaaucagaaaaccucaggcauggggauggcccccacuggggccucuggcagagggcuggcuggagccguuuaauaguauuccuaggcuggacaaacaccucccauccuuagauccucuucccuccgcauuccagacaccaaccagcuugucacugggucauugugguucugcacaggaaccuaccuggguuucccuucugcacuguagccuauaaaccuuugaaaacaucacuccucuacccuugucccuugccacccuuucaccccugucugaagcuccaaaccguuuccaagccaacuaccaggagcuagauuccuacagaggcugcuggugaauugucagacuguuuucuuagcauuagugggccuggaccugaucaauacacacucauggggugggggcuaccuuuucagugguccuacacacucuccacucuuaccaaguuucuggcuacuagaaccucuggagauguguuuggaaaacuucugccuaggcagagcuccucuacccuggggccggccagcgguucuugugcuuuccuaaauccacgagucguagcaggaguuucugugacuacagcagguugcaaauguggacagucaaaaauagauccguuauauuucugucccccagggaggugacacucuggucaccuccuucacaagcugcuccugugcuuguauguagcguucuccaugaaaugagaucauacugcaccauguauucuaaccuagugcacacacacacaacacacacacacaaagagagagagagagagagagagagagagagaaaaaugauccucauauuugaccuuauauaagcuaucaucaaauguacugugcagaccuguuccacgugucucuauuuggccccaaaauguccacuucugauguuuuuuguuuuguuuuaagcugugcugcgcaccuguuccaugugacccuggcacggcccccuccaguauccugacuuguuaacgaggucaggccgauugucucucauuuguuucuuaaaucuaaaccgguggugcuucccuuguuccuacucaguuugaucuugucuucccgcgagacccuccguucugacccacggugcugacugcagcagcuggugcuguccaugugggaagccaggggcugagggaggaggaugcagggcaggaccacggacagggucugcagcuguucugcucacacacacaccagagcacugcuccuuauagcacuuucacaagugcuguggcucagaguguuucuguuguuuguuuacacaucugcggugacauugacuccccagcccacugguguuccagacaauaaccaaccacucguuagacaugagacucaaccucuacauuuuaccaacugcccugguauaccacggagccugggaucagaugcaguaggucuuagagacugaaauagccuugagagucuaaggaguugaugaauuaguaaugcaaaaaucccccauacaggagaaacccaggggcuggggauggagggagugcuagccuauuuuccuagcacguaggaacccuggauuugaugcucaaaacuacauuuuuuuuuuuaaauuaaaacauuugccaggcgguaguggugcaugccuuuaaucccagcacuugggaggcagagacagguggauuucugaguucgaggccagccuggucuacaaagugaguuccaggacagccagggauauucagagaaacccugucgccaaaacaaaacaaaacaaaaaacaaccucccccccaaaaaaaaacccaaaacaacaacaacaacaacaaaaaauuuaagaaauggauauugcuauacaccauugagcccgucaaaauccugucaugguguggggagggacccacaaggccuuagcccuccauguacauuuauauaggcaguuaauaguagccaugggggaggggcuuaugaggucuugccccucucuagagccuacaggcaguuaaugguugcugggggggggggggaggaagagucauuuucuuuaaugauguagcugcuggcgagguggccaugcuucuguaaauaaaaucucucacccauguuccuguaagcaucccuaguggagucauucugaugaggaagggggugggggugaggacaugaaaggggagagaggugguuggcugagaaggggaguguuagugggaggagggcgggagagguuaguggagguugaaagugaucagcauacauuccauaccugcacaaaaaugucauagugaaucccauuauuaugcauauuaauacaggcuaauaaaaacaaacaaacacacugaauuuuagaggcagacacagcaucacacaccuguagaggcucuugggagguagagacagaaggaucagaaguucaggguuggagccuggaagauggcccaguagagacaagcuugcuacaaaagccuggucagucucccugagaccuuacuccuggaagcuguccucugaacuccacgugcacacaguggcacuuguguguccccacaucacaaagaaaagaaauuuaaugccaucuuuaguuacaaaaggaguuugaggccagcuggggauauacaagacccugacucuaaauaaauaaauaaauaaauaaagcaagcuagcuuuggcaguacauguauuaaaauuguaacuauacagagaagauuaacacggccccugugcaaggaugauaagcaaauucaugaaacauuccauauuuaagaugaauacauauguaauuuguaugagauaauuccacggaggagaagccugucuccccaucccuuaaguacaaguuacuuuaagacuuccucagagucugguggaagaagagggaaaagguagccugacagugaaggaagcugacaaaugccacccuagaaugccaccagaugcuucuccccugcccauagcuacggugugauuaucccuacguggucgugagagaacgaucgggcagccccgcgcugggacucgcagcugcuccuccuuccuugggucagagcuccagugcucuggaagagcauguugggcauacugucugggaaggaaaugcagaguuagggcuuguuccccgaggacccggugccccuggcacucacgcagagacccucucagcagaagcacugguauuccccaggccuuuauauggggugugguaggagggguauaguuuuggcucuggcuucuuccuuccuacuccaagcaguccuaccggguugaguagacaaggaaacccgaaaccuugaaagcugucugggcuugagagcugagcagagcagagccuaggcagggugcagcaagcagcggccugaaaacaugcugcaggcauccccacucccagucccagcaagcaagauuguaacgccucauauuuucauagaguggucaucuuccuuuugguuuuuguuguugcuaugcuuugcuuuauuuuucauaugguuguacuuaaccuaggcuaaccuccaacucacuguguagcaagcacgaccuugaacuccugauucuccugcuuauacauccugaaugcugggguucaggccuguggcugcacccaacucuacagaguaauugugaaggcugucuccuccauuacucucagcauguuucuagcgugaagccuguuucccucugucucuugugucccuguuaagggccagggcugggaaauagcggggcugugagccuaagcucuccugaauggggcuagagccaugguugcaagagacugacagccagacauaguggugcauuccuuuaaucccagcacuuggcaggcagaggcaaguggaucucugugaguucaagaccaaccugaucuaccuagaaaagccagggcuguguggagagacccuauuggggugggguagggaaagaaacaaagagacagaaacagagacaggggagggagggagggagggagggagggagggagggagggagggagggagggaggaagggagagagggagggaggggagaaaggagaaagagagaagaggaagaaagagacagucagggagggggauggacagagggaaggaaagaaggagcaagagggaagaaugggagggagggcaaugagggagggggagagagggaaggaaggaaggaaggaaggaaggaaggaaggaaggaaggaaggagaaggggagggaggggagagagggaaggaggaguuagaaugucuggcuggcagcuuacaaguugucacccuuagggacucugcuaaaauccauuacuuacagccucuguguccucagggacaagguagcagaagaaaucaaauccccaaaaccuguccagcaggccuccagguagccauaggccaucuuaucgcagugagaaggucucuucuucccuuuggacuccuguccaaaguccagcccacaucauagugcuccuagcuuaagccacacaacucagagaagagugacagaguucuuuagaggcuguuccugugaccuguagugagcauuguccccaagagggucccaggcuaaagucagcacccagacuaggcaacaacaaggcuccuauacacaaaacccaagccugaagguggggagggguggcgggggugaggggaggugaggcuucuccaugagaccuuccauucagugccugugucuuucuagaauaauccuacagggaauuggagacucgccacuuccaaagccaggccaucccgucuaggcaaaacucuugagucucuuugaugucaugaccugaggcuguauucuagcacuccauccuacugucugcccauucauccaucugcccacucacuggggaauccauucguccagccacucuuccaucacccacucaccugucaccucccguauccagcuucuacuuugcagauccauccguccacugaaccgccugucagcaaugucuuccuccacuccucauucacuguauguuuaguuaggguuucuaucgcuguaaugagacaccaugaccgaagcaucuugaggaggaaaggguuuaguuggcucacacuuccacaccgcuguucauccuugaaggaagucagggcagaaacucaagcacggcaggaaccuggaggcaggagcugaggcagagaccacaaagggauacugcuuacuagcuugcucuuaguggcuuacuuagccugcuuucuccuagaaccuaggaccaccacccacagugugcugggcccucucacaucaaucacuaauuaagaaaaugucccgaaauucccugcaggcuugcguacagccugauuuuauggaggcauuuucuuucacuuuuuaaaaacuacuuguuucaguuuauuuauuuauuuauuuauuuuuaugugcauugguguuuugccugcacguauauucagugugagggugucagauccccugaaacuggaguuacagacaauugugugcugucaugugguugcugggaaucgaaccuagguccucuggaagagcagccagugcuauuaacugcugagccaucuccaucccagaagcuuuuucuuaauugaacuucccuccucucagaugacuuuagcuaugugaaguugacauaaaacuguccaguacacccaccguucuuuagucaucugccuguccauucacccacccacuaaugcagucuuugcuucuacggugcauauggccacguacagacucaggagugggaccucauugucacaggaugccaaguggcugugcguaguuaaagucacaggaagggcuuggagagugaggacugaggccgaaacaggggcagauggugaccagaggaaugaagcaggacugucugguucuuguguuuagaaggacagcacaucccaguacgugcugucccagcuggcaugaacuauuuuuauaauuucucaguucugcaggcuguugccuguagaaaggucuggggucaucuugaaaggaguugcagccuggcuucuucuuaaaggagcucauuaggagggaugggucugcccacuucucuauaaagguagagcucacguggcugaagggacagcuuaguguggcugcucuugcagaaggcuuggguuugguucccagcacucacaugccagcucacggccagcuguaacuccaacuccuggggaucuggcauccucuucuggacgccaguuguggcugccaugugggcacugggaacugacccagguccucuggaagagcaaucuaugcucuuaauuccagcccagaugauuuuuggaauuguuuguuuauuuuuuucaagacaagauauaacccuagcuguccugcaacucuauagaccaggcuggucuccaacucagagagauccaccugccucugccuccugauugcugggaauaaaggcaugcaccacuucugccagacuuaauuuuuuuuaaagauuuauauauauauaaacacauacacacacacacacacacacacacaaaauugcucucuucggacaccagaagagggcauuggaucccauuacagauggcugugagccaccaugugguugcugggaguugaacccaggaccucuggaagagcagucagugcucuuaacugcugagccaucucuccagccccugauucaaaauuuuauaauaaucuuuucaaaaaggauucauaaaguagcagucaaggcgauuuuuuuggaaggcuagcauagacuuaccauacccuucccagagugcccuggaccauggaggugucucuaacgucccucagucccagaugccgcugucgcuuucugcgugguacuuuccacugcaggcucucuugugcaagaagagaguucuucucaccuccacuggugguuuuuugaacaggaagaauaagggacagacagaaccauuugucacuggccuuugucuuucuccauucauccuccagcaaacagagguuccaagggcugaagugacuugugcaggacccaugaacacaggucccgcugguuccaaagcugccuccuugcugccugcaagaucuggggucucaggcucucagaggccagggauggggaaaccacagcagaaggcuuaccuggcuuuuugagccuggaguggccugguuggaagcaggacuaagcggaauuggguugugaucugugagcccuuuuggagcccagcagcaaccuaaguguucugggaagacagccggccucuguggaaggcccagaggcuggaggauuugaugcuugggguggaagaggcugccaguaaccacacccuguucuguuaaguaggccagagaauguguucucgggcuccucagcaccucugcuuucucauggcuugcucucugcuagcagccuguucuguuuaucccaccugcaucucagcucuggccaaagggcccugccuucaggggggagaggcacuggcugcaggcaucuccccccccccccgcccccccccacuacaggaucccaagaaaucacugcucuggcccccuugcugcaguggggugcucacugcagugccugcuggguccuacaagugacaguuaacucugugcacuggcuguguuugaaugggugagauguccauuuauuuuuuuccauaggccuuuucuagagccugccccaugucacacugguggcuacagagccacagaagaacagggcauuccucugcuuagcucccuaaugugggcaggaaggcuaggagagaaaccugggguggggggcauuuuuacauugugcaugugugcaugcgcaugcgugugugugauuuguaguugggaacggggauggcguacagcaugacgcuucacuacauaaguguacuguggaaugagccaaucaagcuaauuagccuacuuccuccauucucagcauuucgguuuagugagaauauuggaacccacuccugacauaugcauaguuauuugcuguagccaccucgcaaaggagcagaggguuggagcacaguucucuugucuaacuggaccccuccccucucacagugaucccuuuugcugguguaaccugaugagccuggacccuggcgggauggagucccugggugcagcacuccccagaggguggaaggguccugugucuggaaccgaagcccuaagggaagacuccugagcuguucccacuaggcugggccuccuuugucccugcucacuguucuguggacaugacugcuagccagaggacuggaccaaacuggacuauggugugggugucucagagcccgggccccaaaugcacacugccagcuacauucuuucuccugcucucaacggucaggauauaaccuagggcuucagcaugcuaggcacagugacaccgagcuaggcccucagcccuacauuuucauuuguaacuacugcuguggcuguuguuacuauaugugucugugugugcaugccuguaugugugcaugcauacauugcugagaacuuggucuaguauugagcuguccccaccccaucuucuagguccccccccccccccaguucauggauuccucccuuucccauaggcuauaauccaggucacuauccuuuuugaugcuuaaagguuucuuuugguuuguuuuaguauagaauugaaacauguugacauuugauauaaaauuuuauuuauuuauuuuggugcuaaggauggaacccacagccuuuaccacagauccauauccugguccaucacugccuugcuuuuuguuauuguuuuguuugagacagggucucaugugaccccaggcuggccucaaacugcagccaaggaugacucugcuuccaguguuccuuucuauaccucccagguguggguaucacugagaugugccacgggcucugcucaggugcuaggggcugaaccagggcuuuuacaugcuagguaacacucuaccaacugagccacagagucagccccucaccagccccugucaaagaacucccugaggcugggguuguaucucaguaguaguguguuugccuagccugugugacacugggggugugauccccagcaccacaaggauggauggauggauugguggauggaugggauggguggauggaugggauugguggauggauggauggguggguggauggauggauggaugggauggauaggauggaugggauagguggauggaugggauggguggaugaguagauggauugguggauggauggauggauggguggauggauggauggauggguggguggguguguggguggguggauggauggauggauggauggauagaugggauggaugggauggguggaugguggauaugauggauggaugaaauggauggguggauagaugaauggauggauagauggauggaugggugaauggaugggauggauaggauggaugagaugggugggugguggauaugauggauggauggauggauggauagaugaauggauagguagauggauggauagguagauggauggauggguagguggauggguggguggguggguggauggauggguggauagauggauggauggguagguggauggauggauggacggauggggagauagagcucugacauucucuaacacuuacagaauuuauaucuauuuauagauaaagucaagcugugucauccaggcugaccaugaacucauaauucuccugccuuagccuccuaauugcugagauuauagguguacaccacacuccugguuucauaaauagauuucaaaguaaauagcacugucucaaggucuuuaauaaauauuguauucaacccacuaacuuagacagcccuuacuguauauccagucuuccucaugagaacaaaguacuaaaaaguagcaucuuauggggcuggggagauggcucagcaguuaagaguucuuccaggggaccuggguucaacugccagcaaucacaugacagcuuacaacugucuauaacuccaguuccaggggaccugacaccuucauacagauauauaugcaggcaaaacaccaaugcagaugaaauaaaaauaaauaaauaaaucauuaaaaaauuaggaucuuaaaacuaugcuaaauuaauguuaaguguugaaugugcucuguuaccacuaagaauaaaguacguuuuucacucuuuacuuauuuuuaaauuuuuuuuucuuuuuauguguauggguauuuuaccugcaugucuauccacaauacugauaauguucagaagagggcacccaaucccgugggaguuacagacaguugugaaccaccaugugggugcugggaauugaacucacuaccucuggaagaucuuacuacauagccuuccuggcuucaaacucacagagaucagccuaacuaucaaauaaaugcuaggauuaaaggcauaugucaucacaccuggccccauuauuauuauuuuuaaacuuuuuaaaaaagauuuauuuauggccggacagugguggcauacaucuuuaaucccagcucuugggaggcagaggcaggcagauuucugaguuugaggccagccuggucuacagagugaguuccaggacagccagggcuacacagagaaaccuuuucugggaaaaaccaaaaaaaaaaaaaaaaaaaaagauugauuuauuuauuucauguaugaugaguacacuauugcugucuucagacacagaagaagagggcaucagaucccauuacagaugguugugagccaccaugugguugcugggaauugaacucaggaccucuggaagagcagucagugcucuuaaccacugagccaucucuccagcccccauuacuuuuuaaagcuacauguuagcagcauauaggaauacaauuuauuuuugucaauguaucuuuauuugaccacuagcaugaauucacuuauucuaguaauuuucuagcugauuuccauggauuuuucuagguaagucuguccucuucaaagguaauuauugcuuuucugucugaggugugagauagaaugagcaugggagauguguccuugugggaaaaggagaggggcauguugggacauuggccacauggccucaugcagaaucaggcgagcaggccagguuagggcagauagcugggcacugccgccugaauggcaggcuguguugggcaggagaugauggauccuggagucugaacaugggcugcuguggguuaggggcugauguagaaggaagaggccgggcaauaguaagucaggagucuugguuacggaucuagugagacuccagcccacaaacaagacaaccuggacagaagugcaaagaauggaccaguggaugcuggccuuugcuggcaaggcauuauuaauuauuagccuuggguucagaguuggccuugggcauccagagccgcugugcagcccagguagcucccugagcucugcaguggucuggacugcugguagagccaguagguguaagguucaguggggcugccagaaucgggacuuuucuuaucacauguaaaggggugagccugagagauggcucagcagguagggacacuuguguggcacaggucuuacaacccaaauuugauccuuggauuguucaagguggcaggagagaguuguccucugaccuacacacacauagucaagugugcgugugugcacacacacacauaguuauuuuuuaaugcauugacuguagcauaccaccauuacauuacauuacaucgcauuagcagcuggcgucucagcccugaucuucuuugguuuuauuguagagcaagaaguucauugcucucccagagguccugaguucaauucucagcaaccacaugguggcucacgaccaucuguaaugggaucugauacccucuucuggugugucugauaacagcuacaguguacucauauaaauaaaauaaaucuuuaaaaaaaaaagguucgcugaacauacuccugccuacggcucucacagacguaguccagguuugcccgccgguuggcauugggcagaacccacuuuuuggccuugucugugagguggguugcccaguggggguacgggggggggcauuacugugccugugacuggaagagugagggcaagugcuuggcacaggacaaaguggugugucugaagcuccuuguucugggaacuaucauuguggacacugugaccuuaggcacacucagaagagaugguacccugggaugaggugguuaggacucuggccccuggggacgggacacuguggccuuguuuccacuguugccgugcuggccguaugacccagguugaugguggugacgguggugauaccacugcucagcacagcaguuuuagagcagaucaaagcacugguagagugcagaagagaccgagcucuggugaguucugacuuccucacuuccuaacaagcugaggguaaccauuucuccuuaguaaaaauaggccuaagaauagcagcuacuccauaggcuuguggaguaugucuggaaugauucugguaaugcucuuaggaguaccgggcucagagcagcugcuccuguuguccguuguuauugugccauuauuaucauuacugugacucuggggaccucacuuuagggagcuugcuguggugggcggggcugguaguaggugagcuaccacaucuccagaggauggagucugcccugggguagaggugcgggugaugacacggccccucugcuuuucuguuggauucugggaccguuccccuucccugccccuaacugcccuggaguuggcucagagaacuugaguguguucacagacagggcccucagcaaaggccaucccugccacucccugccuggcagagucuagcgcugcucagcccgguuccuucccagggggaggauuccguaggauuuacugggaacugaacacucagguuccagagguucccugcuggcugccaggcugagcagaucugcgcugggauuuagaacuggccugugcccucagcccagagggcccacgucugaacgcuugccucucuccugaccuggaagaccuaaggcuugucucguggcuugucaccuccacaccaggcagucugcagcuccgucuucucugguacccggaaccuucuugcuuuuacccuucccgcucugccgcagccuccaguccgcaugcccgcuuugggaaaggagaccugaauuaugaaucaaggccugaaucauguaugaggacucuugcccuauuugguguugcaguaccugccggggaaggguuugcaucugcagagagcccuugguagaacagaccugaacuuuuucuagucccuaaggaacuuccccagccggcuucauugccuccggcuauggaggaaaaaggcagccacaaagaggcagcccugggccugacccugguccccugcucuggccagggcuguaagagagcugcagccauuuuggggaguccaaagcugcuucuucacuuaggacguugcuugaggacagagcucaccuagguuccgcccuucugaggcgcgugucagguacagucugggaggaagcaucccuaagaggcucuggcagcaggggaugggcagguggauuguguguccucacuaaggaccggaaaccccucucacccagauucugucucugcugccaacauggccgacuuagugucaugugcaaagcagcacagcaguaaagggcagcgcccaggacgugaggaauccugguccuucggaagucagagggaagcuucaugagcagggacagggggugggggagccaguggaagcugacaggccugugugucucagacugacugaucugagagggcuguguguguguacauauguguguauguauauguguauguacauguguguguuugugucuguacuuuuguauagguguguguguacgcacgcgcccacacacacacacacacacacacacacacacacacacaugcucauguuaaacccgacugucacauauuccggauccuuucucugucacuccucacuucucuuucuuucucuaagcugauuaacuagaacauugcugucacagagaagagcaguaaaggaccugaggacacauuucaguuuacaacugaggacgcuaggcagacugaaccugccacacuugcugcagcucuuguuacuccuggcaguguacaauuaggacuucuguaagaaguggaagagagggcuggagggauggcucagugguuaagagcacugacugcucuuccagagguccugaguucaaaucccacaaccacaugguggcucacaaccaucuguuggggauccgaugcccucuucuggugugucugaagacagcuacaguguacucauauacauaaaauaaauuaaaaauucugaaaaaaaaguagaagagaauuaaaaauucccgaagaacauuuauauacacauccagaaagaaaaucugcaacaucuuaagucucuugauuauuuuuucaaaaaaaaaaaaaaauguugagacaggguuucucuguguagcccuggcuguccaacgaacacccucaguagaccaagguggccucaaacucuuagagauccaccugacucugucucccucccaagugcugggauuaaaacugugugccaccacugcccaguuugaacacuguguuuauucuuugugaaguucaugugauguauucugauuauuuuuaccuccccuccccugacuccucccagauccacucaacuaugugcccucuuuuuaaaauuuaaaagucuaauuugugcuacccaaauacccuuagguggggccaccuccugcaguguuauccccucaccaggggucacacgcuuaaagccggcugccccucuccuggcugccuucaauugcaaggcuugucuccgucuccaagcugggauuugucgagcaugagcaagucucucgcaugcugucacaaccacgugaguucauacaugcaccggcccuguugugugcagaaaaugcucucucccuauggucacccagcgccucuggcucuuacaagccucuacucccucuucugaaaugugugagccuugggaggauggguugugauacagaugauccaguuagggcucagcacuccacauucuucuauucucuacuccuuagccaguccugggucucuguguuaauugccauuugcugcaaaagaugagggccaagagauucacuaaucuaaggguacagccguaggucguuagcaguggauucaguacuucauuacaccugacgcucauuguugaggcuaggcuggcuggccugucuccucccuggcaccggauuacaggcacacacugccacaccuggcugagagaaggcuuuucguuguggucauucuggggauggaacggcaauugugcauguuaaguguaugcucagccucuugagaaccacuuuuccugugauagaccuugagacuccuagaccuugagacuccuagagacuguggcaaggggcucaaccuuccugggcacagcuugcuucauggacagaacuaggcugguagcccucauuguuucagggcaggcaugauggauggauggaugggccagcuuaaucuuugcuuucuucauugguuugagauaucuucuugguaacuccagcagggccugauuacugaauccauuacaggacagauagguuucuggaaaucggcccugugcugguuugaaggauacuggcucccauaggcucauauguugggaugcuugguccccaguuggcagcacuguuugggaaggauuaggacaugugacucuuguugaaggagguguaaagcccacaacaaucccaguuaacucucucggucucaugcuuguggaucaagaugugagcucguggcugcggcuccaguaccugcuuaucaagugccauguuccccaucaugauggucgugaacucacucucugaaauugugagccccaaauaaacucuaaguugccuuggucaugcugucuuaucaccacaauacagaaauaccuaaggcaggccccuuuggucgaugggcuggugggggcagguccuuugccuggccugugggcacugagguuccacucaggaccccuguggaauuucaagagaacagaaacugucuggugagcaggacaccauucccccaguagccuuccuaggggccugccugauucccacaggauucuuaauaagccacugcucaaaucaauagcuuucaaguccaaaauucuccuuggucuccaugguuacagugcaaguuggccuuugcauccuggucauuucacaggagaaaaccccaggcucaagggggcuacaguuuguuugugucuggguggguggugaggcuaugguccucucccaggaccuguaaccuuuccuucaucguguggaggagcggcaccagggcuucuggcuggagcugccuuaauuuguuuugccucggaagcuaaaacgugauuccccagaggcugugaggucuucagcccaauugcagcuucugaggaagagaggaaggcauuucauuugagugugggagaaaccccaguaaaguucuaggaugaacagugccccuccagcagccccaagaaucagccaggcaugguggcgcacgcacucgggaggcagaggcagguggauuucugaguucgaggccagccuggucuacaaagugaguuccaggacagccagggcuacacagagaaacccugucuugaaaaacaaaaaacaacaacaaaaacccaaaagaaucaacaguguccacagaggcccugacacugggcuggaggauaccagagaccacuugcccacggugugaccccuagugugccccucccuuggggaagcauuguccaaguguccuucuucccccuuacaggcugagcucccuggcccacagccaggaaacaguucccaggggugcgcccugccuugcccucauuaauucuuaaucuuccuaaaccuuaaaaaaaccaaagcaaguagcaugcauagauuggaccuggcuucagaauucaggacugggccaucaaugucaacuagaacucugcuaguccaaggauggcugggauuggccuggugcuaggagcaguuagaaaggcaggcucaagagggagggccaggggauguagcucaguugguagaauguuugucuaucaugcacaaagcucugauucccugcacuucauggagacaggcauaaacaguguacaguaacaggcagcacuaaucccaaacacgcuacagguagacacaagauaaggaguucaaggccaaccugggcuaccugagacccugccucaaaauaaauaaauaaaaacaaaaauaaaaaaugagaaaggaaaggaaaagaaaaagggaaagaccgaaaagcagccuugcaaagugagaaccuccacccaacugauuggucgagagucucccagucucuguccugucaguagcucagaguagggguauccaugucuuuccuccccacugagagaacagggcggugguggcugugccuuugagcuaucauguaccccgauguacccugggccucaaacucaucugcccgcacccuguggaccucagcacaccugggggcugguguuggcugagugaccgagagaagaagcuguguuuguggccuucccugaagcaggucacugaagccauaggacaaaaccuugucccucacagucagccagagccacccguguccucuugguggagacaaguucccucuucugccacggcugcccuugcagaccggucugugucaucagugagacaauggaagacuggccgggagggccuugugucugagaguccaggggaccuggauuugugaucaggcagacaugccacccuggccgaccaaaaccuacccgaugccccaggugcauuggucaccaucuccuuuucuauagagauucaggaaaugaccccuaggugucaaccuggccucccugugucugucacaccagaagcaaacuuccuucuuuccauccccacauggcccuggcuucucuucuggacuggacuggccucauuaagcucuaccugucuucccccccuauaccuuccagcaccuuccuaaguacaaaccuggguccuugagccccugcuaaucacuacccucacccccagcagaggacauggugacuuccuggccagcuucccugcccucuguguucuccagccaccaaagcaggugcugcacccccaaccagcugguaccacugccgccuguccugagcuccuguccaccccucccaugucuucuuguucucuccaccuuuucucugcuccccgguauuccccacaacugaauguuugcuguguccauccuuuagguccagcacagucacauccucuggcugccccagugugaaguccccagcccucuggacucuccuuccuuuaaaucuccaccaacaggacuccagaaacauccaggaggugaccuuauggccacuucugucuuaauuaccccugaaauacugugagccuucccuuuuuuacuguccccaccacccugcugggguucuuaaaugauccaauuccguuuuuaaauucagcagauugaaaacucuugugagaggaaacggaaggauuagccaccagccaauaugcagccgccagccagcacgcagcagagcagcgucugcugagagcagccucugaggagagcagcucagggaguugggacaguguuacuucucuagagccugcguguuucuaaaucccagcagauaaugagguggaauucagaggcugagucauuggccuuugcucacaccacuggugaacggaaaaggggggauuccagcccagcucugucuaccacagagaccuggggugacauacggcccagacgugugggcgggugaucagucaccuccaugcuuuuaugcucuucccaaggcuauuuuuauuuuacuccuaauguacagcaggacaucuguccuuucccuggggacuuccugggagcuugucauucuccccguggagcugaagaaauguuugcugaaggcagggacagaggacagccuacuucaggggccacccacacgccugucauuuucauuacuauucagacacuaaacaaagcucucguggguggccagagggacucugcacuguagcagcucagacugauuaaggggccgcuggugacaccuggacaugcuggauggagucuugaaagggcuccagccacagcuuagcugaggcuacacuacccaggacggguggccugggccauggugacaggucuccuuucaugguaucuuacccuagccagagacgucccaauaguccuucuucaccaccuuagcucuugaaauuuccuucaucuuuuucaccaacaaacccuggaagggggaggggugcuguguacacgcgcgugugcaggguucagcuccugugaauaagcagggaggccagagcaggaugccagguggguguccugcucuuccuuauuccuuugaggcaggguaucucccugaaccuagagcuagacugguugccagcaggccccagugaugccccugucugcacucccaacagcacugggggugcacaugcaagccauacccagcguuuuacaacacgguugcuaggcuccaagcucagguccaugaguugcagugggugcucuuaccagcccaggagaguuuuuccaucagggacccucagcuuugggaagaaaaacccauauauggcucaaaugcagagaaaaaaaccugccugugugugugugugugugugugugugugugugugugugugugcuauguugagaaagcacagcagcucaaagguagcuuccuaaaguggcuuggaggcaucacccuuugggaagauucuuccccagugucacccaagaugcauccucuccaggaaaagaggguagagaaccuuucaugacuggcucaccccucccccaucagaaccccugcagaguucucuuccugucucaucucagugaaccgagguuuaacagacauuugccuaaagcaaacucagguuuggcucagucugcucuuucuggcccugacugagguauccugugcaccuggucaaacaggggugggucaggaggagaggagagcagccaucaggaccugcuucaggucuugccauuauuuguggacauugguugaguccuccacagggcccugugccuuagagggagacacuggcuacucugguuuucaucucuucccuaaccucguguguaccccaaacaacccuggggagacaccccaacucuauagacucccaaggcugcugguauuuaguguuauucagcgcuuccauuuuuuuccaaaaagggaaacugaggcauaaagaagaaggugcucuccaagacuccugaccaaguaccuugaugguggagcugcaggcaggccccucugcccauuccugccagaaccuguuccccuccagcucccucaaagcaagcaccuuuucacccagcauccuuggcgagcauggugcaacguucguuauuccuugcuuaguuauugucuuaguugauccugagagucagcacuguagaugugugaaaaccagucuucuagggguaaugugacugcacagauuccacuguagacacagaccacaaugcccugagcaucccauggggugcaggcuuugggaguggugauuaggaacugacaccagacucuucagccuggccuaagguauggggacugagugguaggacccucuuuggaaacucuucccucucugucugcaccuggcucugugggaacucuugccuugcuccccucuccgcccucccugagaaucccucccugagaauuagcggaggucaguggcugccugcacccuuugucuucuggauuucagaacacaggccuuauugugugccugggaaaguggauaaacaagcagcugggccuuuggcccugaggccccagaggccccagagaagagugagagcccucuggguggguggcagggggaaagacuggucugcaaagagaagagucccggaugcuaaggugcuucugccucugccuccugacuccucuaauguggggugaggccagaggacuaugugcuguuucucuuggccagugcuucucaaucuuccuaaugcugcaacccuuuaaugccucaugauguggugaaccccaaccauaauaaaauuauuuucguugcaacuucauaacuaauuaugcuacuguuaugaauuguaaugcaaauaguuuuggagacaaagguuuggcagaggggucuuggcuagguucacagguugagaaccacuccucuaggcuguugagaagacucugaggaagaggccuggagauuguguuguuaggacaaagcacugcagccagccuccugucugcaaacccaggguaacugugacuguccccuccucccaccuccugaguaccgaucugacaaggaugccaccacacccaguuccugcaggggaucuaacucagagugucccauugcagcuacacccuaagccucugggccucggagcucagggccagcccuccagcuuugcuucagcuagcccaggcaccagccuuugcuggagucccccuuccccagcuucuuuugccauuugcuaucccuauaucgcucuccuagccagcugccggcacccuggccacagguccaaggacccaugcuacccaaaucaaaaaaccccaacaaaccuuugaugaaacauggaaacagcugggucaucuuagagucaguaacuuuguuaccauguuuuccaguacacaauguuaccaucuuuuccauuuguguggugaauaauuuuggauuguguucugggcaucuugaagacuagaagacucuaggucucauuagauaucucagggaaaugucagcauaguguagguuucuuuuuaauuaggaaauuaguccaguuaaguugaagccuagcaucuccgcuugcccgcucuguaagcagcucuucuaacguagccaauuccguucccaaagcuggugccgggcucuucauagcuuccccauggaugcacacccacggccgguccacugucuccuuagucagcugcucaauucugaaaugaucuguuuacuccugucugcagcucaggacuucagucagccucacacaagggucuccaaccacuccccagcuccaccuucucaggguccugcccugcccauuucccaggggcucuuuuccuaauuucucucucacccccucuaccccuccucucuucucugccaccacugccacauacacaugacuguguggcugcugccaccacucagcuuugggaccuaagcuugccuugugggagagacagacagacagacagacagacacacacacacacacacacacacacacacacacacacacagaggaaaagggagagaaagaaauaccuagggcauuuuccuuguuuuuuuacucaggugggaccccucuccagcuuugcaucagaaagguuucuuuuagauuuagagcccccucucuccccaucugcugcacaggaaauagaaagaaggguaaagauaaucccccaaauucaagguuuuguuuucccuuuguucacccuguggagccuuggcucuuuagguuccucacuuagugcuccggcuguggucugugggagagacaggaugugggguacuuguguagcucacccagagccaggugucuucucagguugguuuuauuuguguuuggggaggggguugcuuugaggucucccuauguggacuaggcuggcuggaucuagugaccauccuguuggggguuacugcacaugccaccacgcccuucuucccagagcuuuaauauuggcaucugaguaacaggcucgaagucuacagucuggaugaugcuaguggccaaucuuucuuuagcaguucaaugucuuuuaacuauucuuuccuuuacuauuccaguucuuaagcaaggauugucuguacuggugcaaaauuucuuagcuuuguuuuuuucucuggucagagcaaggccuggaacuuauuauaagugaucaaaauuauuucaauagcaauaguuacuggggguugucugggcucagcugccuccucaugguuuuaggaccuuaaccccaaacaucugagccuaguguauuguccucaucuguaaaaugggaauaagaauacuauucaggacccagaagccugugaaccuggaauaagucugucuacagcgugaucaaacagugccuggcauaaaggcaguugcucugcacuuacuugauucuugguaggaagggcuaauguuuauucacuaccucuaagugcugaaagccugagaucuuagagacaaagggcugcuugaccuucacuggcuugccaggccugugugggggaggucugggaggcagcugggcuugggagagaucuuaccaguaagcugaccacagcuggcucacagcaucacagcauccuuccaucagagacaugcgacucugggggauagauggaagaaaccagccugaagagaagagcaacagaaauagaaggggaagccugguaauugaaugguucccaaugcgaaagaucagcaucccucugccagcagaaccaccaguuccucuggcagcaugcugcugguccagcugugcgugucucagcuguuccaucaccccugccagccccggggcuugcucucuccucucaugggagccagaggagcccgggacugcuggcucucaguguuaccugcuguacuccuuggugugagagugagccccugccucuuccuggaacucagcagacccagcauccucugagacaggaucucucuuguagccugacuucaaauacaauccuccagaaucuuuauauuccuuugaccauguuaggaagugaggccagggcuugcacacacucacagagcagcaccucagccagaucugucuucacacgugggauguaggggcuuugagucgguauuccuugcacacagguggcccaguagaggccacucacuugcagagggcagggaagcaguagaaagcaguugcugguacuauagggucaggaagcuccuguucaguagcugccaaugcuggugacugccuaaauggcucaauuucccugagccucgguguccucaaauguaacaugggacuguuacaacagcugcuguuuaaauagcucaaaaugaguccugauggucuugcaaggauuuuuuuuucccacccauuuuuacaaaauacugauagagccuuguuuaaaaaaccacugugucaggugauggugacacaugccuuuaaucccaguacuugggaggcagaggcagguggaucucugaguucaaggacagccuggucuacagagcuaguuccaggacagccaaagcuauauggagaaacccugccucaaaaaaacaaaacaaaacaaaacaaaacagaacaaaaaacucaaaucaaaccaaacaaaaaaccuaaauaaaugaguagauagauaagguagauagauagaccauugcaaccacuguucuggucuuuauggaugcuaauuguaugugauauaagaauuuacuaauuauaguuuccacaaagcugucuuaguaguauaucuagccacuacccugggaccaccacccuccugagcucaguggagguagcugaagagaagugagucacuguaguuguaagcucuuaacugcagucuggaucacaucucugucgacuguaugaagguccuuacagccucacaucucugucugucugucugucaucagacaccccaaccccuaccucugaacuagcuuucucuggaagcagaggauggacagccugccccagugauguccccagguccuaggcauuagggauuaccagucugguagauuauggaacccugcugucccucagagugugugaggucggagcuucucuucaggccguugacacucuggaguagaugccuuggacuuggccucaauuaaggcauaggccuuggcuuuggaaagggcuguagggguaagauccuagaggcuggggguugggguuaguaugucccaggcccuccuuacauucauaggcucucuuaauagcaggggagggggcaggaggagaggauggccaguggagccaugggugagcuccccgauagucugcagguggcaccugggcuguacuauucucagaagccccaucauugccuggcagugucagcagcuuccuugguaguggggaugggagcagggcuggcagcugcaauguuggggaugcucuguccaggccugagcuggcaaaaaaacaaaaacaaaacaaaaaacucuucccuguuaccugacauucuaccacuccauggcagcugaggggaaggacuggggcuuucucagcuuuggauagugcacagcacuacgggucucucugaaccucagcuauagcauuccccugagaguugaggauaucuggagccgagggaugcgcuacuagguaggcagguucagaaacaucuuaggacguugcauagcuccuggguuauccuuuggauccagcagagcaggaaagcuggaaagagguacaaagccacagccaccaugcacaggaguggagaguggccauggugggaguugugcuccccgaagcccaccaagccagcccgugaugcugacugcugcagugacggggacuaggugcccgcugcagcugccauguuggacaagcauccuguggaugugcagggaagacaaugugagagcagaugagucuuccacaccugccugugcucuggcacacgugacaagcagagcuggagggagggcagacccggcuguaaugaugccaaaggcacagcagugacagaucucuacccugcaugugugucugcagcccagccagaggggauuccagaaagagcuugcccuugcuuucugaaucuuuccccgaggaagauacacacaagcgcuugcuccccaccauguagggcaagccaaaguaccauuccacccaaguacaacucucggggaacuauuguguuuaucgggcuuacuugcagaaccuggguaaccccaaagcagcuguaucaucaaaaaaaaaaaaauucucgcucuaccauggacgacgguuucugcagauggucaugacuuggggggaaguugccuaaggaggugcaugaguauggauguguguacaugugugacuaugugugugcguguucauauaugugugacuaugcaugugcauguucgugugaccguguguaacuaaccaguuaccaccaucaacaccaggcaaauaggaggugcacaguggacagcuguugaaugagugagugagugagugagugagugaaugaaugaaugaguguuaggaagggccgcuacuaagguacaagcuaacuuggaagaaaugucaagaagcuaaaguacauagacuagggaccuagcuccuuaguaauuugcauacacaaggcuguggguucaguccucagcauugcauaaagacuggcgcagugauacaugcuugcagucccagcauucuggagguggaggcaaaaggcucugaaguucaagguuauccuuggcuaccuaacaacuuugaagccaaccugggacaaauaaaaugcuguuuccacuaaaaaacccaaaacccaaccaaccaaacaaccaaacaaaaguuguuagccaggcauggcggugcaugccugugaucucagcauucaaaaggccgaggcaggagaauucaguuuuaagcuagucugagcuacauagccagacccugucuacaaaguagacaaacagugaaccuggcagcaguguuggcuuucagugugcugucuuuggagaggcuguaggagcaugcucugcacccuugaggccucuuuacuuuuucucacuugagccuuuuuguuuguuuguuuuguuuuuugagacaggguuucucuguguagcccuggcuguccuggaacucacucuguagaccaggcuggccucaaacucagaaaucugccugucucugccucccaagugcugggauuaaaggcaugugccaccaucucccggccucacuugagucuuaaucagagaaugacaugauccuagagggaaagaccacauugggaacacugguguccuuuugaccuaguuggcgagacccacccaccuccauuccaccuucugccuggugcccugggcccuugggauguccagggugcuucaagcauguccucuuuccuucccaaagguggaaaaacuugugaaguguuuggaucccaaugaccuggggagaaucaacuucaaggauuuuugccgcggaguauucgccaugaaaggugagguccuuuugggagcacuguccagauaggaggccagcacacaggguaccagagcccagggugggucccagaaauggguucuguuccuggagggagcuggcugccaugucucucuccucuuagggcuuccuuauguauuaucugcccucucuucucugagcccuuccuaacuccucccuuucuuuccucaauccucucucucucuuuuuuucuuccaaaauuccaaaggcaguuuuaagaacucacagaauacucagcuuuucugucaaguucccccaagcccccgaggaaaugaagcugaggaagcccaggcgccccuaagauuuucuggaggcauuuguuuguuugauucucugugcugagcaggggguaggagccuccugaccuccuaagaguggcccuaucuagggcugggggguugcuagagaaccuugugggcggccccugugcagagggaaguaccuuuuagccuggugcuucccugcgugcgcccagcaugcuucuguauaugugagugucuccucucuuaguccccgcugcugagguucaucucauggaagaaguucuucucaucaggugccuuucugacaccuugaguggggcccuggaccaggcccaugcagcuggcugucuccuccccugccacccguucuuccagcucuucccuccaaggcccauuagucagaagaacagccuuauggacugaggcucagaccacucacugcccguuuaucugucuguccacagggugugaggagcugcugaaggacgugcugucgguggagagcgcagggacccugccauguucuccagacaucccagacuguguggagcagguaagggccccugccucagcgccugcugccuuccgccacccucugcauuugcaccugggcucagcuuuggaaggucuggaaggacugggcuuuccacuaaugaucuucuggcaucaaagucaaaagacagcuacaggauugcugaguaagguagcaccugccucuaaucguaauccucaggaggcugaggcagggggacugccacagguuugaggccagccugggccacauagcaagacugucucaaaauaaucaagaaaagaaaaaaauaucacuuuggaaucgguacagugaagcccuuaggaagucuaguguguacacacacacacuaaauauguaauuaauuuuuuuuaauuuuaaaguuaguuuucauaacccagucucuagccccuccuuccgucuagagguggggaguuagaggggcugagagucccaagugugauauuucugugaccagcaccaucauggggcaccuagaaacacccuaagucaucucagugacauaaacucggguguggguaccaggcagugguuaggcagaaaagccacuccuuuagggaaauaacaaggccuccagagcucugugccucuuugcauccugcugaugugguaaaugccaugaccagaaccaaguuagggagaccacaacccaguaccagcagucguucaaggcagggaucuggaggcaggaagugaagccaaggccauggagguacccugcuugcuggugugcucucugcuucuguugagcuagcuuggggacagcugcccuggacuggacccuccaccaucaauaaauaauaagcugucucacagucgugcccacagcucaaucugauggaggcaaaucuucagccgaggauguccauucuucccaggugugucgggcugacaaccaagagcagccaucauagagaccaccuucauuuuguauuugcauauauccuuggcuuuaguugaccucuagucuccccacucccucugcuccucauacucacagaaagguuccuaguuacacguguuccguuauugccucugcccauuucccuuaaggccucucuugucccucucuaguuuccuggcuucuauacacauuagcuuccacauaaaugcacagaguguguguguguguguguguguguguguguguguguguguguguguguguuuuaauuuauucugcuguuaucgccaaaugaucuguuuauaaugcauuggacuguuugcaagcacagcuguguaccacagagacaguuuaaguugcacuauccacagucuccagggaaccuuccggcuggaugaggacucuuuugguuucucacccaagucagcuccaaaaccccucuggcucuggguagucccucauccugaggccaccucccugagaaauggaagaaggcuagagccauaguauucugcguggugguguccaacugggcuucggcagggaggaagcuauaugaggugucugguaaugcugaggguggccaaacagaccgugucggagaaagcuaaggcacuaucaagagacagaaguguaucaauucaguugaagauugcaguuaugcgggcugaguauauccugguguuagauuauuuaccuagguucucauaauugagccugaucagauugagacauacuugcaacaaugguucucaaccuuccuaguacuaggacccuuuccucauguuguggugacacucacauccaugaggucauuuuauugcuacuuuauagcuguaauuguguuacuguuaugaauugucauguaaaugccugauauacaggaucugauauguguccccaaaagggucagaacccacagguaagaaacacugacuuagaagauuaggaaaggccauucaggguggguuggggaggguguuuucagagaggguuaacuaaaaggagaugugcccugaauauacaggccccgccauccugucagacggaaugaaaggacaagaaagggaaaagucgguagaucagguucaccaccaccaccaccaccacccugcccuuccccaccaugagguaugacgcuucuaccacacauuccuacugccguguuacucugucuuaccucagucuccaagcaauggaucccagugagacucugaaaccaugagccaagauaaguucguccucccucccucccucccucccucccucccucccucucuuccucgaguccuucauugacaacaggacuaacacaagaucuagggcaggaacaggacaguggguuuuguaaggugggaacaguaacggaucuggucauucagagauucaccaucugacgaugacuuaauucuaauacaacaggguuuauuaaauacugaccggggagcuggagagaugacucagagguuaagagcauuggcuauuucuccagacguccugauuucaauucccagcaaccacaugguggcucauaacuaucuauauugaagucuucuggcuugcaggcauacauguaggcagaaugcuguauauauuauaaauaaauuaauuaaaaaaauauacuggccaagaccauuccugagacucaagcucagagaauggcccccgaauuccauuagucaggaguuuauaaaggcaaaacucacgaggcuacaaacuuccugccuuuguccaaccaggggcaggcauauauccugacguacuuccugccuauguaccuccuccgccuacccaugaucaagugcauauccugugcaguuggggcaaccaagcuuguuuacagaagugaaaaugugugguuuguuaucguacauaaacuacagcauuucaggaaguuaucuguccuugagcaaguggaccuuacagguuacaggcuuuuguuuuguuuuguuuuguuuuguuuuguuuuguuuuuuagagacaggguuucucuguguagcccugacuguucuggaacucccucuguagaccagaacgcccucaaacugagagagaucccccugccucugccuccugauuaaaggcaugcacuacccccuggugaagcauuucugcuuuauauuucucuuaagcacaguaauuuaaacuuaaaacauaguguugcuaucacaggaauaaagaaacugaauaacaggaacaaaaagcugauuggccagcaucaaacugcuauuuugaaaggguuaagguagcaggagacucccuuaccguaccagcuaagacccuccugauuuccacauagcaguuuaguuuccgucuuaguggcacgagacacugucaugagcaaggcucuuucuguccagucugcuuagugcagaugccugcuccucacaaagggaaccuguaaauuuugucuaacaauuugaagaugacagagacuaaacguccagccgcuguggggccaggguacaagucugguuccagacugugcucagcuugagaaccguuagggguagaccuggauaaccaggcuccaaguguguguaaggccagcgcugagggcuccagaacuguuuuacuguguccgguccaugaaugcauucaggaccaauggaaccagaccugggacagagaacccccaauguggggcugacacuaaguggcccuggacucuuuuugggcccagccuuuguggagggugcagaaugaguaggcgguaccgucauuuaaaaaugggauccgcaccucacuaaggccacugacuacccauacaacuucagcaaguuccccucaacaucucagaaccucaguuuucuuggccaaaaagcaggacuugcccagccaggcuaggucugauuuaaugcaaggacaaaucagggauccacaaucauccgagucucugcauccccuucacccuugagguccaauguuucaaagacaugucaaaacgaagcuugcagugagaaguuggagaacagagaugcacugaggccaagaaccccagggguacccaggagcagggacauguuccaugggcuccagcagcuuccguggcauccguacugucucaaccacagccagaaaagauggugcauuuagcaaagaggggaaguaggcucggaggaccugacccucaagagggaauucuuuauaagcaauggucuuguuguauuguuuucccaaaauccagaggucccagagaggcagaaagacggagccagcaaucucaacaaccuggcucuucccgucuccccuguaggacuguagaaugugacugugaguguuaugccucuuccaggaagacaaaccucuucccauccuccacacagcucuggccagagcacccacugaggcuguguauuccuaggcauggcaggugacuugguuuggcuuagucagauagcuugguggacaugggccaauuccugccugugggcuccugagugucccugagccauccaggcagagugaauccuuagaacucaccggaaucccagcuccuggaagagauggagcaaacccauagcucaucaaagucagaauuccgaggaagccagcuagaggcagauccuaaugcuguggaccaggcacccagcaccuugcugugcuccagcuguccccuagaggucagugugggaccaagaagccagccagauucugguucuugugggggggggggggguugcagugugucuccagggaguacagaucugagccugggauugaggagguagagaauggcacacagcuggaugucaggacugcagcugagcgcccucaguggagggacgugaacccuucaggguguggaugucacuugcagcuuguggcuuguugggagucaccuugagacuauaaagugcuuuccuguuggcuguaggauacauaggcuucugcaucuguuccucuuccaggucccauggaggccggugcugggcaccacaggccugggcaaguccacucuggauguuuauuuaaccauuccugugcagcacuagaugcugacuguggggcauacccuuguccccagagccuggcacaccuguuggggaaagugucacuguguguugcuacaugugcuguugaccauauuucucaguucaggaaauguuggucuggugagaggaugccagaagauauccagggauggugucuccaggacaagcuuccaccaccaccacccccaaauaccacuccccagucugcuccaagggcugccuacuggcuucccuuuuguguggccccccagucccuaugguaaugagagcuguggaggaaugggcccaugggcaucaaagcaagggcaugcuggcuaggggcuguggccacccaugucaagcagugaggcaaagccuaacuaugagaaucuggguaccuggucauccaccuaugugggaagauuaauagggaacccaucaaaccagaaggcagcaggucaccugcuccugcuguguggcugccaguguaagaaucuaauguuaccauccaucuaaagaugcccaggucaaagagucacccgugguacccuuauacgcugcagccuccccuccugugcucuucauaauucucuuugucacagcugcugucuccccagccuccuaguuccccacuguucucucuccggaacccccaccacagccacagcaagugucccuccccccaggaggugaaguagaaccuggggucccaccugcuucucacuguagcaugucucacacccuaaaacuugugacgucaaaucucuccuaguuuguuuaauuuuauugugucaacaugcauguguauaguagaggccaaaagaggacaugcagugcugccucuaucucccuguuaucccuuugaggcagggucgcucgcugaaccuggggucaccgguguggcugggauuguguccagucuguuccauggguguuagcaucuaagagcugaacccagaccucaugcuugaacagcaagcacuccccaccgaugaccgaucucucccccucccaucuacuuacauuaugggaaagccguguucugucucgguucugggccuuugugauguuugucuuucuucugggccaucuguucugcccacugauugucacaggcugucuggcauuucuuucucuggguccccuuugcuccacccuagagaaggaucugcgcugggccuccuggaggccugggagccaucacugcucagucuuacucuccagaagguuccauuguacugugggaggcagugaugacaguggcagagccccuuugagcuccucuccuucacagcaggcagcaccuguguccucgggguuucucuaagcaucuagaagacuagauaucuuguugcuauuauugcuuggagacagggucucacucugcuucuaccaguuuuugaacucagugugaagcccaggcuguccuagcacucacuauguagcccaggcuggccuugaaauaacagucacccuucugccucaaucucccaauccugguauuauagacacgagccaccaauccagcuuaauauacaucuuucgagcuagagagaugguucagugguuagagcacugguggcacuuccagaggauccagauuugguuuccagcacccacaugacagcucacaacuaucucuaaccucagucccggacaauccaguguccucuuccuaccucuguggccacugcacgcauguggugcacauguaaacauauaggcaaaacauauaaaauaaaauuuuucaaaguagauuuuuaauaguuuugcauuuuuuguuuuuaauauaagaagccaagaagacuguacuaauuauauuuuaccaacuauaccaaaacuguauaauauacaaguacuguuuacuccccguccccaaaccuugauauccugcagucuccuccucccggcuuucucccucccuuguuccaccaagaacaacucauuaccgcuuguuauucuguaguguugacacauauacuuugcuauaaucuugagaaguaacaaaugccaugcaguaaucaugcuugugccuuagucuguccccugacaguagccaaauacucugcaaagcuacaguaagcaaagaggcguggcccugucaugagaaugggcagccagcgcaauagagcagaacagagagcccagaaauaaguccacauauuggcagccaaccucgccuuugacaaagguggaaagagaagugacucuguuuuaugacgcugagaaaauuggauagcaaauacagaaaaaaagaagaguagaccucugccccucaucucagauggauuaaagacuugauugaaagcagagagacacagauggagaaauuugagccuaucaagaauuuuuuauaaauaaaguuuuauuagaauacaagcauguccguuugauaaaugcguucucacccuaaccuccaacccacccccuuuuugagacagggucucucuguuuauuuagccuugacuagccuggcuauguggaccagaggucagccugcucuaccuccugagugcaguaccacacccagcccuucugacuguuuucaaaccauggcaguggauuugaauuaaaaccagcccuugguauccgcagaggauugguuccaggaccaguaaggacaccuaaacccgugggugcucaagcaucggguauaaauggcaugguauuugcauguagcccagucauaaccucucaugucccuguuaucaucuccugguuccuuguaauaccuaaagcaaugcagaugcuaugcaaauaccuaccauagcucacaguuuaggagcaagggcaaggaaauaagaaacaaguccagguauguucaacauggcuacuuugucauugcucuguuggcuguuguggcuuggugcugggaaccaucuugaaccuagggccuagcauaugcuaagcacagccccucccacugagcuacaccuccagcauuuuguuuucugcucaugguugguggaaugcgaugcaggacccaaggagggagggagggagggagggagggagggagggagagagagagagagagagagagagagagagagagagagagagagagagagagauagauaugcugccuccgagucugaaugacugcagguucugaaauaggugccaaugcuuuuuuuagggaagaguuguuuuuuguuuuucgaggcaggguuucucuguguagcccuagcuguccuggaacucacuuuguagaccaggcuggccucaaacucagaaauccuccugccucugccuucugagugcugggauuaaaggcguguaccaccacgcuggcuccccaugagugcagacuguucauuuaaaggacacaaauaccaaagcuccugauacacccacaaaucccucucugaggaguccaucaagauuacauuagauccuuuaaaaaaauucuuauuuguguucuguuuaugugcauauagguguggguuugugcacauccucacagaggccagaagagggcauucaauccccugaaacugcaguuacaguuaugagcugcccaacacggaugcuaggaaacaaacuguaucaaaacugucuguaagacccgguaccaccuucugaccccugcaaguaccaggcacauauuuggugcacaugcauacauaagagcaaacacuuuuacauacaaaagaaaaauaaaucccucucucuugggcuauugggauaccucaguggcuaggagugcuugccaccaaaacuaccagagauuuaccacugggacccaugggguggaagaggagggccaacgccuccaagucacccugaagcccuugcaagcuuguguuuacacagccuucccucccuaacacacacaguccaauacaaaugggguuugguaaggaccaggacuuuaucuuagaccccaaauggcuuccacucacauucagagauuuugcaaaacccaucuugucagagcaggucuuucuauccuguacccagccugagaacgcuucaggacccuccauccaagaccaccaucccuucauccauccacccagaaggaagcauucuugaggcugauuaugacaaagugcacuuuucaguucuaagaauacuuccuuccuaagagacaguacugcaauucuacagagcuuggagguucaggguggcacccugugugcauaguguggcgaugacuggagaguuuguagcucaggaggauccgcccuuaauccauccugcuugugugugcucccuccaaaaggaaaaccccuugcuuuaaccuaaggcucagagcuucuggaagaacauccucgggaagugguugaccgcugagccugaaggcugagcagacaguaggugcugaggaggcccucuccauucaccuccucugccugggcucccccaccuccaagcuccgacucccucaccccaccagccagccccucaccuccugcccuaaucagccccugggaagucugggcugagcuagccugagguaccucccuccggggacagccucacccuggugcucaggggcagggacauuuuuaugggguagccuuaccauugcagggcgccaggaagcuguagggagugggcaggcgcauagguuccaucuuuccugagccuggcaggguucugguuuuauuagccagaacuuucuccuguaaaccugaucucucuacugcccuccccuaccagugaguuaagggaaucucugacacaugugggaaaacaccacgcaggugugugcacugaaagagguuagcuuuccaaaacaccgcaggcuaagccaguguucucaggccuggcugcacaguguaagcauuugauuaauuaguucucucucucucucucucucucucucucucucucucucucucucucucucucucucucucucucucucucucucucucucucucucuccucucucucucuccagguaaccgauucuuauacaaauuuacuaucuaaaccaguguccucaagguuugggacaaguuagaauggccuguuagcuuguaagaguccccagacucaggcugggccucugacccaggaaauaauuccaugaagccacagugcacuggccacucugcacucuggcccauuccuucaaugcuuucucugagucuagaagacuggacugggaagaagggaccggucccuugcaaacggccacugccugacccagcugugcacucacgagaguuccugguguuuuuauauuucucugugguuugauagaaaccuggccacagccugugauuguucccaagcccaaagcacucgcaguccuauagcaccaacuucauggagucgcaguuaaggaaggaagcauuccuagugugcagugagccguggcucaggcuacuaggagucacugggaugcuguauccugacuauuuaauuuaaaguguuuucaacuuuuggaagaaugauaagaguaaaacaaaugcauuuauuuaaacacagcaguuagcauguugcaacaugugugugugugugugugugugugauaucugguuuguuuguuuguuugcuuuauuuuuuauuuuauauacguuaguguucugccugcauguaugucuaugugaggauguuggagucucuggaacuaguuacagagaguugugagcuaccauguggguguuugaaauugaaccuggguccucuggaaauacagauagugcucuuaacugcuaagccaucucucuagcccuugcuuguauguuuuauugcuggggauuuuguuugccgcuuuuggugggcuguauaaaaaucaguugcaaauauaaugacauuugacucuaaacuuuguuauuuguaugagguuggaucucauguaguucaggcuagccccaaauucacuauguagaagaggguauuccugaaacagugauccuccugccuccuccugauuggccuugaucuuuuuuuggaggggggguguugagacagaguuucucuguauagcccuggcuguccuggaacucacucuguagaccaggcuggcuuugaucucggaaauccaccugccucugccucccaaguguugggauuaaaggcgugcgacaccacuacccggcuggccuugauucuuaaagucuugguggucccuuagccugagggcccucucucacauaaccacaacagccuugucucuuucaggaaauuuaggauggaugcaacauauuaucuaauuuaaacugcuuuccuaguucccaaguuucuagcuucuggucccaaccucagaccuaagccagaaacacacagcauuuucaacugucgugucuccuuagcagccucagccuagacuagcuccugagaccuuccccacgcuccuuugugccagguguucagaauuaugucuuagcaaggccauaccuccuccuccucugagcugaguugaaaauaucaaaguagcuuacagaaaacuuaaggcagggcuccuaacagggaccucccugugucugguggccuaucugagguagcaccggacaagaugcaagggucugugugugacgagugauggugccuuugcagacacaugccugaggguggucccagcccggugcugugcucuuuaguccacugcccuccuccacccugacugcaccucguaggcuccccaucuagcugcuccaaggucaguugccauuaaugagcccauccuugcuuccucccucccuccuuccuuucuguccucccuuccucauugacagcacugcgaaggccuguggguuuguucuagaacaugucuugagucuccugagccuuucuccccacccuugcagaaccugaagcugccuuccaacccacauccuacacccucuugccuuucuaccgcaaaccuuccauacaacugccagaauugucuucuagguccuuaagucaggaccuggaacucgucgaggggcacagaagcaggagacccagcuccccucugcccauugcagccugaagagcuccccugaucuuuuaagggccucaccucaggccaaacuggaaugugcgacuuugacauagacauggauuucaagguaggccggaugaagcagaguugaucuuuuuacuauaaagcuuuuugauauagauuuuaaccgugaggguuaaggaggggagguugcuuagaaauaaagacagacacaccagagaacacagcugugggauucucugagagagacuuacuucauagucuuuuauagucccagguaggacuuuggugagauuugagacuauuaucuucaaaggguugcuuagaaacccacaugagaucacaggauggcuccugaguggcaccugaugggaucauacucgauaagguugcagagauacaaggagguaggcugucuucccggcaagcaaaauuaacugccuugaaauccccagauccuugggaaaggagugaggcccuacccaaggucauaagcauacaggccuuagaacagagucacugcuguugacaucaaagguccacgucugaaagggacagugccaucaugccagcaacuccacagcacguguuaauugugugggacuuuucaccucucagauggagcggccucagccagagcaaggggcuccucucuaccauguuccccagaauuucccuuguccuuccauccuucuucagcaugcucuugcuugagaccuucccaugcuaaaucuuccuaacagaguccuaggccagaguccugacuuccuucaccugccugggagagcaaacuggucggagagaccugcuggaaaggcuggaugcaggcuuacaggacacaguggagagcaagcaccaccccccacccccugccccacugcaggaugcugcccugagaugcaggcuuauauagaggaagagguaugauagucagacuggcaguuagucacuaucauggcuccugcucugagagugguuccagaaaucaccccacuguugcugagaucagucaggcuccuaggagaccauugcuccugcguagcagggagaacagcuuccguuuccgucaugggggcggggaggggggagcaguguucucaucauggaugauaagucugcuaggauuuuucuggaauccagacugagggcaugacugggugcuacucuaggagucuggaagaggacaaggaaaacuccguuacucuuaucuuggagacuucagcauugaagggggcagggaaaguuagauaacauaagggccacucauccuugcgucacuaguguuugguggcauucugugugauuaacaagcucacgggcagaacugagcagaggucugaccaaaguuuuaaggccaaggagacagacacagaaugaaagccgagaggccaggaauucucuugcuguuaaucccaugugggccugcaggucuaagugaagugauggugcucuuuaaaauggagccgcuaagccccugucacacacaaucuuguuagaagaaaguccuaacuucucaccacacccuaugggauuucaccucugccugaauuucugcccuggucccugccaccucgcaggguucccagcucuccuggccuuuuuugucuucuuugcugucuauaauuugcuuuccacuguagugauaaagaccacggucaaaagaaacucagagagagaaaaagguguauuuuaucuuacaaccucgggucacacuccaucagugagagaaguuggggcagggacucaaggcaggaacauggagccggaacagggcagaagucauggaagaaagcuguuuacuggcaugcucagccugcuuucuuauacacaucagggcggccugcccaaagauggcaaagccuccagaagaccuggucuucccucaccaauuauuaaucaaagcaauaccugcccccccaccccagaccuuucuauaggccagucugauagaaguauuccuucgucagggauaugccuagguuugugugucaacuugacaaaaaccauccagugcauuccggugauucuccuacccaggaccaugucccucuacccuaaucagguaccagcaccagugucaccuccucuaggaagccuucccugccugacccuuggucacgucaacuacacugugcaccguuucuccagucccucuuguccacaucugguaccucuccagggucacugagugugugccucccugguucacagaugcuccugggacacaugggcuggguggaugaauaccagaugggaagaucaccccaggugacaaggucaccccagaugggaaggucaccccagaugggaaggucacaucugggcuggggaggaacugguucccaccuagaaacccaggagcacuaaggaaaucaguucaaaggccucaaaauucacacuaugcauaggcacuugggaaagaaaucauaaaacuggaggcccugagccccucccagcuacgcccuggcucucauacuuuuaucucgcacaggaauccccugccuuuuuugaugucucuaaugacaguggccgcauugcugccuaagucucaccugugccucugugauuugaaggugcuuucccuggccucaccuuaaaugcuguagacgccacgggagcagucccuccuugcugccucucuuccuccauccaccaguguguccuuuccagccuggcugucacucucaccugcagugagggccacgggauuccugucuucacaucugcugcuaugacagacaagacugguuuucugccaggaacugugcucagccucugacucucccuguacgucucagugaacugcuggggcaugucacaucugcccuaagccaggcccugucacugccagggaugggaaggcggugccugugacccaguugaugcuauugauuucaggaaguagacagauggaagcccacuuggcuggucuuggggcagaguugauccuuguuuguuuguuuguuuguuuuucauauggaauucuucagagauguucaugucauucuugcucaggggcccuguuaauuuucuguguauuuuugcaguguuagugucugugcuguggaagcaagaauucauguuguuuauuugagaugaaagucucccuguuguccagacugacuugagcaauccuccugccuuagcuucugaaguagcugagacuacaaguauaugcuaccaugcugggcuccaaauugugauuuuuuauauauauaaaauuuuuuaaagaaacauuuauauuuauuacuuauuuauuuguuacuuaguaaguuuuuugagacaggaucucucacuuauguaacucuggcuguccugggacuggauccaggcugccuugaacucacggagauccaauguaaguuucucugaagcauugggauuaaagagucacaccacuaugcccagccaauuuauuucuuuuuauuucacgugucugaguguuuugccugcaugucugugcaccacauguguguaguacccauggaggccagaagagggcauuugauuccccggaguuguaaucucagacaauugugagcugccauguaggugcugggaauuaaacccagguccuaaggaagagcagcaagugcucuuaaucacuggagccaagucuccacccacucaccccaaauuguaaaauuaaacuugagagcaaggcauuggggcccgaggauccuggguucaccucuugauccuguccaauacuaguagggcugauagcaaaaucucagacuuccaccugugccacuuuuccugcacuaacugggagugguaacuggugugguucuccaggaaggccugcuaacccagcagagccuagaaaaugcugacaucucaggcuguaaaacaagucuuuuguucacugauaccuuuugccccaggggugcugaccucccgugguggccaagcccaugcuucugaucucuacucaaagguccccaccccugucaucagggguccuaccuaauugggaaacucagcucaaggccuuccugcaggguggggacuaccuggucccagggcaaagauguuuggaaggcucccuggaggggaacaccugagcuccuuccaaucccugccacguucuugaccaggaaaacaaauauggcugaaauacuaugauaacuauggcugaaaacaaauauggcugaaauacuaugauaacucuggcuuuuuguugggaguaugcugacaccagacccagggucucugguaugguaauggaagcacucuaucgcaggcuagccccucacacuaggcaggagacugauccuguguggaggagaaagaauguuaucuuucucucccucuaucuagagcccacaaauuaaacuaacaaaagauaccucucaaucaaucucucucucccuuccccuccccuccccuccccuccccuuccucuggucucuuugugugugucugugucagucucugccucuuacccccccacacacacacauacaauguaggccugagacugaagacccacaucuuuguucuucucuuccugacacaaauuuacaaauucauguuguuguguuccuccuccuccucuucuuccuccucuuuuuuugauuuauauuucuuacuuuuuauuuuucucccuuccuuuuucgagaugaagccuuacuguauguagccuagcuucuaggcuugagcuggcuggaauuacagucaggagccgaaaggccugcuucaagucugcuuuauggagggagaugugugaccugcuuucccacacaugagacagcagcaacuugcuccuagugucugcuauuucucuguugccuuuaacucaaaacaauccuauaucggcugggcaugugacacaugcuuuuaaccccggcacugaagaagcagaggcaggcaggggguucucugaguucuaggccagccuggccgagagagagagagagagagagagagagagagagagagagagagagagagagagggagggagggagggagggagagagagagagagagagagagagagagagagagagaguuaguuccagaacagccagggcuacauaaggaagcccugccuagaaaaaacaaaacaauaauaauccuaugucaaaauagccuaucugggggugcauuuugguccucucaggucccugccucagucucccucuuaggcccuucauacacacaggcaccuccauguccaccugaacuaagucucuugguccaacagugagggaagcuuagugccugaccacccccugcucugaggucuucacaggggcugccucccucacagucuuuguuuguuuguuuguuuuucuuuuuguuuuuucgagacaggguuucucuguguagcccuggcuguccuggaacucacucuguagaccaggcuggccucgaacucagaaauccgccugccucugccucccaagugcugggauuaaaggcgugcgacgccacgcccggccucgcucacagucuugccuccccacuacacuacaguuacuccuuuaggccuuacucuucuaaggugugugaugaggaggggggguucuuuguuuguuuugcuuuacuuuuuuuuguuuagguuuacuuauuuuaauuuuauaugugugaguauuucauuuacacguacguucccauaccucgugugugcagugcccaaggagggcagaagaggggaucagaucccccagaacuaaagucaggaaugguugugagccaccaugugguugcugggaacugaacucaggaccucuagaagaacagccagugcucagugguuacugagccauuuccagaaggaaguucuuaaucuaagcuaaaguauucuaagacaguggcagguuggagcuguacugccaguguugggcugauguagggcagguggcugcccuucccuaccugcagggccccuguccugacugugggcgggagcuuagcuccaggagacuuggggcacucagccucugggaaaggauagagccucucucuuuagagcucccaucucuguccugaucuccugcuccaagcuugguugucucucgucucugugcccauucccaccacgccaugugaagcgcccugagugggagccuugggaacucccugagaccugucacuagagugcauuugugaucuguacucugcucaggauggucuccggguuuugcaccaggucuuuccucauggaaugaaaucucugucagaugaggagaaucacuccagcuaacucgaacucucccuggugaggccugugaaugcacgcgcugucugucaguguggcuguuguccuccuuugccucuguagguuauuucuaucuuguugguccaacucugaaugugucuuuuauuguaaauaauuauacagauguccaacucugaaugucuuuuauuguaaauaauuuuacagaugucaggaaaaaaaaaauccacaaugaagacuaaggaaggaaagagacacuguauuggaaaauaagucggaagucuucaucaagggaggggcuguugccauagggaugagacugcacccaacuggcaucugccagcauuaccagggccagcuggauuuugguuuggggauuuggguuuccuuuuguuuuggaagcuaggucucaagugggccaggcuggccuggaacucacuuuauugacaaguguuuucuuuuaaaacuuucuuuuguaagguacauacuuuuauuaagacuaugggacccucggugaauuuuuguaucauccucgcacaggggccgugcuaaucugcuccguauuguuccaguguuagcaugagugcugcugaagagagcaccuaaggacaguccugagcagguccucuucccucccggccugggugcuggaauuagggugccccagagcuucacagaggcugggcaugcgcuucacucccagccagcuucagcuccuauaggauagagguggccccagaugggguaggcggcagagucacagaacaccgugucccugagacugacuucuucaggcagugggagugggcuuguccugcucaagaauaguuccaggguuggggcuggagagauggcuccaugguuaagagcacugacugcucuuccagagguccugaguucaauucccagcaaccacaugguggcucacaccauauguaaugggaucugaugcccucuacuggugugucugaagagagcaacagugugcuuacaaacauuaaauaaauaaaaucuuuaaaaaaagaauaguuccagguaaagaaugcguuugaagguuggaaguauggagccuacuguccccugcuugcacccuuugcagaugcaggaccagccuugcuggagcucuguucugcccagcuguuccauguuuauggacugaaaggagaguguugcuagaguguggggcuggccuaucccuaaacuccaggaaaggaagggucccuagccuaucauagggccuuacccugcauccucgagagucauccucauggccuggcuucuagcaaucagcacugugggccccuccuccugacaauggcuucccauuuccaccgugacaggaaagacagggguuaccucauaguccucaggagacccagauggauugaucguucagggcuguacuccuggaagaagcaggacagggccuaguguccauuugcuggcuggccucacuaggcaaccacacauuuuacacuauggcugcuuucucuuccuuccucccucccccagucucccaucccucuccaucccgucuuucugcuguuucccucucagcauagggcaccuucccauugaagcccugucuuggcaagaggcagacacaggguggggugggcuguuggaauguuugcaguguaagccagguacucacacuuuccauggccaauuucucugacugccacccauccuuucugcuuaggcuauauagcccguugugcccacugcauuuugaggaaucugaggaaucucaggcacuugucugagagauuuggugugcagugccuggguugucacucgcccugucugcacccaggacuccugguagccagcuccuuucuacuugcccugcagcuucucugcaucccaggccucuccuugcacucuguccccgccugggagaaaggaacagcugggcuaggaagggcuugcagagcuuguccucgcucuacaaccuaagcaucacaggagacccacaggguaaaugacaagggagaagagugucccccccaccccaccugagcccccccccccccagccugcuuuguuggcauugccuggacaaagguccuaaccaggagacuuuugucuggcuauggagcagggaacugugaggugaauauaaauaagaaacacuccagaaagggagcguguguguguguguguguguguguguguguguguguguguuugugugacacacauauggaggucagaggguaagcugagggaguuuucccuuuccacugugugggucuugggaucaagcucaggucuugguggcaucucuaaucugcugagccuuugugccucuggauuucaaaugacuuuagggacuccccauuggggaggagguaccuuacccaccuuauuggcucuugggaccccuuucaguccagacucuuugcuguagaaaugcaaacccagcugacucaggguguggugugcagugcauuuggggcuuauuugccacuuccuccccuagaggaaacaaaacuugugauaacagugugggcuugguagacagcuauuacucaaagaccgaaaauuguccccagacucccagucacgggugucugcuccccccaucgcucuguucuucaagccccugggcuucacagcugcaaggaagaacuagucuccugcagucugugggaaugccaccugggaacccaugccaccaagcacagcagucccaggccaugccuuuuuuuauggucguugucuggcuauugugacagccccugugcugacuuccugucucuagucugccucccuucacuacaagcaucauccacaaacacggggacccuggguggagguuccugccugugagaugcguuggcugugcagcacugggcaaacugcuuagccucucuguagcuagaauccuuauuugaaaaaucaugauaaaaugcccaucagacuauaacuguuuuuauugcuauuagucacuagauucugaccuucaggaagucagggcuaucucugguucaucucugugccucagugaacgaaugacacacuaggacugggugaauauuuauggaaaaguugaagggcccggagcugccccuuugacaagaagccaucuguagcuccccugccuccugacugauauuuagugucucuggcaacaggguccuccaccugcagaauggugcuccucucucucuuagaaggucccccuucugccucugcuauguuuacugggugcuggcucugccccagcagguuuugccagcccucuagacugaccagaagcagcccuccccuguaccaggauaccuuaucucauaugaugggcugggccuuagagcaucuucuguguuuuagggcacagggacacuuggaccuuugagguggccuccugugauccuuagagcugggggcgggggcauuggaaugauuggcugcuaaaacucacuccugcucucuggccacuuuuaccuucaagaucaccuuccagaaggaaugaaaggcaggugcuuccccccccccccccaaucuggauuggaugaguggcugcugccuccccaggcccugccccguaucuuaaucccaaaugggguugggguagggcacuucaaguucacguguaagguacccauugaaaacaaccuuugggcuggguguggugguacggaaaucccacugcuaaggcaggagguugaucaggccaggccagagcaggucgggaaacaggaacuugucucaaaacaacagcagaaagauaaaaaagcaacuagucuuugggucagcuggagaaggaacacucgagacccauauguguuguccuggcuauugaaaaaugggcaguucuuaguuuagggcuggcucuagagaucgaccaaucaugucugucaauccggaaggagggacaggguuucccuaccagccuuccccacccaauaagaccuugagcuagcaaucucuccuagccucagcuugucugugaaaugggugccaucuugcugcaccccugggccugauggaaugauucugggagguucaguuagagcccuuucaguguuagccagggagugcuggcuccugacagugagacaugauguaagaaauguagguggcuguaaagauucaaacuuuaguuccaguuccuguuggccaucuccacuuuucuccuaugacuaugacuaguuauaggugguggcuuuaucccugggacuguuuuccacagaaaucaagugauaugagugagugagugaguguguaugugugugaguguguauguaugaguguguguauguauguaugugugugugugugugucuguguguguauguauguaugugugugaguguauaugugugugaguauguauuaugugugugugugguaugugugugacuguguauguguguaugaguguguguaugugugugugaguguguguguauauguguauguauguaugugugugugaguauguauuauguguguggugugugugugacuguguaugguguaugaguguguguguguaugugugugugagugugugugugaguguguguguguggugugugugugacuguguaugguguaugaguguguguguguaugugugugugugaguguguguguguguguguguguguguguguguguguuauuuuggcaggcauuagccaguggaacuauagcaaacagcacuauguugcagcuuccagcuggagcacacucucccuucccugcuacuugcugcucauaagcuccccacuaccccagucuuuaacagccuuaccaccagguucuuggugucucuccccccuccccuggccugccacucccaucccaggaguacaggcagggcaauaaaaccccuccccagccuggcuugguuccugacucacaccauccauugaucauaccuccaguagccucaguuuccccaucaagaagcacagagcuucagagcacuaugugacaugggguacuuccaagcaccugggaaccaagagccaggagauagacugguuuccucagcacagagccccucagagcuugacaaaccaagaacccucaagaagaacacggggugcuacaaaauuugcacucagacuugaccagggaggccauucuuuucuccuggaacacacuuugggacauucacaggccuugcuacuccucuguggcuuguguguguccugguagcugauuagaccacccagucugugcauauacaaauuccuacauucugaccuccaggcgauuuaugcuucugcccagucuccugggcaccccaguaggucacauauacuggguucaccuggggagccuuaaaaccuccagauuuaauugaccugcaguuucaccagucacugggaguuugccaagcugcccugaugguuuuaaaguacagccagcuauauggaugggugcacaccagacaggguuaggcggauccauuugaauuugaaaucuugaggaaaacaggggacugucucaaggccccggcacuggcugguugcaaggccugaaccaggauaaggcgccugcaguucuagcuggugucaucacucaccccaccucguggccuggaacguucuccuuccgagccucagcuuguacgugcgugugucgugugggggguggaguccacgugccacaguguaucugucaagucagaggacagcuuuauggagcggguucccuccuuccaccuuuauaugggcaccagggaucaaauucggguuuccacguuuauccagcaagcucuuucuccuacugagccaucuuguugggauccucagccuuagccuuuugaccccaaacaagagccuugguugagcccgguccugaaaccagcuuuguaccuggcccacucuacucaggauucuaaacgacccauccccaggacggaaaagcccaagccauccgggaagggaaacaagccaucagggcuugguccuguuauaaagcaagcacucucgggaggacgaaucccagccuggccccuugugggcucugcugccuugccuuacccuugaucccuaaugcaucucaguuuccuggcuuauggacgggcacaguggcccauggcccugugcagagaaauaaaggaggugcuggacucuuggcuggcaucgugugaaguugcugggggcucuuacguuggcagugaugcaggaggccugagguuuuuggcugccuggagagcaacauucccugcacucucccuucccugguucccuugcuagauuccccagccuggccgcuaucccacugucccuucaugugugugacuguggcuaggaggagcccuguguccugugcugccaguguaggggaccagauaacuuugccagccacagcugguggcagccuucccaccgagugggcccacuccugacggggcagcugcuaccgucaggguugguuuauuuuuauuccucccucuagagccuguaaucaaagggcaguaucauacugcugcuugccacggggaacagagaugacgggguguuauucacagccaggcccugggaaugggucaguggcuggcuuacacuuucaucucugagggaaacggagguuguagacucaacuccuucaagguugcucccuucagcucugcucuagaucacgggucuuccccuggcccuaugacagcugugguaagggcagcauuaagagcagcaccccacggaccucacaccuuggccagagucagcuggcuaagugcagauggcaggccacauucacucccuccucuccccaguccuggguagaucugagaaucagaauccuaacaaguucucuggaccaaccacagaucuagacacugcugcagagcuguggacacuuuuucuccugugccaguucaccucccagggcucccagcccugaccagucagucggcuuucuuucggcuuucggucucagaagcaccgacaguccugggggagcaggcagcaauggucacaguuagaccaccugguucacaguccauaucuuugucugcugccuccuguucugugacuucuguuuucucaccugcgggaugagggugagaccggcucccuccugugcuguuaggcagguuguuaagucagugcuuaugcuagucuccagcacacagagagcaucaucucacaggugagcagccgggauguaacucaguuggcagagagcucacuuagcauucaugaaccccccaguuugauuccccggcaugauauaaacuacgccuggugcauucggagggcuagagagggagcggcggggggaucagcaguucgaggcuaaccugagcuuacgugagauaccuacuguaaaacuuuaauuaaaaaaaaaaaaaaaacuucuauuuuauguauggguguuuugccugcauguguguguaccacguguguuugcuguguuuguggagcccagaggagggugucagguuucccuggcacuggaguuacagcacuuugugagcuaccauauacgcucugggaucaaacacaggaccccugcaagagcaaguguccucaaccugcugagucaccucccgaccccuaaaaugauaauuaaaaaaaaauacauuuaucuauuuauuuugguguucugagacagguucugcucucucuggagcccaggcuagccuugaauugccucagccuccugaguugcuaggaccgcaccugccuguuugagcgcauuguccagguugaaagugcuauugagggaggugaagagauuuucccaagguuacccagccaccgaauggugagguuggccagccgugugugugugugugugugugugugugugugugugugugugugugugugagugugaggugugugugugcaugugugugugugugcuaucacagucaauccucugcuggccagcugcagcucagcuggugguggguuccauacagcuugacuuugaaagaccccuccauacucugcucucucuggccacacacacacuguaguuucugauaaauuccaaucccauuagccagucaggagaugucuagagaaaacagguggcccgagagagggagcagcaacccucugcuuccccagggucugaauguccccucagggaggagaggccccaggcgaagcugcugcccucagucuagaaagcucggcguuuguuaugcuaaugugcgucggcucacagaaccuccccaguuucuggaagaaugcacacuuggaaucuuugccuuuggucugggcagagugaaccucacccucugucuggcgcuggguggaugccaucaggaucuugcucuuguuuuugcuucugcucccaaguguuccagaaaagcugcuguuccucgggucucacuuucuccuugccuugauucucgccucugacugguucucaugcugcguuugcuugagggccacuuuugugagccuguccccgauggcccucagaaagggcuuuguguccugucucucugguugccuguggaguguccagcguugcacccacuucccacucagaucucugucccagcugcugggcaagggcaguuccuuggggaccuuucucucugcuuucaucccugcucugauggaguggguccagaggucaguggcugccagcucggggcccauucuaaugaagggaacugaaugccugggccgccaaaacuggcccuuugcaaaacagucaagggagagccuguccccaaggcgagcgugccagcucuuguuugcccuagccugguauucuuagacacggacugggccauggggccccgaaagaggggcccaggauggggaaggcgacagaaagcagguuuauuuagggugagcuggugccuuucauggcauggugccuucagaaacuggaagagcagcagggcaccugggguaggagucgggcucagcucuaacaggauccugaugccaaaugcuugggacucuggacuugggacccuucugaucagagguucucccucccucuccacagaagcccacauagcugcaugcugacccgauccagccucaugcugacccgauccagcugaccuucugcuggauuuggaagggcugugcacagugcaggcaggcaggcaggccugcauguccucugaugggccaaucuuucagagucucagcuucuuaaaucugugaaaugggaagaaugguguauacucagcuacauucagguuaggcggggucugaagcucuuugcaggcaaagcacagcaucaaguauuaguauugcaugugcacaccccgggagggccucucucaagcucucgaaggucuaggaguugaggcuuggaaaaguugcacugcaaaugcagcuagcugcucccugccugguggaccagggagggcaguguaggcugacucugaguccagaaacagucucccaaccucaggcagccuuccugugguccucaggccaugugugcuggugcagccacuuccaccuguccaguagccccaaacaacagcccccuccuggcuuacuggcucgcccauguuucuuuccccuuggaagggaacuuagguucuauugcucccuuccucggaggccugcagguacacacaaagagacaugcaugcacgcuggccauaaaaagaguuuagaagcuugaaagcaagcagggagagcccacguaggaagcccagcaaacaguauggaaggagcaagccucugcugaagguucccacggacccagcagaggggaaguugauaguagcuguucugaucugccacgaggaaggaccgaccuagcagguggccugggcagcauggggacagaggcuaugcuggccaccaccauguguugggagccugccccuaaaugcuccuugugugguaaguacuuuuauucccauuucauagcugggaguaugaggcacuagguagaaagaccaaaguccccacacucugucacuggccaggcagagagccccucaucuggcauucauguuggccacaaagccuauaggcugugccuggacuuggguuaaagucaagugguuagaugcugagccugaagcagggaaagacuuccuugucggggggcuggguguccagacuuugggugagugcuucacuggucagggcagaucuuggaugucugaagaguacucaggccaggucugguguugagggagucgcaggagcaagcaugguggucacacuagguuuuggaaagccaacaaccauuauaaagcuucgucuggaaagaaaaugcuacaugaucccucuaaccuacagaacuuuacaauuauuuuuaaagggagcuggugagacggcucaguggugaagagcaguugcugcucuuguagagggagggcaucuugggaugugacaggugacaugagucaagccuaagggcagugaggcuaagaagaugugaaggcagagccugcucugcugaguaagagggaacuuggcugauggacgguuucagaauccgcugcacacuucagagcggggccugggaaccccgggggaaggcugcugggcagaaaccugagccauaggggcccuugggugugugcuaggccuccaggaggccagaugaggacgaugcucacacaugaagagcccuuuuuggcauuuuagagacugcuggggacuuuaaucccggaugguaacagcaggugacugcagacacacgaccugcugcuguggggccauaggcuaagagacucacccugcgcuggucacccucagugagcucugggugaaugcauaucugguuagcuaaaugcagugggaauggggcugaaggacacagcaagugugugugugggaaacucggcaucaagccugucgacauguucccuuuggaugccucucaaguacuggggccauguuaccaggaaguagaaggaggaauucagaucucuguaggccccagccccucauuuuccuaccuucaaaagugugugcuguagcaggcccuccccagggggcaacccgggcuuucucaccaaggaauugcagcuaccccuggagccaccugccuuccauugcuggccaagagggauucaaagcuucuaccucugugcuucguuuuuggacaacuugaggugaucaucccuacucuggagccccgugagagccggugagaucccucagccuccugccuuucuuguacuuucaagggucugaugccuaggacaccccuguggcuuccuucaagcggcuggguguaggggucuggagcucaggagagagguccaggcuggguaucaacaugcaaugagggggaagccuguaucuccaggggcucagguguugaagaaugcugggucauuauucaccgacucagagcugguagugacuuuauagcgaacgcaaccgcugcaaauaacgauaaggggcuggaugccgugguguaucccuguaacuucagcgcucugggaggcugcagcaggagggccagaauguaaaagcccuguuuuaaccgaaugaugauaauaaaaauuaaacaggcaguggguguagcucggugggcagagugcuugccucgcaugcaugaggcucuuagguuugauuuuuaguaccacauaaaaccggacgugguagugcaugccuguaacccugacacucgagagacagaagcaggagaauaagagaaguuugggaucacccacuuacauauccaguuuaaaaccagccuggaauucaggaggcccugucucaaggaacaaacaaaugagcaggagagacgguucagccacgaaggacugaagacagccaaagagcacacaaucaaagacaaaauauccagggaaaugacugcuguccacccuguuguccagguuagaaccccacacugagauacuaaaguacagguggccagcagcaggccagcuggggcuguagccugagcagauuggauaccaggggccucacccuaugagugcagccuugugguuaaguugggacagcaggaaaccuggccugaaaacagccucuuuguagggcaacccccaacuggccuucucugggcucagccucuccaguuuccaccugaacacaguggcuccuucagcccugggcugugguuucuccuuaaggaggaagaacaguggcucagugucccgaggccaggcgccuuugguuuuccuuugcugagcccaacccuggcagagaagccacaaagagcugugugugugugugcugagaggagaaacuagccggucuaucugcugcuguggccuucuguuuauccagggauagacuggggagggaggcccaaguaagcugguggcagugggcccuccuggagucucuccaggcucucugccuuacgggugcuggauccuaggcuccggugccucugcugcaguccugggccugcaagccugcugagaagaucacgugucugcuguggcuuggggguguuuuccacugagaugauuugggagacaauuuggagggauuuguuugcuuucaacgugggauuauaagccuuuuaguguguccuaaccagaaaaaucacugucuacaucuacccauauccagaaguagggguguguguguuuccugagacuaauggccagcccccuggagugucccuugcagaggccuucauuugugcugcggaugaggcagagaacuaggaaggacaggaacauacuaaggagugucacagcaacucuugggaagacuuaagggcagacagagcacaugugggcgaguucccaagaccugguaagaagugaccgugcuggacaguggucaccucuggacagcugauggagagcggagggagccgcuuccuggcccaggcagaccugaggcgagucucagcucugauccaggcuugucacuccuuuauuccccuucuguaguauggguccugcagcggcggcuguguggcuggugaaugugagcagcgcugugagggagacacacaacagaucggcaaucauugaugguucuuguuaagaaucaguugaggaggcugggugugguggugcgcaccuuuauuccagcaccugggaggcagaggcuagugauuucugugaucggaggcuagccugggcuacagagcaaguuccaagccaguugaaacgacacagagagacccuauuuuggaaaacaacacacacacacacacacacauaggaaaugaucauuucuuagggcgcagacuccacggagcagagggggccuccucagaucuguucugggauaagaugaugggucuugaagaaggccucuuugauacccucacugucucucuucaaaugcaugucucagagcugggcauggugucugucgaaugccuucaccgaggaagcagagaucucagagucaucacagccagccugggcuccacagcaagaccucaucucagaaagccaacagagucuuaggaacucccccaaaggcuccgcuaacccacacccggcaggcccucugcccuucaugcuaugugugugauccucagcccgcuguacgccugacacauaaggaguugaaagacaaccggggacaugucccugcuccucagaaauagcaaccuggugggggggccuaaagaaaggacaguuccucacagcggcaguucuuauucuuaaagcacagggaucauugucacuuugacaagacaagggaauauuuaaccggaggucacacugugguagaguuuuacaggagaaacgggaguuuuccuaauagccggaaaggaccgcauguuugauaauaaaacaguauucccaguuugcuccuaguugucucuacuacucucugugauuaugggcgagccuuuuguuguuguuuuaauguaggcuucaauuucccacuuaaacugccaccccuuuugggacaguucauccccccucccccaccuccucuguucuggaaaacuggagcuugaacccagggccugcacaugcuagggaaguacucuguccugagccacacuucagcccuuggaggcucucagugaggggaaguuacacucgugugcuccgggcuguugugcaacugagccaggccuggggacugcucaccguugcuccccaaacccaacaccccgugguggcgcacggagaagguccccgaggagccgcaugcccggccuggcccugugguggcuguggugaugagaggcagggggcuugaaagugaagccugagguguagaagccuggucucugccagaauuguagcuggugggaaagaggcuagcgacagacagccccugauguuggccgagugacagcuuuccagguagcaagcagguauacugugaccauuuccagaagcaaagaucguugcuugaauccuggagcugauacgucuucacacccuagugccucucuaucccucccccuucgcuccuccucccccucucauuccaauaugugcuggguuuugcuguuacuguuuuugagcuagggucuuccgcuguagcccuggcacucagugcgggcccuggcuagccaucaucauuuucuucggagcccgugcuugcucaucagcugacuacccugauacugccaguuccacagcacccagccgagacuuuguacugcucacagcuguacccacaagacccacaauagcaucuggcacguagcaugucuucacccauuaggaaggaguaagggaacaaguggugccuuuggccaugaccauguggucacgcccauugcugucagcgaggcuuaaagcagggcagcugcuacggcuuucccgcucaccugaacaguuuauacccagggucacgggcaccuggcuucacacugccgcuugucaacgguaagccgccuguagacaguuguggguuccgagagagucagcaagccgagcagggcaggaacgcaagccgagcagggcaggaaccgcugucuuaccagccauucugaaugcucucaaaguuggcaguaauugaucuggguggggcgaccuauccugacuacccuagucuaggggaaagugagagucugggaagagaaguauuuacacggcccuggguguggugagcaguuaccugcugucaccaauggaagggaaaggaaguucccuccuaguccucccaguucugaaucaaaagaaccccuguuccuuucccuuccccaggcgccucuucuugggugacugcaugacucaaaggugugugucaaagaggaaacauggcuuuucucaccaucauccccuccugucagguuuaaaugacuaagagaacucacuccugugagcacuggagcuauaggcccagggugguggugugugccucuaaucucaggaggcagaagcaggcaguucuccgugugugugugugugugugugugugugugugugugugugugugugugugugugagggcuaacuuugucucaucuauauaucgagcuucuaggcuagcuagaauuacaaagugaaccccugccucaaaaaggaggaggagggagaagcagaaggaggaagagagaaaauggagcuguguacccugaagaccuggugccacccccagucugcacacaauuugcacaggaucuagccagguauuaggaaggagcuggccugaggcccugaugcugccuacagaggacagaugcuuauugcaggguccauuccugguguagcacaggguguggagguggaguccucgccuaugcuguccagcaucagcuuuucaggagaggcuuguggaucaagggaugggagugggaaagaggagagguccugcuucccgggaagaugcucggcuccacuucccaggaagaugcugugcaguccauggcacaaaccugcucgagaggaagggcucaggcuuccaggggcucccggguugccugaguaggugauuggacgugacuuuccuuuggagugacaggucacuuggggugacugccacuuaggcuccugucugccugcuuguaccucucuuccuuuccugggccacuguaccauuaugauacaaccauccacuguguucugagacuggaaacugagacuuaagucagcugacacuuucuaaguguguacucuaggaaacucugaagagaggugacaaaggacaagaagagcauguggugcagucccagcaggcuuugcugcacagugacaccguauugaacaggaguugucaugcccagggugugcguguugacagaagcaacucgcucaugugacucagugugacugauauugacaguucuaguuaaugacugaugucuaucauggagagaacuggacuggagggggaggagaugccuggcuaagauccugccugucacagguagacuggacagcaggaaggagugaggccauuccugacuuggagcugcuuuugggugugguuacacuggaggagaaguuguaaauguggccucacguggaagaccauaugcuaaguagaccaagggaaacucuuacauuuuuuaaucuuaagaaauguuuuagccagguguggcuguacacaccuucgaucccagcacuugagaggcagaggcagguagaucucugugaguuugaggccagccugaucuacagagugacugaguuccaggacagucagggcuauguagagagacucugucucaaaaaaaaaauuuuuuuaaaagaccuuuuuauuauacuuauuuauuauguguggggaucagaggacagucuuuaggaggccaccaugucggauccaagcguugaacucaggccaucaggauuaguggcagcuggcaagugaccuuacugaacgaugcugggugguaaauagaugucagaggcaacuuuguggaguauguucuauuuguuuuuuccagcuaagguuucucuguguagucuuggcugucuuggaccucucuguagugcagacugaccucaaacucacagagaucugucugacucugccucccagguacugcgaucaaagguguacaccaucaccgccuggcuuuucuuuacaguguguguguguguguguguguguguguguguguguguguguguacaugugagcucacaugcccucagacuuuagaagaagacaugagauccccuggauccagaguuacagagaguuguaaacuuccugacguagaugcugggaacugaacuaggucuucuacaggaguagcaugcgcucuuacccaugggacuucucucugucucagacagggucuccacagaacccaggggguguucaaagaacccaguuugagaccccuggggccagacuuagguggcgguuuucuauuugcuguuagcccccagcuguggucagcucacucacacaggucgguaagcuuggguaaugcuaacaccgaggaauggccccuuuucugcauucaagguugggcgagugagucacugggugccggcagugggaagaaacaucauuauaagucaggagggguguacucaccuaguaacugaccauucccaccuacaccacccaaaugaccgugcgguuuuggagggcaggggcuuugcuugcugacacuuuucucugucagcuucuaccaacucugccauccaacuucaugggaguaugguguacccacacccacaggaaagucagucccaugacaggaagaaucaaucuuucagaauggcugggccaucugaaaguuauucuuggauacauucucuggaagaggguuuguuuugaauguuguuuuuuuucuccucaaaaagcaagucagauuccuuaagagacucaagccacugggcuaacaagguaaaaacagcgacuaacucccugccacucgccgccucugcccaucuuccauccaacagagcaggaagaccgggcuccacuggcagguagcaucagggccugcuuaauagacaaacgcugugugguuuugagacuagucuugguuaucucugagcaucaguucucccucgcauauaagggaacagagaguacaugaacuguuuauccaguuuccuaccuacauaccguuugaugucacaauguguaaaacacacccacaccuaagagacuaaggaaugcuaacuagagacaccugauguccccagccucaagggcaagggcagagcuauauuuccugcuaacucauucuugggugcuuucuuuguacagugcuggguauuaaacccaggggcuuugggccugcuagacaagaugucuccagugguaccacauacccagcucuuuucuacuaacucuuucaaccuucauuugagacagucucauggcuggccuagaauuccugcauaaaccagacuagccuugaacucccagagaccccaagccucugccucaagagugcugggaucaaaggcgugugccacuauaccaagcuuuauugcuguuuugagaugguaucauguagcacauaggcuagucucagacuuuguagcugaggcucugccuccaucuuccaagaauuggggcacuuggcuccauacauuuuagguauuuuguuguugugaguuguuuugcuauaguuuucuuuauguuuguuuuuugaguuaggguacaggguggccccagcuggcuuuacacucacugucuagcugaaaguggccuugaacucuuuauccuacugccucuaccguccaagugauggacuuucacagagcuccacagccuuaacccccaucugaaccaggggcacagagauuugcccuuaacucucggguccccacauguuguucaguccuuaaagccacucgccagucagccccuccaccucaacaucuccucugaaccccgcuggcagguggcaggccucuccuggaaguuuggggaaagauuccuccccaaggcuuucaguuccucucugcucuccacuugacccuucgccaugaaaacauuguauccacaguguagauagauagggcucagcagaggugaagaaccucucuacaggagcagaauuguucuuuaaucagaacaaucagggaguggaauggagacuaugcacaagaguguaaggggcuuggguuuuauagggaaaaaaaaaaauucuggagugggaagauucuuguccguagaccuacuuucugcuuucccaagguugcaaauguuggcagagguaccaggaguucuccuggcauguugaguccuaguccagagccucccucuccuaacugcccagggagaggcucaaucuuucugcagggaguuucucaggcggccugaagcuuuucguuauuaacccuucauauaguuuaguaaugacuucuauuuucugagugccugcuuucucucagauucugugcuaaguauauauauauuuguguguguguguguauguauguauauauauuucuucccaacauuuuaaaaaucuuuuuauuuuuugguuuuucgagacaggguuucucuguauuccccugguuguccucgaacucagaaauccgacugccucugccucccaagugcugggguuaaaggcgugcaccaccacugcccggccucuucccaacguuuaaaaauguuuccacaauuuaauuuaauucccaacgaucaagauugccagguggugguggugcaugccuuuaaucucagcacuauggaggcagaggcagguggauaucugcguucaaaaccagccuggucuacagauuguuuucuaggacagccagggcuacacagagaaacccugucuuggaaaaaaaaaauucuuuguaaaucaggggucuaaccuaagaugcccaucacuguuaccucuaaaaccuaaaaagccaaucacuguucucucgacugaguagaugaauugcagggucuuuuugccauggccuuggcucuggggccuacacugaguuagagagcuggcgagugcugggguuaagggaucccuugcagggaugcuauggugugacaggcacuggccugcacagguaccucacugucccacccacaccccacaccugaaagaggaagcgucuuauuucuauuuuauagaggaagaaacugaagccucagcacauugggcaacuuccugguggcaaacagaggcagcagugaugugcagugcgucugcgcacaacuaucgcuuugccuuuugguuauuuuuguugagaaaaaggucucaguuuguagcacagacuguccugaaacucauagcaaucccccggccucugacucuguuaggguuacugccauaaacuaccauauccaguucaauuuggcuuuuaggauaauaaccuaacccuaacccacuuccugugagaaaagucaaaagggccccacugacaccacccacucuauggaguucuuaaacaugucauccgaggggacgggggaaucagaaaaaaagugcuuacgaagacuaguguguuuuaaaagccuggguuucccggcuuagugugagcuggggguggggaggguguuaccaggucucacuugucccacugguuaaaugacugcagauacccggaagucaugacuaccucaaguccugcuuccuggacuaguucacauuaugggccuuggaaccgaugaggagaaaacaagauagaucaccuggauuuaaccaugccaaaaccacuggagaccacggaguucaggccucagagccaagcacccaagagucucucucaccuuugccuggggcucagcauucagaugugcucacaaugagagggcacacagcaacccaggagauggccuguagcguucucgucuuacagacugagucucaggaagcuuauggaaacucccaggucaaggagcuggacucaaacccagcucugcuguccuccaaagccgagauaugguucauugacccugacuagcuaggauggagacuggaccgagacagugugagaaacugucuauggcaucuguacgcaguuccaaagguuguguagaaacuacaagacauaaauucagagaaggccuuacaagaugggauucaccacucucacagaccuuacguggagguccccucuagcuaaggcuguccaagcaaagcugcaacucuagugggcuuugaccagguaagcagagagguaguuggaaauuuauugcucacacacagcgggugagaaagagguugagagcaaagggccagaguagugguucucagucuucuugauauugugacccuuuaacauacaggucaucgugcuguggugacccccaaccauaacguuauuuuuauugcuacuucauaacuguaauuuugcuacuguuaugaauuguaauauaaauaucugaaaugcgaccaccgugaaagggucuuccaacuccaaagggguugcagcccaaagguugaaaaaugcugagcuagagagcagcagagguaggugugugugugugugugugaguauguauguguaugaguaugagucuguaugagugugaguauguguguauaugagugugugugugugucugugugugugugugaugugaagccaccuugcccauucuaaguauacccaaguauuugugucaguguguaguguaugaagaacaugagaacguggcuugaggccagucaggaagguaaucaggcuuuucccgaguuauguaaaacacuaccaaaaugaagggaaacugguccuagcguuugcugucuugcuugaauucuaaacauuucggccauguuuaaauccugaauggugugaaagccugagagggagacgguguuucugauggaaaucuuucuuuguugaguucucuaguucuuaucuugguacuuguuucuuguauacuugccacuugugucuuggugcugggcuagcuauggauagcuuucgcuuggugugaagaaaacaaaguaguggguaggacuccaaaucagauuucagcuggugguggguuggggcaggcuuuuaguucgcgaguuugagcugaacagugcugccggagucucgcagcacugagauauuaaguuugaggacaucaaacagggacauagcauugagauggccggagaauuucauccaaacucuaguguuugaccugcuggcaguaaacugcacgcucagacaagcuccacccaccgaggcgccgaccguguggccauuggcggccaccgccuccgccaccugccccuuaccuugggugggcggggcuaccugggccccgcccccucggcucggguucccaggccuccgagccucaggacccgcccccugugcgaggcccggccgccggagcccggggagcuugggcgccucgugaugucacggcagcuuugauacaaagagccccuucggcccacgcgggucucccggcaacgggugcgggcgggggcgggaccggcggcuucaacuggugcggagcagcgcgccucccggauuguuuucugagcacggugcuggcuucguccccguguaccccgccggacccgacucgaccagccgcuggcuucuuguucaucuacagcggcccgaccugcagccggucgggggaugcgcuccccgccggcucccggaugccagguaagcggcgaccgcgggacgcaccuagcuugcaccaggagugggaaguugguggauucgccucuacccucccugugcuggccagggagaucagaguaccuucgcaaaaccacugaccccucugcuugcuccgggccuucggccagcgcccaggugcgagcgugagcggaaccaacuuggugcccgaggagggugcccgcgaucccuguggcgcuguuccagaaguguuuuagggggaaucugguggaaaugggaagagagcuugucagcccccaucaguguccugcucuuagcugggcugcuucccuagggagcuguaaguggugaaguuguuuccauaggugauggcugcugcaugaagccaguuuccugcuuuuccccucucacggggcaucugaaggguuagaagacagaaccagccuaguaguguagggauuugagacagguccugcuuccccucagcaagaugcuccuauggguggaggugugcgcaggccaccagccuaugcccuugagucccguaagagcccacaguccaccucaauguaaguuguugacauaguugcuucuccguugcgacaaguguuucccagggccuagcaucgaagccucuguaaacgugguaccaauacagcccuagacagcauuccgucaccucuccaucucccacuucuggucuugcuuuccccaaaagagcuagaaaugauucguugcugaacucuuaaggacucaccaguuuucuacuggcugauuuauagcaccccugcccccucccccuaaaguagcagaggggucagagguccugccuccgugcuugcugcucuagucauuuuggauugggccccacuuugcacugguuccugaugcucuccaagccucugucucccuucccagagcaagaggcaggugauaauugcuuggguucccacauucccuggggcaauuuccagggcccuucccuggugaaagauggugucuguuauugcuagggaaaggagucucaguggggaggguuuuacgacugcaaaagaccacugcuagcuccuccacccaccuucacuagcugagaucucacgguucagccccagcuucugguauuguggcacugacccagacuuuaaccugcuuagcggacucucacagaggcaggguuaaauacccagggaacuuuauaugugggacacauccuugcccuccagaggaccuugaguuccaggguauaaucugacaccacccagcuaccuugaaugccugggccaguucauguugguucuuugaggucaguggccuauagaugugggguaagcuggugaagaauguguggcuggagccugaaggcagcacagcuugcuggcugugcugccugguggaaaccacuucggaccuucagauucugggauuuagguguggggaucggaguaaaugacaagucaaaguuuagagagauaagacugggcuguggggcagggaugguuuacuggccaggccagguaagcaagcuggaccgucugaccuuugccccgagggagaucuuaugggacagacugccuggagccuguccuuggucagggcuuuagccaggggaaggaagaaaggcugaaguuaggaggacuugagugguuugagcuguccuuucuggggcuccacagggcaacagcaugggggcaggaggggguccccuucugucugugccaggccuaaagcaaguuggccccuuccagccucuugcuguccugggaggccuuuucucuggggcugucacagcucacuuaacuuuccugguggugauagcuaggugccuuguuuuagggggcuggaaguucuucucgguagccuguugugccuaugguuccuccacagugaaucuugucuugagggaccuuaggauauuacuucuguacauuuauuuuaggugagggucaggaggaacuggaacgggggagguuuccugugagauugcagacaggcaggcauuucuaggguuggaauagccuaugcagaaaguuccgauccacccucugaccuaugcugucucccggcacagagcuuguguuuuaaguaggaagauucauugucugucucaccaucuggcauuaguggggucucgagcccaggccucaccagguacacaggacccuggggugucgcucuguuuucucugggucaguucugcuagcucacggcuuaguaacuaguucuuuauggugucaaaucacuggucaugacaugaggaagaccauccuggugucauugcuagaaucauggggauccugcuucaaccagcugggcguaugguuuggcaugccugccugguguuucaccggucacugugaucuucuuuccuggauggcaccuugucuccuccucugucagguggcauuucagggcuuugugcuuuugccguuccugucagcucauauugccuggcacaaggcaggcacaugcugcuucacucguucacuacauagaaucuuagguuccugugcucaguguuggcggaggcagugagugagaugcaugugaguccuugcuuccuggagcugcgaugugggaaugaggcagacuagccaggaguuagacauccaguaagauggggugggaaacaggcagggugaacagagagcugcuggguuuuaaccagcggccagagaagggacaccuugacggaagaguaacaggcggcaggaacagcgacuguaacguuccugaggugggcccugugucuaaugugguguguccagcaggacugcaggguuuagcugugccuggagacagaccaggggaauaagcucugagagacagagggauccugcugcugucagacagcuggggaguagggugcggcuggaaaucugcccuagucgccguucguggaguccuugguuuugagggguaaaugguaucucucagagaaaagaugucugugugacugagucugcugucagcuuccugaccucaaccugggacuggucagauaagccuguccacgugacucuguguggguucggaacauguguucuccaccacagaacuggaacuaguaaaagccuugcuggugacacgcugguagcugggucuuagaguugugcuuggagcuggucuccuuauucauacuggucagcuccugucgaguggagcaagaccaauuauaagacccacucuguagcccacaagcucacuggcucccaucugucugcagaucuuccuuggccucaggggccuagaugucccuccaccugucugcugugggcaguuggccucuuaauucaggacaccagucccuuaaggaucccgaagaggccuucacauaccugggcagcagcuuugggguucaucucuuucugggcuucaaagugugugucuuagacaccucuccccauccacugacccaguaugguuugugaccaagaguuagggugccauugaguucucaguggcuggaaugaguugguggcuauuucuccugggcaagacuguuggcagcuuucagcuugaccucauuucaaagcagcguugcuccagaggcuccagugggcagcagguuguggagaauaugcccuccaaagccugagcuugggggucucauuuucucaugccagcugucugacugggccuggcaguccuuaucuaggcaccuagggccucauccagcuacugcuaauuaaauggaauuuagcaucggccaguucacaugggcccauuagaacuaaaggaccuuacucgggcucuuaugaagucugacucuuagggaguugugacacggacucugagaaccuuccuggguaccuggggagccuguugaucccuuccuugauuuuaccgugaccugagacugggaugaguggcaaaagcaacagccagggauguguguauccuggaaaagucggccaaaaggccagugccauaguuguccgggugaccuccagucucagccuugcccagcaguggguucuaguaauggcagcgugucuagcccugcugcuugacuccuuuaacaaagaggaaggaguguuuaccuuggucagaguuguaagugauucaacaaguuuugucuucucaaaugaguucuuucucaaccauguuaacauuauuuaaaugaagacagagaucugacaguuaagaucugugucuuugccugugagauccuuaccuuuaaauugauuuaagugugugugugugugugugugugugugugugugugcagaggcaucaggugucccuugaguugaaguuauaggcagguaugagccaccugauguggguggugcugggaaccaaacuuugcuucuuuuaacuacugagccaucaccucuccagccucugaauauuuuuuaaagugugugcguguguguguacacucaugcacaccugagugaaagcacuggccuaggcagaggaauuggauccccgcugaagcuuguaggcagcagagagcugcucacaugggugcuaguaauccaagcccagguccaccagaagagcagacacacacucugaaccucugagucaccucucuagcaccccuaccucuucaaaaaugaaaacugggggggggggaucaaaaaaaaaagguagggucucacccuguaguccuuuagggccuggcaaucaaugugugaacuaggcugguguggaacucacagacauccuccuguuucugccucccuaguucuggaaucacauagacacauaggaauaugucacuaugccaggcugagucuuucuccuacaagccuggugucguaaaaagagaauccauacaucauaacucagcuagcuagagaggaaaaagaugagagccaaagguaggguguguguguguguguucuuuuggccuccaacuuaagucccugugcucagaugggagaguguagaaguuguuccuuuguuucuguucacugguuuccccugagagaaaaagccugugucaaccaccaggaagucccuguuccucacacagccagauucccagggccuguuuucuuaggguagaaagauagguuugggagcuugaaaacaucugagcauagaccuggcucuuggcuccaccacucgcugcuugagguagaccguuuaauucuguaccuuggcuuccucaucugcugcacaagaacaaaaguccugccucugggcacgccccaugcaugacccuacaguauguaaacccgaagggcacuugugcuggcauuucagaucaugccaucuuccccagcuuuuucucaggacugauaagcuuaguucccaacagagaggcuagcagguuuugucuugaugagauaggaagggcacgguggggcgcggggacuccaccuccugagggucugucugucuaagagaagcaaaguccuuucucagugccuguaauuuuaaagaaaccaucuuggucucugcacaucacccuuuggguccaagaagcuggcaccuugguggcagucugugaaugagaugcgaagcacauucugaggugacagccuucuccccaggggcuuggucuguguggggggcugcauuuggccuuugcucucuggggcugugcacucugcacagcucugcccaccccacucugccccgucacaucacaguagucuaaaaggggagcggccccucuuuuucuuucuagccaugaccugcccgugccugcaccugugcccagggaaaggcucacuuggagcagggcugcugucuguccagcagcccacaauccgccuuauuaaagugcuguggcuucaucuagcugcagaggcugcgggaggacuggagaggggccaggcuaaaaggugcaggcuguacagccccuggccacauuaggugacuguccuugguagucuuccagggagcccgauguaccugcugguccagcuuggccucuuugagcucugcagauccgcggaagugaggccagacagccugacuuggcugguacaguggguggcggucagagcaacucugccuggcacagggagguaauaaccuugaggugauggccuuggggccgagcgagguccuuguuugcaaggcaguccuggccagcacaucucuguguagguagcugcauaguggguaguuguacccauuagagaagagggcuggaaggcucuuacagcaucaagagggguggggagacagaaaguguguguguacauguaugugcucauguguacaaguauggagucauugaccaccaugggcacacacaggauaaagaacugacuggauccucauucccauuuauacucucccuagauuuugagacagcuuuucccuuuagcauguugaugucuccgauugguguguguaguauacacuuggugguguuauaacuuagcugacagcaccuuuccuuucuugguauacuuaaaauaacagugcaucuaaaacagagucacuguuacuggauuuaaugaaacacagaaacuagguaaccucuggagaaauuauguaauucacccaguuucuacaaagcagggacagaagagccaccuguaguggucccagaauugauugagggacagcguuaugugguucaaaugggcaagcuuguguacuggacucagaucccugugggcucugcagcugugugggucugagagcagaacagccacucugagccucagguuccuucccuacuacgugggacugugagcccaaaguugucguguguguguguguguguguguguguguguguguguguguucaccuuuccguguuucugcuggcugucaguucacauaguccucuuuucuaaaaggagaucaggagcagggagcuguuacucacacacacacacacacacacacacacacacacacacacacacaccgucccuacuccccacccccaccccaaggcagcagcaggagaccgaugugauaggagggccucuuaacuaguuacaauuuauaaaugugugugugugugugugugugcgugugcaugugugcaugugugcauggguguaugggugucuguguguguuuaugcauaucuguaccacaugcaugccugauaccuacagaagccagaagagggcauuggauccucugagacuagaguuacacaaaguuaaccacuuugugggugcugggaacugaacccagguauucuggaagaucaccaugugugugcccuuaauugccgagccaucucucuagccuccuugacccguguauaacccuugggccuucccuuccuucauuuuuuucacugugccugagguuuuguuuuguuucguuuuaacauacgauuucccuuaaagccuucuuccacaucuguccccagcaguuuccugaggccaggaggacaggacgaguacccuugggucugugccguggguucugccccuuccacccaagccccagugcugccagcacuauuggugucugucucgacagccuucacggucaacucuggauucucuggugcucagaguucuucaccaagagucuggggauuccucugagcccuccucacugagcugaauaucagacuugauccuuacggcucugcgguucuuuguaugucugcccgucugggcuuuccccucugagaguggauaauacacguggcaggugcuuagcagaaggcccuucucgcuugauugugacaacaaugugcugcucuucgugacaggucucauggaacgguccauggaugcucugggcagggagcgaugguggaguccugugagcagguguccugaguuuaguggggcugggcugcagcagucaguaggauggagguggaagguagggugaguccugacccuucaaggguuccgguggaccuuguggauacucucugggauacucucugaggugggagcaggguuuuggggcagugggucauguuugagguccuggcagucaggucuuggugauggggcuuugcugggugcucagugagcaaguaguggcuucaagccguguuuccucaggucuccucuccgcuccuugccugucuucucugaagguucugguagcuucuagcugacuucuccaccuuuugugcagucagggauuuccagccccugcuuucagaagguaacacuaacuugugggugcugccgcagggggugagccagguaacaggagguuggugcaugucagaggaagaacuuguggaagggccuuaggagcaggcccuaucuauugguaugccuuugaaggguugcaauggucuccccugugagucuguggccuuuugagcucagacuauagcuauacucugguccagugcucuuaccugccccuacugggcagagcuugggagggcacuagcagaggggcccuggggcaggaaggaccccacacuaagacagcaggagggaugcugcagcccugagcaggagaggcaucugcauacaaggcccuggccuagguggugugcauguugagggaggaagccacuggcuauccaucccucccucccaucagcuugcucgugugucugcuccauacagagccucuccagcagcugugggugaagguuggcaccucacugggccuuccauggccugagggguuuuguggcagagggaguuggguaguuccccuuuuggcuucggguuucaggcugugugucauuucacuggggucacucccuaacaguggugaggacagagggcuggccgcugcuuuccaaggcuucaccugaaauccaugccccucccgacacagccauagaauacggagcucccaaagccagccugagagcgcugggccaugugaauaauuaagcccucacuuccaacagccacaucuuuaaaagcuauaauuuguagcccgaaauagcugccuguuccaggagccaggagaacccuugugcaggcuucaguguagucuaugcauuuugcuuugacaauaacacaugaguugcccuggcccacaguuucuugggagagccugaggcacggugacugauaggaaccgaaucuucccagggugcuuggggaauaauuucuuugagaacucaaaugcaguguaguggcgagccugggaggcagaggcaggcagguuuuugugaguccuaggccagccaaggguacagagaccgcaagaucuuaucccaagaacaaacaaaacagggagagaacauagcuggggugucugaugugagguuuuaggugcauguggccuuagaugguagauguggacauaaagaggggaaauggccauguguugagggaagccuggacuguggccagggguggccaguguggcucuacaagcccucuuuguuuguggagggaucuucuguguggguucagauaggugggugaaggaaccucaggcuaacaggaaaugccucccuggacccucugcuucuccguggcuggcaugccuggaauucuuggggcuagcugccgcuuugguuuccagauguggaagcaauuuaaagucuguuuucauaaacccugggaguuugccucugaaguccacgugcucauuuggaaaucaaggucauugacucugacuaguggggaagggguagaccagauauccucugugaauccuucuuauuaaaaaauagauuuacuagggcacuuggauaugagacccuggguuuuuguacagucacaccucaaccggggcugaguugaaggccgguucaccuccucuccugugaauuuuucuuggagaugauucagccaggcucugcuggauccuuaguugccaucccuguacugaacagcugugggggcaggggauaaaggcccucaggaggcuggcaucaccgcugagcugggugcccacguggccccccgagugguagaggcccuuuuuccuguccuggccacaacaaagggaagaaaucugcucuggauuuuaaguagccagaaauacugucugguguagagaaacuggaaauaucuugcucaauuacugggcccuucuggccacagagguggcugccccaggauuagaggcuguguguacaugcagggccuguggucguguggcugccugccugcugucucuguauguguuaaccagucacuauucacaucuguuuuauaacccacgagcaggauugugaacaaacaaaaccaccuuugcuguugcacugucugacugcacuugcaauuuuuuucccuccaagacaagguuuuacuguguagcccuggcuguccuguaaaucagucuguauagcaggcuggccuggaacucaaggaauccaccugccucugccuuccgagcacugggauuaaaggugugcaccaccauaccuggccuccacacugucaguuuuuaauauccauggaauuguuguuguuguguguaugggcaccugugcggauuuggugugcacauguggggagucuggguggaaacauccaccgauuggggaucccuaugggccuccccugaagcaaagggaaggccuuuaguuguugggacuaucacaucaaaguaauucagaccuagugguugacauagauuuccucgggguucuggaagcuucauuugagagcagggugcuaucaggaggguuucuuauaaagucucuauccuuagucucccccaccccccaacagacacccucauuucucuucugaguuguuuguuuguuuguuuuaugaaagagucucauguagcccaggcuggccucaaacuugcuauguagcucucucucauggauggcuuggagucccuggcgcuccugccucugccugcagggugcugggcuuacaggugugcaucaccauguuuguaaggacaccagccacauuggacggagcucacccugaaggucuuguuucuauucaguuguuucuuuaaaaagcccuuacucaaacacaacaacgaauucuuaggugccaggugcugagaguuuuacauauaaauuuacauacaucacugaagggcugugggagccuuccuccaaagggaggagcaaacugagggagcacagagccuaagaucccaggagaacucacuggagggagcuagcccacuuccauucccaggcccacccucagcgagggcuccugaccaaaugcaccauuuggaauuggggggcgguuuagcuaucacugccucgucagcagcucuccugccugcccccuuguggucuuguggggugcuugguucuccaggccugguguuucugggguucugacccugaaggguuuugcuuuaagggugcuuugcuuguuuaugucacuuuuaucugguucuucaagacaaaguuucccugcguaguccuagcugucccaggaaguagguuuguagaccuggcuggccucaaauucagugacuugccugacccugcuagaaauguucuuuaaccccuuucaacuuggaaacacacauuuccagaucccgucccaguuuaauuccccaccgugugacaugaaauaacacugaaguuggagggcacugaucuagaaaccccccuuaaucuaguugcauggcauuccuuuaugugauuuuaggcaagguuucacuguagcccaggcuggccucagucucucagcgcuucccuucccuuagucucccgugugcugugaguauaggugugagccacagggaccuuuuguugugguucaacaggccaguugucucacagaaggcaugguguucguuuguuuggggguugguccauuuuuugugacauguaacuggugguaccuccugcugugggcccccuugggaggacaccggccagugucugucuuuccauuaaugaugcugucugauuacuguguuaaaggaacaguagccugcucagugcucaaagacuugaggggguuucugagcuuuccuguggucugcaguguguguguguguguguguguguguauguguguguauauguguguguguguguguauauguguguguguguauauguguguguguguguauguguauguguguguguguguauguauguguguguauguguguguguauguguguguguguguguguguguguguguauguguguguguguguguauguauguguguguguguauguguguguguguauguguguauguaugugugugugugugugugugugugugugucugguacugugcaaguauacagagucccaucagccucucaucugcuggcuuuauucucguggcagguguugggaagugugcugugugagcacggucagguuggagguauucccaccuaucuuuccucugauccaccauugccugcuccaucccccccagaggagggaaacucucgcucucaguccucugaaguuuucuguauguauuuugaaacuuguaaaagaugcacaaauucguaggagggcuacaucuugguaaguggguccuccgucauuuuuaagugccuccuaccccuugaaguacuucugagacuguguggcccugccagcuuucucucgguugcuguggugguaagggguguggcuuggcaguagggccccugcucaccugcaugcucacacaggagcagcagccagucccuuggcagcaccaaacaggcccuggccaacaaugugggcaacuucuuucucuucucugucaguaggcccuuggucaaaggcacaggaaucucggucaaaggucugccuagguauugauugguuuccagcuugggcacuggcugagccgcagccuucugggcaguuggacaugcuugucagucagagcugcgcugcccaggucuaccucagacccuccuucuuggugcuguaccuuacgccagccccucucuguggacuuggcucuuuagaucccuuaacacugcucaugccuccagaccuuuuggaacagaucucggcucugcucugggcuguuugaugucuccuuucuaaguuuuucugggagcuacagugugcuaucuucaccuaaucucugccauuuccugucagcaggugggaguuaagaccggugugggaccugggaggcaguugaaguugggaugaaaagcugugugggcuuccacaggcagugguuggcuaggucugugugcccauggucuguguaaauagcacuagaggccugagaaaucccggcaugacuugaaaccaaagaggaagcaucuauuguugcugcggcgcccuuccccccuccccggcccuguccucagacgaguugcaacugaguuccaacugagguuaacauuggaauaucugcacagagauugucaccugagggcuccugcugagggguugucuugaccuaaggugagacucaucggggguucaggaguagacuuggagcccagggaccaaacccugcccuggcugccauucuuggcguggugcaggugggguaggucugggaagaaacaugguagucuguccugccuucuaaaccuucgccuccugcaccaaaauaggaagcccagggccauagagcuucgaucucacagguuaaggcuacucucagagcaauggagauagcagagugaccaguucuccuguggguucccuuggacuuggagguaggucaagguucuggucuuuugcuuggaugcuaaccuuaacuugaucccaccuuugaccuuugauuggcaccaggcagccacugacaagcauccggucaguguguguauagcaggguuggcagccccaggggaagucaguuacugucaggauugcuucacagccaccauggucgucaugucucugugaaaaaaacagccaaguaugggggggucaugagggugugugucacuguaggcaguccuagcccacccucuuugaauuugggguguugggaccuggagccccuccucgaggggagguuccugccacccaaaggaaaaacccaucaugacccuggucuguuccaugucuccaggguauugacuggccacacacacaagagauuccauuguuggccugugcccacuuacagccccuucccuacaguggggagauccacguguacccacgggugccugguuuucaagggaagcugagaugugcccgcccaggcuauuuuuacccagcccuguccccacagagcugcgcuuuggcuccaagucaccgccugcggaguggagccuguugccagagcuggggguggaugagcccgcaccucagggccuccuggacucccuucuccaggcaacaucucaucuuaacacuuauuacaggcugugacuaaugugcaggcagaccugccaaggcagugggcaugagaggacccuggugcagggaggaaaaccuaacuuggccuccuagagcucagccuaccucucuguccaccccaguguaucaccgaggggucagucagagggaagccuccccgggcuuggauagaauucggaaugcucagguguggcccuggagaccgucccuuaaccuacuaaugacaguaaucgcucacgaagcccuucccaugcauucuaagaacaauuacuuagaacaguugccaguucacugaacuccaguuaugguuagcucagcuguggaggugagggaacugaggcacuggguaggguaguucaguaaccuacaggccacagugcucauauguaguggagugcgacuggaacccacucuagaucauguccccaacgcccaccaucucucugucauguuuucaguguccucagacagugagccauuguccuuaauuagauccucugacaauccuggucacguguaugcaucgaggaugcucagagaugaaacaccucauccagcggucacgccgcuggacagcggccacaacaaacucuuagaucagugagucagugagugguucucaagcugugggucgcaaccuccuggguuuccaaacgacccuuccacgggggccaccuaaggccaucagaaaugacagacgcuugcauuuugauccauaacaguagcaagauuacaguucugaaguagcaacaaaaucaccuuaugguuggggguugcuacagcaugaggaacugcguuuuaaacgguuuuaagcgucaggaggacugagaaacacugccuuagaugcuccuuggauggucguccagguccuguggcgcagugcaguuugauucaggccgugcucagucaugcgcuccuggagugcuagcugcugagggucaggauguagaccucccuguggccaccacuucacccucucugcccuuguagggaauggaaauacguagccacucuguaccgccuguguucucuguucaucuuuguuucgcugccaggaaaccuagggugugugaccuugagauucccccucugccacccccaccccccuagguggaugaggguaaauaccaaaugaagcuguuugguuuggguccugcuguaccuccugccugcacagcggggacagugggcccuugugagccucucugaggcuuggacagcccagcacguguacugauacugggucuuuucagcagcccuugaauucagcccuuuccaacuucuuacagaggaaagggugaccgugggaccuucugacgggggaacacagcucuuagagaggcugaagaggggcugccugggcagccugugugccuucuggcaaccacuuccaguuagagccggcuuuguucaucccuagaugagaagacuaaguggaaacauggaggugggggcacuccggggauguagcuggguccuauuuccugggacuugggcucaguacugucuccaguaaucccuguccuuggaauuauuccccaggcccaaccauauauaucugucaggcucuugcuagcugaccagccaaggaccuauggcaggugagacaaccuggucccugagcagacagccuccagucucucuccacgccaggucugacuucuuuaagcuuucauagcugccaacugguacuugucaugcagccucucaggcaaaaaugacagucccugcucucuaggggaaaucccagggccuuguggagguagagucuuguccaggaacacaggacuuaaugagcagcugagucuaccaggacuaacugccaggcuccagagcugugcccuccagcaguccuagccacagagguccccuggguuuacacaggggcacacuauaucuacuuuaucuuccaucaccccguggaccccaagguuggggaagaaggugucccugaguuuggacacaagcaagccaggguggcucaugggaguauagucccuguggcccagaaggacaagaacucuguauguagcgcgcaccucugcgcccucagggacagagcccugggaggcuagauggggccacaaagagccauacugccugcugaggauacugccuuccugaagcuuccuuaaagaccagccguagccuuucugugcagacucugaggaggccucuguaagcuccuggcuuggaccuguguacucaaugccagggcaacugcgugaugaccuccccuucucccugugcacgcagacacacacacgcgcacacacacacacacacacacacacaccacagacacacacacacaccccacuggugaucaggacaagaaagaagaguucugcaagcuagaaacucagaaacugcucugagcauccauauuucucaguagaaagucagucuccucggguaccgguuuccugcucuaccggcucucgggacagguccugggcaccacgggagaugcaggguguagacaugugcuccaaccggcauggugaucagguggggugaugacgaugcugccccucaucucaucacacaucacacuuuagggagagacucugaccagccagggccuccugcauuuguucagcacagagaucuguaucuugcgucagccugaguagaguuugcauggcauccucuggagguucgucaucagcuccuacacaguccccaaagcucuccagugcccugagccacgugacacaguuucucuuugggguucuggccugagcggguauagcugggggauggcacagagcagagccaccuagaccccugggagggugauuuuauugcuagggggugucucccuugcucguguaaucccuuccccgugcaacuuaagaaucauagagaaacaucaccagcuccgacgggguccuugugugacuuagcucuccgugccugcuaggagggguacagggugggggucagaggccucuucuguacccccaagaacuaccucccuuccugagguguguggggugagagcugcugacccggcacuuugcucaccguuccacagaggccuggccuugcaggagggagcagacugaggaggagggcugcuuggguccggcgcagggccugugccauccugcucacuucuuuuacugccugccuuaugcugcuuuaauuugggggggggggggggagcugcaagaaaugauuuugaaguuauaauuaaaauuuccacuugccuuaggcaaacaauuguggguugaaugaaaagguguuaauaaaaggagagguuaauuuuaaaagaaaauguuaaugugggcaugcaccugcggacgcagcugggggcggguggcacgccacucuuggcagccucagccuggcuccuggguccuccaucagcugggcagcuucagcagccaccugccugcuuuaagccucaucugcauucgaugggacaggagugggcaucagagcccuguacaccucuggcacucuugggugagagauggucagaggucagaggugaagggcagaugaguccucugcucaaaaguccgccaggaaggaggguucgucuggucuugggauaggaaggguguuuucagcuuuucuucuguccuuccugugacuaagauaguccccuugagccacuuuuuccacccugccaggagcguauguggcucguggugucacuguacugcuguggguugcugggugaaggacugggugagcacuggugugcgguagauugugggucauggcucccaggaaagaccugugaucuagaaaggguaaagggacucguccugggacggagugaggucggaugcagcuccugccugcagcuggacggcugacgguggcaguccccaccgcucaucucaugccagccuggccugccugucuggucaggugacauuggcaggucucguugugggagaugguguagaggacucaagcugcucccuugagggacaggccacccccucacuuuccccuagguguuugugugcugagcagcaucucccgcggggguggcgugugcacguggacuguugccuuaggaggagaaccuggacaucaucaccagcaucuagucucuagagagugacucaccuuaucacacccaacucuggaaacuagugagcuucgagaguagccgugacaaagggaaccgaguguguggcaggcagacccucugcccagccuaccagaacacuggcagguuacucucugagcuccuguuucccuaucaguaaaaugggaacaaagacgaccguucuggagaauuguccccaaacagaaguaggacaugugaauucucgucagucuuugguagucaguggcugcucugugacauuaguucccguguuucgggugagcguugugugagcugaggguauguagcucagugacuuuggagcugugugugguucaacccuuggagcgugaggaagacuuugauugcucacccccugaucuccaccuuugagauugccugugcugauuucauugguccaucuggguucagcugagugcuggugcaggcagguuuugcagggcauaggcucagcccagcuccagguggcuucugguguccuggaaccuuuucuuguggacacuuuugugaggcuucuggcucccugggcagccuggggagaugagggaaacaccuacagugcaguucucggguagcccuagacagagaguauaccaugggcuugaaagcagagccacugggagugccugcccucucaaaagccaaguaccaugggaacgguuugcugagccaacuacuuacauuagguuaaauaagccaguccugaacuccgcuauaagaugaugucauuaagaguucagcgaaccuccuugcacaucagcaucauuuaaggcauuggagcaucucaggcccaggagugagagauccuggcugguggugucucauagccuuuucuuggcugcuuacuccggauagcccacaacagaccaaaguauggauacagcaaaguccaccccaggauacuacucacaaaacgugggaaccuggagcacaccacacagccuccgggcagcccaggaggcuggagaguguccuuuccccgugccucggcuagccuaagccuucuccaggcaguugggcuaucucuguuucuuucaugcuguuugacuggucuacgccuguuugaacuuggcugugacucucagcagucugucuugggagggaggggccaagauaaucuggucaguuucugggaguuccugaaacugauuugaguuuacuuucugucuucagggggguuaccugggagauaagauguuucaauuuugaauaaaguguuacauaacagcuggcaaaguggcuuaagggaagacagacagacagacagacugacugacugacaaauagauauguuacuauuacuguuuucuuuuuugugcugagauguuguggcuguacagggucuuggaggguacacccuagcuguguggacuuccccgcaccauugugccucagguuccuugugugaggucaggguugucccugacaguuggcuaggguggguccucagucacuacagccaagaagccgucaugaacguaugcggcucccugugcagacugugaugagggcuccagcauagcugcccaguccucaagguaguugaucuaguuguagcccuuuucuauggguggcucuaccugggcgacagaacccuuaccgagcucucgugacucagccaccaugagaggcccuugcugcugacacccccaccccacccccagucccugcagacgcacuuguagacgggugaguacugaguuucaggagccaccuuacucauucuguccuucugacuuuccagggcagcgacuucucuggcucuacugauggcgagcaacuccccagggaacccgacuucuuccaggaagacgaagaggaagcgaugacauuggcccuaccugagggaccccaggaguuagacauggacagucccauggagagcagccaaggcccggagggcucugucaaggguuguggcgaggagaaggagccugagcuggggggccuguuccugccagaggacaagugaguaaacccaauuggcauguggccccggagcuagaaaguacccgugacaccuuauaggaucagcacgcgcguguugcuuccccaggugucuggauaguggggauaaugcuggaauuauaagccccgugcagaagucagccugcugaggcagggaagacgggcucaguauguauuucugauggggccuagaacuugcuguguagaccaggccagcugaauucacagagacccaccugccucuggcucccgagugcugagaugaaagguguaugugugugcaugugcuaccucugacuuauuguuagauguauuuuuauacgugugaguguuuugccuacaugcauaugugggcauccaccacgugugugccuguuacucacagaagagggugucggaucaucuggaacuggaguuauggaugguugugagcuaccauaugggugcuaggaacuaaaccugagugcuuggccagaucagcaagugcucuuaaccacggacacagcucuccagccugagugucuaagacucauuuauauguauucugaauugugugugccagagugggugugcauucuggguuauggggaggcucagagaggguguuugugaauuuguaggggcauuuguggguacugggacugagcucagcuccucuuuuguaaauuuauuuacuuauaucuuaaacacauacucugccuccuggucccccuucacagagucccucccccaaccccuccccuucuccuuagguaucucccagguauuccccaacccuaagagcaauguauucucuucccagccacggugacguuucacucacauuuauaaggggaaagggaguguugagagccauucagcuugaaguacaagugacccccccaggggggacaaagugugaauaaauaaaaugcagauugagugccaggggacuccuuagcaucugccagcagggcugucugugguccuuacacagaagcugggguuccccagggacagaguuucagaacuaacccaggugucaucuguccuccccacauccccacccuccauuaaaaguuucccauugugaguguagacucccuggacuuggggagucauggucugugggugagcagagaauuugcugugacugucguggggaagauggaugcaggcaggcuacuagcugagucucuuugcucucagguuguagucagccccaaccaggcccucauguuucccacgggugguccaugagaugcccuagaguguggggccucuggcauguguagauaauucuuuagaauuaggcaucuuuggacuagacaugccacuuuauacauugggggcugguucucccuguguuguuugucaugauaaaagauagagggcuagagagcuggcucaguggguaaaggugccaguugccccgagccugagcuccagaaugcaugggcaugggggggggaagugggggcaucuaugaaucccagcccucggacagggagacgggcgaaccgaccuggcagaugcagcagcaagagcaaagcagggacucugcuggccucuggcccccacauguggacuguggcaggaguguacaugugcccacaugcacuaauaauaauaauaaauuuugaaaaauuaagggauaauuaaagauuggaaaagauggggaaagugagaaugagaggaaauaacccuucuuaacccaagucccauggccauguuacucucaugugcucuuugcuucucccuucccuuccccuuccacuuuucuaaacacggggucuuguguagcccuggcuggcuuggaauaaucuauauagcacaggcuggccuugaauuuauagauagaccugccucugccuccugagugccaggacuaaaggugugcacuauugcugccaacauaguaugacacugucccagaauaaauguauuaaucacugucaaagcuuauaucuaacuuaucauugauaauguauuucucugccuuguuaccaaugcuuauaugagucuuucaacaaucauuugauacucuauaauuuaauaacugcuuuacugauacauauucuaauacaguaacuauaauuauaguguaauuuuaaucucucuguugcuaaaccauuaagaaauaagcaguguuucgcugucuggggauggcacaaucuacucaucuguuauggagacauuucuaugugggauguuccccuuaggacgggguccccaaaaggguaagguuuauccaggcuccugugaucuguugggccaggcugguucccccgagacacugcaugcgggucacgcccucagcccuccacuaacugggugcuuauggcccuaggugccucguccucacuccaucugugaccacaucagaccuuuccacucacuccaccgccucucuuaucagcaacgaggagcaauuugaagacuauggcgagggggaugacguggacugugcucccagcagcccaugccccgacgaugagaccagaaccaaugucuacucagaucugggaucuucagugucuuccaggugcucccuuacucuggguggcauuugcaguccauggaaaaugucagaaccagucuagccucgucccagacaggcaaagaacauccuuccucuguccagggcuacugccaggcucuacuggcaggcagggugccaccgucuuacaucugguuggggcgggggugggggugggucacauaauaaaagggaagccuuuuauuuuggagaagaaacaguuaauuggccugggagucugcagaccccugugagggaaugucuaugucaccuugccuccuagaaccucaguguucuaaggaccuuucaagugaccuucuguggcuccuuccugccugccggagucauuccuuccugugacccuaucugcuaauugguagcacacaugcacacaagcauacacauacacucauacucucucucucucacacacacucucucacauacacacacucacaugcacucacacgcacucacacucacucacacacacaccucuaucucuggcagccaaggaaaaggaugcucugguuuauuuccauuccucugccacaaaauagaaauaagagccuuggggaacuagguugagcaagcucagugagguggggcggggcacagccugccagcagcacagagagugaccuccccugccuguccaaccccccccccccgccccccccccccccgguccagugcgggacagaccccaaggaagaugcgacaugccuacaacagcgagcugcuggacguguacugcucucagugcugcaagaagaucaaccugcugaaugaccuggaggcccggcugaagaaccugaaggccaacaggugaggccacagccagaggggcagggccaggcgggacccauagcacaaggcccaugugcggucagguacagcgucccugcagggcugccccuggggcguuuccugcagcaccucacugagugaggugugaugagugaugucccuucagcccaucauacccgagugucgggcagugggcaggguguggaaguguacucaugacccucuguucagugacugugucccccuucucucucucuccagccccaaccggaagaucucaagcacagccuuuggacgguaagacccucuugggagacagagagcugagugcuuaccacucagagacagcagaggggcggagcagccccuucccgugcccuugccacccuguccccacuuaguaggaucagcaucuucagauccucacuucgucaaccuuagugggccuucuagugugcccauggcuguuuguguuacccuuccgcucaggaccgggcuuggggagcgcccugucuaccauccuuagaguagaagucguuugggugggaaggucagguggucagguggaggauuccuccugugaccucuuuucuggcagccccuguacugaaaacucacccagcccguagccugaguuggggcccaggcuguggcagacauggcaggcaggugcccuccacccccacaggcagcucaugcacaacaguaacuucagcagcaguaauggcagcaccgaggaccuguuccgugacagcaucgacuccugugacaaugacaucacagagaaggugggcccuggcacugucugcacguuccugggaugugugggggaccugcuccgggcugcucucuggggacuugaacccuaugcccaccuaggaguccagggcaagaggggcucuaaucacguggcccucccuuccucucaaaauaugagcguucuuuuuugcguagucauuuggagauccuugucgugggcuuuucuagauucucaguuccgugccuucaaaagccuguuguacccugccccacccuccaugcugcaggugagcuuccuggaaaaaaagguaacagaacuggagaacgacagccugacgagcgggggccugaagagcaagcugaagcaagagaacaugcagcuggugcacaggucuggggcacgguggccccggggagcgcagaguggguccccagucucuccggcucugagccacuuggucuagauucuagaccugcuagauaacuccccuggguguauagccccagggcuugugacucccaccgagugagaacagcuguucucaaccugugggcuacaaccccugcagggauuucaugucagauauccuguauaucagauacuuacaauuuauaacaguagcagaauuacacuuauaaaguguaaaauaauuuuaugggugcaggggguggggagggggggaagguauuaggaagguugagagccacuggcuuagagugcuagggccugaccucccuucccggggacaugccccuguggcagggaguggaaggcaggagggcccaggaggcgcuguguguggccagauggugauggaacggauggacagcagggagacugggaaggacagauagcagggagacugggaaggaugcuucccaugcugucuggccucccagaugcaagaaacuugguagacuucucugugcugggucuggucccacaugcuggguccccacauggccuuuuuguaugccccagcccagcccgauggagggacuguggacuguuggacuuccgguagccagcauuggguuaucacuccagaggggccugaccucuuccuggcucuggauuucuuauggccauuugccaggauggaccuaaguaauuggaguggcucuggucaggaaguccauagaaaagagaggguaagaguuggaagccauugguguagcuguggccaagccugcugccuucacugucuuccguguggccucgcuccccucuggagcuuuuucucuagaucuacuucucccuggagugugauugacacacuucuuguuagaugucacagugucccuaauucaccugucagcuaagcucagggcccauaggccugggaacccgccaccaucacagugagugugcugagggccucgacagggcucaggcccuuguucgaugggacgagagugcaccccgacugaacgcgucugcgccccaccucagggugcacgagcuggaggagauggugaaggaucaggagaccacagcggagcaggcgcuggaggaggaggcccggcgacaccgugaggucuacugcaagcuggagcgggaaaagagcacagagcuggagcugcucaacaccaggugggcaccaggcgggcaccaggccucgugccugcagcgccccgccccucugcaccccgaggguagugcugcccccgaggguuuccgguaaagcugagccaaucguccuagcauuucuacuuaagauacuauaaaauugcaccggccaguucuucagggaguaggcagagugaaaguucaugguagccauggugcuugggcagaggaagccacagaggagggucagaaggcugggucucauagcuaggccuggagcgcccccugcugucagaucgucuccugaauuugaguguggguaagcugagccuguggccuccugcauacaccagcaucuuccuugcuagaacccaagucagaggcuggaagaagaguaccggcccuggucacaggguuucugucugcuguguaaccccgucuauccccuucucugccugccccacaccaugcaucgugugcuuugugaugaggcuguggucuugucacuggcugggcgugguggggccccuggagggacaggcacuguccugguauuccccggcccagguguuuaagcagagauuggugaggagaccucccaacucaugugccugagacuccccaccuuucccaacaccuucucaaccuuccuaaggcuguggacucuucacuacagugccucauguugugaccuccaaccauaaaauuauuauuucguuugcuauuucauaacuauaauuuuaccaccaugaagaauuguaauaugaaugucugauaugcaggcucucugauaagggacccccagauugagaaccacggcuuucgaggcuguuauuugcaauauggcucuggggcuggaguccuaaggggcugcucacauuaaacacuccuguuuuaaaugacuacaggcucaagagagguggcugggaacagagagguagaggagagagggcagugaacagggccugaagcaggagcacagaaggucaggcucugaggguaaucuuaccugcugcccuucccacagcuccuggggcgguucgugugcagccauggaugguacuucccaucauuggcauacucccuccucacuuccuuagccagcuucacaccucuuagcacggagguccagacuccucccuggcccuugucuggaggccuuccuaggguacccaaggccucauuaagguugauaaaagcuucuccagaaagaggaggcagaagcuggggcgagggcacugccagagucagaugugguucuguacauucuguagccaucucaccugccuauaaaaccaucugagugccagccccacugggucacuguagggcagcugucuggaaucacuccauagagaaucauugccuccgaucagagaagcugccgugagcacuccgaauuccagacgagggcuagggauggagaauagagagcagauaugggcauagccuuaagacuacagaugcuaacgggagagcccugugcuuaccagacauaggacuauucuccuccuccuccaagaaguggccuuccucgguguuucaugaaggauuuuguguaugugcauguguguucacaugugugcauguugaaggccagcuuucagaaauuuuuagauuuugaaauauauauuuaugcauacauacaucuuggagauaggauccugucuaaacaugacauuucucuuucuuuuccuuccucccucccucccucucucccucccucccucccucccucccuccuuccuucccucccuuccauucuuuuucugagacagggucucucuguguaacccuggauguccuagaacucacucuguagaccagcuggguucagacuuagaggcccaccugccucugccucugagugcugggauuaaagccauacacaaucaagccuggcuccuuuguuuuuuuguuuuuucuuuuuuuuuguuguuuuuuuuggguuuuuuuuuuuuuguuuuuuugagacaggguuucucuguauagcccuggcuguccuggaacucacccuguaaaccaggcuggccucgaacucagaaauccgccugccucugccucccgagugcugggauuaaaggcgugcgccaccacacccggcuccuuuguuuuuaaaauagcugauggugccagggggauggcucaguggguaaagugccauacagaauucgcgucuccagaacauacauaaaaccaaacacagcaguguguucuguaaccuuagugaucugcagcagagauuggagaacccccagaaguuggagggucagcuggucuggcaaacuaauaaaagauucugucucaaauaauuugaaaauucugucaaacucauuuucaaugugacccauguacacuacccccccguacaugcacaacacacugaacucacacacaguuaaaaaguaacuuaaggacugaaaguaguuuuauauauacacacacacacauauacauacauauauauauacacacacacauacauacauacauauauauauauauauacacacacacacacacacauacauacauacauacauacauauuuuugagacugucucauguuacucuggccacccuggaacucacuauguaaacuaugcuguucucgagcucaacagagaucuuccugccucuguaucccgagugccagaauuaaaggcacuaauaauuccgcacaugaagccauuucaugguauacaggauuuuggcuugugguaucacguuagugcuuaaaaagccuuggauuuaggaacauuugggauuuuuggaucggggacgcuggaccugaguuauccugugagacauuuucuuacucuugucuccauuuucucuugggugguaguuucuuucuccuggaagcagaggcugguugucagaugccuccucucuaaggccguuucugcuccagagucucugagccaugccaucuuucuuucccagggugcagcaguuggaggaagagaacacagaucugagaacgacaguggcucgacucaagucacagaccgagaagcuggacgaggugagccgcaggucccagcaagaucuggguucacagagugauggcagucagggcuggaucgcagucacaggagcccugacguauuucccuacagagaagacguaccaggguaugguagcacacaccugugaucccagcacgcaggcugcagagaaaagagggucauccucugcuacaucaucaacuuugaggccguccuaggguacaugagaguuuugucuuaaagauaaacaaaagcaaguuuauuaauuaaauaggaaggacaagugaaugacuuucguuucugaauuuacaaaauuucaaguuuucuacuguggaaauuuagccugccuuaaaaaaaaagauuuauuuauuauuuauauguaaguacacuguagcugucuucagacacuccaguagagggcaucagaugucauuacagaugguugugagccaccaugugguugcugggauuuaauucaggaccuucauaagagcagucagugcucuuaacagcugagccaucucucuagcccccuagccugucuuauauacuguaaaugccuuacauuguagaauucucuucuugaagagggugggcuuagcuccuguuuggacagacagcuucuucucaaccucugucugacacuacugaaggacaucaggggccugggacguuuccugcuauguuucuagaauguccccauuugccacacugagguccugcagagugcaagggcccucucaggaugccugcccugaccaugucugccuuguccuaggagcggcagcgcaugucugaccggcuggaggacaccagccugcgacugaaggacgagauggaccuuuacaagcgcaugauggacaagcugcggcagaaccgccuggaguuccagaaggagcgggaggcgacgcaggaggugagucacaggccagggcccccggggcuccgcucagaguuacugcugcagccaacaggcuucuuuccccgcacagcucaucgaggacuugcggagagagcuggagcaccugcagauguacaagcuggacugcgagcggccagguaggggccgcagcuccucuggccuuggcgaguucaacgccagagcccgggagguggaacuugaacaugaggucaagcgucugaagcagguaggccccagagccauguccaguggcuuugaagguggaugggucagccauuccggauucuguuuagaaggggggagccacgagccccagucugccuccugccaccucuccugucucuucucagcuaccugaucgccaaggcccaucaucccaucccccacucaggcaagcagcuuaccucugguuacugccagcaguucuugcacucucaggccccugucuuguucuggguguuggaaugagagaaccaugcucaggcugcagaugcaugccuggcuggguugggaccuccgucagauagggccuaagucuuuaagauucugcuucucauggugucccaucauuccugaugcugcagccuguguuagcgugggaucgggagggggugguggcugugaagggagugaaguccaaacucagcugggccugugaaccagaggcugggcauggaccacaccugaguucauucacccaggcaaaagucuuaguggccgucuccuccaguaccgcuagccugucaccugcccaggggcucccagguuccugggauaagcuagagguaagaguuagaggggcagcugcggagcuauagugucaccugccuucuggggcaagggugucuugaagcagcucccacuacgcaggguccagaaccuggcugcaggacgagccaggaaaaccagcccucccuuccugcacagagaauccagaauagcaccucccuugugccaggucagggcugcaugcugagcugcuggugggcagagcucccuacaggacccuagagagggaagaccucugucaccucgguucucccaggcagggcuguaacuccccuucucgcugaggacacagacacagggacaugggcgccagcgggcucuggaugcuuuccagaguucaugaugccuuuguucuguuggcacaggagaaucacaagcugcgggaucagaaugaugauuuaaaugggcagauccugagccucagccucuacgaggcgaagaaccucuuugcaacccagaccaaagcccagucucuggcugcagaaaucgacacagcaucucgagaugagguagccuuguccucccauucucuuggacacucacauuugucuccauggcgacuugucuccauucuguggguccugccccagcuuccaccugcugauaccacgaaccccagacuacaugggaucccaaaggcaggcugaggccuggcccuaauaguccuccauuugcuacugucucagugacaucagagcugagcaggagacagcauggggcaggggcuuagcuuuccuaacucaggagcucugggcucaagucagaguggucuuaacccagauggagaccagaauucccgaagcaucuacuuuugcacacggguuuacuuggucucuuagcucacggcuuuagugcuuccccauagacaugacaggccacacccauggcagcgggaagggagcccagcuccuagcacuacaguccaucuucucuacaucagauaccagaacacucaguugaguuuuagugugaaacugagccucuguguuccugacuccucuggccucaaggagagcagguaacuccaugggguuggagcagcaguuuagcugcacuuaaaugucgcugugagagagcggcuagauaaggcaaggcuggagugagaagggcacuggucucaguggagaaaaagcuggcagccccagcccugacuaugagugcaucuggccaguguucccaaucucugugaaaaguuccccauacuuuagccccuucccaggucaaugaaauugccuuaggcucugaucccugcuuaaaaugcucagcugaucugggcgccucuguccuuggucacuggcucagcaucugacccaccuuucucauucccuucagcuaauggaggcccugaaggagcaggaggagaucaacuuccgacugagacaguacauggacaagauuauccuggcuauacuggaccacaaccccuccaucuuggagauuaaacacugagucaggguuggcugcagagcggccgucggaccugggaccuaagggcaggccugccugaggacgaagaaagaugcaggcuuugcccacaugcacucugugauuguaccucugagcacccucucugugugugcugguguccgugcaaggagugagcuuggggccauggcugugggugacaacccacggugagcugugugugcacuuuguagccccuuugugaggggcagagggggcuggaugugggggagacacucucaggaguuaacagcaaggccuggaagcuugcauuuaggauacugaugaaaugauucuaccucugggauaaggguuagaagauacucucaggagauggguucucuccccucccccacugaaguggggacaaaacuguuacauucuccagaauuugguguccuugccaaccuuucaggccaccuuucaagccggguuuuuuuguuuuguuuucuuuagcucagaggaggaagggguauuggagaggccccugaggucuagcccccuggggugcagauaagcagguccaguggacucggacuuacagagcaguuagagugcacuguccaugccuuugggcuaaguccaucguaguuuucugagccccucccagucuugcuugccuaccuccccuuucugguuuggcuuugcuuuguuuugaagauggaaaauacaagcagcauucagcuggggguggaaggaaggccaagaaggguagggugccccaaggcagguguguguuagcacugggggccaaaaggagugauugccugggagagagguguguuuucauggcugcaucgucacacaugaccucucuggguuccaugcuccuuggugaggacaggccuagggaaggguuugcaggacugauacccuugccucggcuuucagacccaucugaaucagguccccaguuagagagccgacacggcuggcaggagguccaguggagaauacugggggaaccuuagucuucgguuccgucaauacaugaugggaauucacauacacacacccguguuggggguugagggaggguuaaaaugugaucugggaguagguacuguauagaacauuccgguuuaucucaguuuuauacagcuugugauugguuggcuuccuuaccccagcuccuauaaagguguaugguucaaguuuccccuucaguuuguuuucuugagcacaucuuguguaaaaaggaagguuuagggaugcuggggaggcuagcgaacagaaaggaggcacaguugaaagaaaauaggggaucuagggugugugccccggggugugugccugcuuggcagagacggggcuucggucaguuucaguccagucauggugcuuucuuuggcuuuugagacucccuguaaucaugugcuuggaauucaucucaugcugcauagauagugcgugggccuggucugccuggaugagccacaccaggaagacaggaaggcuugaucuggggauacgggguuuccuucccuggcgucugggaagauagagaaaaagggggcuggguagggagucuugugaggaacaaugggaagauaaccauggcuugagguugguccgugugccgugcuagcagaaugcagaggccagcugaauauagguccugguaagaggggccuacgcucaggugagcaguucagacuugaaguuguaugggccgcccgcuucacuuguauguggguuuccagagaaggccacagagaccagagucagugucacagaagaggaaggagucugucagggaaacaggcagggaaggaaggcuuuaggcccaaguuguagggcuggaagaguggacucccugaggacaugaccagguuuggaggccccuguggaucuggacgcuugcuaucuaggccucuggaagaaugauuucugaauguggucugacuuccauguaacacaccucaggcgaaauccagccuucuuacagaauacacuuagaaaacucugucaacuuccccauaagaucauguuugcuguuugcuguuucuuguaguggugacaguagguuucugguuuuuuuuuuuuuuuuuucuguucuggguuagaaggcccaggggucccagugccacaccacccaugggagguuccagaacuucccuugcuuggcaagaaucuaaucucucuuucuacugccucccuggcucucgcuccaguugagcucccagagacuuucgggagucuagagcuuacacuuggcauucaguuacauuuggauugcagauaaacaagagguuuuagaaucaccguguuccaugcuauaccugguuagaaagcguuuuuaccauucugauccucacguguucugacaguugguagagguguggcccaggccuuggaaugcuuuaagaaugccacaggugacgcuaauuuaguuaggucuccugugaagaggguguggcucuuucuaaguugaagggucugcagugauuugccaagguccaggaagguuggggccgugaaggaaguacaccuuucaugugacacuuagccauccuuguauuccacugggagccaaacaagaugagcuucugucucccugauuuguuuccuuuuauuuuugaauuagccacuuuuuuuuagaccaguaguuuucuuugagacucuacagaggaaguuccuuuugaaaauuuuauuucugauauacuaaaaccacaaaucucaaggaccaagcagaacgccaggccuugagccugagucugccaguuuggcagugugcuggugucauaccugaugcuggagggccugggaguggaacacaggaguggcgugccuggcaugagguucagucccuggcagcauggaagaaaguugaugacagaaccaccucugacuuccauauauaauugguagcacaguguggcccggcaccugugucuucaauggccuucccaaguguuguucaugcacagaucaagguggaggcccguaaaucaugugaaaugucugcugaggucagcagggcuggagaagcuuguguguggcccagaggauggguaauuaugccacugagugguccuugcccugagaguccagcuguucccacuacucugaaagucucacccuagacggacaggauauaagugccagcauuugacugggcauaggcccauuaggaauuggaggcagguaggcgggaagagcuggaccuugagagcagccuagacgcaguggccacuugucuccgcgggcuuuguccauuucauaagggugucucaguugcuucccugucagugccaaaucagcagcacccagcccacacucuggagaacucuaggugauggucugauagcuaguuaguccugaguugugguccuucugcuucugaugguccuggggcuguugguacauaccgggcuguguaagggauccagagacucuacagcaaggccuaaagaauaaggaggacuucacucaucugaggggcauuggcaaaucuacaccugucuagauaggacugaugggagugggaaagguacaggguggucaccaggcuagucaccaggauguccagugacucugucgagguccaggugaagcucuuuagggccucagugaugccuguuauccccagucuuuccucacuggggcccagcgcuucccucugguggcuccucaggcugguaucacuagcaugcgcuugacgaggggccuccaguuagagcagccagaucuuggaaaggaccucccuguccugacuuggacccugacagaacguacuugcaauggguuuaucaggaaaggguagagguagcaccuucagggcggggcagcucuguggcucugucgcucugucaucguuagcucuguggcucugacaucguuagcucuguggcucugacaucguuuagcugcucugcuaagaaaaaaagccacuugcagaaaaggcuuuguuucuggaagcauagucagguuaccagccuugucgcucugugcacuaggggcuggguagcuuugguguuccuuccuuguggacuccuccucuucccauugugacuguaucguagggaugugcauuccugagguaccauauggaggacagagucccaggccaccucuccugcaggccuaacuucugguggcccugucucguguugggacugucuucuuuaccguucugcacuguuucuugucugcaugguuugggguccucgugccuuuuuaccuuguuaccaccacacaggauucucuguuacccacugcccccuuuuguacguccccuucccccaucucccccaguccugugcguacucacgugugcagccauauggcucaacugaggccagcuggcaaacacuuuaccccacaccaggccgacuucccauagcuccccagcucuguugacuugguaacuuuuguacaggauuuuguuacaaucuuaagcauagggaccacuuaauccccauguaccugcagcuaguuuagaagcccugcaucccagacaaggguagcuuugugcagaccagccucucccgcaaaccucuuccucguggguucagguauuuauaaaagacagauuuccuuuaaaaugaggcccuggcccuagcagggaggugacaggucuacaaagcucugugcauggcucuucuggaggaagccccagccaugugguuuccagugcuuggcaauacaucuggguuuagggccauugccucucgugucuccccugauuugugcugaaggaagucacuugccacugucccugccugcugucacuaccuguccagcccuuccuuguuugcuggugcucagaccagagugccauuaaucaccagaccaacgucaggaccugcacaggacagagugcgcugaggacucucggccggcugccucccagcuucagcucccauggggcugggccuucugggguccagguggaagaagcuauaggcagauaggcucugccuuuccagggauuacaucuggggcuuugccucagaagccagugguugcagauggccuuagcuuugggcuugggaaggagcuuccacuuuaggccccagggaagggagaaugggguacagcccaggcccugaacuguuuguuuccacucuguucucuccagaaacaggcuuucaguggggggcaccuuccaaggaacuguauuguacagaccacaguguaaauaaaaaguuggcuuuuugugccugac

SEQ ID NO: 6214 - RNA, 30088 nt, Mus musculus
cuuacgaagcacguucagucaaucacuaagagugaggcugaaagguggcuguucucuacgcuuaucggccgcccggcugcuugugaaguuccagccucauggcggagauaauucaggaacguauagaagaucgaaucccggaguuggaacagcuggagcgcaucggacucuucagucacgcggagauuaagugagagaggaucagggaagaggaaggagcggggaggccggaggggagcuugaggccaguguguggcggggaccggcgugcugacuuuucugaguuuguuuguagcuaccaugcuagcagagggaaaaguccguggcuggaauuugaccacggucagaauucaacuuuaacguauugcaaugcgauccauaaucaguccguuuacccuuccuacugaccgucauccaauggucagggucuugcggccguaaaggugauccagccaggauccuagcccgucaaggauacugggcagugugaauggcgggagaauuccgauuagaaaaugguuauaguuuaaaaguuugggguauacagcuuuagauagucgaguacagcgccacggaagcccagggggaguggguaggucucccuaacuaaacuuauagacugaagaccauucaauucauuuccuaugcuucuuuagcgcucugccacagggcacggaauauaguuggcauuugguaauuugguaaaaucaguuacuuuuagugauuuucuguaacaguuuacuuuucuaugacucuagauaaaagugcaguaguagugugaguguaggauccgcaaagaaaaacguuaggaaacaccgcgaggacgcuuagaaagugcuaaauguugcccggagucagggcaccggccuucaaucccaggacuugggaggcagaggugggcggaucccugugagugcuaccugucuggaaaaacaaggggggcgcggugcuaaauguguuaccauucuuaaauauugucuugaguauucuguuuuucuuagaacacauguaugcucacuccuuugucguaauauuuaguuagagacaauuuagguuuuaagaauuuacaugcugaaaauagacccaagauuuuaggauagagauuugguuaacaaaaaccuaagcauugaagcuaagagcauugcagagugcuugcuuagcaugccaacgccuugaguuugauucuagagaauguauacauacacacacacacacacacacacacaccccaagacaagccccuaaguagccuaaauuuggaggagaaaucuuuguuaguauguauaaauaauaaaaagcauuaggcauuauuuacuuugcuggugggaacaguaaugaucuuggcaacugaggugauuuuccugaaaguuuaaaacuguauguggauguucuuaacagcauagaguaaguguguaacagcauagaguaaguguguaagagaaugcgugcuuugccuguggaagauaacuguguucaggaacuagauguuccuguuaaauguccguuuucgguauaucccaaauaaaaaucacauuuaaccucucaaaugucacaguguaauuugcucucucugcagggcuaucaucaagaaggcuuccgaccuagaauacaaaauacaucggagaacccuucucaaggaagacuuuaucaacuauguucaagugagugagucuauagcuuuuuaauucccuucaagaauuuuuuuuuuuuuugguuuuucgagacaggauuucucuguguagcccuggaacucacuuuguagaccaggccggccucgaacucagaaauccaccugccucuaccucccaagugcugggacuaaaggcgugcgccaccacgcccagcucccuucaagaauuuuaaaucagacaguggugagcuucacagcaguuuucuacagaaauccagaauucuaugauugugugcacguuuuuuaaaauuaggaucagagaugacuguguggagggcaauugcccaauaaggcuugguccuugucagagugaacuauuuccuccuguugggucaguagaucagcaacaucauuguguaucaggauuuuagcaggaaacuugucuucuggcagugggccugcuagaggaguuugacaacggcaggcgguuggaaggucuguagagggcuugcuuagcacugucaaccugcaaaagagguuugcuuugagauuuuuuccaucuucuaaauggacaagagauugauguugagauuaaacauauaggaugaauugucaaaggagggagaauggcuacuauguacagagucagaccagaaagaugaaaaaaaauaucugcagaggccccaagagaguguugggucuggaaguguuacagaugguugugaauguggguucgggggacugaacucccccccuuuuggaauuauagccacugagccaucgcuucaguccccagaaagguaggauguuagccaugauggugcugccuagaauccuaacgcuuaaugaggcugaggcaggaggaucuugaguuugagaucagccuggauacacagugagacuugucucacaaaaaucaaaacaaaaacauaagacuuaaagcuuugcuggaucugauggcuugcacuuagaaucugaggcaggaggcauggcgguacagacuuuuagauacacuacucagaaagugaguagagacagauuuuuuuuuuucgaggcaggguuucucuguguagcccuggcuguccuggaacucacucuguagaccaggcuggccucgaacucagaaauucgccugccucugccuuccaagugcugggauuaaaggcgugcaucaccaugcccgguuuugacauacuucacuagcgccuugaacuucgccccuccuccagccuuagccucugagguauagauuugugccacaauuccugacuuagauuuuuuuuuaauuuuuaaauugaaaauuagaacaugcugcuuuaaguaggaaguuggauuaauauuauaaaucuuacaaaaucucaugcuacuaaguaauguguugucuuugcuucuuagcugccuacaagacucuuacuauagauguauguguguguguguguguguguguguauguaaauuuuauggaacuaaggugaauuuucagggcauucuagagauuuuuuuuuugaauucuggcuauuaauaacaaauugucuuuuauuucaaguuguuaacuuuuuuaugcauuucccguauuuaaaacguuaugcucuucauguuucucuuuguguuucccccucccccauaguaugaaauuaaucuuuuggagcugauccagagaagaagagcaguaaguuaaugcuuaauuuuuuuuuuuaaaguuuguuuuauguugggagacacugacuguugauagccaauguugugcccaaaguggauacuuguaauucucugauauuuuauuuauuuauuuauuuauuuauuuauuuauuuauuuguugauacugagagugagcaugugugaaggcuacuuuggauaaaugugacucauuaacuagggcuuuguuuugucccuuuuagagaauuaaauauucauuuaagaaggaugagauugaauauucuaugguacaucggguccagggugucuuuggucgugcuucagcgaaguggaaaguaagugaugagagugcacaggaagacacaugacgaugcccaguguauguaucgggaguuggauaucugacucuuuaaaugccucguccucucuguuccucuccagucuucaauacuuaccuccgugaugacaccguugcuugaagcagguuuugagccacagaagcuguuaagagcguuuaucuccucaccuuuuucuuacucugugaggaugauccuaagcacuguguuuaauacauuauuaaagauagaaaaaucaaaagaacugggcauggugauacaaacuuuacauucuagcacuuagaaggccaggucuauagagugaguucuaagacagccagaucugucuaaaaaucuaaaggggcuuaccuuuauuuuagaauugcacuggacacauuauauagauacagauuuugucuuggaacaugguuggugggaguuagaguuagauguauucucaugguuaagaaauccugucucagaaaaccaaaaaaaaggggguggaaagggacuuaccuagcaugcauaaagccccaguuucaguccccagcaccucaaaaguggugugguggcacacgccuguaugucauaccagaguuagguagaggcaggaggaucagaaguucaagguuacccucugcuucgacaguugauguuaaugguuuuuguugacuagcuaguucauuuaucccuacuuauguauuacuagcuacuuugccagguauuggauuuaaagguauuugugaaaaagaaggucugucugucuagucugggguacaugagacacugucagggaaaaggcagucaaggaaaucagcagggaccuguugggugacagcuuggagaugggcagccucccagugcguugcuguuuagcuuugcuggggacugauguaucuaagagugcucugagaaugggagguugcucucucucucucucucucucucucuuucuuuuuccuuuuuuuugggggguggguggguggugggauuucgagacaggguuucucuguguaguccuggcuguccuggaacucacucuguagaccaggcuggccucaaacucagaaauccucccgccucugccuaccaagugcugggaucaaaggcaugcgccacuacugcucggcugguuuguguuucuuuaccugguuugagaagccuuuacaauugcacuggacauauuagauagauacagauuuuugucuuggaacauggucggugggaguuagcucauucucaugguuaagagagcccaggcaucagugaggaagagcacucccaggugaggaguguguggcacacuggcucuuuuggagcuugccugcuuucauugaagugaaucaaugcagugugaagauggaacucgagcgucuucuccuaugcuucccuugcaggaugauguucagcucuggcucuccuauauaguuuucuguaagaaaugggugaguaaagccauaugcggcuucuccuucucucuccucuuaagcuucauucuguguuauugaacuccauagagguacaugguuaacaguuggagaaagaacccagggggacagaagccgggccccagugucacauuugaauaucugaccauauacaggauucuaagucacgugaaaagaaaaucauuuuauguauauuuguucaguaauaaaaaaugcuagaauauauguuuaauaguuuagggauaaaaagcaugagugggucuuguaagucucuaguaauaacagaucuuucucaguguguguggggggggaaagggggagagggagggagagugaguguguaucugucugugugucuggccuggagcuugcuauguagcccaggaugggccuugaagucacagugcuccaucugccugugccuccugagugccgaucuuaagucaggagccaccacgccuggcguccucacuugauuuucuaguuaguaagcggugguuucuguguucaggaaguaaaguguuuucucuuuugcagggcaccaaaacucaccuuagcaagauauucucugccaugcuugccauucacucaaacaagccagguaucucaaaaucuacauucuauucaaaaucaggccguuuuagaauuuauugugcuuggugagccugggacgucauuuggagagcucacucagacaguuugcugugucuuaguuuaucuacccacuugcuguguugacugucacugugcuaggcguuggauucgugcacaggaaggguggguuuuccuuucacugauggaaaggcagcuugccgguuccgugggguauauuuuaugugggggcaguaggugcugagugauucuaaaguuagaaggaggagauauuaacguagauuuauaagauagguuggcugacacaaggugugcacaaaggguaagagaaagauucuccugugaguggugaguaaggucucacugcucuucaguggaggugcuccaggaacuggagucaggguauuaggucaaccacaaguuuaugacccaggaaucuagugaucuuagcaauuucaaggccugucuuuaucgucccuaaagcaggcgugauuccuaaauugagguuucuggaggggcuacguuagugggcuuacccacgggggcaagagagucuggaaauagccgugcccaguuucagcagucacaugcucaggaaagcuaaaagcaauggcuggccgguauuugugacccuccaagaaaguugagcugugauuaccaagcaggggucauucuguguaugcgucagcauguguggguaugcaugugccuuggcacaguauguagaguccagagggaagcucauagaaggcagcucuuuucuacucuguggguuccaggaaccaaauucaagacauuagguggcaagcaccuuucccugcugagcuagcuugccagccccuccucucacuuuagauggaguugucaaacuuaccauuagaaacucccucagccccucucuuuuuccugggguaugauuaacaaauuacucaauaaguauuaaaguuggagcaucaauuauuuacugaaauuaagucuaauguuuuucuccuguagcuuuguggaucauggcagccaaaugggaaauggaagaccgcuugucuucagaaagugccaggcaguuauuucuucgagcucuacgcuuucaucccgaguguccaaagcucuaucaagaagugagugggcauguagaaugagagagagagagagagagagagagagagagagacucugugacccucagagagcgguagcaaugucuccgucaugcauagagaacaaauacagugacguuauccccccucuucugcguacuuuauuuucucaggggugcuuuaugaacauuuuguugcuacuuuuaaaaacagaggugcuggaaacauggcucaguaguuaccaucauggcugcuuuugcagaggauccagauucaguucccaccaccaacauguuggcucacaaucaucuguaacuccaggggauccggcauccucuucuuggcucuaagaggaccaggugccacacagacauacguguaggcaaaacacccguacacauaaaauauaauuaaacaaaaaacaaauaaguagaguaacauuaaaauauguuaauuaaguuaacuuuuuuucucccuuuuuugaaaucgagacuagguauagccuuggcuguccuggaacucucuguauagaccaggcuggccucaaagucagaaagaucagccugcccuugccuuccagggcuuaaaggcuaggauuaaaggcauguccaccuugcucugcuauuuuauuuuauguguaugaguguuuugccugcauauaagcauggguaccugagggggccagaagauggcaucagauccccuguaauuggaguuacagacaguugugagcagccauaugggugcugagaaucaaagcuggguccucaguaacaaguguucuaaacuguugagccaucucuccagcccaaauaugacuuuucuuguguuuuguuuuuuuuugaggcagaguuucuuuguauaguccuggcuguccuaaaacucucucuguagaccaggcuggccucaaacucagacuccaacugccuuugccucaucaugagugaugggauuaaaggugugcgccaccacugccuggcaaauaugagugauuuucaaacaugaaauuauuauuguuuuguguguguauacacguggagugcaagguugauguucugaggcuaugugaguaugccuugcuacuuuccuggaucuugguaugauuagugauccaucuugugacuauuauuuugugagacugagagggucucucuaccaucuuggaacucaauacauagaugaggggugugccaccauaccuuguacuuuuuauuguccugacaaaauaccuugaccaagggaaucuaugaaagaaagcauuuaauuuagacacucacgguugcagaaauuaaaguuccugacugucauugcagggagcauggcugcaggcaggcaggcaugguaucgugcuggagcaguagcugagagcuuauaucugauccucaggcaggcagagagggagcuaguugggagugguauguguuuuugaaaccugaaagcccauccuaaggacauauguccuucaacaagaccacacuuccuaaaucuuuucugaauaguugcaccaacuggggaccaagcauuccagugcaugaagcugugggagccauucucauucaaaccaccaccguagggaaaagacaccucuuguuuagugaacguauucucauacgucuccuccuuuguccuaaaugggauagaagucuggaucacccaggcagcacaaggcuucuuacuauaucuggcugaguuuaaaugaagccauuuacagaaccuuccauuaagucuuuugacucgugcacauggauuacacaucaagcaaucucaaaguagucucgucuuuauccgaccucaucgacaugagcuagguucauuccaaagucaaaugugguccucucauuuuccuggaucagauaguaaugguuuuuguuguuguuguuguuuuucuuuuguuuguuuuuuuaagaagccaucuugaauguuuucaauuugagagucaucucuaaggacgucuaggucauuauuuccuuuuuuuaguacuuuaggauggagcugaugcaugcugagaaacugagaaaggagaagcaagaauuugaaaaagccgccauggacaugguaagagccgguuagucuucccagccuccuuagaaaagaagaaucuuugagguguacguuuccuuccaacuuaguguuacauuuuucacuuucaaaugaguuuguaaguuauuuuaauuuuuagaaugauauuuuagugcguguuuaugucaugguguuuguggggaggucagaggucagcuugagggaguugguucucucuuggaaucuuuuccccacugagccauccaucuugugggcucuugauccucuugccucgcccucugaggggugcgguuaaaggugugcuccaccaucgcuggcucuuuuccuuuuuauggaauuuguaaugugacugaauaacuuuaaagaaaaagcuuggaaugucagagcugguguuauggggcagaccuguaauuccaggauuugugacugagccagaaggauugugaguucugggcuagucgggcuauauagcaagacccugucuucaaaagauaagacaacaaaacuaaagcagaaaccaaagaauuugcuguaccacuaguguguuucuagcucagaacuuuguguguaggugggaagugcaugugcgggguguguuuauguguucacaugugagggagugugcgagugcauguguguacauguaaguaccuguaagugguagccagagguugguguggaucccuucaacugcuucuucacauuacauuguaucuuuuaaucacauuuaagaaugcuguuuugaaggggcggggucacaugucagguguguguguggaggucagaggacaacguguucucauuguuugucacauggacccugaagguccaucucagguggucagucagcacagggaccuuuccucacagugccaucucaucagcucuuauuuaucuuuuaaaucacacuuauuuauuuguguuccacaguguauguguggaggucagaggauggauaauguagaggaguuggcucucucccuccaucauuaaccucagggaucuagccaaggucaccaggccuggcagcaggaccuaucaaugagucaucucacuggcccuuaguauuaaaauuaaaaaaaaaauauuuuuuauuuguuuugagacagggucucauuauguggcucugcucugcuuggaucauguauguuggcuagacgggccuugaacccaccugccucugccuccugagcgcugggaauaaacugcucagauacuuuuauuugugaguguguugggugggugaggggugucuuacaggcacuauaaugugugugugguggucaggggacaacuugugggaguaggauuucucuuccuaccaugugaguuccagggacuggacugucauaagcguugguggcaagugccuuucccuuuuaagcuauuuuguugguccuuuccauccuauuuuuuuaagacagggggucucuugcugaacauggaacucaccaauuugaucagacagcugaccagcagaccccauugaucccugucucuccccaccccagcacuaggguuacaggugccugccaccacaccuggcuuuuugcauaaguacuggagauaaacacuguauccuuauacuuguguggcaagccguucaucaacugagccauuuuccuggcccucagaacuuuuuuuuuaauucaaaauaguaaacagaaggcuaaucaagguaugugcgacuggaucuguucuggucuaauggagagugagccuuagagaagcagcugagugacagaacugguauucaagcugcacaccuuacaagugaaggagcuggccuugguccuguggcuggcgcugguagucuaggccuguuaaucuccauccuggugggcuguuuuuuguuuuuuggguacuuccugauacugccuuuucaguaacaguugcuauaacgcuuuguagggggauuuugaucauccugaagaaauccuuaaaggcgaguuggcacggaucauuuauaaaaauucuauaagcaagauuaaagguagguauucucuacauacuuacuuuugguagguguucuguucgugaugagaaggacuguuagcuuguaagcaaaguauacugugucuucagaaaaagcuuccuuuugagcuaucaucgggcauuucaguaagguuuuauugaguauuugacuaauuugggggaguuggaaaggaguagaugauauaaucuuugccuuaugcccuuaaguuuaugaaacuuaagaauauuuagaaauauuucaaaauguuaaugucuuuguacaugugguggggauauaggacuaucuccucucuuuguucuauuuaaaaaaacaaaaaacaaaagucaccagaaggaggcugcccguucuaacugugagcauagcuuaguguuaguuccaucaugcauuaggucauggguuggauccagcaccaggaaaacaaaaaccaagcuugguaugguggccccuaacacccgggggaacaggagguuccugauuggaggccaucugagguagggcuuguagcuuaaagugcuugccuugcagcauaaggauguagguuugaucccuaccauuaggguucgggagaggagugaguagaagccagccaugacuagauagugaagcccugucucaaggcaaaagacagcaauccccaaaagacuaacucuaauacauaaagaaaauggcucguuuagaaugaagugugucuuuacaguuuaaccgacagcagaucgcccucuccccucaacuuuuaaauuuuaggugcagaauuccaugugucacuucuugcuauugcucagcuauuugauuuugccaaagaucuacagaaggaaauuuaugaugaguaaguaaagcuauggugaggccaacaugucugcuucuggucugugauuaagaucuaaggcugggggaagaggaaaagaauauacaccgggcagugguggugcgagccuuuaaucccagcacuugggaagcaaaugcagauggaucucugaguuccaagccagucucgucuacagagugagcucugagacagcuagaccuccacagagaaacccugucucaaaaaaccagaacaagggcuggagagauggcucagcgguuaagaguuuuggcuguucuuccagaggcucugaguucaauucccagcaucacaugguggcucacaaccaucuguaaugggaucuaaugccuucuuuuggcaugcagguguacaugcacauagagcacucauauaaauaaauaaguaaaucuuaaugaagaaaagccaaaacaaaacaaaauaagaagaaaaagaaaaaggauauccuuuacaaacccuccacgggccuuugggcgugcugcucacccaguccacugcauaacguuuacauucggcaccuuuguucuuggguuccacuucuucaugucguaggagagaagcuagaacaugcaucaguuuguucuuugaauucuucagcguuuugguagagaguuccguuguguuuuuucucugccucuguuagaagaauuuaagagaccaggcucugcagggcucauggaggugucuguggccacagauaacuacugaugugauuuggagagcuauaauaauuuuaaagauaauauuuguugggguuuuguuuguuuauuuuuaagaaggguaggcuggccuugaaugugugggaaucauucugccucaggcuucugaaugcugugccaccacgcccagcuaaaaguuaauaucuguaaaugaugccugaaacauucugcaaucuaauugauauauaacaacuuugguccauugauuagucuauuuguuaagcuauucuggaacgccuguuaggaaauuacucuuuuuuuuuuuuuuuaaauuacauauuuaccauuaugauuguuacugaguauuuucuuuuuuuaaauuuuauuagauauguucuuuauauacauuucaaaugcuaucccgaaaguucccuaaucccuccccccgcccugcuguccuacccacccacuccugcuucuuggcacuggaauuccccuguacuggggcauauaaaguuugcaauaccaaggggccucuccucccagugguggccgccaucuguuaggaauuuaauaauccuaauauaauaguagauucuaucauaggauagguucgcugucacuuugauauuuugcccuauugucucuugauacacaccauucugaaggccucuguuguucuuuuuauauacauuucuuacuuaaauguuccaucaaugacacucccaccucuugaugcaaaaugaaaaaaaaaaacuuuuagaaguaaacauaggccuuccaauaaagaaacaagcuaugccacagugcagaacagaauaguacuguauuaacaagaaaccaaaugcagcaaacaugaacacuagcauauguuacauuuauuccucugaggaaauuacucuuguguuacugcagcuguaaaaggguauccugugcccuuuuguggaccauaggaauucuguuauuuucgaauuaguuucuaucauggggcaguugccaguaaacugucauuuucagccuucaagcucugcacaccgaugacccacucacuugggauuauguggcgcggcgagaauuagagaucgagucccaaccaggugaagaacagccugugucgaaacaagccaaagcaguggaaaugggccgaagggaagagaggugcugcgcgguguaugaggaggcagugaaggcccugccuacaggugcgucugucucugacugugacugugcccugaguucagccccuaguagagaagaaaaaaaggaagagaaaucucuguaugugugugagugaaugccacagcauacacgugauggucagaggacagcucacuguacuggguucucccccaccccuuuuuuaaacauuuauuuauuuuauguauaugacugucuuuagacaugucagaagaggauauuggaucccauuagagaugguugugagccaccaugugguugcugggaauugaacucgggacaucuggaagagcagccaguguucuuaauugcugagccaucucuccagccccaugcgccccccccaccccccgcuuucaaaaaagauuuauuuauuuauuuauuuauuaugaguauacuguuguucucuucaggcauaucagacgaggccauuggaucccauuacagauggucgugagccacuauguuguugcugggaauuaaacucaggaccucuggaagaacagucagugcucuuaacugcugagccaucucccuaccaccaccccucccuuuuuuaacuuaagauuuauuuuuuuuuuauaugagugcucuaucugcauguacaccugcaugccagaagaaggcauccgaucagauuauauggugguuaugagcacuguguaguugcuggggauugaacucaggaccucuguaagagcagaucaugccuuuaacugcugagccaucucuccagcuccugcuucucuuucugauaugugggcugagguccucaggcuuggcguaaagagccuuuauguguuaagcugucuugccagcuguuuuauaccuccuuuuuuugggggggggguucgagacaggguuucucuguguagcccuggcuguccuggaacucacucuguagaccaggcuggccucaaacuaagaaauccgccugccucugccucccaagugcuggaauuaaaggcauguaccaccaccagccuccuuuucuuuuuugagacaagaccucauguauuccaggcugaccucaaucuagauaggccacggugaccuugaacuuccgaaccacaaugugugguaccuccugcaugcuagacaagcacucuaccaacugaacuguauacuuaucccuguaugccucuuucuaguuguuauuucugugaugguaaaaagccagacuuuuucaugaugagauuucauguacucuaggcuggccuugaaccccugacccaccugccucugccuccugugugcugggauuauaggugugugcuagagcuuuugugaacuucuuuaguaauagagauauuuauguucauuugcuuggcauaaauaauacauauacucucagggccggggcuguagcucaguuugucaagugcuuugcagaacacgugacgccugggcuugauccccagcacuggaauaaacugcaaguacugcuucagacuuaauaaugucaaugccuuggagauaaaggcaggaggguccagaguucaagguuuaucucuaacuugagaguugaguuugagguuucucugagcugcaugaaaccugucucagaagaaaacaaaacaaagccagccaacccccaaauccuaagaaauuauaaucuagaagacugcuuauuauucuauauccuuuggagacagggucucacuaccuagccuugguuagcccagaacuuucuguguagaccaggcuggccuugaacucugccugccucugccuccucagugcugggguuaaagggaugagucacuacguggggcaccauccuguaucuuccauuagagauuucguucucauuuggaauauuaaaggcagcggagauagaaagccuagacagggaucugaguuccuguguucgcucacuugcuuucucccaauaucugauacauuugauuccauacaaugggaauaauuguuuuuaaagccggguuaauuuaaacuuguuuacagaagcuaaaagagggugucggaucccuuggaacuggaguugcagggauuguggccuacccaguuugcuauaaucuuuuuuuuuuaaaguuuuuuuuuucuuuuaagauuuauuuauuauuauaucuaaguacacuguagcuaucuucagacacaccagaagagggagucagaucucauuacggaugguugugagccaccaugugguugcugggauuugaacucaggaccuucggaagagcagucggugcucuuaaccacugagccaucucuccagccccugaaugcuguaaucuuaacucagguccuccggaagggcagcacaugcucauagccaucgggccaucuccagcucccaauuuaaacuuucuuuagaggaguuuccucuucaaagaaaggcuuuuaaagccgggcgugguggcgcacgccuuuaaucccaggcagaggcaggcagauuucugaguucgaggccagcuuggccuacagagugaguuccaggacagccagggcuacacagagaaacccugucucauaaaaaccaaaaaaaaaaaaaaaaaaaaaaaaaaaagaaagaaagaaagaaaaagaaagaaagguuuuugaacuaagaggacuggugaucuaauuggugucaucugccuuuuccagaggccauguggaaguguuacaucaccuuuugcuuggagagguuuucuaagaagaccaguagugugccccucagagggcagguaaggauuuacguugcauagcuacagugagugguuagaaagcgucuguucucugcagaacaacacugggcagcuuccagcauuucacacuuaaucgcuugcuuuuugcugugggugacccgucaucgugaagaucuagccugguuugcccuuaaucuggauauagggcaggagggcuuugugcugcuuggacugugccaggugcaggggcuuagcucaucucauccugagucacaccccagaauucugaauucucagaaaugugcaaagucccuuuugcccagcucaguggccaauggcccaccccugccagaaucucccuaaugaccugacacguuucugcuuccagaggcuggaaagaaccaugcuugcauucaggaaggcccaugaacugaagcugcuuucugaaguccaguacaagcaguggguaaggccauagagagcaaaugcagugccugguacaugggcuuuauucugauuaagguacacggcagcagaacagucagagcgagcaaagccgacuggaaggagcacucccuuuccucgccuuccucuucuucccugccaugugggugcugagaauuuagccugaguccucuguaagaauagccaguuuucuugacuguaggacuaccucuccagcccuccccuccccucuccuccccucccuucuuccccuccccccuuuuaccccuuccuucccuuucccucgcauuccuucucccccuucucccccguccccuuuuccuccuuuuccccccuuuuccuccccccuuccccuuucuuccuggcuuccuucccuuccuuuuauucccucccuuuuucuuccugacccccacccccaccccgugugcccauuucaucccuuccccuuugcuuucccuaacucuucucauuguuguggcaucgcacugcagucccagugcugggaaggcagaagcccuggaguucaucuguucagcuuaggguggauccccagcacccauguaaaugccuagaauucugugugcugaaggugaagauggauucccagagugaacuggcuaauuagauuagcauaugagugagcucuggguuuaguugagagacccugccugaugaaaaaggugagggcuauggaggaagcuaacaucacaucagucuugcauauccguacggaugaacacacauauguacgugcaccugcaugcacauuugaacccacauacaugugcacacacaugcacacaucacacacauagacacaugcaaaaaaaaaaaauagaaggaaauucugggaaacauccaacauugacgaccucuggcauauauguguauauauguguguuugugugucucucucuggcauauauguguauuuaugucucucucucucucuggcauauauguguauauaugucucucucucucucucucucucucucucucucacacacacacacacacacacacacauauacauacccccauaucagcauguacauguguaugcucacacaaacaacauauaugucuuaaacacacaaauaaauguaaaaauuacaagauuauucuaguuuucccauaaucuuuuggguaaaguuacucaaaccuuuuuuuuuuuuuaauuuacuccaacuucuuaacuuggucccugccuguaauucuggaaacaucuucugucacccuccagucauacuaaacaugaauuuccucuuguguuaaguuugucugucaucgucagccccuugugcaaacugguuggagagccuucucuuuucugggguucuguguuuaccugucugguaccuguuugucuuuaaguguuagcuggaaguucccuuccugaaguucuuucucaccguugccaugggccaugcuggcuguucugcacugcccuccuauagcaaggugguucuuguucugucgaggcaaagaucuugcugucucauuagaugggaagcucugugguagggcagagugucugguuuucugaguauuaaauuugcccuguaacaaugcauaguaaauguacuuguuguaggaaccaacuacaaacugcuguucauuggguuucuucacaauuuuguaaaauucuguuguaaacagaucgaaaguguauggguguuuggcugcacgugccuuaggaggcuaaaagagggugucugauccccugagacuaaauaaauaacuugccauguggguacugggaauugaacccagguccucuggaagagcagccagugcucuucaccccugagccguaaguaaccucuccagcccccaugagucauguuacacacuauccaguuacauuuugagaaaguuagaccugugaaugaauacacguguuuccuuacaagucuacaaacacuguuucugucuuucuucugcucugaugggugugguuccagcugaaaugacucaggcucuccgccuuucguuuguuuucugauaaaggaaauugccaucacucuguaugucugugucauggcauguguguggggagagcaccuucggaagguaauucuucccuucagugugggauccagagagcgagcuggcaggguggccuggcaggcaccucuaccugccgagccaucuaucuccucagcugucuuuaugacuuucugaugauccuuuggguaggaugagggaaaggaggaaucccagaugcccuuucugccuauuuagcagcugugguaaaggcguaggagacuaguggacuuauugucagagauagucuuucugcgcaucuauuuguaucuguaauuuugcuuucaaguggcccuuuacgugugcauugccuuccuuagauugacuuguugcugcgccaggaccucuucaaagaagcacugcagguggcagaggcugggaccgaauuguucaaggacucuguaacaauguggcagacgaagcuccaggugcucauugacucaaagagcccggauguagagaugcgcuuugaggaagccuuugcacaccucaaaccccaggucugugaacuguuucuuuuauauuucauuuuuaaaaaagauuuauuuuuauuauuuuaugugcaugaguaagauugaacccagagcagcuggguggugguggcgcacgccuuuaaucccagcacuugagaggcagaggcaggcggauuucugaguuugaggccagccuggucuacagagugaguuccaggacagccagggcuacacagagaaacccugucucaaaaaccaaaccaaaccaaaacaaaaaccaaccaaacaaaaaagauugaacccagagcuucgagcaggauaagcaaacccucuaucaacugaauuaugucucuucccccucuuuuuggaaccuuuuggaaaauuugugaaugcucauuuguacuauacuugucuguugagagcaaacccuagagugacaauugugguuaagugaugguaaguggcucaaggauugacuaggaaaguuacuucuguuucuaauccuuuauuugcaacauuacuaaaucauguaagaucucuuacucuguuuaaaucucuuaaaauaaaaaaauaccaguggaauauucuuacuuguauccacacaccugauuauaaacucgcccuguaaucacaaaaauccaaacuucaauguucuauauuuauuuggcaguaagucuuuuauauuagugagugggaaaauggacugcagagggucagguggggaacagacucaguuccugcucucugcugucugccucuccacacugaagaucaggcaggccagccuaugucaguucuuaugccguggcucccagacugcagacagaaggccugaguaguguggggcugauuggcugugggcuuuugcucgcuucacugacagaugauggcugaugauggcuacgguuggguuccccacuggaauuggacuaaauuaucaaacuguugcucuggaugacguggcugggggcuguaacccaucuuuauaguggugagucucucagagcacuucugcauagucacaucuaauggcuuccuuuuugugagcagguuugucugcccuuguggauuucuugggcagaguggagugaaagugcuaaaagccaggaggacacggaagccaucuuuaagguacaagcucccauuucugucccuugugcagggauugguuauuuuauauccuaagucacgaugaccuaguagcucgggugggucuucauaauauguuuuauaucucuaaguuccuuuuguuuuuuucuuuuaaauguagaaagcuauuauagcugucacaggugccaguucaguaacucugaaggagaaauaccuggauugggccuaucggaguggaggcuacaaaaaggccagagcaguguuuaaaagguaccacacucuaauccuaguuuugaauacaguugaaaagcauuagauagccuuuuucccuugucgccaggcuacuuuguggguuccuuuuucuuccacccuucucuaccccucuucuuuucucuuuuagcccccucaacacuagguaggagagaaaaaaggacagagggcaaaggggacaacaauauccuuagacugcuuccuacugauuaagggcaucgaguuucuuggggcgaguuugaucuucaccaguaggauaucuaauuucuucuuuucuucucugcacacaacuacuugacaaagaacaacaaauuagagccaaccagcagucucugucagggcucuagcauuuauaucuccuuugaagagucccggauaccaaaugucacacacuggcagaaacuuaucugcagcugucaaaacuacgacacugcuagagcacgagacaaaucauagucagcugcugugacagaucugaagcagccaagccucauauccuauaccagggaauuaaaacgaaaacauauucuuacaauauuucuguguuuuuaaagaaaccaaaauucacacuacauuuccucuucaaaaaaauuuaguagcagcacuuauuuaagauacaugacuaaauuaggagaucauuuggaguuuagagaccaaagaaggcaacauagagagaauuguuauaaagacaaacaacaacaacaacaacaauaacaacacaacgugugugggaaauuguuuuaggguggcgaagggucagucacuccaagcugaggcaugggacuggcuccagcagguccaguuuggcuguguuaaacgaccuguuguugggcgcaaagccuaguuauucauccauauuuauaaguuguaaaaggcuuucuguugcugcuggaacuaacauuuccacuccuuuuuaguuuacaggaaagccguccauuuucgguugaguuuuucaggaaaaugaugcaguuugaaaaggagcaggugaguauucugagcacuucugccuggaagcacaucucugugguuacacucagagcagcgcgcuguuauuuaacuuguuagaguggagcacaaacucccggucccuuggcucagccucuuuuccauagagcugcuaagaaugggaaucagauaggagaaagucaccugugaggaacaggaaacccaggcgggagaggaagcccugugcugggggagguacagcuacugcugaacuccuguguccuguuccucuccugucaggcugugcagugagcacuugauaucugucucagguggucuuaacuguaacuuaugaauacagugaaaagguaggaaggucucaguuaaaaaguaauaguuugccaggcagugguggcgcacgccuuuaaucccagcacuugggaggcagaggcaaguggauuucugaguucgaggccagccuggucuacagagugaguuccaggacagccagggcuacucagagaaacccugucucgaaaaaccaaaaaaaaaaaaaaaaaaaaguaauagcucagagagguaguauagugugcaccuuuaaucucagcauucaggaucucugugaguuugaggccagucuguucuuuguacugaguucuagacuagccaaggcuacauauaaauauccugacucaaaagucaaaacaauucaaaaucagacaaauaacucucucucucucucucucucucucucucucauuguauauauaaaguauauuucuuucuuuuuugagacaggguuucucuguguaauccuggauguccuggaacuugcucuguagacuaugcuggccuggucuugaacucaggucugccugccucugccuccugagugccgggauuaaaggucugugguaccaugguccaacccccccccccccacacacacaccaaaaaaaaaaaaagacgaauuuuaaaguauugucauauagcagcugcagagguggcucagugguuaggagcacuggcuacucuuccauagaacccgguuuugguucccagaacccuugugacuuguaacaacuguuuguaauuccaguuguagggacccaacacuaucuuccagcccucaugagcacuguacacacaugauacacacacacacacacacacacacacacacacacacacacacaugcagguaaaacacauaaaauagauaaauauauaaaaaauucuuaaaagaucagauguguacugggagugguggcacacgccuuuaaucccaacacuugggaggcagaggcaggcagauuucugaguuugaggccagccuggucuacagagugaguuccagggcagccagggcuacacagagaaacccugucucgaaaaaaccaaaacaaaaaacaaaaaaaagucagaugugugcuaucaugucuguuauauaugcuaauguauauuugcuaacaugcagcuuucuaaaagaauuguaacuguuuauaaagguagcugauggaucuaauggaugcagauacccauuuccucuuugcuucucuaaguguuuggcuuuguuuuguuguuguuguuucuuuucuuugauuuugguauuuuacuugguauuuguuuuuauuugaauuuugaaaaaucacuagugagauugagcuguuuugugcugaaguauaauauagccuuacaugcugagacaguuuagcauaauauuuaauaaucaaucucuguauugauuacuaacguaauaauuaugccuagauaagucacuucauugucagucuuccccucaucuguguaggcaggcuuucugccugugaaacgugugagagacacaaggcccagugggauaguggauaggaaagaagguggauagugccauguguguuaugauucuguagcagaguguuugcauauuugugcaugugaaguuaaacugacuguaaaauauguggcuuggagaagggagauuugaaaauauuuuuuguuuuguuuuguuuuguuucguuuuuugagacaggguuuccucuguguagcuuuugacuguccuggaacucacuguguagaccaggcuggccuugaacucagugauccuccugccucugccugagaguaaaggcacgugccaccacugcccaguguucuaauuuuuguuuuaguggugcuagggauuaaacucaugaaauaguuacuuuauacuaaaugcuccccccccccaauuuuuuauuagguauuuucuucauuuacauuucaaaugcuaucccgaaagucucccauuaccccccuccccaaugcuuuuuuaaaaaaaauuaaguuguguguuucuuuguggaaguacuuauauaggaauucggauucccuuggaggcuggaagaggccuugaguucucuggagcuguaguuacaggugcuugugagccauaggacuugggugucaggauaggaacugaacucagauuuucugcaagagcaacacguguucuuguucucuuucuuucuuucucucuuuuuuuuaaagauuuauuuauuuuauguauaugaguacauugcagcugucuucagacacaccagaagagugccucugauuccauuacaggugguugugggccaccaugugguugcugggauuggaacucaggacucucacaagagcaguuagugcucuuaacugcugagccaucucuccagcccgucuuguuuauuuugugagcaccacggugcaccugugaaagucagaauaacuuuuuuuuuaaagauuuauuuauuuauuauauguaaguacacuguaguugucuucagacacuccagaagagggcuucagaucucguuacagaugguugugagccaccaugugguugcugggauuugaacucuggaccuucggaagagcagucgggugcucuuacccagugagccaucucaccagcccccagaauaacuuuugagaguugacucuuggcuccuucuguguugggggugagcucaggcugucaggcuugguggcagguguccucaguugcugggccaguccccgccuggucuuuccuuccuuccuuucggauaaguugagaaacuaggcugguuugguccuucuccuucaaaccuaacagguaguaguugcuuaaaauaugaauuuaugaucagaugaaugaagccagauguucugauuguuuuuauaggaacccugcaagaugguaaaccugagggaguauuacgagagggcgcugagagaguuugggacuucagauucuggugaguagcugcagucucuggcuguuacauggcugggguaguguuucugguuuguccuucuuagaacaguucuucagugcuucuccugccuucuucccuuguguguguguguguguggucuugucuuuuuuuuuuuuuucuguuuucuuuuuuccccuuguguuuuuugagacagguucucauucuauguagcccaggcuagccuggaacucacuauauagccuagacuccuaccccugguagugcuccugccuccaccucugcagcaguaguguuuucuuaucacuuaaguuugcaaaccccuguauccacuacuucucuuaccaacuguggcucagagaaagauuugcuugguuugggucucuuuuuuuuuuuuuuuuuaaagggauacagauaagaaagguggaaaucauuuuuuaaaagauuuguuuauuuuuauuauauauaaguacauuguagcugucuucagauacuccagaagagggagucagaucucauuacggaugguugugagccaccaugugguugcugggauuugaacucuggaccuucggaagagcagucgggugcucuuacccacugagccaucucaccagcccccgcccuugggucucuuaaaaagagaaauuuguguggccggguaagauggcuauauggccaaaggcacuuauuuucaagccuaaagacaugaaucugaucucuuggacccacaugguagaaaaaaaggacugacuuccgcaaguucuccucugcccuacacauguaugcugugacauguugguguguauguacacacaauauaaaauaaauaacuuaugacucaugacuauaaccuuauugcuacagagguggaagcauauugccaggaguuuugaggccagucuaggcuauguaguaaguuccaggcuagccuggacuacagggugaaacccuaucucaaaauuucaaaaccaaaccaaguauuuauaaagaaaaugcuaguacaggccaguagucacagcuggucauauguagucaccauaguaggaaaggaggaacugucagugcuuagucaguuacaacagggcuagcuugcugaggcacaguguggggcugacuagaugauaacaugguacacguaccgugucuuuuaaaaaguagggaggaaaccaggcagugguggugcacgccuuuaaucccagcacucgggaggcagaggcagguggauuucugaguucaaggccagccuagucuacagagugaguuccaggacagccagggcuacacagagaaacccugucuuggaaaaaaaaauuagagaggauagaaaggaauuugaaaguuuuuacuguaaaggcaugauaauguuugaggcaauagauaggcugaacuuuaacacuacacagugcuuaaaugugucagaguaccuuauuuuauucauauauauuuacauucucuuaauuuuaugugcggaaguuucucagaacuuuuuaacuggcuuaguauuaauaguuaaauuugcuuaauuaaagccuucccaguuuucuagcuacguuuacaguaguuuuuugguuccuuuugaagaucuuuggauggauuacaucaaggaagaauugaaccaucccuucgguaaaccugagaacugcggacagaucuauuggcgagccaugaaaauguugcagggacagucagcagagcuguuuguagcuaaacacgccaugcaccaggcuggccacuaguggucgagcaccaccaguuggcugaaguugugaugcaagucucggggcagguuugugaugagcuggugugugaauugucgagagcuggcagaagaacggauugauuuuuguaacauacuuuuacuugguguuaaucuuugguuccagaaaugaguacugcuagugccuguuaaaucuaaaauacacagaaaucauaugauucagcuucaauucuuguuccaggcuaagcauauacagcucuaaucuagacuaggugugagggacccaguucaaacccaagagaaaguauaguuuuguguguucucuucuuguugugaaagccugcaugauaccuguggagauaggagggacgaggguguggauggacugccucaacccuccagcucccgaauacugauuaagagacuuuauuuaugaaagcuuaguccuuauggcuuagccauguuuaccaccuggcugaucaccucuccucagccccguacauucaaguuccaagucuggccggcagaucucccaccucucaauucuucccagaguuccgaucucuucuuggaugucccaccuuuacucuccugcccagccaucagcuguuuaucaaacaaaucagaagugauagaggagaauguguacaaucuucgaugcaggugaugcuucauaaaaauaacaguaccaaaguccggacaguacucuacugguucaaaaaucaacacugaauacuacaaagacagccuuuacagugcccaagauuaucccaacacuagggcagagcagagcagaaagucacuuagaucaccgaagugaggcugaacagugacuucuuuuccuguaucugaauuggaucuguacuuuuaaaucaaucauucaagaaauagcgccuuccuucaccugcaggaaaaagggagacuuggaagaugagugacagagaaggaggcgcuggguauugggagaaguuugucuuuuaagaagguugagguggcacaggaaacgauuuaccccaaggauggacaggccaagaauggcauggaggaugcccagcuuuguggcgggggagggagugggaagugccucaguaggggguggaggggcagauuggcacaaaggagggcauuuggggaguaagggaggaagcugaaauaaauccuuucauuuuuuuugauacuggguauuuguuuguuugugauaaaccuaaauuugcauuugaggcaagagcuuuaccacugagacagaccccaggcaucuuuuuauuuucuguuuugagcaggucucacuaaguuuuggcuggccugaaaaguucucaggucuaggcaggccuugaacuuugaaugcucuugccucagccucucaaguggcugagguuacaggccucaacagcuggaccuuaacauuuugauaucauugggaaaguauuuugaacaaguuacuuaauaguaagccuuaauuaauauuaaguucauuuaauaacauggaaaacaccuaaugaauucauagcauucccuugucuuaauuaaucuccuguggcuauaguuuuuuaaaaguauaaacgauauuggugaagauucuugucaaucuuugguuacauucacuggcacuuccuuaggggacuuacuugacaguggaauuacugaauuagguaaaagaacaaaauuugccaauuugcucuuuccagcaucacaugcaggaggcaacgcccuugucugcacuggggauuacguacuuccuuuucaucauuuuauaauucaccacucaguagaugaaagcgguacaucaucacuuaagcuacuuuuucuuauuaauuuuugucuuaaaaauacauugagagagccaggggagauggcucagcgguuaagacugacugcucuuccagaugucccaaguucaauucccagcaaccacaugguggcucacaaccaucuguaaugggauccgauauccucuucuggugugucugaagacaguguagucauagacauaaaaugaauaaauaaaucuuuaaaaaaacaacucauugagaauguuaaucuuuuguuugucguucauuucuuacagauaaguuuaugcuucucuucccuuuguuugcuguuuuugaugcgggaagauuuguuuuguuuugguuuuuaugagacaggguuucucuguguagcccuggcuguccuggaagucacuuuguagaccaggcuggccucgaacucagagauccgccugccucugccucccgagugcugggauuaaaggcgugcaccaccaugcccggccaaauuuuuuugugacucugucccuucuccccaguacugaucagaucuaugaccucacacaugcuaugugaacacgcuuccaugcuauacccucagguguugauuuugauuuuaagauaauauuuauuuauuuuauauauaugagugcucuaucugcaugcacacauguaugcuggaagaaggcauaucacauaaugguuaaaugagccaccaugugguugcugggaauugaacucaggaccuuuggaagagcagccagugcucuuaacugcugagccaccucgccagcuccacccuuaguuuuaacggccuuuucaguuucuccucuugcuuaguacaacuggaucucuuccucaagcaguugacuaacuucuguagcacuggguagcccaucuguuuguucucuucuugguucaucauacgaccuucagacccuuaguauauauugaauccuuaugcauguuagaauauauggugcauuuuugaaccuuuacugugguuuuuuuugggggguggggugggggggugaguggguguuagagacagguucuccauguaaccuugacuguccgggaacucgaucuguagaccaggcuguccucagauccaccuccggagugcugguacuaaagguaugugccaccaccaccuagccuugucauuugcuuuuuaaaauuuuaauuuuauagcugagaguggugguauagcugagaguggugguacaugccuuuaauuccagcauuugggagggagaggcagauggaguucugugaguuggaggcuagccuggucuacagaguuuguuccaggacagccaaggcuacacagagaaacccugucuaaaaaaaaaaaaaaaagauuuuuauauguaugaauguuuugccugcauuuauaucuguguaccacguaugcacaccugguuuucucuucuuuuuuuucuuuuuucuuuucuuucuuucuuuuucuuucuuuuuucuuuuuuugacagauucucacuguaauccuggcuggccugaaacucaguggaccaagcuagucucaaacucacaguaaucuaccugccucuaucccagagugcuuaaaggucugugccucuaagaggggccacacuugucacauuguaagugcuuaaauggccacaugguuaccauguugcacagugcagauaauagagcuuguauuuccacccuugcagaagauucugauagggcuugcagugacaggcagccagaccauuguggaucagcacaacagaacacacauugauuggccacauucccuuuauagaaaagucuacauagaggaaaaaccuaacauugacuaguauguaucaaaugucuauccaucacagaccagcacugccaauaaaccauaccaagucua

SEQ ID NO: 6215 - RNA, 438 nt, Mus musculus
uuuuaaaucagacaguggugagcuucacagcaguuuucuacagaaauccagaauucuaugauugugugcacguuuuuuaaaauuaggaucagagaugacuguguggagggcaauugcccaauaaggcuugguccuugucagagugaacuauuuccuccuguugggucaguagaucagcaacaucauuguguaucaggauuuuagcaggaaacuugucuucuggcagugggccugcuagaggaguuugacaacggcaggcgguuggaaggucuguagagggcuugcuuagcacugucaaccugcaaaagagguuugcuuugagauuuuuuccaucuucuaaauggacaagagauugauguugagauuaaacauauaggaugaauugucaaaggagggagaauggcuacuauguacagagucagaccagaaagaugaaaa

SEQ ID NO: 6216 - RNA, 34501 nt, Mus musculus
gcgcuuccgcugcgcgaggccgcucggggucgcucgcgggagcuaggcgcagucgggaauccggcgggccgcgcgaccagaugaagggcgcgauggagccggagcccgaggugcugcuucaggaagcccgcgagaacguggaggcggcgcagagcuaccggcgggagcugggccagcggcugcaggggcugcgggaggcgcagaggcaggucggagggccgcugcgggccuuagagggcgcgggccggagggugggcgcgcgcggcgggggcgccccgaggcucagcagaggaagugggucgcagaccugugggagacgugacauggggagguggguccugcagaguucuucaagggaaagauaaguuuggcggacugagaaagaguuuggggagcgcuccugagccgccucgcggggcacuuggugagcguaggggugguguccgaggaugaaccacgggagcaaaacccgagggaucgcagagugaagaucggaaaagagaguugggaggaagagggcauagucaggggaaaccugcgacagauaacucgguuuagaaagccugagggcacugaccuggggacaguaaagguggagacgaaguagagggagagggaagaaguaaggagaaauggagagguugagcagcagugaccuuaaugccgaaugaauggggacggggggggggggggguuguuauuugaacaucucacaagaucccgaacgccuugaacaaccuuuuagaguaaucucuagacaggcuagaacugaaggugaaggauguugaagggcagaaggagcaaaacaagauguuucagggaggguauacaaaggugaagggaaauggaaaaacagauuuuaagagaggacugguaauagaagaggcuaaauacacuuucaaguacugcaguuaucucuccacaaggaaaggucgaacagagauagcggaaagccacauggcuccucuccacucucaaagguauacagaaaaagauauaagccccugcuaaugcuagauaagauagauaauccucacauuacuauuaagugcuuuaguuaaugcuuuuugaggaaauggaaauucauuagaauuucucuaggccuaguuuuguaggguaccgucacacugguaacuccagugcugcugugccgaagcagaaaauggugaaguagugcugcgauaaucuucgaauauugucauugcuaauaauuuaaaccucucuagagcugguguaggccaggcaucaacaguugagcuagaacuaggaucagaauccagauacgacuuaugauuuaaaccugauuuggugaauacuuucaaggucuuccaaugcagacaucuggauuuccuuuggaaagaaucugcauuauuccuucugcuauuuugaaauaaauguugaaaaucuaggauuuaaaaaaaaaagguuuaaaauacccucuuuuauauaguacugcuuagucugugaauuucauguaugcauacaguguauuuuaucuuagucaccucccacaccacccccucgaacauuuuuaaauuuuaauuuuuuaauuauucauuuauuuuuuuugaaacaggguuucucuguguagcucugaccguccuggaacuugcuuuguagacgaggcuggccuugaacucaaauauuugcuagccuccaccacucagguuuuuuuuuuucuuuuaaauuuauuuauuuuuuuauauaugagcacacuguugauaucuucagacacaccaaaagagggcaucagaucccauuacagaugguugugagccaccaugugguuguugggaauugaacucaaaaccucuggaagagcaaucagugcccuuaaccacugagccaucuccuuuuuuuuuaaaacaaacaaacaaacaagaucuugcuaaguagccaaggcuauccugggacucaccauguagccaaccaaggcuggcaacagcuggaaauccuccagccucagccucuggaguacugggauaacaggcauguuuccaccauucuuggcuaaaguacccuguaauaaaugacuaaugugucagccaguucauauaucuuacacacgagcauggcuguuguucagcucccucagcaauuaagaggcauuaggguuggcacuagaagaaugagguaagcacuggguguaguacuuauuaaugucuuguguguguguugagugcaguuuuugagugauucccacccuagauaguuagauguucauuugccaaaccuagauguaugauuauggcuccgugauacuugccuaaucgaucuacagcccugaaaaggaaaguuaaacuuauauucuuucauuuuacauuuacuuauuauuucuuuauccauuguguuggugauggaauccagugcuuuagacuuacugggaaacugcacucacuaccucuugaacaguuaaguuuugaauccaauaauuuaaauucagaacauacucugauaaugaguuugguucacugugguuuucauuuguuuucuuuuugagagcccucgucuccugcucgacacagcgcauucaucacaguuuagauuuuuggugacggcgguacugcuuaugcuaaguaauaguggugucagucuccucuucagcuggagucuguuuuguuccaguuucaaguuaccacagcuacuucuagcccauugugcuuguucagauuuguagaauuaggccccuguccagucggguuuaaagaaaggucugugcuacaaaaaacguuaucaaauaagcaggagccuuugcgugguggcuaggauauucuuagaguuccagucauuuguagaucgugaaccaccagauagauggcuuuugaguaaaaacgcugcuuugggaagggugagaagagcaaggaggaagggaggcugcacuggguauauuuuuuuaccugcuuuuacuguuguuuguuuuuuuuuuuuacacuuauuuugagagauagaauccaaggccuuaugcauaccaagcaaaugcuuugccgcugagccacuuccccagcccaugauguuuuguuuuuuuaaauugaaaucaaauucacgucaagaaauucauucaguguuuuuuuuuuuuuuuuuugguuguuuuuuggguuuuguuuuuuuuuuuuuuuuuuuugguuuuucgagacaggguuucucuguguagcccuggcuguccuggaacucacuuuguagaccaggcuggccuugaacucagaaauccgccugccucugccucccaugugccaccaugcccagcuuucauucaguguuuuuuagcuuacuuauaaauuuguuuagccauagggcuagagggacggcucagagguuaagagaacuggcuguucuuccagaggauggggguucaauucccggcacccacauacauggcagcucacagaccccaguaacuccaguucuacacccucucuggccuccaucgucaccaggcacacacauuguacacacauuguguacacacacauacacauagaggcaaaacacccaaaucuguagcauaaaauaacaauuaaauguuuaaauguuuaauuaaacauuauauagccaucaugauguaugaauucuagaauguuauauuagucucuagaaauacccuguauucaguguugcucugacgaaccuaauagaagccuaccguccauuuuuagggcuuuaccuguucuggaccucucuuucccuucuuuuuccucagcuucuuuccuuuaaacagggugucguguagccaaggcuggccuugaauucucugacuagucaaggaugaccugaacuucugauccuccugucuguauuuccuaaauuuuuggauuacaggcauauacaccauuccuccaaauuuaagugguuaucaaaacuagcuacaucuuuagccccuauucuagacauauuguguaagcagaaucaugcaauauguagcccuaccugagugacuuccuuggguuagaaugcauuuccagcuaagcaguggugguaccuguuccuuagcacuugggagguagaagcuggcagauuucugaguuugagaccagccugucaacagagugaguuccaggacagccagggcuacacugaaaaacucugucucaaaaaauagacaaacaaauuaaagagagagagacagagagagagagagagagaaagauaaaaaagaaggaagaaagaucuuauuuucaggguucuucuaugugguagcauuucuuaguacuuaaguccuauggcugaauaauacuugugauaugaauguaucuuggguuauuuaucuauucaccaguugauggacaaugagaucaauucaucauuuugacaauuauggaaaacaaauauaucuauauuguuuuuuguguuaacauguuuucaguuuucuuuaggacauaccuaucaacuacugaaucacaacuuuuuucacuaaagauuuguuuagcugaauucauaaauacaguuuuaucuuuucuuucguuucuuucuuuuaaaaaguuauuuuuuauuuuuacuucaugugcauugguauuuuaccuguauuugucuaugugaaggugucucuggaacuggacuuacagacuguuaggaacuuccaugagggugcugggaacggaacccggguucucuggaagaguaguagccagugcuuuuaacugcugagccaucucucuaguucuguuuguuuguuucuuaccauuuaaaaaaaaaucucucaugauuuuugucacauguuaggaaaugguguauaucuggguaguggugcugaaugccuuuaaucccagcacugggaggggggcaguggcaggcaauucucugugaguucaaggacagccuggucuacagaaugaguuccaguacagccagagcuacauagaaauacccuugaaaaacaaaacagagaagugguguguaugaaauucugggggaagaagaauaaaaaaaaacuuuuaaaauagguaaaaaaaagccgggaggugguggcgcacgccuuuaaucccagcacuugggagacagaggcaggcagauuucugauuuugaggacagccagggcuacacagagaaacccugucuuggaaaaaaaaaucuguuaaaaacauguagcaguuuguccucugugguugaguucaggcccuacccuguuuuuagagaaaaggaaguucuguguaggaacgcaagaguugucucuaaccuaauacuuugugcuuuuugcuauuguuuuguuugcuuugagacaagcuuuccuguuaucuaggcuggcuuugaacauguuuuuuagcugaagaugaucuuaacuccuuccuccaccaagaauacagacguaucacccagcuaauccuacugcuuaaguaaaaggcuagagauagguucaauugucaggaagccagaaaauguccacagccagccuauucuuuuuuuuuuuuuuuuuuaagauuuauuuauuauuauacauaaguacacuauagcugacuucggacgcaccagaagagggcgucagaucucauuaugggugguugugagccaccaugugguugcugggauuugaacucaggaccuuuggaggagcagucagugcucuuacccacugagccauuucaccagcucccacaaccagccuauucuuacauagaaaucauuaagaaugguuuucuauaucacucuggacuccuugguacuaagaacugacuaucaggucuagagagauggcucaguaguuaagagcacugacugcucuuccaaagacccugcauucaguucccagaaaucaccagguggcucacaaccaucuguaaugggaucggaugcccucuucuaguguaucugaagagagcaacaguguacucauauacauaaaauaaauaaaucaaucaauaagaagaaaaaagaaauuaacccccauucccuuuaaauacucacuaguucggggcuggagagauggcucaguggguaagagcacugacugcucuuccgaagguccugaguucaaaucccaggaaccacauggugacucacaacuauccguaaggagaucugacacccucuucuagugcaucugaagacagcuacaguguacuuacauauaauaauaaauacaucuuuuuuuuaaaaaaaaaaaaagaauacucacuaguucauucacucaguaaguauuuauuguguuucagagauacaucuacaaccuguauacugagagaaauaaaccuucaugaauuuauucugaccugauaaguauauugucacccuuaaaaacaaaauaaacaagagaagccuaagucguguauuucauuuuaggauuuagcuuuugcuguauuuuucauuacuugugcuauuuguagaacauugauguuucuguuuguaagcagagauugcagaucaaggaugccagcaguccacucaggccuaaggcagcaguaccuuaaggccauugugcuagaguccuaggccuaacaaucgaguuuugcagauccagaaacuccaucuuucaucacugaagggggggucagagugagguaccagaaaguguauauagugagaaaugccaguguuuuagucuguauguagucuguguguuuuagucugugugugcagcuuaccuucuaaaaugacucuccugccuuuccugugucuuuuaguaggguaauccuuuagccuguaggcacucacacauucaugucuuuacucucucagaguauaugugaaauccuaauugagauauuauuuggugaagguucuuccuagcucuggccaguggugaccccugagaacuugcuacuauaacuguggcccaugacuugcagcagugacuucaucuugcaaagaaugcagaaccuugugcuucucaccagacucauuaaaucuaccugagcagggucccuaggcacuauaagaaagcacacuguaaagggcuggagaguugguuuaguaguugggagagcaugcuucuauuguagaggaccuaggcucugcucccagccccaugucaaguggcuuacagccaucucuaacucuagcuccaagggauguaauuucccuggucuccacagugucugcauugacuccauaguaccugcacucacuuguacauacccacuacauacauacacacacacacacacacacacacacacacguacauacaaauaaaacaagaagaauaaaugaaaugaaaagaauauaaagauugagaauauauauuaaaguacucagagugaccacuucacuucagcagaucuucucuaaucucuaugguuuaaccuaagaugauuuuuauauguugcauuuucuucauucaagauugaaauguuguuuaggcaugguggugcauuuuggaaauccuagcacuuaggaggcucgaggaggaggcugcugaauuccacacuagucugagagacugucucaaaacaguguugaaaauaucagaccaugcaacugaauaacugauaguuuuauuuuaauauuuuugggguguuuuguuuuugaaacugggucacacuaaggaguucuggcuguuuuggaguucacuauauaggccauguuaggcuggccucgaggucagagagauccaccugcugucuuucagguucugggaccaaaggcuugcauccacauuuccagaugaauagugcuuaccuagcuagcaugucuuuugugaccguaaggccuauaagguggccuugaacuccugcuagcaguucugccccaaucauuccaugucaucauucugguuagcaucuuuuauauucuaauguggcuagucaguggauaccuuucuguauacuguguuuuuacuuauaauuuauuuuuguauguucuuuuucuuugguugguuggucuuugaaguauggucucauucucucugaugggaccaguguccagugcaguggguucuaacuguuguuuuucuguuucagucuuuuuuuuuuuuuuuugguuuuucgagacaggguuucucuguguagccuuggcuguccuggaacucacuuuguagacuaggcugaccucaaacucagaaauccgccugccucugccucccaaguacugggauuaaaggcgugagccaccacgcccggcucugucucugucuuaagaaagcuggcaugauagacagugccgcagacacccuguuugaggcagggucucacugagcguucccugggcucagaacauucucuugucuaguccuguuagugacuguguccaacagcgaucuaccuagcuuaguauugguuuuuuguuuuagaaaacugauuucagauuacuuuuugaagaguuaauuacuacccuuaggguuuuuuguuguuguuuuuuguguguguggggguguuuuuguuuguuuuccuuuuguauaauacuagguucucuauaguucuuuauucccacaggguuugaaaacacacaguaaacuaaagacuuaugaagaaaaacauagguuguuucagaaaaccaguacaggaagucuuagcucagugaagaaaggaaagcgauuauugccgccuuuaucuuucacuucccuuucuguuacuuuuuucaagacaguguaggaaucuguuuagauguaucuugguacagcguaacacuguuauaguaucuuaagaaaacaucuaaaucuagauuuaggaaaagcuaaaaacaaauaaaaucauuugaaaauaaccuaugauuacagucccagauagcugugguuaauuaacauuuugauguaucugucagugcauauucuacagagaugagaaacgccuguguauauauaacuauguaucuuacauuuuucuuuugauuaacaguauaagcauuuauuaagaauauuuuuccaggcuugggguguugcucccuuguguauguuauucaaauccugagauucauuaccagcucacaaauggucuuuauuucauuuuauuuauuuuaagacagucaugguggcauaugccuguaauuauaguacuugggaggcagacucauguggaucucugugaguucaaggcuagccagguccacauagggauuuucagggagcauuguguucacagauaauugugaccccacgaccugacucucaugugugugcugggauugagcguuaguccuuugcaaggccagcagcugugcuucuuaaucgcugagcuuccucuccaucccacggucuuagagucuguaagcugcuucuaguuuguuuuuaauauggauuauaauguauacauacuuuuuuuucuuacucuuguuuuuuuuuuguuguuguuuuuuguuguuuuuuuuuuuuuuuuugagauggguuucucuguauagcccuggcuauccuagaacucaaucuguaaaccaggcugaacucgaacucagagauccaccugccucugccucccaguggugcugggauuaaaagcgugcaccacuaccacccagucuguauuuauuuuuaagagacugugugugugugggggggggggggcaugggcacaaauggaugucugugcacccacauucaugcaggaucugccuaggccagaagaggauguuagagccauuggaacugaaguuacuuacacgggauugugauugugagugaugcaggugccaggaacugacuccuguuccuuuagaagagcacugaggacuuguagccucugagcuaucccuccagucuguguguguguguaagauguauuuuaaguauaugguguuuaccugcauaccuuugcauuauguccuuguaggggccuucugauccucuagaacuagaguuacagauagguuuuaggaaccauguggguguugggaacugagcccagaucuuucccaagacuaacauguguucuuaaccacaagucaucucuuuagcucccaucauauauauaauuuuaauagagaaauccaccugccucugccucccaagugcugggauuaaaggcguguugccaccacugcccgacaaagugugacuuucuugaucuucaguuucuuugucuguaaaugaagguuaaaaaauacugcuuacuuuaccuggccagugugggaacugaaguagaguugggcuugguggcggcccuuuaaacucaacacaggaggcagaggcaggugaguaucugaguuugaagccagccuggucugcauagagagaggccugucucagaaaacaaaaaaguaaauaacauaaaguaagaaguacuguggccagugagauggaugacucagcaaguccagugcuugcugcccaugucugagaacuugaauuugaucucuggaacaugcgaaaagaugggcgaagagaaccuaauccaugccuauccucuggccuuuaccugcgcgcugacgcagcgugugcccucucccaucacacacacacagaauuguaaguaaaacauuuaauaggacuauuuaaaauguuuagcacaaugcccaggacaauaggauguucucaacuaauauuagccacaauaaaacuacuaaaaauuguuguucaaggugacaucuuuugcuucuacugacagcuuauuuuuuaaaugucugcuauguuuuuccccaacaaaaugcccuuuuuuaauuuuggugguaguuuuuggcugucccauuuauauaagaacuuaauaaauuuuauuacaguuacuagugugcaaaaccuucugccuccuuuuccaaaaugaaagguuuuguuuuguaggcuggcuugaaacuugagguguucccgccccaggcucuugaaugcugugcuugugagugauaugccaccauguccagagaaugaguucuuuaaggucaagaucaugacauauuuauuguuuuguuuuggggugauuuuaauuaauuaauuagcuuuuaugugcauuguguuuugccugcauuuuugucuaugugacgguaucagauccccugaaacugggguuacagacagguaugcucacacagcugccaugugguugcugggcauuaaaucuggguccuuuggaagagcagccagugcucuuaaccacugagccagcucuccagccccgccuuaaucguuuuuacaauccagauuccuggcacauaaucaacucaguaaacauguaaaugaaagccuuugugaauguguggguguaguuuugcagagauucuucuuagauuguaaucuugaugaugugcauuuucuucauuaaugcaguuaaucuagaguuaaucaucugucucaccaugcuguuugauuaucuccugcuguauaauaaacugcaaaaguucagcagguuagaagcuguuaguucuuuggugcagcacauucauaaucuuaucacuaaagcugaggagggaggauuccugggaguauaaggguagccugggcuacauaaugaguuccaggccaaggcuacuuagugagacacugucuaaucacaccugacucugccuccugagugcuaggauuaaagguguggucuuuuuuuuuuuuuuuuuuaaagguuuuauuuauuuauuauauguaaguacacuguagcugucuuuagaucucguuacggaugguugugagccaccaugugguugcugggauuugaacucuggaccuucggaagagcagucgggugcucuaacccacugagccaucucaccagcccuaaagguguggucuuaauuaagguuuaaauacauuuuauaggggcuggggagauggcucagggguuaagaguauuggcuguucuuccagagguccugaguucaauucccagcaaccacaugguggcucacaaccaucuguaaugggaucugacguccucuucugaugugucugaagacagcuacaguguacucagauacauaaaauaaauaaauaaaucucuuuuuuuguuuguuuguuuuuugcuuuuuugagacaggguuucucuguguagcccuggcuguccuggaacucacucuguagaccaggcuggccucgaacucagaaauccaccugccucugucucccaagugcugggauuaaaggcaugggccaccacugcccggcgauaaaucaaucuuuaaaaaauacauuguaugaucuuuuuaaaugacuuauuuauuuuaugugcauugguguuuugccugcauguauagcugugugaaggugucagauacucagcagcuggaguuauagccuugugagcuaccauguagaugcugggaauuaagccuggguccacuggaagaccagccaguguucuuaacugcugagcaaucucuccagccccaacuuuaugaccuuuugauaacuaaacucugaggaaaguaguucaguuguguguugucuuguaucaauggauaguauuuugugagcucaucauccuguuaccuucaaaagguuaaacagugagcuuaaauaaucuugucacuuuuaauaaucuugcaaggauggccggugacagcaaacuuuuaauccagcacugaggaggcagaggcaggcagauaaaucucugugagcuccgggacagcuagggcuagagagagagagagaaagagaaagagagaaaggaagagaagagaagagaaaagaaaaguuuuaaugaucuugucacacuggagguuucaguaggaguucagaauaugacugacgaauauaaacuguauaaauuacaguuuccuccuggaguccuuaaguugccugccauuuauacuuucucucucucuuggcuggccuagaacuaucggcauuguuuccuaguauagcacuggcuagucuggaacuuauucaauagaucucuggcucuugccucuacguuugaguguuuggauuacagaagugugccaucuugcuuggaacuuguuaaaaucacaucuguaagucaaaaucaccucgguagcaagaacauggcuccuggacucagauguggggcacagggaagucuugaguuuuuuucccuccauuguagacugugcagguaugaugcuguagucagauaagaggaaacacauuagccuaccucaaacugggagacucaucagugaacuguuuucauaaagccaaaaaacuugauacuugauuacuaugguuagauuaauguugacugagcuuuaaacugugagcuauuuuuuggaagaagaaaaugaucuaagggaaaaccaaggagguuugaaaaggcagugguugguguucugugaacaacagacaccacaugcaugcccggcgagcgccuggggggcagguuuggaaguggaggcuucccuccacaguccucacuaauguugacauauuuccucuuucccuaagguugucagacaaaaccaacaaaauaacacgggcuugcaauuucugagggagcuucugaauucuuucuaaagaggaaauugacuuuaccuaaccagggcacuuccugcauaugcuguauccguuaaagagccaggcagggccuugcugguucagugcucaagugcagaguuuccucuuagaggaaggucugaaauguggcacaguggacuuuauucuaccuauauugcauuuauaaaucaaccauggucuuaaaaaauucagguucuggggcugggccugagauguagcucaguugggagaguauuugcccacuaugcuugaagcuggacauggggggaccuaccuguaguuuggaggggugaaagaagaaagaucagaaguucaggauccucuugaacuacaaugagauugaggcuugguauccaugagauauugacuuucaaaauaacaaacaaaugcaucaggucuagagccugacacugugcauugcuaacaauauaaaagucauaagacuuucuuucuguaguuuuuuaguuuauuuuuugguuuuucgagauaggguuucucuguguaaccuauucuggaauuagcucuguaaaccgggcuggccuugaacucagagauccaccuaccucugcuuccaaagugcuggauuaagggcuugugcugacacacacacacacacacacauacacacacguauauguauauauuauucauuuuugguagguguauguguguguauguguguguguguguguguguguguacacauguuaauauuccagucaagagaaagcuggcaagaggauuaagaguuagaauaguauauaauagaucauaaaacuacuauuguuuguaaaacaaaaugauggcuuugggagcucuuuuuuugguuuugguuuugguuuuuuugguuuuugagacaggguuucucuuuauagcccuggcuguccuggaacucauuuuguagaccaggcuggccucgaacucagaaaucugccugccucugccucccaagugcucggauuaaagguaugcaccuuuacugcuggagauugaaucuagaugcuuacacuccugagucauaucccaggucguguguuugaacugucccacuuauaguuaguauuugagaggaaauggacuguguuuuauccauuacauuuuuuuaaaaagauuuauuuauuuauuauaucuaaguacaauguagcuguccucagacacuccagaagagggcgccagaucucauuaugggugguugugagccaccaugugguugcugggauuugaacucaggaccuucaggagagcaaucagugcucuuaaccgcugagccaucucuccagccccuauccauuacauuuuuguuguuguuguuuuguuuuguuuugaagacgggguuucucuguauagcccuggcuguccuggaacucacuuuguagaccaggcuggccucgaacucagaaauccaccugccucugccucccaagugcugggauuaaaggcgugcgccaccaugcccagcccauuacauuuuauuaaacaucuggugacuacaaacagcuuauuugcuuucagaauauaugugagaugcaaagacuuuucuguuauaacuccuagcacaaagauuuuuaaacuuggcucuguggaccgaggacagugcaucuaaaaugugggcagacucaccaaugugccugugacaagugagaguucugagcguaugucccuccuacuccuccuaagcuguguucaguuggucucaacccuguagucugaguuagcagggagcacacagaaucccuuugcaaagaacauuucauaaucacaacucgauccaguuaucggccagcuugucccaccaaucaccgagguuugugauuagugagagauuguauucaccaaaaugaaaugaacagugaucuaggaagacaucugugccccugcgcguaugcgugcgugcacguacacagacagacagacagacagacagacacaaaaguaaagcagauuuaaaaaaaaugacagcagcagcaacaaagcugauuauggugacacaugcuugucaucaagaggcuacaugaaacaagcaaacacgagggaaggauuacaugaucucauuucuguagaaucugaaaaggauucauaggagcaugcaguagaauacuggucagcaggaacaagguggggagaaauagugauacgugguaccacggugcaggguuucugugauaggaugaacauauucuggagcauuaauguauagggcagggacugugcccugaacuauauuguauuuugcaaauugcuaagagagagcuucaguguucuuaccacagaaaguaaucauuggguuggcaagauggcuuguuggauaaagguacuugcuccaagucccaaaaccugaguucaguccuugaggcccacaugguggagcgggagcacugacccucaaaagucuucuacacacaggugaaggcccaggugcugugcacaggagcucugcacacacauuccuuacaaaugcgugcucgcuugcgcgcucucucucucucucucucucucucucucucucucuccauauaguuuuaaaaguuuucuuuaacuacaucaaaccaggugugguggcucacaucuuucauuucagcacucuuggaucugaguuugaggccagcuuggucuacagagugaguuccagaacagucaaagcaauacagggaaaccuugccccuccccccccccccaaaaaaaaaaaagaaaaaauaaauaaaguaacuaugucaaaagauggauacauugauuagcuugacagaaguaucaacugcucauauguguaucaaaacacaguguaccuugaguguauauaacucaauuaacaaaaaauuucuugugagagcaaguuucaaauuuaugagcguuuagccucagccuccugagugcugguauuacaggcuuguucucccaugcuuagcuacauuaaaauuuucugcuaagcugaggucagagggucacaggaucagagcaagcuccaggccaggcagaccuauacugaagacccucucauccccuacccuucuuuuuaaaugagggugaucuggguugaugaugcacccuguaauccuagcacuuagaagguaagaagauuauaaacuuacuauguaacguagguuacgugguuagaucucgucuuaauuaagacaagccaaagaagggagcacugugguuauauaauaacucagcaguagaaugcuugccuagugugcaugaggccauagguucaaucccagcacaacauacaaucuuuuuuuuaaugaguggaagguggugguugugugauacaauuagguaauuaugaaugaugccuguacgcuaacuuuguguaaagauucugaacuugaguuuuauguucuuuuuagauaaaggagagugcuucacagacaagagauguccucaaacagcauuuuagugauuuaaaaggaacccuugggaagcuauuggaugagcgauuggugacccuuuugcaagagguggacaccauugaacaggagaccaucaaaccacuagaugacugccagaaacucauagagcauggggucaacacugcagaugaccugguccgagaaggugggacgaagggaaccuguuaaauccuuacacuccgauggaugccugggugauuucguaggauacuagcagauuucuuaccaucugaagagucccugggauguuuuugccuugaaauaguuuauaauacaggaccauagauaagcuaugaggaacccuguauaaucaaaguauugauuagaaucauuuauaacacuaagagugauuguuccagacggugcuaugauuaugguaucugauacacaauuagauugugaggcacauacuuguuuguccuagcacuuaaugcuugagguuuuuuauaauucagaaauguuaguucuaaacuucugucuuauguaucccagagauauagcucucagggcagcaggcuugguggcaaaugcuuuaccugcugagcugucuuacuggcucaugcauuacauuuucaaucccuuauuuagcagguagucucaaauuugcuuucacagcuuuuguguauuacuguuuuguauuuuaaaaaaaaaaaagauuuauuuacuuuauuuaugagaguauccugucacugucuucacacacaccagaaggucccauuacggaugguugugagccaccaugugguuucugagaauugaacccaggaccucuggaagggcagucagugcucuuaaccacugagccaucucucuagcccauacuguuuuguauuuuuaagacugggucuccuauuaaugugcagacagucaucaauuaauucucagcaguccauuugacuaaacagcaugagcacugggcuuauugccaugagccaucgcacccaacuucagauuuaauucuuuuauuccaguauuuaggcagguuuuguuguuguuaagauauguauaggucuuagugugaucaccaucuuccuuccuugguguugacaagugccuuccaugguggcacuuguuagguauuuucuuuuuuuuauuuuuuuauuuauauauauauauuuuuuauuauguauuuuccucaauuacauuuccaauguuaucccaaaagucccccauacccuccccccccacuccccuacccacccacucccacuuuuuggcccugguguuccccuguacuggggcauauaaaguuuacauguccaaugggccucucuuuccagugauggccgacuaggccaucuuuugauacauaugcagcuagagucaagagcucuggguacugguuaguucauaauguuguuccaccuacaggguugcagaucucuuuagcuccuuggauacuuucucuagcuccuccauugggggcccugugagcauccacuuauguguuugcuaggccuagucucacaagagacugcuauaucaggguuuguuagguauuuuaaauaagaagguaggaguuguguuucuagcugggcaugguagcccacgccuuuaaucccagcacuugggaggcagaggcaggcggguuucugaguuugaggccagccaggacuuccagggcuauacagagaaacccugucuugaaaaaccaaaaaaaaaaaaaaaaaaaaaaaaaaaaaaagaguuguguuucuugggguuuguaauucaugagagucaugcugaguaagaucuaaaaucuuaagaacaaagggcucugucuggagaaguacagggcagcccucugugggaacuccacugaggcuuggagaaauucaucaagcaaaggaaaggggccgaugugcuucugagcagaaggacuggcaggagcggagugaauguuucaggcgagaguuauguaaugagacuggcccaggccucacaauuacuguguagcuaauuguaauccucacugagccauguuuaucuuuuacugacauaauagugccuuugagaacauucuuuuuagcagaaccacagaccaucuucccccggaggcugugaauuuggaaacagacccagaagcaggucagcacagggcaggagugugcacacccaucucauugaggacugugcuuucauuuuugaaaauaaauccuuugaggcacauacuuguuuguccuagcacuuaaugcuugagguuuuuuuauaguucagaaauacuuuaaguuuuaaauucuucccucuuccucccaagggauaaaaagcuucucugugugugugugcauggggggggggggguuccuuuuuuccucucuuucuuucuuucuuucuuucuuucuuucuuccuuccuuccuuccuuccuuccuuccuuccuuccuuucuuucuuucuuucuuucuuucuagauuuauuuguuauauguaaguacacuguagcugucuacagacacgccagaagagggugccagaucucauaacggaugauuguaagccaccaugugguugcugggaauugaacccaggaccuucggaaaagcagucagugcucuuaaccucugagccaucucuccagcccucuuuuuuuauuuuuauaaguguuuugccugaauauauguauguguaccauggaauacuugguaucuguggagaccggauccccugaagauagaguuaucaaugugaaccauguggguacuaggaaacaaaccugguuccucugcaagaguaauugcucuaaucccugagccaugucuccagccuccgagguuuguuuguuuguuugcuuguuuguuuuguuuuuauuuaaaagacagagccuccuaacccagacuggcuuugaacuuccuauuagcuaaaggugcccuugaacuucugaucacacugccucuacuucccaggcacuagauucuuuuugaaggagcauucagagugucuguguuucuuucaguaaagaaggucauauucucucuggaaaacuugaguuggggcuaacaagauggcucauuggguaaagguacuugcugccaagccugaugaccuaagcuugaucuugggaaccacaugguagagagagaggaccaccuccuguaagucauccucugacuuccauacgcaugccauggugagcaugcacccuucccaaucucuuagaaacuccaggaugauaugagaguaucuuucaucauuguggacaguguagaggcuggccauuucuauccccucuacguagccuuccuucuuaggcuguguugaguaauuucugauccaaauagugugaguguauaggaucucauuauauagcacaggcuugucucaaacucagaucugcccuccuuccucugucucacaagugcuaggaugacaggcaugucauuggcaucauuuggcuguuuaagauccuauauccuacuguugcuuuuaggauagcacuuuguuucuacuagaacugacaaagaggagccaggaauuuggugggagugcugggauuaaaggcaccacacccggcucgauauuuuaccuuuaaaaagacaguaaaucccagcacucgggaggcagaggcaggcggauuucugaguuugagaccagccuggucuacaaagugaguuccaggacagccagggcuacacagagaaacccugucuuggaaaaaauacccaaaaaaacaaaaacaaaaaaagauaguaaaaagugcuggccagguggcucaguguugaaggagcuuggugccaagccugacagucugagguaggucccugaaacucacaugguggaaagcaguaacucgaacaagcuguccucuagucuccacauaugcagaugucucuucccaguaaauuaauguaaggaagaaacaggaugaaaaacucuuaauugauaaauaggaaugaggaaauguccccgaccuucugcucugaauaaaacugguuguugaacuagauuuucaguuauagagcagaaucuuuggucucuggcaaaaauuugccaaaccccccuuuuucccucuggccuaccaagucauuuugagaguuuguuggugcauagcucagcaguuaacuuugaacaaagcuggaaauccaauagacaugagcuuuguugguuacuggauaaucuugacuuucaaauguggcugguuuuguacucagcuaguuuucuuacccucaauuguaggugagauugccauucuuggugguaucgaagaagagagugauaaacuguggaacuuuaccaaaaaggccucacacauucagcuggacagguaacaacagucucuuccuuuagacuuauuuuuaaguacuuauuuugcuuuccucucaauuuuucgacgaaaaaauugugauuacaggaaauagagaaucugguuuucaaaguuauacuguccauuaucgcuacuucugguguuaaacgguugugguuggaaucuuugacguagaauuauagauucuuuucaaguccaguagagaagagaauuguuaaauuuaaaacuucuggugccugcuuucaaagcagcacacggugaaguugggagcacuacauagagaauugucaugguccgugcacaagaaaaacauuuuaaaugucuuacugcaaccaacucuuacuucaguaaacaagaucuuuugauagaagcucaauaguugugaguuuaucaauuuugucuuuuuuuguguguguguuuuguguauauagcucaggcuaaccucuggcuugugauucucguguuucagucucuggagugcugacauuguaagcaugugcuaccacaccauuuccaguuuuuuugucuugcuuauaguuauuggggaagagaaucuuuauguaauaugaagaugaaagccccucacaacaaaggcuucagcuucucacuuauuuguugaggccuuuaguguucuucuagcgugugaccagucuaaaauagucguuucauuuccuucuccauguuaagcaucauuuaaacacuagaacuuuguuuccucagcuuaccagaagugcccuugcuaguugauguacccuguuugucggcucaguuggacgauuccauucuuaacauagugaaagaccacauuuuuaagcauggaacaguagcuucccgcccaccaguacagauugaagaauuaauagagaaaccuggaggcaucauagugcgaugguguaagguaugugccagucgcagacgcgguaucacugugaugggcaugugacuggggacuucuacgauucuucuuagcuaauacauuuuucucuuuccaaaaaaaaauccccccugcugucugucugucuguguaucuuccuuccuuccauccuuccuuucuuucuauuaauaaauuaaauuaaauucacagaaaauguagaccaagguaguucuucuucuaguaucaaauaaagagcucaagguuuguuuguuuugugugcuggcaguccgagccccaugaaaggaucucugacaucagugagaccgcagaggaaguucuuccacguaacguaacaguuaaggaacugaggauuucucccuucucauugcuucaaaaagccagaagaugauagugcauuuucagcuuaguucaucuuaauacuuguuaagauuucuaaaguauaguacugucauggaggugcacacucucagucccagcacucaggaaguaacacagcuguaucucugugauuaugaggccagucugaucuacauagugaucaaaccagccaggacugcacaccacuaugugucaaaacaaagcaaaagaauaacgaaacaaauauuucuguaguuuccuuacacuugguauuuccaagaauucuguucuuucuuuuuuaaauacauuuuuauauaaauauaugugugugaauauacuuuuuuuacauauauucuuuaaaucuguauaucugaguuacuauauuuuaauuagaaaccauguccaaauuagccauuguaucuuggcuguugauaaaucauucagagcaagaaggaaggaaccaggcacgcuaacauagcauugggauaccacggcagggggguggucaguucaaggacaggcuggaaaauagaauaagacucacucucagagaagaaggaaaggagaagcaacugggugugauaaugcaaaccuguaaucuggaaguugaggcaggaagaucaccaugaauucaaggccagccugggauacauauaguaagacccuaucucaggucaaacaaaaggaaaggaaaggaaauacugauagcauguugucugugccuucucccagaaugguccauacugccccuguucagcacauagaccuguguguuggucuagauguccugguucuguggauuuuaccuaacuuaaaaauccuucuccauagguggaugaugacuucacagcccaagauuacaggcuucaguuccgcaaauguacugcaaaucauuuugaagacguguauguagguucugaaacggaguucauaguguugcacauagaccccaauguagauuaucaauucagagucugcgcccgaggagacggcaggcaggaauggaguccuuggaguguuccccagacaggccacuccacacuggugccucaugguauguaugcucuuaccaugucagaccugaagcuccaugggguauagaaacuuuuuuucaccuucugcugggauuccuagccacuuuuccuaaggauaauccugaauugagagacuguggaaccugccuuuccuuagaucacucauggaaaugauuuucaucacaucuguguaguagauuggccuuuggacucacaauugaguaucaccuaaaaccacacacugaaaauggugccgaggacacugacuuuucuagacccucuaaaagucuuacaaacuugauguuggucuuucuccuccauuacugauuuaaagggcauacuccuuuuuccuagaauaguuaggaucuugcuguguugcccaacauuauuuugaacacaacaagacucauuucagcuucccagguagcugggcuacagccaugagccacauaccuggguaucuauacacuuaguagcuuuauuuuguuuuucuuuaaagauauauugggcuagagaaauggcucaaugcuuaagagcacuggcugcucuuccauagguccugaguuuaauucccagcaaccacaugguggcucacaaccaucuguaaugagauccaaugccuucuucuggugugucugaagacagcuacaguguacucauguacauaaaauacauaaaucuuaauauauauauuuauuuguggauguguguggauguguucacauguuugcugguucuguggaagccaauauaguuauaggcugccauaagcugacugaaaaugguguugggaacugaacuuugauccuccacgaguguucuucacagcugagugaucucuccaguuguuugauauauucauuuuaacguggugcuauggguuaaacucagauccuuauacaugcuaauaaauacaugcucuauuacagagccuugucucuaucucuuauuaacuuauucuuauugacauuggaauaaccucaaauuauuaaauuuaaacaauuucuuuuuuagauagaagaccaucauuuaauuuuucaaauaguacaggaauuuaccaaacucuuuuuuuuuguaauuugugggucuaagcccaauucuuuguuguuaaauauuuauuaaauuuagccaagaucuuucuaaguagcuacugucacucaguucuauucaauguguguaucccuugaaaagaucauuauaauuuuuuuugugucuuugucuugaaagaguggacaacuggcuuugagggauacagucugagcagucgaagaaauauagcccuccggaaugaugccgaguccucggguguucucuacuccagcgcuccaaccuacuucugugggcagacgcugacauucaggcaaguggauugggacaugccuggcaugccucuggcuguguacuggagcguguggggugugccugagucugagcuuggcacgccccagcuuuaguccaucucuuacagggucagcuuggcaacgcuuuuguuuuguguuguuuuauuaaaacaggguuuuacuguguaacccuggcuggcuuggagcucacaaagaccagacugggcucaaacuuagagaagucugcuugccucuuuuccaagugcuggaauuaaaggcgugccuaaccacaccaggcuuuugacaaggcuucauucagacuuuuccuguuucaguugucugugucugugggguucuguauaaaagcuugguacuugauuuguuugucucuuuugcucugguaaguaaggaugaauagaauaccuguuagaaguuuuuaaaagucagaggcaugguggugcaaaucugucacuccagaacucaggagauggaggaauucaagauggccucagcacaaagcaagucagcaugggcuguguaagacccugucuguacaacaaagcaaacugcucggaggccaagaauuauuuuucccuuugucucugaaaagcagcuuacuguuaagagcacggcguguguguaacucuguaaaauauaacugaaagcacgccuucccugccaucagcucuccuuuaccugcuuucuuguuagccgagcaguguguucuauggucguauuucuaaauagcucuuuguagaaaaccaaagcccagaugcuuugguuugguuugguuuuggcuaagcccuguuuugguuugagugauuaaacgugugccuggcuuuuaccaugcguacuucaggguaacagaaucuccgcaagauuuuaagucucaagauuaucaaauauuuuuauuucuuuaaaaauguucuuaauugggcuggagagaugacucagcaguuaagagcauugccugcucuuauagagguccugaguucaauucccaguaaccacacaguagcucacaaccaucuguaaugggaucugaugcccucuucugguguguguugacagggugcucaugucauuagauagauagauagauagauagauagauagauagauagauagauagauagauagauagauagauagacaaauagauaaguaaauaaauaauacucuuuaaauguuuuucuuaauuacaugugugugcauugugggauacaaacuugcaggaauggauucucuuuuucuaccucguagguucuagauuuccaaucccauucugggcugugaccagugucuuuauuagaacccugagcaucuuaccaaccucauaugguagggauuuuugucuguucuguuuucuugugugaggcgugggagaacaucuggaaguuuugucugagcuaguguugcuguguuccccuucagccacaucauuugaacugaccccacugucaggaugguuaaugcuuugucuuucuuuugacaccuccucuuacccacuaagucguaaagaaagaaugaaucaccagaagaaugccaagagaggagaaaaaugagucuguuagcuuuccacuucuacaaauaagcacuugagauaaugggcucacagagaagagggccgucccugcucaccuccaguacuguagccugugacaagucggcuccauuucugugggcucgugucagcuguuagguggcaggauuuucucccuaacagggccugcugaggaccaaaccauugauacuugugccucucaggagcauggaaauaauucuauaucuaauuauggcagaaccugaaacccaaaaccugcuuaugccccacguagugacuuuucuuuguagagaaauaccuucauuagugaaauuccugaaacccagguacuucugcacagcagcagaccuccuacaaccuguagauagaggcuggcuagagugccaaugagaaugacgauaaauaaauuauugcaguugcuaucuaaaucugggccaagggcuagugcgugugguuucauguacccaggcugaguagcuggggaaagccuuggacuuccacuucccaagagcagauauaagagcugugcacuacuccacuggcuuauuggugcugaggacugaacccagggcuugguaaaugcaaggcaagcacucugcugccugagcugcgaagcaaacuucauuguugucuuacaguaaccaauuugaugaguguaguugaccauuuuaggagggagaaaauugaggcacaaagaaguuuauuauucagugucucacagcuaguaaguaccaaagcugagacugaaguccgggagcugucuccagaauccagugguuaugccugccucggccugcugagugggagagcugugcacuaacgaccacacccagggccgucuuagccacuggccauuucgucugucucugcugucuucugugaggaaggaagugugaaggcugcagugccgcugguguugguguugguguuggugcuguagcugcacgucaggccuggggcauguaaagcauuuguucuuccacggggcugcccccuucccuuuccgauuuuaguaucuuuuccucucuguauuucuugauccuaaugcugucuuaugguuucgauucccucuguggauacaaaggaauauuugauugauggcuuccauacuugucagcgauauagacugauaggaccucacggccuacuaucugcugacgggucugacagcaggcuuaaucaaacucucucugucuucgcccagagaagucucacuugggccucucugggcagggugauuaacuaagacuccauucugcucagucucaggcagacuuugcaugguugucauugaaugugaacuaagagucuccuacccguguucaaaggguaaaccuggagguaagugggggucggggcagcugaguguggcugaacgaggggcuucugaaggaccugcucuuuaggagggcgcuguacacucccaggcacuccucuuguuuagccagcuugucuuugcuguggcuucuggauggcuugcagguaugggaaccuuuuggcacugugacuugguguugucaucuagaaaaugugcacuuaaggacugaacagugccauuauaggaggguggggaguaccagguuuuuuuuuuuaagucuaaauauuuuaaauaaguaugcaauucuguguugggauaaauucauaauuacccuuggcugcgugacugugggcacggcuuggacaugcuugguagaaccucugaagcaaugaggccuuguuucuggcugaaugcuuagccucucugccauggugccugagucugcugacggcccuucuccggaccucucccaucuccuggcugaacauuccuguuuucuuugccugcuuuuaacuuuuccuggcaucaucaauuuacuuuuuaguuaugugugucugugugcaucugccaugugagugcaggugcccucagaggccaguugauccccaggggcugcaguuacaggcaacaacaguacauguucuuaccccugagccaucucuccagccccuuauuaauuuuuaaacuguaugguaaccucuuuucugucaucuguuucuuaguuuguuuugagauggggucuaguguaucccaggcuggccucaaacucacuauaaagccgagaaugaccuuaaacugcugaucuccuugcguccaccucccuacugcagagccugugggcaugcgcacucuccuuuuaugcugagcuaccaaaccgagccccaccaccuguuuuuuuaaagcagcuuccuuuuuuaaguuaagaaacaaaagcacacggggaucguaugucaggcuucaaaucuuagaaguguagaguuaccccagguugugugcucagugcugucuacucauccugcugucacaguuugccuucuguugcugggauaaaacacugacuaaaagcaaccugggaagaaggauuuauugcaucuuacaggucacagucccucaccgagggaagccagggcaggaggugagaggaacccuggaaucgggaacugaagcagaagagauagaggaaggcuacucacugucuuccucuggccugcuuagcuacccgucuuguauaccccgcacccaccugcuaaggagugguauagcucacagugggcugggcacuucaccagucgcaacuuaaacaaacaggcagccguucacuuguguuuugaaacagguucucacugugguauucugguuggcuaagaauuuaauaugugggcuggagagauggcucaguggcuaagagcacugacugcucuuccgaaggucccaaguucaaaucccagcaaccacaugguggcuuacaaccaccuguaaugggaucugauuaccucuucugaugugucugaagucagcuacaguguacuuacauauaauaaauaaauaaacaaacaaacaaacaaacaaacaaacaaacaaauaagaauuuaauaugugcccauuccggucugggacuugcagcaacccucuuuucccugugccugggugcuaguaucauggcaguacucccacccccagagguuaauagcugugagcuaugugaauuugcuucagugcuugcuuuggugccuccuccauuccccacccccagcaucccacaauaagggucuuaguuuauagccuaggcuagucuggguggaauucacuguguaucccaggcuggcuuuagauuuucagcaauccuauuuuugccuucuuggugccaagauuacaugugucaccauaccuggcuugcuuuauuuauuauuauuauugcuuauguguguauacacauaugcauauuuugauuuguaugugugccuuaucaugaguguaggugcacucaucguagcaugcgugggaaggucggaugacuuucaggaguguguucucagcuuccacaggugaguucuguggaccaagcucagguugucagaguuguaacaagcuuuuuacccacugagccuucucucaguuccuuggcuuuuuuuggguuuuuguuuugcuuuuuuguuuguuuguuuguuuguuuguuucugagacaaccuuguuauguagcccaggaugaccuuggacucuuaacugcuaggauuacaaguauucaccaaaugagcugggcagugauggugcacaccuuuaauccuagcacuccagaggcaaagguggguugaccucugagugugaggacagccugcucuacagggcaagcagccagggcuacacagagaaacccucugucuuggggaaggaaacaaaagaaaaugugcaccaaccaugccuggcuuuuucuucugucuacuaaggaccgaaccugggccuuucauacgcaggcaaggccuuugccacugagcuacacccuuacuguguuuccuuucuacuaaguauuaacauuuuuaucauuucugaaugaauuuaagcucaaagagauccuuauuuccuguacagaguucauuucugccauuaccagguauaucuuguuaguuucuuauauucaaaaaguagucuaggcugggguacacucaguggcacugugugcaguuagcauacagaaagcuaaguucagucccuggcaccaaacaaaauacacaaaaccgacagcacaauuaaaucuuuccuagaaaagcccuguggagaagcugcuacgggagguguuuuuauauagggguaggaugugucccuugguaggcugcccuugcuccacuugauggccccacaccagggcagcauuaauuggauucugggcuauaagagaaaaggcaugagaggggcguauuggaggguaggauugggaggagcuggaggcaugagggaagauggguauuaguaaaacauguuuuaguccuguaugaaacuuucaaagauacauaaaaacacuauuuuuuaaagccugguguuugagucaggcacagcauggaugauuaucccucugagcaccagagaggcugggccaggagcuucauggguucaagggcaugucaggcuccauaagugagacugucucaacagggaacagaaaugaaguuaauuuguuuuuaacuaggaucuuugaaccuuguaugcuccuccauaugcuguguggagagacugcauagucccagggagagugcagcugggcuagggcucugugguuuugcuaccagggaaccccuagaggugcagcagcccugugaaacaggcucauauuacagauauggguaaugucacccagaggaauucucuccgacacacucuuauuauagugugggggagauaagcugagaacuugccaggagucgcucccuggcuuuuaauuuguuugcauggguaggauuacaugaagucacugggcauuccugccuuggguauucaugcacaguccugguuaugacagaauuaauaggccuuuuucucuguguuuuucuuuaaaaaaaaaaaaaagauuuauuuauuuuauuuauaugaguacacuguugcugucuucagacacaccagaagagggcauuggaucccauuacagaugauugugagcuacuaugugguugcugggaauugaacucaggacuucuggaagagcagucagugcucucaaccacugagccaucucugcagccccuucucuguguuucuuaauaucacuuuucuaaaauggaaagucaguucucuugauugacugcaguaguuguuuguuucuguguaaacuacaucaggcauuggucucuucucccacugugggcauacagcauuggguaucauagggaaucuggguuuaagaaaaagaagaaaugccaggcguggcaccuuauagcuaguacuugggagggugaugcaggaagacaccaaaaauucaaagccagggaggcuacauaguaaguuucaagucaucuugggcuacacugugagaccuuaucuuuauaaagaacuaugagaugcccaguggugguggcacacgccuuuaaucccagcacucggaaggcagaagcagguggauuucugaguuugaggccagccuggucuacaaagugaguuccaggacagccaggacuauacagagaaacccugucucaaaaccaccccccccccaaaaaaaaaagccucaguuugaaugcccaggauacacaugagaaccagacaugccgugugaaucucugugaucccagugucuuaguuagagugacugugcugugaugacuaaaagcaacuuggggaggagcggguuuauuucacucacaguuccuuguagccguucaccaucaaaagcagugagggcaggagcucaaacagggcaggaaccugggggcagaagccguggccggggcugcuuuacucacuugcuaagccuguuucuuacagaagugaagcugaguauggcaucacccgcuaauuaaagaaaugcccugcaggcagaucuuauggaggcauuuucucaaauugagguucccuccuuuuagguaacucuagcucauaucaaguugacauaaaaguagccgacaugcccagugucccuaugaggagaugggagggggagacaguagaagcccuggaagcuuucaggucagauagucuccuacacacacacacaccacacagaggggaguggugcaggagggacagguaagggauggggggaaaaaaaacaaccacaaaguagcaaagacuguguccugaaauaccagcauguacuccuaaccacggaaccaucuugcccaucccauguuacauuuaaaaagaggaaaacagugagaugaccuuuuuacuucaaugacagaguugaaacugugggacagccagaccgaagagacaguauaggaguaugugcagaaaggcagaauggcuacgaaucucugcagcgggaccaagccgugugcaucagcacgaaugguaagacaaacauggcuguacaggagcugaugggaaagccuccuccuuaacauccaaguacugguaccagaggcugccauucgagcccucaaaggagggaagcaaccaccaguccuacccagcuaugaaaagaaaaaccacacacagacuauuuagggcuguaacuggcuuagccggcaaaaguacaugcugugcagauuccacaaccuggaacccacauaaaggugagacgagggaaccaacugcauagagcuguccuugggcuucuacaugcaugccacagcaugcacauggcacaguuacauccacauugcacacauagaguaauuuauguguuuuagcuccauauuccauaguguugaugcuuucaaaauuacuucccaaauccagacagggcuaauccuaucacuugggaguuugaggccacucugggauuuuuuuuucccuccaucuuugggggaauaaaauaaauaaaucacuccuaagucaacaguuauuuuuuuuuaaauuagguaacaguuauuuuuuuguggcacaaaauaaaacauuaaauagagcaggauuccuguauauuacacaggaaacaauguugcuguugagggcugacaggcagagaugguguucccuuccaugcuguuccuguggaaacucacaccagaagucugaaaugggauuacaguccugauuuuugcuuccccugugggaauggggguguuaaucucuuuaaauccauugucaauacccaguuuucuggagccuuccuuuuucugaacuaaggaggcggcucuucaauaaucuagacacugucuuaauucucucaggcauugcucaggugacugacuuuaauguuuuaggugcagucuuugucaauggaaaagaaaugaccaaucaguugccugcaguuaccucuggcuccacugucacauuugauaucgaagcugugacucuaggaacuucuaacagccaugaaggugggaacgccaagcuccgagugaccaucagcuccaauaaccgggaggugguguuugacuggcugcucgagcaggccuguggcccucuuuacuucggaugcucguuuuucuacccuggauggaaagugcugguauuuuagcauuugaagggcuuggcuuugaugugaggguuugcuguuucuguccucaguuuaguugucucugacuuugaaaaggugagcuuaccucucuguccaccggaaauuaaaaauguuucuggguucaccuuguaagguuucaguaagaagugagcugagugauguggacaaaaccauagcucaguuuuguuuugaaguacaaauaucaaacuagcuuuaaaagucugcauacuuuuuccacuguucuuccugaaguugguuguuagaacagaaaaugucacauuaguaagucuucaucaagauugaaggccagaaguaaacacagaagacagcgagaggccaggcuccucggugcuuguccaguccugaguguucacccucuccacgucccccuccgggagugucugggucugagccagcaucugugacagccaguguuagcaucuuuuuacuggagugugacacagagagggcagaggucugcauuccucaaggugaagcuacuuuuggaagaacacagcaguguuagcaggucacgugugcacagcaggccccaugcaucuuuccucagccgugcacacgggcugugugcaguguuauagucagugugaugucagguugagaacuggucuuuuaguggaccaaggaaauaaaggauaaauacuugaccuauuuuuuuuaaacuuaaauuucuguaaaauauuuauuugacuuacuuaauauguaaaaaaaucguggucuuguuauaccagcauacauauaauuuuuaaugugaauuuuuguuuguuuuuuaucaauaguaaaaaaaaaaaguggaaaagcaagugugguauuuuuguaagauaauuuauuuggggauucauguucccuuucgacaaucaugacuuuuccucccguuuuauguauaaguaagugcccuucucauguuagagguucuagagugccguauccagccuuaugaaacaaaauaaaaaaugaaaaauuaacagaau

SEQ ID NO: 6217 - RNA, 46403 nt, Mus musculus
cguaggcuccgcccccugcgcuccggacggcgggaaaacccaauugacagaacucccgccgaagccccacuaguccgaucugcguucuguggggcucgagcgcuuauucuggagaaucugccccgggggcaccuuguauugucccgccgccaccucggggccugagcccgggcuucccguacaucucugucugagucugacucggcggcccugggcccagccucucacucgcguccggccgguggucucuacgagacccgagacgggcuccccggcucgcagcucgcucccacuggaccugccgccccuauggccuccagccaggcugggccggaccucugaagggccuaggagcccggguucuaggaggcagagaucaugguggggguccugagcauggcggcggcugcagcaccccuuccugugaaggacuacgagauugaggugaggauccgucaaguuccuuucugccaguguuggggaauuguggcgugaggauggggggaguccugcgugcuucugggacgaggaaggagggacacgaugacccacagucauaauuuugugugggauaguugccucagugugccguguaaagcucucacaaaagcguuggcauuuuaagauauuuucgggcugguuguuaagucaggauuugaaaacuacaguucccggguccuugaaacguugguggaauagcaugucaccaaggauuucagggucacuuucuuuguucaugaugaugugggaucacagaacggcgaagaagaugaagcuuuaaguucagcuagucccguacuaauaccuguccuaggaauuccauuuagaaugucacuuaaauggaucaaguaaggaacuuaccgugaccgcagagcuuaauguaauguaguuaagagucucagugacauguaggugcuuaauauuuaccauguuuuagagaauacacuaaguagaggacagugcuuaauguaggaagcccuugcuuucugagaaagaaagagaaauauauacuaaacaacuauaaagauauucuaugccguuuagaaguaguuuuuaggaucuuaaaguacaucucugaccuacuuuuucuucugucaucauuacaggcuugugccucuucagagaugcuaugguuuuuauacaccauauaccaggcuagcuuucugauguguucuggugcccuuaaagugagcuaagauguguauucacuuaaauucuaauucuuaauuuuuauaauuaaguaacuuuuucagcuacagaauauuuauauuauuuacuguguagcacagcacaucucaaauucaucaccuacucaccucagccugcuuauucagggaucacaggaaugcaccauucacaccccguuaaucgaguuuuuuuuuuuuuuaaaagauuuauuuaaaugaggacacuguagcugucuucagacacaccagaagacaucauaucucauuacagaugguugugagccaccaugugguugcugagaauugaacucaggaccucuggaagagcagucagugcucuuaaccgcugagccauuucuccagccccaaguuauauuuuaaaaauuaauuugcuuaagauuuccauaccaguagaugucaggucuaguacuugaacuuagaucuuacuugagugucuguuguguggugccucugauaccaucucaaagcuuuaaagaugauaauaauaaauucacuuuuaauucacuuauuauuucaacauauuuaauuuuaccucauuuaucuaaauggucaaaauuugucccaauaucguuuauuauuccugccaguuauuuugaauguuauuuuuaccccuuacaaauucuucuuacccuuuaaaauuauuuuguuacauuuauuuauuuauuguaugugccaggaucagcauaugugugaagaucagaggacaacuugugagaagagaaggcuggugaaucucuuaguuugaggccaacuugaucuagagagaguuccaggauagccaaagcuacauagagaaacuuucucaaaaacaaaaacaaacaaacaaacaaacaaaaaaacccccaaaauucaauaauucaaauauaugagccuaugguaggcauucuuaaucaaaccaucaccacaacauauuugcuuaauuuagugaauuucuaggccagguuuaaggaucuuuauaaguagauaauauuauuuagacuucuuugagcucucaucuuguagcccaggagugcaaccuggguucacuauagccugccucagcuuccaaguuacuaggacuauagauaugagucaccaugcccagcccauguuuauacuuaagccuacaauacacauagaaacaaaaugagaaauaauauucuucuaaggacaggcuuagagauucuaaucuagucaauucagaacagugagauauuuucuuaguguaguagcaaggcugauucguaccauuuacauauagucaaaaaacaaauacagaccacaggaaaugaggccaguucauuuucccugugcuaacccauagguuucacaauucauaucaucuguacucaaagguaaauccauuaaaccuuuguaagauauauguccagccaaaaaugggaucacuguuguuagugagccagcagcuggaugagcccuagucagauucaguauucaccaguuuugcacuagggccacagagaacagcauugaaucuguguugaucgguguccaaguagagucuacuucuagaagaugguuaauuguucagguuaugacacuguggauuuugggguuugguuccccccgccccaguaguauaucauguagcccuaacaggucccaaacucacuaaauuuaccuugaucuucugauccuccugcugcucucuccucaguacugggacugcaggugugcacuaugccugauuuuacguaauaauggggaaucaaaucuaagguuguguaccugccuaggcaguauucuccccagccuuaguuacgacaaugaaaaugacaugaaaugguuaucuugacaguaucuccuggcucaugauuucucauuuugagccuaaugcucuuguccuggcagccauugccuugcugagucucaucagccauaugugggcucaugauaaucucuguugaaugcgccgggguacaaguaucauugcugacugcaagugauugcuauaacuauggcuauccuuaguguuauaaccaccuugauuccaggagggugauggcuacugcaggagguaggcaguggaucaugguagaaauuaaaaugguagacuugaggcaaguguucauugguuaucuuucacugugaguucuaauagaaauaauaacuguuucuuagauacuuagaaugauguguauauuuuuaaccacaaaaguaaagcagaagggguuguuuguagguuccuuaccuugugugcuuccacauauuuuauuacagcuucugugagguagauggugcacuuuuuauuuauuuauuuauuuauuuauuuauuuauuuauuauauguaaguacacuguagcugucuucagaugcaccagaagagggcaucagaucucauuaugggugguugugagccaccaugugguugcugggauuugaacuucggaccuucggaagagcagucgggugcucuuacccacugagccaucucaccagccccagauggugcacuuuuaagguuaugaagagggcaggugcaccuuuagucucagcauuugggaggcagagggaagcagaucucuuaaguuugacaccagccugaucuacauagugaauuucagggcagccaggguuacauagaaagauccugucucaaaaauauauaaauaaaauaaaacaaaugaaguaaaauaaaauagaagauaguaggaauuuauguuuucuuauaucuuugcuucaauauaagcguuuuuuuguuuuguuuuguuuuuuugagccagagucucacuauauucacuggcauagagcuugcuauguagaccaggcuggccucaaacucacagacaucugucagucucagauuccugaguacugguccuuauaagcuuuguuguuguuuuguuuguuuuugaggcagggucucuguauauagugguugacuuagaacccucacucaguagacaagacuggccucaaacucacagaggucuuucucccucugacuuucuagugcugggauuaaaggcaugaaccacuccaccuggccauagaaacuuuuuauuaaaguguguguguguguguguguguguguguguauaauauaaauuacauauacaaguuaauauaacauuaaauguagguuuaacacuaaaggucauuuaauauguuuguuuuucaccuaaaguagccuucucugcagggagauggcuuaguguguaagaaugcuucuuguacaaguguaaugaucugagguaaaaucccuagcaaaagucagguaugccuuuuaucccuggguuguggggcagcaaagccaggaggauugcugagacccacuggcccccagccuagcucuagguguaaugagggaacuugucuuaagggaauaaggcugaaaguaacaucgcaggacacuugacaucuucuuucagccucugcaagcauccuugcauacguuuaugcucaaguguaucacacaccccucacagguauauacaauggagccuucuguaguuuuucuauccaauuauuuaaacuguuaucugugguuuacaggucauauuucauauuuuacuugaaaugaauuguggcuuuuuuucuccuuaaauugcuagccaugcaaaaagcggagaaaagaugaugacaacucuuccugcgaaacaaucaccaaauauuuaucaccaauagggaagacuggagacaagguuuucucuccaccaaaacccaguaauauucuacauuauuuuagaaagaccucacucacaaccgagaagccacaaucgacaaaggcguacaaaauaaagccaucucccccauugcuuguuggcaacagcaaagacuguaagacgccauuggaaguauucucaaauagagaauuuaagaggaaaagaaagagaguuaguuuauccucucaacugaaugauauuaaaauucaggaugaguguccaguugaaauuaguaacaaugauaguaaggaggacggugguuuaagugauuguguggaaagcagugcuucuguuucccuuuacaaggaacauguggagguucucgcagaaaguauugaagacagcagaaaccagccaaauacuaaguccuccaaaaagaaaguaaauccuaaacaaugcaccacaaaaagugaugacaggauacugaggaagaggaagcguagcaagguaacgggucagucugaaagugugcccuuagcagaugaacuuagucugccugaggaugguggcaaagacagcaagcugacuaaaccuucccuagcugaggaaaacgacuccaggacucaugcaaccaaaagagcugauuuaaaggagaguacaauuacugucuccuaugaggaauuuguaaaaagucacaaggcagcuaaaguggaagagauaccugacccugcaguuccagccuguguuccuucugggccaggugaagcagucaaaagugguucugaaggcgaauugucgggaagcugcgaaccaucgccacagcugcaccucaagacaguuacuguucuugcacaaguucaccccacucccccuaagaagaaagggaaaauacccccaauuuucuugaaacagaagcagccugagcuggagaauagucucucugacccagaaaaugagcagccaguucagaagaggaaaucuaauguugugauccaggagggccaauuagagcuggcggugcuggaagccuggaacucugaggcuucaguaccaaagugcagcauggaggaaagacagcaguucaugagagcauuuaggcagccaccgccagacacgcucaaaaauggauucaagaaaccucuggagaagcagaaagacccaagugaaaaaucuguccaugaaggagauagcaguucugaaaaaauuauagaaaauccuaauauucaaagaguuucaagccaaggcugucuacagucacaugccgauagaggaaguuuuccuaaggagaaaaguaaaaagccaaauaaaaaggguaagaaaacuaggacuacugcagguggaaacagagaagaaaacauacaaaaggaaaaaacagccuuuuccuuaaaagaugaacaggaucaaaauagccuacgaaggaguguaagacagaaaucagaaguucucaaaagcaaugcauuacuuaacagugaaaaucuuguuugugaggauacggcacaugacucuguacaaaugucucuguguaauagaaauaagucaagaagcagcagcacaccaaccagggauaugguuacacaucacagagcugagccuggaaguagccuggaguaugucucuacacgccaaccaaucaggagaucucugagaaguugcagcacgccugcaacaaaugcucugggagguacugagucugaggaugcucaggacacuauuccagugaaggcuuccaccccaaaaucagccagaacaucagaaaagcacaaccuguauacagcagaauuaauaauaguaucuucugauuccgagagccccauuagguaaaauuuuguuuuucuucuuaagauggagcaucuacauguauuauuaauugggaaggaaaauucuucaagcauuguagaguccauuuauuuucuagaacacaguuuauuuguaaaggauuuuugauguguauauagcccugaggacuggcccucauagguuagguaaguggucugucuacccacugagccauauacaaguccucuuuucaucuugagacaaaggucauagguuacuuaggcuggcccugauuuucugccaggucuuaaacaugcuauccuucucuguacucucccaaguagcugggaugacagaccugagccaccaaacuuggcuuuuguuuugagauagggucauacucaguagcccaggcuggccuaggacuccgucuauagccuagaauguuuucagacuguagcaguccuucugcuccgguucugugagugcugggaaaucuaguguaccucugcacacuacucugucucuucagacaccccagaggagggcgucagagcccaucacagauggcugugagccaccaugugggugcugggaauugaacucaggaccucuggaagagcagucaguccucuuaaccacugagccaucucuccagccccccagucuuguucuugcuauguacagaauuagucuaggacucaaauccucuuccaagugcugggauuccugguguguaucaccacaauauagcuaauuuaaaguccauuucagaagauuuuucagauagauuuaagaugaguucuaaacucuuauuugucauaguugauaauccuuggagagaaauagucuucaaauaugaguucaucaaauaugagauuaaaaauaaauuauaagaguaguuuuuuauuauuguuuugaaacagggccucucuguauaccuuuggcugucauggaacuuuauguagaccaaucuggcuuucaacucaaagggauccccaugccucugcggucagggugcuggaauuaaggcaagcaccagcacagccagcugaguguuauuccuuagguaaacugaccaguagaugauggagcuugcauacuggccuugcccaauguuacagugauccuggcacaaguucuaacuuucuucaaguugugcuaccuucuucuuuuuguuucugcuuuugcuaugcuccauggggcucauacuagacagguagguuuauuuucuucucuuugcuucucuucuuuucucccuuucccucccucggccucuccuugcuugcucccuuccuuccuccgccccuuuuucuuuauuuuuuugagauagggucucucuuggauggccuggaacuugcuauagagauaaggcuacccuugaauucaugagugauuuuuuuuuuuaagaaaucuuuauuuuuauguauaggaguacacuguagccaccuucagaagaagguaucggauccuauuacagauggcuaugagccaccauguaguugcugggaauugaacucaggaccucuggaagagcagucagugcucuuaaccacugagcuaucucuccagcccucaugaguggucuuuugucucugguucccuugugcuugaauuauagguguguaucaccacaccugguaaggcuauuacuuuuguuugcuaacaguaagcucucugcagcagaaagggguccugaaaauguguugauuagguuuacuauuuuuaaaugaaauaauaaaugauaaaccuuggggcuggcaauguaauagaaugguugcuuagcauguacaggacccugggauccaucccuaggaccagaaagaaauaaaguuuagcuuacuguugaaucaaagugaugagaauugguuuugcaguuuguuuaaauuguaauaucaacugguuuauuuuuauauuuaagauucuuguacaauauuaugaaaauguuuauaaaugucauuuuuuucccagaaugaaauucacuagaauuaguacucccaaaaaauccaagaaaaguucuaagaaaucugaaacaacugaggaagagcucacuucucagaagaaaaagguaagaaaaguacuggaguccugaagacaguauuguuuccuuaaaggacuggcaguaguuacuagaagucaugucaaagaagauucccaagggucccuuaauuaagacgugugccauuuauucccauuccucuuauaggagcagccaggccucuuaacuacugagccaccuccccagccccuuccuauacguccuugacugggucucacuaugcagaucaggcuggcuuugaacucaacagagauccucuugccucugguucuauaauccugagagcuaggauuauagguguguguuaccacacccagaccccagcuuuguuccuaacucucuccugucauguuguauuagauucuauaaaggcaauguacauguauuauauauuuucccuuuauauuauguaaugagagcuuacuuaauacuuuaccugaacuuguuggcuaaaaucaaaaaaauagauuuguugugaaaaaucuccaauccaaauaagucugggcaaugaaaacaacucaauuaauaugaauacaagcugcaugucuagauugggcagaucuaccacuacacuaccaucuuccucaucuuccccuuacagcuugcgguuucuccaggccaugugcuucugcuccacuuuccuucuucuuccucuucugucauccccccacccccaccuccuuuucucccaaaaccuucaccucuaccuuccccucuuucuccauccaaucacuggcucuaaccuuuauuuauaaauuaaguugggaaggagauuuacaggaaaucaccugagugcugacucauuccguguucacagccccccauggagaaaacagaauuaacauuaaauacaguuagccaacacagauugucaucaagguuguaggaaaacugaccaauucuaauguaaauuaucgaccuucuuuugaguuuuuguuuuuugaaucuguauacuauguguuuguauguauguguaguacucacauguacauucuuuuuguuuaagauuuauuuauucauuuguuauauguguguacacuguagcugucuucagacacuucagaagagggcaucagauuuuuguuacaguugguugugagcgaccaugugguugcugggauuugaacucaggaccuuugcaagagcagucggugcucuuaaccgcugaaccaucucaccagccccucauauguacauucauagcaguaugcaauagcacacugugguguuggucuuugcuuuccauuuuauuucuuacaggaucuuugauuugcacuuugcacuuuuuuuuuugucuaggcuagccaacuugugaaucgucccauuucacuauaggaacauugggauuacugguugguaucuagcagcuaucaugccuagaguucuuggauaggcuaucucuuuuuuuguuguguuuuggauuuuuuuuuuuuuuuuuugagacagggucauacuauguagaccaggcugucuucaaacucccagagauccaccugccucugucucccagugcugggaugaaaggcaugggccacuuugcccaccugguucugggacuuuguuuuauucauucauucauucauagguauugauugguugguuuuuugagacaggguuucucuguguagccuuagauaucuaggaacucauucuguagaucagguuguccuugaacucacagauugucucugccucugucucucuuccucucugccccucugccucugugcuucugccucaauuugggacuaacaguguagccaccauggcccagcugguucugggguguuaaacucagauucucacacagaacugaacugucuuucuggcccuccuggguguuuuacagacaugcaaaugcacuuauaaggacaauuaguaauuaucacugaaugugcauuuggggucccugguaaaauuugaaugaucuuuucuugguugacuauuaaugugauguaaauauauuuuucuauuauacauuucuauuuuuucugugacuaugaaauuuuuuuuuuuaaagauuuauuuauuuauuuauuuauuacauguaaguacacuguagcugucuucagacacuccagaagagggagucagaucuuguugcagaugguugugagccaccaugugguugcugggauuugaacucuggaccuuuggaagagcagucgggugcucuuacccacugagccauuucaccagccccgaaauucuuuuuuuucuuaaauaugaaauucuugcugugaucucaauuaauagucccaauuuuuaucuaggcaaauaguacuucaaaaaauauaucaaaagcaaaagaacugauugaggaagcaaaagcauuccaaauuggcggaucaaagacugaagaaacagugguacccuugaggcgguccucuaggcaccaggcacguucugcaaaggagaagucgccagagauagauguaagcaucccaacgucucccgacccgccaguacaggcgcuaguuuuccuuguuauaaagaguggaagaaggaaaccuuuccacucgacagccgcagaguguggugggcgugcugcuugaagagcauuuggcuuacaggguacagugcgcgucucaggucucucaaggugucuuguaaacugaccuguucugcucgaucaucaagcaguuucuuuaccacaggcacacugaguucuucccagauaacucacgguucacuucauucucaaacuuggaaauucacacuccaaguauugucgucuaccuagcuuuuacaauccugcuaaaggauaguaauuauaucuuaaauggcgugugaauuauauugcaauaaaaccauuuucuuauuuuggaaaauguuuaaaaauaguuuuauuaagauauaauucacacgccauuuaaguauacaauucaaaaccuaaggcauuauggugcauaucuagaucuuagcacuagggagguaaaguagagggacuagaaguucaagugauccucaggcuacguaagaggaucaaggacaguggccuauaugguacccugucuuaaaaaaaguauguaguucaguaucuuugaauauauucagaguucuacuucuacuauggccaauuuuagaaaaaucucucauuuuugauauaaggucuugcuguguagcccagggucccucaaauucaccauccuuuggccugagcugggauugugacuaugugccacaggccaguuugggacauuccuguuaccuccacggaggacaccuuucuaccuuucuucuagcuguugcuuccccguccucacaucucacuaugauagcugcuuauuugcuuucuauuucuauagauuugucuguucuggauaguucauaaaauauuguaugauagaauaccgaagacuguuaucacugagccgcaaccccacccuuccgugagaccaguuacucuguuaucacuguauccugcuuuacuugcuaucuccccauuaggagccacgucaguuaucuggacagcuguggcaggauuaacaguguuuaucugcugaaauuacaaaaaucuguaauaagaaucuuuuauuugaaauuaugaagaaaagggaaaacccuucauuuucacuguuucacuguaagaguuaugaacauuguguguuauuaaguuugugugaaaacagcuuagcucagagcugucuuaggcguucccugggguuauuaggauuuacugagaguaauggaaaaugcuguuuuaaaguguuuuuguuuuuucucauauuuuuguuuuaggacucuguaauaguaauagacucaaguccaacuucuauaagagaaccagagaaaagucagaagaaacuucagaaucugaaugauguacuaggaaaaaaacuuaacaagucuucuaaaaaugucccugguaauuggauucacuacuguuuuauggauacucuuuuacucaguacuguuuuauggauuacuauccauaaauguuugggggcaauucauccugaauauucuggugucuuaucccagaaaucauaaauuuuagguguuuuguuuucuuugagacaggcuugcacucuguuuuccuggucuggaacuggcuacagagaucugccugucucugcauaugaagugcuggaauuaaaggcauauagauaccauaaugccuagcuuugguuugguuugguuugguuuugauuuuuuuuuuuuuguuuguuuguuuguuuuuaguguuuuagauuuuugagacaguuucucuggauagcccugacuauucuggaacucaauauguggaucaggcuggcuuugaacucagagaucugccugcuucuggguucucaguuuuauuuugugggacaggaucuccuaucacaccaggcuggcuacuuacuauauaauugaggcuggccuugaacaccucaacucccugccucuaccuucaggugcugggauuauagguaugugccaccuugccugucuaauuauuuccauuuugauaaguaaaauuuugaucaaguuuuucaaagaaaaauugggcaucuuguuuauguuuuaaguuuuuuuugggggggggaacauacuuuaaauuauuguacuucuguauguauauacuuagcaacuucaaaacuugucuuucaaauuuuucugugcuccccauaugagagugcaagacaauuuuaggugugggucuucaccuuccaccuuguaacuuaugagcuucagggauuaaaaacccagggugucugucaggcuuuguccaguaagucaucucuacaguccccgggguuuuguuguugguuuuuuaaguauuuauuuauugcuggacaaugguggcacacgccuuuaauccuagcucuugggaggcagaggcaggcggauuucugaguuugaggccagccuggucugaagagugaguuccaggacagccagggcuacacagagaaaccgugucucgaaaaaccaaaaagagaaauuaaaaaaaaaagggaaaagacaaaccaaaaaagaaaagaaaagaaaaccaguauuuauuuauugagccagcgucugagcaaaauuuugagaugugcauuauaggauucuauagguaaaaaugaaaguuuccuaggggauuugauauuacaaagcugaugaaacauuauauaccauuuuuauaauuaaguuaaauuucuaaaaaguuuaaaagauaacuuugaaaacaacugaagguaaguggagaugguaaacauuuaauacuaacuaauccaaguauugauuuuucuaaggaaaaaugaaaauugcuccuuuauuucuugccaaaaggaccaaaagagcagccauuccugucuuugauuuggaugaaagcaggucaguccaacacaaauauuuaaacauugaauguuuuauggacuacaaguuguguuuauuuguuuaacuagaugucaaugggcauuugaaguccuuuuuugcauaugcauauaugugugguguguguauaugccucucugcggugucugugcuuaccuguacuugugugcaggugcucacgcauauguaaauggaggccagaggcagauggcagggucuuccuccauuacccagcaguggguaaugugggcgauggcaucccaacuccagucuccacacuuaaaggacaggugcucuacucacuugggcaguggugguccacgccuuuaaucccagcacucgggaagcacaggcaggcggauuucugaguucgaggccagccuggucuacaaagugaguuccaggacagccagggcuacacagaaaaaccgugucucgaaaaaaacaaaaaaaaaaucuuugugggacacgggugggugugugcgugcguacaugcauacguguguguguguguguguguguguguguguguguguguguguguguuugcgcgcgcgcgcacacgcgcgcgcguguguguuuuccucagugcuggaaauugaacaguguuuacuuaguaaacacucugacauucaaccauauuccagcccuuuaauugagacagggucuugcuaacuuccuccaucuucaaauucagccuccugagucaggguacagcuuuguggaguaggucuccuaccuuucugugaguuccagggauugaauucaggcugccagguuuguguggcaacaaguacuuuaccuguggagccaucaugccagaugugauuguuaguuuguugguuugguugauugaaacauuuucauguagcauagacuggcuuugaacucacuauguagccaaagauguccuugaacuccugauucuccugccucuuccagaguguuaaaguugcagacaugugccaccacacacaaugauaaagcuuucuuuauaaaugaccuagguuuggggggguuguuauagcaagcaaaaacagcugcuuacccuguuuccuuauaugccagucacucacuaacuguuugaguacaccuucuagucauaccaucuaaagaauagccuuuucuccaagggcuguugacuccuugacuuaugaaaccguguacagaauccaccagcuacaugcuuucugugcucaccauuccuggguagacaguagauaaauugaggaagcauuugccugcacacauccaaagcuguuuguagguguacaauauggauaagaugauaaaugcuaaauggauugauaccuuguaccacuucccuuaaccuucagcuacaacuucccccuacaucuuuaccuuuauaucacccccugcucccuccacuacuaguagaaaagcacaucuccuauuuucugaaucuuuuuguauuuuuuuuuuuuuuuuuuguaugaugaguacacuguagcugucuucagacacaccagaagacggcaucagaucccauuacagaugguugugagccaccaugugguuguugggaauugagcucagaaccuuuggaagaguagucagugcucuuaacggcugagucaucucuccagcccccuuguuuuuugcuguuuuugagacagaguuucuccauguugcccuggcugucuuagaaccacucugccucugccucccaagugcugggauuuaagguuggagccaccacugcccauugaggucugaguuugauucauuuauuuguuuguuuuuugagacaggguuucuuugugcagccauggcugccuugaaacuaauuugguagaccaggcuggccucaaacucugccucccaaguacuggaguuaaaggcacaugccaccacuaccuggcuguggguuugauucuuuucucucuuuuuuuuuaaagacuuuuuuuuuuauuuuauuuauuacuauuauuauuauuguugugauuuuuuccagaagggguuucuuagcccuggaugucuuagaacuuacucuguagaccaggcuagccucaaacucagagaucugccugcugggauuaaaggcauggguccccacugccuagcuaagacacuuguuuauuuauuguauacauauuugucuccauuuaauuuaugaacaugaguagaugagcaaaagagaaauuuaccagcuaauauauugggugugcuugugcuuaauuuugaaaaguuuuuuagauuuuauuuuuauuguaugugucuguuugugcauguguaugccuauguuggcaaauuguaaauuggcccuuucuucuauuugugaauggaacucaaguuaccaggcuuguuuggcaagugccuuuaccacuaagccaucucacugucuagaugguucauucucuaauucuuuugcauuuauuuacuugcuuauauguggguauggguguguguagggcagagauuuggguuuuuuuccuacucccauguuaguccuggagauugaacucagaucauuagucuugguagcaaguaccuuuaccugcuaagccacuuaacuggcacuaguuuauuuuuuaauuuaaauuuuacuuuauuuauuuauguuaagauauaguauuacugucagcucugcugccuugaacuuacuuaguagacuugccuggccucaaagucacagagauguauuugccuuugccuccuaaaugcugggauuaagggugugcaccacuauuccuggcuauuuuaauuauuuuuauuauauuaauuaauuuacaugugcacacaugccaaggcaugcauauggagacuggaaaauaguuuguaggaguugacucucuccuccaugcuaugguuccugggaauugaacuuggguuguuauuccuucaguugcuuauaacuuuugcuuuuacuuuucaaauaauuuucuucaaagucaagauucaucagaacaaacucaggauugugauguacaguuuaaagcaaagcgugauuuucuaaugagugguuugccagauuuacugaaacgucagauugcaaagaaagcugcugcauuagauguguacaaugcagugaguacaaguuuccagaggguuguucauguacaacagaaggaugaugguaaguuuguuuaguguguguguauguguguguguguguguucauuuaaacaggguuucuguguagcuugaacagccuggaacucacuacauagaccaggcuaaccucaaauguauuuaagccagggucucuuauucuguagcccuuucugaccuugauuauguaucuauccuaggccugaaacuuagcaguacuucuauauuagcucuccaaguauugugauauaggcagggguccucccugguuaaguauuuaugcuuacccuguuagaacuaaucugauacuaugcauuguuuaaaaaaaaaaaggaccuuuggaugucccuagcugauagaauacuugccugcauaugggagccauugguuugaucuucugcacacaggaaaagguaaaagccauaaggguaguggcaugcaccugcucuccaaaugccuggagacugaggcccuucugagcuguauagugagacucucuuuuuaaaaagauaaaggguuggagaaauggcugagugguuaggagcacuuacugcuccugcagaggaccuggguuugagucccagcacccacaugaaggcucauuaccaccuguaacuccagcuccuggagaucgaucuauguuucuugcauucaggaagaaaaacacuuucuucuguccuugauaaguacaguucaaaugugguacacauauauacacucaggugcacacacaaaaauauaauaccaacacuuacuagguauaaacaggagaaucucugugaauuaaaagccagcguggucuacacagcaaguucaaguucauuaugagacucugucuugaaggaagggagggagggagggagggagggaggaagggaaagagggaaaauaaaggcuuuaaaaagagauaaauaauuugucauuguuauaguuucucaagaguggguuucucuuggggcuggagagauggcucagcggcuaagagcacugacuguucuuccaaaaguccugaguucaaaucccagcaaccaucuguaaugagaucugacauccucuuauggagugucugaaagcagcuacaguguacuuacauauaauaaauaaaucuuaaaaaaaaaaaaaaaggaguggguuucucugcauagcccuggcuguccuggaacuugacauguauauuaggcagagauccaccugcuucugcguucugagugcugccuggcaguaaauacaaauuuaaaagaagaaaaugggguaggauuucugguuuuauagcauucugaugguaguuuuaaugauuacaagaguauuuuaucuuuuuuuuccuaaucccuggacucaaguuuacugaugaugcuccuacacagagcagacaaagaaggcagagagauucuucuucuaccucugucaucuuacaucccugauggaaagauguaagaugaguaccauuguaauaauucaguguggguuuguuggaaggcuggguugagaaucuguaguucuuggccagucugagggagguagcaaguuuagucccagccugggcuccauagugaggcucugucuaaaaacaaacaacauaacaacaaaacaagcaaaucaaaaccuuagacacacucuaaaucagaaugcugaauaguaccuugauuuuuuaauuuuuccuccuauauaucaaaguugauuuuaaaagauucaaaaauaugaguuugcucauuuuuacaaauuaaagagaagaugagguaaguuuuaucaguuguuuuuggugggguucuuacuacaaagcuuagacaagccuguggucucaguucuuucucgcuucucgaaugcugugagugagccgugacgugggcgagcccugacgugggagagcuaugcauuuuguucacugcauucacuuggguguuugguauuuuugucuuaaccauguagcugcuuugguuuguuugcuagugcugggaauugaacucagggucucuuacauauuaagguuuguagggccuuugaauguuuguguguuugauauuuaguaaguagauucaguguauaacuuaguaugcucuguuuuucuuuagaauauugguuauggcauuugaagccaccuucuuguccucuguuaacugaauuuaaggaauuaaauacuaaaguaacagaucucucagaauauguuguugcuuuuggugaauuuuccaccuugaauccaaauccaagaaguaauccugcugcugugguaaguaccauccugcuuucauaggaaaucacugaucaucagcugucuaggcuagagguccuccagucuccaguuaaaaacaagcguaauugagauaaauauucucagcuugggggcugguggcacacuuuuaauuccagcagaggcaagcagaucuuggaguuuaaggccagccugaucuacggaguaaguuccaggauacccagggcuacacagagaaacccugucuugaaaaaucaaaagaaagaaagaaagaagauaaugaaaaaaggaauggagcuuguguguguguguguguguguguguguguguguguguguguguguguagaauuggagaauugaaagcuaggcauuuuuuaauuuuauguuuauauauauuccugaaugcauauguguguguugaugugcaccugcccacagaggccagaagagcguguaagaugcuuuggaacugaaguuacagguaguugugagccacccaauguggcaauggaggguuuauuuguuuguuugucuuuuuuguuuuuuuguuuuguuuuuuuguuuuugagacaggguuucucuguguaguccuggcuguccuggaacucacucuguagaccaggcuggccucgaccucagaaauccgccugccuuugccucccaagugcuaggauuauaggcgugugcuacuacugcccggccggcaauggaugguuauuguacauuuuguucuccauugcagaugaugaggacaaggaaggacuuuacuaaagaaguaagaaaccuuuugcuggaggaaauaaagugcucaaauccagaauuuucuuuggaaaaauauuuucccuugcuucuuaaaaaacgaauugaacaccagguacuuugugagggucaugguaaacaagguuagugacaaucauugucauuuauguuuauauuugaguuuugaaaagaugaaaaccagccuuugacucuuagaaaugaauggcauagacagaacugugcugccaguuggcaagggagacuguuuagcagugugaugcagugguugguccuuccaauuugcauggauucccaacccaggcagaucuaguucuguuaaaaugcuaaucauucauuaauaacuuguuaaaugcgguuauuacaacucauccauauggaaggcaaucuacauauuaaggucuccggcugauguaauguuugauucuuaacuuuucauguuuauguuauacgacuauaggacauuugagagugauaggaagauuuuggguauugaagauuguuuuuguugauaaguaagcacauacauuccucuaaucccaaaacagcaaguccacaacuacagccugaugucagucaaaaagaaaccaaaaggaaacaaguggcaacgggaaaucagaagucaaaaagaaagagacaaaaugaauauucagugagcccggaagagaugaaggggagaucaaaagaccuugacgaaagaaucagcucuucuuguacaaaucuagauccuuccagagguauacuuuucaauaucucagggaagaacugaacugaucacaguaacauguaaagucgagagagaagcaguagacaaugauauucugacaguagaugaugacaacacuguccuuuccuggcuaauugaaguuuuuccucucuuagaacucuugauaguuuauuuuuaaucucuccaucuucccugccugccuccauuuugagauagucuuauauagcccaggcuaaucucaaacaaagauaaccuuugagccuccugccuucaccuaccaagugccaggacuauaagcaugcauuaccauaccauguuuaugcauggugcuggaaagugaacccagaccuuuguguaugcuaggcagauauucugcuuacuaagucacauugugaacuccuaaccuuucauucucucuugcccccucucccucuuuuuaaacaacacucuucuuggcucauaaaucugccugccucugccucucgcaccaucgcccggcaugagaaauauuuuuaugaacuguuuuccuuaaguauauugucaguuucuuaccuguauaaauuccauucagauuuuccuuuuguuuggcuggcaugaugguuuggagagaauuggcuucuuaucagucuuugguaucuuuuucucuuuacucagacugacaucauaaaaucagaacuggguucuuuagcuuauuuguuucaugguuccuauuauuaaacaugguaauuuaaaauauacuuauuaaaaguuuuaauguauacauauuacucuuuuuuuaaaaagaauuauuuauuuauguauaugaguacacuguagcugucuucagacacaccaggagagacacaccagaagagggcaucagaggccauuacagaugguugugagccaccauguagaugcugggaaucgaacucaggaccucugaaagagcagucagugcucuuaaccgcugagccauuucuccagccuccauuaaucgguauuuauaauaguuaguuuuuacauuuuuuucuaauuuacuuguuucuuuauuuguuuaauauaggcucucacuguauagcauggaauucacuauguagacuagauuagccucauucagagaucuacaugccucugccucacaagugcugagauuaaagcugugugauugguuuuuguuuuuguuuaaaguaauuugaguuuggugugauaaauuuuaaaugaaaaguuuaaaaacauuuuuguauuuuauaaaugaaagucuuucuauucauaucuuugauugcaucuauaauaauuaaauaucuaagaauguuugcuuaugucaaggaauguguaauauguuaauauguuuacuuauuuuucuuuagauucuggaacugaagacaugcuuuggacagaaaaguaccaaccucagaauucgaaugaacucauaggcaaugaguuagcugucaaaaaguuacauagguugguagaacuuguaaaggaauuaagacauaguuuauaaacuuaguuuugcuauuuagacuaaaauuuauuuagaaacuaaaaauacauggaaagucuuuuuggaaaauaauuucaaguaaaaacauucucuucuuucuuuuauuuauuuauuuauuaaauaauuucaaguaaaaacauucucuuauuucuuucuuucuuucuuccuucuuuccuuccauuuauuuauuuauuuauuuauuuauuuauuuauuuauuuagguuuuucaagacuggguuucacuguguagcucuggauguccuggaacucacucuguagaccgagcuggccuuuagcucagagauuggugugcuucugucccccuccccccucuaaauguugggauuaaaggugugagccagccaccaccagcuagcuuuuuaaaauuucuauucauuagagcuuacacuauugaaacugucucauaaaacuuucagauaagauuauaucugcuggucauguggcaccuguaaucccagcagucuagagauggaugcaggaagaccaggaguuaaaugccaauuugaacuacaaaguucaaaggcuagacugggcugcaugauacgcuucuuuuucuuuuuguuuuuuguuuguuuguuugagauaggguuucuuuuuguagccuuuacugcccuagaacuaucucuguagacugggcuggccucagacucacaaaauugccuuuccagggcuaggugucaugauauacuguaaucccaguacaugggaggccagggaagagaauacugugaauucaaggucagucuaggcaacauagccaaacccugucucaaaaaaaaaaaaaucaggagggaggaucauuaugauggcugggggcgggcguuaaguugucugacaaccugaauuccaucccugagcccacaugguagaaggugauagccaacuccucaauguuagucucugacuuccucaaccacacauaucgcaaauacacugugauccuccugaguuguggaauuacagugugggaaucauaaguacacagcacacccuguuuauuuggugcuaguuauagaccacagcauuugagccuucaggacagguguucuuccagcugagcuacaacacagcccucuacuuuagauuguuucuauuaacacauuucuuuuaugacaguugguugaaggacuggaaaagaagagcugaacuggaagaaagacauaauuugaaaggaaagagagaugaaaaagaggaagguauuuuggguuaguuuuuuuuuuuaauuuuuaaaauuucauugaacauuuuagaguugguuuagcuaaaauucacauaaacuuaguaaaagauugguacuuuucauguuugacuuuuuuacuuuuugugaauuuacuuuauaguauuuaugugcaagaaauuuguaggauuuaauugcugucucaugagguaaaagugcugccuaaguaguugaucauuucauuuguauuuggauacuuuuucagauuuaucggauagcacggacuuuaaaggcaguucagaugaugaagagaaucgucuuugcaacacuguucuuauaacaggaccaacgggagugggaaaaacugcugccguguaugcuugugcucaggagcuuggguuuaagguuaguaguuagcuauagugaauguuaauguaagaacugaacugaaaaauaaacccgccagugugccuguagucuuagcauuaaacuagaagagcacagacccaaagggcagccuguguuaaugaagccuuguuucaagaaagagaagagggggauggggagaugacucaguuggaaaagugcuuguggacugaguucagauuccccagcaccugcaugagugcugccagguagugcauaucugcugcccuggggcugagaaggccaagucaggcauuuuucuugaguuuacaaguggaccucaccaaucaugaauacgagguuuauccaaagacuguuguuuguguccuuguuugguugaugguaagcuagccuggccuggagauuggccugcccugccguuuugggugcuaggauuacaagugugcaucaccaugugcaucaugacacauggauagaaggcuccuucuugggcuggagagauggcucagccaguaagagcacugacugcucuucuggagguccugaguuuaauucccagcaaccacaugguggcucacaaccaucuguaauggaaacugaugcccucuucuguuaugucuaaagacagcuaccguguacuuacauauaauauaugaauaaaucuuuaaaauaaaauaaaaggccccuccuuaaaaaccaggguugcuguagauagaggaauacacccaaggucauccucuggcuuccacaugcacucagugugcaaagaaggaggauguaagcaugaugguucacacuugcaauccuagcaguuggaaagcugagggcugaggcaggagaacugcuguggauuuguguaaggccuaggcuacgguaugagaccuugucucaagaacaagaaaggaaagaaagaaaaaaaaaucuauuucugucuuuuacauauauauauauucuuuuagauauuugaagugaaugccucuucacagcgaagugguaggcaaauccugucucagcugaaggaagcuacccagucccaucaaguagauaagcaagguguaaacucacaaaaacccuguuucuuuaacaacuacaacauuggcaagucaccaaguaaguaaucuauuacuuaagcuauaguaauguuuugaaaaaaucaaaucuugagagaauaauucucauaagcaucuacaguuauuuuuucuauuuuucugcacauaaacacacuuuuguuccucaggcuauuuugaaguaaaauaaauccgaagggcauagacucuaacaucaacaccauucuuauauguucuaaacacuaagggcuuuuuaaaaaacagcaauaguauaaucaaaccuaaacgugaagcuuguuccuugcuaaaaacagucugauuucaguuguuugugauuuuauaugguuuguucaaaucaggauccaaacaaggcccacguuucacacuugacuaguucuugcuuuuuggguuucuuuaaccucucuaucaagucccuaccuuuucuuuuuuuuuuuuuuuguuuuuuuguuuuuuguuuuuuguuuuuuuuuuguuuguuuuuuguuuuuuuuuccauuuuuauuagguauuuaacucauuuacauuuccaaugcuauaccaaaagucccccauauccacacacccccacuccccugcccacccacucccccagucccuaccuuuucuauuccugucauuuuuauaaugaagaacugagcccuugucuuacuauggauuuggcuucuuacuguccuuccuuccuuccuuccuuccuuccuuccuuccuuccuuccuuccaucagucacugguuaugggcucucauagauuuauauucuauugugugacuagaauacugaaguagguagacuuguucucccuaugauaccgugaaagaauaccugaugcacaucaaggaauugaugaaugaguucaaguauuuucauucuggcucacucgggauaaagcucugucacaucuuuaguguuacuauggggccagccaucaucucugucuaguagacaaugugucucugcucacgggugauuccucuguuuuucaguccuuuucucuuuuauucgauuugaauaguuauugccauauauucaaguuuguggaugugcucugcaguaucuaagaugcucuuggugggugcuguccagcauaguuuucauuuucagaaguuucaugugggucuucuuuuauccucuguguuuccaguuaucacaugccccauuuuccuguaaauaucugaucacacagaauaugguuauagcuguuuuguuauucuugucuauauaucugucaucuguguaguuucugaguuaguuuucagcuuuuccugucuuauggauuauauucuucuguuucuuuagguguuggguguguguccacaugcguuuaugugcaccuuuugcauguagagcuuacagaugccagaaaguauuugaucccuggaauuggggguacaggcagcugugaacugccugaugugggugccgggaacugaugcucauagguccccgaggaaagcuauaaguucuccuggccacugagccaucucuccagccaauugccugucagacuuuguacaguuuaucuuguuagauccuagguauuucugucugcuuuaacuugaccuuuguucugaacuuguuugguuguuucaggucugcuauauuagcagcauuuagaccugggcugauucugcuucucucuauaagacugcaccugaacaccccugcuagucucgcagcaaugauauugguuggucugucuagucaaaagauucaagcugggcgugguggcacacgccuuuaaucccagcacucgggaggcagaggcaggcggauuucugaguucgaggccagccuggucuacagagugaguuccaggacagccagggcuauacagagaaacccugucucgaaaaaccaaaaaaaaaaaaaaaaaaagauugaauucagucaggcaagguggcacaugcuuuuaauuccagcauuugggaggcauguggaccacuaugaguuugaggccagcuugguuuaaauagugaguucuaggccauccagggcuacauaaugagagcguaucucugaaagaaaagaaaacaaaaaucuaaauaaaaaagggaugaauuugccauuccuagauuuccgugugucucaagauuuguuucccauggcuccuuccucaugaguacuuaauuuuagacuuggcagaagauaagaugguucugcagauuuccgagcucucugcacagcuaucucaacuuguguguucucucauucccugcaguagucuucuuaggacuuguuuccuuucccacugcagcuuaggaauucuuucaaagcaauaagcugggcagucuucaagauuagcuguucauguugucccucaaggauuguccuuuguuggguggcagccaacaacuuagaaagcauuucauacaggaugucagcuuuuuauuguuauuuauuguuuuacauggaaaauuaaauccagucucagaugcuuuuaucuugccuagaagcagaaucacacccuuuuccucuggugguuauaucucccccucuggcuggcagggaacuguuccaguuggucuguaguuuuuugauuggccucuggaaucacuggaucuccugccauucuagugugccagauagcccuaaucuuaggguuggcuggaggugauucuuguuuuggaaguuauuuuuuuaauuucaaugugaguaucuugaaauuaaagguagcacauaaugccagguaugguaguucauaccugaaauaugagcacauauuugagacugagauggagggcugccaugaguucaaagcuagccuugguugcaaagugagaaacugucuuauaaaggcaaagaagcagucagacuuaugguauaauggauagaaugcuuaacuagaauacagugggugugauagugauuccucuagucccagaacagcagcucaagguuaucuguggcuguacaucuaguucaaggacagucuggguuucaugagacccuaucuaaggggacuuagguaucaaaacaguaguauauaauuuuuaagauuaguaauccuuugccugugucaaaaauggaaaacuaaaaaguaguauuuccgcuauuuauucauuauaaacaaauguuuuaacuaagauuuuacaucucuuaccuauguuuuugccugcauguguguaccaugcuugugccuaguucccacagagaccagaaaaagguauuggauccucuggaauuggaguucuauaguugugagcuauugaacucacaguauggugcuaggaauugaacuaaagugcuuugcaaaaggaacacguguucuuaacuuugaggcuucuuuccagccccagaauggccuggugauuuguaaauaaacuuauagcaagaauaacuauuuuaaacucaaaauugucauuguguuuccugaacaccuccaaaauguaagugauaggauaugauccauggauauagagcagacaauugagcaaggcucaguuacggaauuaugugaguaggauggcuaccacggaagauacugcucuacugcuuaauuaaggcugucagaacugagacaaggauggaaggccucacgcugcaagagaguagagaucaucccuuuauguucugacuuuguauacauccuccagaauaucuuucuaaauacacacuguucgcauguaauaaugauguacuauagaggccaggauaugccauuaccuguuuuuucuccaguaucuucugauuucaagcagcuauagaaaaaauauaacuggaggaauugcgaguauuauuucaaaauuauguauuuacauuggacauuuggugcauaccuguacuuagaaggcagagguagagaggauugcuaggucugcccuggcuccaagaauggaacugacuggggaggugagagaauaaagaaaaauuuaaaauacacacauggagaaaagcugggcucagguggacugggcucuuugauggagaaacccuaacaccucagaaucucagcaaguuuauuaaauacaguugaacagagaggcaggguuacuguauacagcugcaaccagagaugggguuauuacauacagauaaaaaaaggaggcagguuucacucuucuaaguaggauuguucuucaagcuguaaauauggggagcgggaggcuaugacagacuuuuucugcacauauuaucaacaucuacacacagaugagaggcuuuaccaucacucugagccuggggaccagggugccauuuucccaugggucugaggcuccacaccucaaaaguuugagucagccguguaugguggcgcacgccuuuaaucccagcacuugggaggcagaggcaggcagauuucugaguucgaggccagccuggucuacaaagugaguuccaggacagccagggcuauacagaggaacucacggaaaaaaaaaaaaaaaaaaaaaaaaaagaaguuugagucuaucugaguaucuuagaaagacuguuggagccaaucaaagaaaaguauguaacuuuggaaaagagcaucuuuuccaacuagcuucuuuguccugucauucucuuagaauaaauagaauaauaugcuaauaucuguguugagcauuuacauauaagaaugaaagaaaaugucugccuuugguuuuucucauguaagaguagaaauaaacuauagaugacuuuaucuggccaucaguguaauuuagaauguuguuaaaugcaguuuguuuuucauagaaaaguuaaacuccccggggaaaguuguuacaucaccaaggaagcuuccuccaucgucaccaaagacaagugggcagaagcgagcacuucuuccuaaaacuuuggcaaauuacuuuaaaguguccuccaaauccaaaaguaaugacgacguaggagcacucaugggagaugacaaagguaaagcagaaguuaacaaaauaaauuagcuuugauguauaaaacugggaauggauuuccuggauuccugugcuaauaguucuaaauauagaagcaucgcuauugaguaaaguuuguuauuggaguucaguuuguggguauaccuaguguuuuuuuaacaguuuguccagguaugguagugcauacccuuaauucuagcacucuggagguggaggcagguaguucucuacaaauucaaugccagccuuaucuacacagugagaccuugucuaaaaaagcaaaaccagugaguguuaccuaaaauauuaacauuguauuaaugcaggagucaaaaauucgucuuuggaacagaggcaacuuauucagacuaaaucaaccaaugcaaauaauucacauauuaaagauguuggagcugaagaauccaacaggaagaaggcgacaucacucauucucuuugaggagguaggcuggcagggguguguucaggagguguuauaguaggaacauuuaaagauuacugugugcugcuucucuuuucucucucucucucucucucucucucucucucucucucucucucuuucuuucuuucuuucuuucuuucuuucuuucuuuuuugguuuuucgagacaggguuucucuguguagcccuggcuguccuggaacucacuuuguagaccaggcuggccucgaacucagaaauccgccugccucugccucccgagugcucugauuaaaggcgugcgcaaccacgcccgcccggcuacugugugcuucuuaaaagaaauuuuaagauagcuaagaaauccaagaauacuuaucucuagaauaauauuuuuuuauaaagaaugguaauuaaaaagcauuuucucuguauuauuuuauauauguggauguuaggccugccuguaugucugugcacuguguguguacagcacccuuggaaggcagagaaggguauuagaucaccuggaacaggaguuacaggugguuaugagcuacuaccauguugaugcugggaaucaaacucagauccuuagcaagagcagccaaugcucuuaaccacuaaauuaucucucuauccuugucuagaauaauucuaagaugaucaacauauuucaaggauacuauuuuauuaacaacuauaaaaaugacucaacuacccagugauuaguuagcgauuuuauuuuauuuuuauuuuuaauguuuacaaugugaccaucuuaaagguuucuuuauggaaugagacaaacuuuucuccaggcaguaguggugaacaccuuuaauccaggcaaucaggagguagagacaggcagaucucugaguucaaggccaguuuacagagugagugucaggacaguccgagcuacauagagaaacccuauaaaaaacgaaaaacaaaaaacgaaaaaauagcaacaacaacaacaacaaagaucuauguuggcuuugacauaguauaucuacucagaucuauaacugaucuaagugaguguauuguugcucuuacuauauuaauauucuaauaaaugguuuguagguugaugucauuuuugaugaagaugcuggguuuuugaaugcagucaaaaccuucauggcaacaacuaaacgaccaguaauucucacgacaagugguauguaaaaauaauuucaguacuguuugguuuuguugaaauauuuuggaagagcuacuaacuuuagacaucaggugagugaggcgggguauggccuggagagagcucagcagauaaaaccuaccggacaaaucuguugaccagaguuugaugccugagaaacgcacagaaagguagaaggggaaacccaguuccccaggguugcccugauacauacaugcuuauguacccacacacagacaucaugcacacagaacacacaagaauuauaaguaacauuuuaaaacaaaugggguuacuggaaggauggguuagugguuaagagcacuuguucuuacaaagaaccuggguucaguucucagcaaccacaugguagcauacaauuaauuaucuguaacucaaauucuaggagauccaguguccucuucuguucuccucaggcaccaggcacucacaugggauacagacauacuuguaggcaaaacacucaaacacaaaaauaaauaaauuuaacuccacccuaaaaaaaacaaaccaaaccaaacaaaccaaaaaaccuaguaugauggcacaugucuguacccaguacucacaaggcagaggaaagagaauccccacaaauuugaggcuggccuaaugucuguaaugaauuacaggucagcuagugcuacauagccaaauccucucccagucuuagucugagcuaauuacacuuaagcagaggcaggaagcugagaucuuuaaagcuagcuggacacuguaucaagauccugcuuugaaaauagaagaaacacacauaggcauacacacaccucauagcaagacccugccuuguaaacaauagaaacacacaggcauugagcccagugaccacacgcaaagcucuggauaggauccucagcaccaacccuccagaaaaagucaguugaaaaauucuuuuuuaaaagcagccugugcucuuaaccacugugccguauuucuagccccuagauuuauuuuuacaauguguauaugaguguuuugacuguaccaugugcauggugcccacagcagucagaagagagcagcagaucccuagaacuguaguuaugugugguugcaagccaccaagaaggugcugagaaccuaaugagguccucuauaagagcaagaaaagcuauuaaccaauugagcucucucuccagcccuuggaagcuaguuuauuuguuuuguuuuguuuuucaagacaggguuucucuguguaacagcccugacugucuuggaacuugcuuuguagaccaggcuagccuugaacucacagagauccaccugacucugccuucuaaguguugagauuaaaggugugcaccacaaugcucuguggaaacuaguuuuuuucaaguaagaauuauucauauuuguauuuacucgcagcucuuguuaguaguuauaaaauucaguauauaugaguauagcaauggcuauuuaaaaauguauacuacuuuggaucacuguguccaguguuaagacacuuaaaagaccuaaacuaaggauugccuaaaacagagacuuacaaaauaguugauauaucuauuauaguuuaauauauauaauauauauguuguuauauauuauauauacuuaauauauaauauauauaguuuaauauauauaucaguugagcagugauuguggagggaggcagaggcagagggaggugaguuugagguaaucuggccuacauagugaguuccaggacagccagggcugcgcagagaaauccuaucuucaaaacaaaacaaguccuuuucuuguuucuuugucauaccuauaauuagcaaccaacagagcgugugugugugugugcgcgugugucugucugucugucuguguuguagucuuauucuuuaggcaggcuagcuuuggccucaaggagacauccuuccucauccuccguuugcagggaugagcucccuccugguuccccgcagaucccuaaugaauuuauuagcacuucuucaucccaugauaaaacuucaaggagaucuguuuccuguuuaguuaaaguaagucuucaucagggucacagaauucuaucuaccuuggguaugagaacuggguguuucacuuuaaaaauccuuauaguuuuuuuauuguuguuugagaugaucuagaacucuugaauccucuuugcucagacugauggcauuauaaguguccaccaacauacuuggccauaauuuuaaaaaauguuuuuauuauuuaucaccuauaucuacacauaugggccauaaaaccugugcaacagagcauauauggagaucagaggacaacuucugguaauugguuuucuccuucuaucaagcaggucccggggauugaacucagguugucaggcuuggcagcaaacaacucuaccuacuaagccaccugauuacuccuauaagaaaaaagauauuagacuggaugugguaacgaaugccuauaauccccucacucuggaggcuuaugucggaggauuaaguacuacuacauagcuagaucuuggcuuaaaaacaaaagaaaaguaaacuuugcaacuauucaaaaggcuaacugcugcaaugguucauuucugguggauguuacccuccaugucuucuuucuuuguuuugaugcuaggccuauuccuuaccaaggagcuauauccccaguucuucaauuacuuaaaaauaugaaaaccuuaauaaucauagguuaggugauagcuucauuaaaauguccuucuguagaucaaaagagaagguuccauaggggguuauaauuugcaugauacuauuguuuccuuuuaucuaugaggaauacguccaagacccccccccccaauggucagugguugcuauauacaguucaugguaccauaguguauauacgccuucuuccuauacauauauauguagaacacuuguaaccuagucacauuaaaaaauuaauuaccaagagaacagucaaaacaccuggagagcugguucaucaguuaaaagcacuugcucucgcagaagagccaggcucagcccccagccccugaagaccagaagugucaguucuagagcuguaguuacaugcaaucaugagcuguuucagagaggcgcaagaaaccaaacucuagucuccuacuaaaacaaaaggcacuguaaacacagagccaucucgacaacuccuguuguaaauauacuauaaauauuuacuuuagauguugucauagaagaguauaacugggaaauguuaguuaguggucuuauuuuauuaaaauauuauguuguuuuccuauagaucccacauuuagucuaguguuugauggcugcuuugaagaaaucaauuucaguauuccuucccugguaaguuuugaauuuucaugauuacagauuauauauauuacaacucuguaaaagauaucuuuuaaauuagauuuauaguuuuaaaauggggggguaaaauggcuuauuuauuuuuauuuuauguguauugguauuugcuuacauguaugucugugugagggcaucagaugcccagaacuggaguuacagagaguugugagcugccauuugggugcugggaauugaaccuggauucucuagaagagcccuuaaucacugagccacauuuccagccccuugaaagguguguuuuaaagggaaaugguaaagcuucugagcuucaagaaacuugugaugauuuccucuuuugcuuuaaaaugagguuauuuuucagauacuaaguuuucuguguacccuaauauuacuuuuuggguuggguuucugggguuuuauuccauugagacugucucaccauguacaggguuucucuguguagcccuggcuguccuguaacucacuuuguagaccaggcuguccucgaacucagaaauccaccugccucugccucccgagugcugggauuaaaggugcgcaccaccacgucugaccacuuuauuccuaauauuuuauuuuauuuuauuuuuauuuuauuuauuuauuauauguaaguacacuguagcugucuucagacgcaccagaagagggcaucagaucucauuaugggugguugugagccaccaugugguugcugggauuugaacuccggaccuuuggaagagcagucgggugcucuuacccacugagccaucucaccagcccuauuccuaauauuuaugugauacuaugguguuggcuugguuauuguaacuagaccaagccuugagaguagaaacuguaacccuucuaacuguucuuuuacaaagccguuuuguuacagguauuacuccacuaauuauuauuauuucuccacuaauuuuagagaucgauuuuuuacaauuuauucugguguuuuauuggaauugcauugaauuuauagaucaaauuugggacaaaugacauuugauaauacugagucuucuaauuaagguuuuuuguuuguuuguuuguuuguuuuuuugguuuuugguuuuugguuuuacgagacaggguuucucuguguaucccuggcuguccuggaacucacuuuguagaccaggcuggccucgaacucagaaauccgucugccucugccuccugagugcugggaucaaaggugcgccaccacacccggcucuuucuaaugcuuuuauuaauuaggacuucaguaccacacuaaauagaggugcugauagugaacaguccuagcaauauagagaaguuauagaggagguaauuacuaucacuguggccauaaaaacagcugcagaagauguuguuguuguuggugguggugguguuauugguguuguuggugguguuggugguguugcuguuguauauuugugguaggauuaaggauaugcccugucaacgcgauuuuaaucauuuuuauauaaacaauaaauguauuacuuacguucgauuuuucuauauuuuauguuacucuugaauauugcacugauacaugugguacagauuucauccuguauucagugcaauacacacaugcuuaaaccacacagauauacacacauauacagacaccugcugcauucacacacucauccacauaaaaucuacacaugauuagaaugcuucauuaucucaguacuugggaaacuugagaaagaaggauugccaauuuaaagcuaaauaagguuguguagccagccuggcuucauaacaagacuuugucucaagaaaggugguaguguacgccuuuaaucccagcacucuggcagaggcagguucgaggccagccuggucuacagagugaguuccaggacagccaggguuagacagagaaacccugucuggaaaaaagaaaccaaaacacagaaaauaaaaacaaguccuggaauucugauauaaugaaagaagguuacuauccacuaaguucuaauccaacagauauuuaacauugucccuucugucauuuauuuguaagcacauaugcaucuaugaacucaauacaauuuucuauuugauuuuagaaaaacauguuucaauauugcuaugauauuuauaauuuuaaugguuauaaaacaugucagucagucagauauaguggugcacaccuuuaaucccaauacucaggaggcagaggaugguagaucuuugagaauccuuagacuuagucuauggagugaguuucucucagggcuaugcagagaggccccaucucaaaacuuaaaaauaaaacaaacccaacaacaacaaaauucugucaaguguaccauuucuuaauccagcuuuauaaacuuccuguaguguucaaguuggagaacuuugcauaaguuucuuugcaagguuuaauguaguacacaccuguaauaccagcaucuaaggcagaggcaaggaggauccugagucagcccaggcuauagagccagauccugcuuaaaacaacagcaacaagacaaacacaaaucgguacaggggaacaugcauguaauccuagcauuuggaagguggaggcaggaggauuauagguucguguuuaaggccagccuggguuguaucuuaagcacauaaacacauuuuguuguuguuguccuggacuauguacaguaagcucaagaaaaauaaauguuuuaauuuggugguauauguucuuguauuuuuuuuuuuuuuuaaauuucuuuuuuuuuuuuuuuaagauuuauuuauuuauuauuauauguaaguacacuguagcuguccuucagacacaccagaagagggagucagaucuuguuacggaugguugugagccaccaugugguugcugggauuugaacucuggaccuucggaagagcagucgggugcucuuacccacugagccaucucaccagcccuguucuuguauuuuuuagagaaauuuuauuuucaaaaacuucucagauacuauggauuguuagcaaaauucgucaucauuauucagguuuauugcuauauuuucugcaauuuauguaauuaaccauguguuucucuccccuaaaucuugccuuguuuuucuauuuuuaagcuaaauguugccagcuaucuacaagugauuugucuaguugagaauuucagaacugacuuuaaagacuuuguaaccuuguugacugcaaaugcuugugacaucagaaaaaguauccuuuacuuacaguuuuggauuagaaguggagguggaauuuuagaagaaaggccauuaucacacugucguaaguagucuguuaugugaaacuuuuugauuuggggaccauauucuuauauauacucuaucaaaguauuucuaaaauuauaaguuaagugucuagcuaugcuaauuuuuauaauacacauacauguauuuauuuauuuggucucauuuuugcuuuugguuuaucgaggcaggguuucucugugcagcccuagcuguccuagaacuggcucuguagaccacaacucagagaucuuccugacucugccucuuaagugcugggauuaaagguuugcaccaccacuacccuacuuucaucuuuuuaauaaagguuuuaaaacuauuaaguguaaguaaacagccagaugugguggucguggacaucuguaauugcagcaguuuagaggcagaggcaggcuaaucagaaacuaaaggccagccugggcuauauaacaccuucucucaaaucacaaaacaaaaagaaaaagugcaaauagauugaacucacaaaaauagagggaaacuuuuucccaguaugguguugcaagcccaugccuccaguucugcugucucuuacaaggugaaaaagacagagccccuagagaacaggccuuagauuuuucuaccacaccucucaagcucccugcagucucugaagcaaaccugaaguuaguaaugacaguguuugggaaauggaggcuagaggaucaagaauugaaggucauccuuggcuucauagcaaguuuaggacagcaaagaauggagcuagagagauggcucaguauuuuuuuuuuuuuuaaagauuuauuuauuuauuuauuuauuuauuuauuuauuuauuuauuuauuauauguaaguacacuguagcuguccucagauacuccagaagagggcaucagauuucguuauggaugguugugagccaucaugugguugcugggacuugaacucgggaccuucggaagagcagucggcgcucuuaaccacugagccaucucgccagcccaugcucaguauuuaagaguacucacuaacugcuuccaaaggacccggcuucaacucuagacacccacauggcagcuuauagcagucaguaacuuagcaucugacacccucacacagauaugcauguaggcaaaauaccaaugcacaucauagauagaugguuggauggauggauggauggauggauggaugggugggugaauaugaacaaacacuccaaacuauugcuuauacacuuguggacauacaguuucuuauagaauuguuguuaccuuccuucuuucacuuauaaaaaacauaccugugucagguauggugauguauuccugugauccuggcugaggcuuaggagagguaaaguccuucuuagcugcauugaguucagccuggacuauaagaucuacuaggucagugagguguauuuaaguauaaaguccugggggcuuuuuguuggucucucuaugauaguauaugcaugcuuuguguggacccgugucuuccucaauuucucuugcuguuucccaguuuuguuuuguuguuguuguuuaguuuuguggggguuuguuuuguuuauuuuugguuuuguuuauuuguuuguuuuuugguuggguuggcuugguguuggucccccccaccacagaccaaguuucucuguguagcccuggcuggucuugaacucacaaagauccaucugccucugugaugggaauaaaagcaugcaccaccaggcuuguuuugcuuuuauuuuuuuuaauuacguguuugcauuuauuuauuggugguguggagaucagaagacaacuauaggagucaguuccccucuacacuaugagucccagggccugaacucaaauugucagcuuagccacaggugccuuuaucugcugagucauuuuauuagucccuuuuaaaaaaaaaaaaaaaaagauuuauuuauuauuacaacuaaguacacugaagcugucuucugacucaccagaagagggugucagaucucauuacagaugguugcgagccaccaugugguugcugggauuugaacucaggaccuuuggaagagcagucagugcucuuuaccgcugagccaucucuccagccuccacccccccauuuuuguuuuuaagacaggaucccaugcaguucugucuuauguaacuauacccagcuuauaugucuuuguagcauauuuaaguuuguaauucuaauuuucuuaagaacuuggggccgggcaugguggcacacgccuuuaaucccagcacucaggaggcagaggcagguggauuucugaguucgaggacacagagaaacccugucucaaaaaaccaaaaaaaaaaaaaaaaaaaaaaaaaagaacuugguuucaguaauauuuuucucacaugauacuuuuaguuuuuucugcucuccagucacuguuuaaccugaugaaaccugauuauagcauaagcaauuauugauuacuuccuccauucuaggucccacguuuucaugugucagccgugcuuguucccuggguguugcuaguuuuuguugccugcuccauagucacacuucuguagggaaagauucugcucaaauaaaugaucacacaaacccaagggcaacaaacaaaauaggaaagaggaagaugaaguucuauaaaacgaauccccugucauuuuucuuuucaauuaguuccaaauuuaaacauuauuuuucuuuuuuuaauuuauuuuuauuuuauauacauugguauuuugccugcaugugugaggauuuuggauccccuaggacaauugugaguugccauacaguugcugggaauugaacguggguccuuuggaagagcagccagugagccacugagacaucucugcagcccuuaaaaauuacuuuuuaaaauagaacuagccugggcugcagagguggcucagcugauuagagcacugacugcucuuccaaagguccugaguucaauucccagcaaccacgagguggcucacaaccaucuguaaugggauugaugcccucuucugguauuuuugaagacagagacaguguccauauaaacaaacaaacaaacaauagaacuagcuaaaaguuuccuucacuguaagcuggcaacuuuagcaaauucucaaaaacuuaaugcgauaaggcauuggggggaaagccauccugguacaugugugugauggcgcccacccugaggcggcaggaucagauguacaaggcugcauaucuuuuuuuuuuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagcccaaggcugcauaucuuaggaauaacaguagcaguuauccucugaccaccaaacacaccaagaaggucaagguuauccuugccuacauuggaaaugugaggccagccuggccuacaugagauccuaucucaaggaaauaauaauauagcccuuggauaaaaaacaauuaauaauauaucaauaaaagaucagcuugaauugugucacuuagguauuuuucaaaugaguuauuacauugugucuguaaugaggcaagcacauuguggagaacagaauggagcggagcccuaaggccggugcccgugcugucuucuauuugggucauuucaaaagcauucacauaagauuggucuucauuacucuuuaggagaaaauagcagaaauacacugguuuguucagaagauggcucugaugcaaacaucaacucuaaaaaacccaaaaggaaccguguggcccuccccaggugugacacuggcugugcagaggcuuuguuuggacucaagaacauugccuccccaucccaggacuuacuuucauuauugaagguauuuucugugucuguguggaauguugaauucauguuucuauccaucuccuuaguauuuacccugcauuuucaaucuuaauccagguuuaaauucacuuaacauuuucuuucuuucuuucuuuuuuuuuuuuuagauuuauuuauuuauuguauguaaguacacuguagcugucuucagacacaccagaagagggcaucagaucucguuacagaugguugugagccaccauguggaugcugggauuugaacucaggaccuuuggaaaaacccaccacugagccaucucuccagccccauacuuaacauuuucuaaacucuagaugugagauuuuuaacucaauugacuguguugacgccuaggcacagcuuuaaaaacacaggaugggacucagguuaaauugagccaggcaugguggggcacaauucuggaggcagaggcaggugggucucuacuucaagcuugguuccagaacagcuagggcuacauagagaaauucugucuagaaaaauaaaaaguaaaugaccuucugauacugaauuggaguauguacuaaauaaagaacacuaguuucugaauguaaaucuaguuuagacuuagaauguuuuccccucccuccuaucccuuucuuccuuuuuuucauuuguuuguuuucuuccggaagcccuggguuuggucugaggaucuuagugcuuauuagguaaauguuuuucacuaaccuacccagcccagucaguacuguuuugauguguuaaauauaaucuaauaaaauaacaaagaguagccacuuaauccuuccaggauauaauagguguuggggagguggcucuguaguaaagguguuugcaguucaaggcugugagcacuccagugugaugccugggccuacgugguggggggaggagagaaugacuccacaaguucucugaucuccacaugucuccugaggcaccccaaaaacaaaacaaaacaaaacaugucaccuauguaguagaugccuaaggacaagucuguguucaucagggugggagaaugucuggagugggcacucuuaaagcauucuuauucaauugcuuuucagcacaagaucacaacaaaggaagaauggcagaaacucauucagguucucaccgaauuccacgugcaaaauaucgaucugcuacauaguaaccuugaggucauccugccacugccaguucaugugguuccagauguaaggggugcuuauggcuucccagugacuacacaggccagugcaccagcaagcauggggcaucuuaccaggaagcagucaaaagaccagccauugagaaagucacagaaaaggaaacagaaaaagauggugauccuagaugacagugaccuguuugacacuggccuagacuuuucuggugaacugccuagccuaucuccugcacccuccuugucuguagaagacaacauaagaagagacagcaauccagagauuaagacacagaacagugguuucaagccccacucuguaccucagcccccuaagacacuagcagagaagaaguguugcaugcucguuucccacuguuuaaauucucucagugaguucauggagaacauguccuucauagaugcucuuuuaacagauccaggggaacagaaugaauuggguagaagugccuuucacuggacaaauggaaggguuaaaaguggacuuugugaugaguuuagucuugagaauagagacaggugggcuccucagagcgcuggagaauuaaaagcaacugcagaagcacugagcuuuacugaguguucuucuaccauuucaaaagcacuggaguccuugaauucaugcaagcaauuagaaagagacccaaccaaugaacucacagucuguguuucacaaaggcgccaugaugcaugcuuccgccaaucagcagcuaaucuagaguaaguagauuuguuaccuucuauuuauuaguaaccaauggcagggauucuucuuauuaauuuucaaaugcugggccauugcucaugggaaacacuuagugcuaacaguuucuccugcaaaugaagcagauuguugaagaaacuaauuuggauggaaauagggaagccugaggugagugugguggcacacaccuuuaaucccagcacuccaggcaaaggcagggagaccucuuuguuccaggccagaguggucuacaaaccgaauuuuaggacagccagggcuacuugggagagacccugucucgggggugggggggauaauuaauuugggagcuuuucggcaauggagaggggcagacuugugacagguaaaagguagccauuaagauauuucacugugacaccaggcaugugaauauucacaucacagagaucaagaauuugaugccagcccaagcuacaaaacaaaguucuaaacagacauuuucuauaugaagcugagugugguggugcuagacuguaaucccagcacuaggaacugagguugaaaucaggcugagcuauguagaguuccaagccagucuggauauauaugagugacugaucugcugacaggaaauuaaaaguguuaucuggucuagaccagaagcagaaacacuuaauuuggaauuauuacguauuuauauacaaaauaauaaauaauacuuacucuuaauuuuuagcaaugcugacaagaggauggcaguuauuaaaaguguguuuucuagucguucuuuucugacccuggguaauaaacaagcuaguauaauugacuaccugccaacucuucggaacauuugucggacagaaaagcuaaaagaacaagagaaaaauaaaagaagguaaaguguuuuuuuuaaaaaaaaguuaauauuuagguaccuauguuaagauuaauguuugugggaauggaaacacuaauauuaacuauuuugugauuuugacagguuucugcacuauuuugaaggaauucaucuagagauuccugaagaaaccauaacuacuuuggcagcugacuucccuugaugcuccccgucgucagccuuguagagacugugugguccugaugacucuagaguauggugacuuuaaagaagagcuuauuucucuuaauguaaauuuugaaagacuuuuguauuuuugugguucaaguuuaaaaugaaaaauuugaguuacaaauuguauauaugacugugacauuuuuucugaauguuuggauuaucuauuuuugcuuuauuguauacuuucuguaugugugaacuguuuguagaauaauuuucacuuauagauuucuagagcuguuucaguucuaagcuuaccugucauuuuucccuuuuccuguaauuguccucuccugccaagcagcagagcugugccacuguaaauaggcagucucuaaaguuacacaauggaaaacaguuauguacaggguauuuuaaaauguccuaggaaguaaauuaugccucgguugugaaaagcauugccuuuguuucuugugccuucuuccaccacguuuuacauguaaucauugagucauuagcacuggcagaguaaagccuucugaauucuagcauuugccuagauaagaccaucugucacucacucccuguaguuacacaguccagugaaucuugccaacucaagucguuuguacauuuucugguacuuuuauaucauuguuuuauuucauaaaguaaugacacuguuuaucuguuguggacaacuuguugaugguucaagaaguaaugacggauucuaccauggggcuucuaccugacugcuguucccauuugaguauggcguuuguuguugguuuuuguuuuuggugcugaggauuaaauuuaaggguuuuuguauuauaggcaaaugucuuguauccuaguauauacacaggcguuguguuuuacuaauuauuugcagugguacguaucaaauccaagaucucgugcauucuaugaacaugcuaaaccacagagcgagaacccccauccuguuuuugaggcagggucugguauauugcuuaggcuacuccuaaucuccuuccagaauuuuguaauccccgucucaagcuccuucaguacuuacagguauuugcuaccacacugagcaaggucaucuuuuaauauuuuuugaguaccuauuuuuaacuuuaguagcaaguuuuuaaaaugcacauuuuacuuaauguuauuuugcagauuaugagguuuguuuaaaauuccuucauaauguaaauauuuguauaauaauauauuauucagguacauuuucugaugaauuguauuuuuaauucagaagguaaggauccuaguuuuguacuuuuuaaaaauauaguugcauaccuguuuacaaauguguauaaagauguguuuuuaccucuuguucaaccuaccuucuugaauuaguuaguaaauugaucuaauuaaagcuaaaugcuugguguguuaaau

SEQ ID NO: 6218 - RNA, 25358 nt, Mus musculus
uggggaucugaauccuucuccggcggacagggaaacgccggaccaugggcguccaggagcgggaagcacagagguggcaggguugagccccgcugagaccucugggccggccaugggcgaccgcgagcgcaacaagaagcggcugcuggagcugcugcaggcugcgggcaccggcaacgggcacugcgccgacugcggggcagcggguaagggcgcggugugcgggacaggugcagccagccacggccccagcuccuggcccacccgcuccuucccuaggagcacgucaacgcgcuacucagacucgcucucgcuuggaaccccaguccuucucacuggagaguuucgggcggccccgacgguucuccgucucccugcucccgaagcccaggaccucgguccccgcuccgcaucagaugcgguccaugcccugggucccucucgcucucucacccggcaccuuaccacccaggacccugcucuggacaccauuuccgauccccggcccuuaccgcgcccuuggacccugagguccucacccuggugccuccugggcccccgcgacccucacugccgcgcgcgaugacugaggaugcugauguggcuggccccgaacccugagccuccaagcgagucccucacuugccugcucuccuccguucccccuuccgaggucuccugggugucaucgagccaaagggugggcuaggcacgguucacgcugucaccucaguuguccaagguuggggaccaagagaaaaaggauugccggcgugggcagagcuugccuccgacccagaauccuaacuguccagcccagccugucccugcacccuaguccaggccuuguccagcucagcggagguccugcucuuccacccugcagauccugauugggccucuuacaagcuggggauuuucaucugucuccacugcucuggcguccaccgcaacuucccagacaucagcaaaguuaaauccgugagacuggacuucugggacgacaguaugguggagguagacuggcacgcaugugcagauucuuggacuugggcgugagggagaagaggagggacgcagguguuccuccuauuccacagaggaggaaaaugaagcccagagaggugcaaugauuaaugagaggaaacacagugucuuagcaaaggcccugaguuuguguguguguguguguguguguguguguguguguguguguguguguguguguauguguguguguguguaucccugaguguauguaugccacacaugcgcaggagcucagaggucagaggaaggcaccagauccucuggaauuggaguaaccaauaguugugagcggccaugguggugcugggaaucgaacccauguccucugcgagagcaguaagugcucuucauucuugagcccuccagcccuggcgcuagggccuuauucuugacucuggaguauguuuccacacccauguaguggacaugucuauaagcccagacacaaagugaauuaaguuacugucaucauucguaggagacgggaagugaggaagagaaacaucagauucauagccuaaggucccucgcccuuucccagcccacucugcuucccugccaaguuaguauguuggaauccucagcuuaggggguaaaggcguuuuggccagaaaaccuuaagagaacaggcaggccaacgucacacuggugaacacagagguuuaagggccacgggggaagcggguaacauuaccgaguacuucccuuuuauggugggaucuggacugggcuuuuuaccauucaauccacacagacaucacuggaagccuacucuguucugugugggaaagagcacacugaaaagacaaaguggcuuacccauucaaggcuucuauuccaggggaaggaaagguggguacucagccagcuagcccauacacucacagguuuuugccuucuaagccccugcaaugucuucacuuggggcaagugagaucaccaggaguccaaaggcaauacaugucuaugacacagcuccaggguccccagggagcaagauaggguucgcuguguccagagacacaaauuacaaaaaaaacaggcgucucugccuuuaacccagcuaugucacacccacuggcgcaucaacauaucacuggacacaaugcccacucugagucucugguaacauggggaauucuacggggcuggcagccauuuucauuuucuagcuuccccagucuccuguaggcuuuaagggcuaagagggggcuuggcugucuguggauugagugagagagaaaaacaugagccuugugguccggcagagcuggcuucagauccucauuuugugccuuaacaagccaccuaaccucucugagccccgguguccucuuuaaaaacagaauaguaguguuaaaauaagugagagaacccaauaugcuaugaugugagaacuauaaggggcuguucuuauauaaggcauaguugucaauaccccuacguuauaccaaacuaggguuauccaugucuggugagauggcuccugagaagcaguuucuccuggcccagccucagagccagugaaaaccacaggcauuuauuuauuuauuuauuuauuuauuuauuuauuuauugacaggguuuuucuccaucgccccagcuguccuggaacucccuguguagaacaggcuggccuugaacucucaaaagaucuaucaggcucugcuaggaguaaggccugugugugggcaccacacccaacaaucacagucuucugggugagccaugguuucauuucaaguucauuuucaaguucuacaauuacgccaaucugcucuugucuuacaguucaugacucaccaugggaaccucaacgugaaagccaaguuugaagcaagagucccagcuuucuacuaugucccucaggccaacgacugccuguaagugagugaccuggggagggguguccccagcccuuuucugucccugguaccugucugaggugaguucuccugugaucuggauggaaggauggauuugguauuaccauggagggugcauagaaauccugccugaaaucaggcgugguggcaaaagccuguguuccugaugcucaggagcugagugagagggucacccucagccacacagcuagguggaagucagcauggguuaccugagacuccaccucagacaaaacagaagccgcucauauuuguggagcauuuccaaguguggcgagcuccguguuaaaugcugcgugcguuauugccaaacacccucagcgacccugaaaggaugacugucacccugaaaggaugacugucacccuaugauucggagacagaaacugaugggugugaagggacacuaggaaaacccagucuagcaagaggguuguaaaggagagggaugggaaggaccauagaaccuagugaccccaaacucgugaccccagguagacacacacagucccaugcaggcauggcugcaaaguuauauuugaaccacugaaucucagcguggcacucccaggccuugcacaacauacauaacuauaauuggugguucuguggucuuacaguuaggugacccaaggccuagugaugccaauguggaguggcaaggaagcacaucuuuaucugcagaggguuucagguuuccccuccccacaauucuacugcuacccagcuauaagaagguggccaagacaccaagccccuuggaugucccucugcauuuagcccaaguccuccuucaaaaguguuaaacaggaacaugccuuucaacaugaugugaaugaaaugacaucauuugcugaagcaucucccaugucacccagcaugcauuucucagugucuacuuuacagcgauaccaggucccucacgccucugagaguuauguuggacuccauuugaaagaaccuaucccaccuugccgcauugcuaccacacagccuuugccccaaggcccugaacagcaucucuugcaugggcuuucuacacugaccccuccagcauuguuuauuguaacucccagaaauguuuuugcauuauaaucccuguuaacugagggcugguggccucuucucuccaguuuuaaaauuacuacauucccugccuuggggagcagaacaagaguccccagucucuagucugucccccagugcugguguuacagcccaauauucccaucuucaugcugggccuggugccaucuucucugucuuaugggaaaggcuguaccuuaggaagugcuggggaucaaaaccagggacugugcauaucaggccaguccucuaccucugagcuucaccucaaacaaugaaagaacucuugacuguaagucacagaauucuagcuuugccuaguucagguaccaaaagauuaugugggcucugaagaucagacaccaggaaggacagauaugaagucacccucaagaaggacaaucccauaccaagugugauggugcacaccuguaauccuggcauuagggaggccagggaggcugaggccagaggaguuggggguugagacaaguccggacuacaguauggcacgauccuauuucaaaacaauaucagcaaaggucugcaagauggccuggugggcaaaggcaccugccguuaagcccaaaagcccaaguuccauuuuugaaaucugcacgaaggaaggagagaaaugauucccacaguguucucugacuuccacacgugcacuguggagugaacaguuaggcacauacauaugcacacaaaauaaauaaauguauauuuuuuuuauaaaagaggaaacaagagggaagaaaaagaagaagaucauaauaccaggagcucaaacaugaccaaggaaaaggagaaggauggagaagccacaccggggacucaugugugacugggucuauacucucauggcucuugucagccaucuuucucucaggcugacuaauaacugcagcuggccgcgaauccucuugcaggugcuugcuguccugcccagcaagcaccagggagggcuuccagucggucucuaacuuuuggccuauacagcucagagcaacccagagcuccaggugaccuguuugggucagauguacaguucuaggucacuccugugcccaggccauucaguccuaaccuuuggaccacguaccuggaaaagauaagaaggaacaaacaauggagacagguuugcgcucagcugcacaguuucacagcagucaagaauaacauuugaucaagguuagcaguaagaaccugccgugagccugguguugggaagcauaccuucuaacugucugguaggcagaagcaagcgguucucugugaguucauggccagccaacauaguaagucacugucaaacaaacaacccacuguacuuuguguugaauguagugcugggcucuuuacauaggaaugacucuagggaaggcagguuuauuacugccugauauaaaaccagauaugguggcauacaucuguaauccuagcacuugguggcaugggggguaugggguggaagcaggaagaucaugaguucaaagucaaucucagcuacucuagauaccucagggucagccugggauaggcuagaccucauuucaaaagacaugaaacagaaaguugagucaguuugcucuauucaguguggugggccagaguucaucaguagauccgggacauuuacugcucaaguucccaagcugguggugggggcagguuaaguauccagggagcugauaucuucaucauugauucagaggguugagggucagucuaguguuucucaagaagacgaauuucccugguguguuaucuggagagcagaggcuacuuaggagauagaaaccagaggucuagcugaauauuccauagagcacaggacacccgacuuccacuacagagaaccauccagcacuaauguuaacuauccuaaggaggagaaccucuggguaucuugagacagcagcuccuggguuguccccacccucugcugcagagucugggaagucacugugggaagacacugaagacacaacuaaccaaaaauucucuuuuuagggucuuaaaggaacaauggauucgagcuaaguaugaaagacaggaguuuacggcuauugacaaagcugucucacauccagguaaaguuacuguuuuguauguauguauguauguauguauguauguuuguuuguauauauguauguaugcauguauaugcaccacauguaugcagugcaugccagggccaggacaggguauuagauccccuggaguugugacaguuuugagccaugugaauauagcagggauuugaaccuggauccucugagagagaagccaauauucucagccacugagacaucucuacagcccaaaaguuaccaucuuaauguuuugaggucuguguucugguuggguuuuguuuguuuguuuguuuguuuuuuguuuucuucgagacaggguuucucuguauagcccuggcuguucuggaacucacuuuguaaaccaggcuggccucaaacucagaaaucugucugccucuaccucccaagugcugggaguaaaggcgugugccaccacugcccaucgacaaaggucuugaaggaccucagcuuccaggauuucuaggaguacaaauuauuccccaacuaauagaugucuuaagaaucacucuuuuuuuuuuuaaagaauuauuuauuuauuuaauguauaaguacacuggucuucagacacaccagaagagggcgucagaucccauuauagaugguugugagccaccaugugguuucugggaauugaacucaggaccucuggaagaguagucaguacucuuaaccucugagccaucucuccagcccgaaggaucacucuuauacucuuaaacuuggcauaugucaaugucaaaguuggcuauauacauacauacauacauacauacauacauacguacauacauacagccucacuauauaucucugacuugauugaaacucuuaauguaucccaggcuggcccuaaacucauaaagaccuguuucugccuccugagugcugggaucaaagguuguacuaccacacauucccuucauucuuuugaggcaaggucucaucuaucucgggguggccuugaacucaugaacucacuguauagccaaggaugaccuugaauuccugcuccuccugcuucuaccuccagaauguuaggaugagagccaccaguacgggccuuaugcaaugcugggggcuaaauccaaagcuccuugcgugcuauaagagacucugccagcugagucacaguccccagcccaggcccuccuucagaguuaguccugucucucaauacuugggcuucuuaagaauuuuuucuuucuuucuuucuuuuuccccccucucuuuaccccuccccucuccuccccucuucucugucuuucccuguuuuuuuuuuauuaaauuuaaaaaaaucuuuauuuuuaugugcaugauuguuuagcccaaaaguauguaugugcaccacauguaauacuggugcccucagaggucagaagagagugucugauccucuggaauuggagcuauggauguuugugagccaccauguguguguugagaauggaaccuggauccuuugcaaaauagcaagugcucuuaacugcugggccauuucccuaacacuuuuuuucuuuguuuguuuuuuuguuuuucugugacaaggucuugcuauguagccaagucuggcauugaacucauaacugcucccuuuccucagccuaaauccugggaucccaggccccguuaccccugccuucuucucaggaagcagugggaccucguggagaaaugaagaagaaggguuuugcacaguggggggagacugaaaucauauaaagugccccagauaggaccugugucccgcaccugagagggacagaucagacuggcuacauuccagcgguggguagaggcucuucuacacucagucccuugagccucagguuagcuuauuuauuugacuucauggcucauuucuugcccuuggugguuaagguaaccgagaaggguuccuguggaagcgaggacgggacaacgcacaguuccugagaaggcgguuuguccuucugucgagggaaggccuccugaaguacuacaccaaggaggagguaagaggccaggccgccugugucucucaggagcagcccuggcaaggaugauuuuucuccuacuucuccuuggcuaccaucaacccagcccgccagcagccacacuuuggucacucaaaagucagcuuaguuugguccauuucacauugucguuguucucuaauuuuuuuuuuuuucuuuuucuuuuugccacaaagucucacuauguaacccuuacuagucuggaacuuacuacuuaaaucaggauggccuugaacucauagagagcccucugagugcucagauuauaggacugggccaccacaccuggcuaaaaacaauuuuaauugagauauauuuacguauuugguuuacucauuuaaaugaggcugggcaaaugacuugugacacuaaucccagcauuugggaggcagaagcaggcuacacucugugaguuugaagcuagccuggucuacauagugaguuccaggacacccagggcuguauggugagaccuugcuuaauaaauaaauaaauauuaaacaaauaaaauaaaaguaaacucccucucucuugcccacugcccuggagaaccccauggucagucagucaggagucuacuuguucuauuuuuucuucuuaugaugcuagggacugaguccaggguuugaugcaggcuggacaucgcucuaucaucccuagcacagcuggcucaagccucuuuaaggcacagacgcuguuugcuucaaugcaaaagugauuguugcuggguguugcuuggugccaccugccuuuaauccccaugcccccaaaauagaagcucauggguaucuaugaguuccaggccagccugauggacacagugaguuccaggccagccugggcugacugcauggugacuuucaggccauccugggcaauauagcaagcccugucuaaacaagggcuggagaaauggcucagcaguuaagagcacuugucgcucuugccaaggacucuggugugguucuccacacccaccucguggcucagaaccaccccuaacucaaguuccaagggacucaacucccuucucugaacucccacgcaucaggcauguaccuagcacacaauaccuucauggaggcaaagcaguuccacacauaaaacaagauaaaccuaaaaauaaaucaaaaccaaaccaaacaaacaaauaaaagaacaacauugccaagccuucaaaaggccaggccaggaacucuaugcuacagggucaagacaaaucaugcauccagccuuccuuacagggagggauacaguucuacauccuccuggggacgacugggcgagaaggaaguggugaggguaucuuuggaggccagcuaccacagugagcccuggggcgguccaguguuagagaacagagggaaaacaaaaaaacaaaaaaccgaaaagugcuaacaaaguugaaugugaaggagcagcagagggacgagcucugagcucgguagcucgaccuugaggcauuuggucuguguguuucccugauguucuccuagaggaggagacaguucuagaagggcaagcugguauguccuggacugagggcagaguguaaggggggaaagugggggccagaugcuuuuaaauccugacugcuuuuuccaagggaggaagagaaacuuuccuguggucaggcagggcccaaaccccacugguggcugguggcuguaacuuggucuccaugacagggucuccuccuuggcuggauaaagguuauuugauuuucagucucaguccaguccaguauguuguguuuuaaaggcagugggggugacagcagccugucuucacuuuugcacaauuuucuuucaagaugggguccugcuguguagccccugugggccauuaacucuaacucaguuguccugccuggguuuccugugugcugagauuacaggauugcucuccauaugagucuuuucuuuucuuucuuuuucuuuuucuuuuuuaaauauuuuuccccaaauagaauuuuuuuuaauuaugaaaguaacucauuuuuauguaaaaauuuuggauugugcaaagaauuaagcuaaacagagucacaauuucucuggagguugaggcaggaggaguugcagcccaagaguuaaagacuaaccugggcagucacgcaugauggcacaugccuguaaucccagcacucggggggccaaggcaggcaaaccucugagaguaugaggccagccuggucuacagaucaaguuccaggacagcaagggguucacagagaagcucugucugaaaacaaaaacaaaaacagcaacaaaacaagagaagagagaacuuuaguuuagcccaauucuaaaaagaaaaaagaaaacccacaaaacuaaauuuccucuuacaauuaacuaaggaaaugauaauauaagugagaauuaacugcugcucagcaaugaagagggaugaaguaggguuuagagagauggcucaacagcuaagagcacauguugcucucccagagaacccaaguuugguuuccagcacccacauuagguggcucacaaccuccuguacuccggggcaucucacgcccucuucugucuucugagagcauuguauacacauggugcacauagauauaaacucagguacacagacauacacacaguauaaauaucacaagcuuccaaaauggauaucaguagcaauauuacacuauagguaaaaauuuuaaacauuuucuagcaaaaaaaaaaucguauacaagaauaauagaaggacuuggguauagcuuagugacagguuauaaauaaguaaguaaacaaacaaacaaacagauaaauagaaaaagggagcuggaggugucccuuagugguaaagcacuugucuagcaagcucaagguccagggcuugggauuuaaauuugugggguuuguuuguuuauuuuuugaaauauuuauuuauuuauuauauguaagcacacuguagcugucuucagacacuccagaagaggacaucagauuuuguuacagaugguugugagccaccaugugguugcugggauuugaacucaggaccuuuggaagagcaauuggcacucuuaaccucuuaaccacucagccaucucuccagcccuuaaauuuguguuuuaaaacuuaugagccagagaagaguucaguaugacuccugcuggugcaggggcaucuguugguccucccaccacguguccuccaaggagcugaugucuggcuauuuauuucacacgagugcucgguuugcuccaggaaagguucuguggcuaaaaugugugaacagccccguuccagcucaggggcuaucagagcagcccaggguuauguauuaggggcuggcuuguacugaagcccuuggcaggaaggcaccugcugccaucgguaucuugaggauccuuucucucuucuaggguaaagccccaaaggcugucaucagcaucaaggacuuaaacgccaccuuccagacagagaagauaggacauccccacgggcugcagaucaccuacaggaaagagggccacaccaggaaccuguuuguuuaucaugacagugggaaggugagaugacucaaguuacuucugcagccuccagcauggcgccugguccaugggcucagcucaucaccuccacugcaagcuuuaucuaucaugcacucagcugcuucuggagaccugcugccacugucgccacacugcuucagcugcugccgcuccugcuccugcugcugcuccugcugcugcugcugcgugucuuuaucuauuuccacuuuauacucugaaucagagaucugagggaggcagaaugggauauagaugaaccuaacaaguacugcgaauguaucugagcaguacacacucaucagggagagaaaaguuaguagagguccgggaccuuagccaaauacagcaaauccacuggcuaugguggcacacaccaggcuccaguauuagguaggcagaggcauguggaucucugaguuugaagccagccuggucuauagauucagguccaggacaaucuggauuacauagugcgacgauaacaauaacaacaaaaacaaacaaacaagaaagggcagguauggguaggguagaguuugugauugaggaggaagggucaauggacagggccaggauccuuccuuccacaugucaaacuggaccaagagcauccuuaugacuuaagaucuugugagccuggaggaauggcucagugcaaccccugcugcccuugcagaggaccuggguucaguucccggcaccgacacaauaguuuaugacuucaguuccaggaccuccagugcccucuucugguuucuguguaugcaggaugcuuaguuggugcauagacauaccugcagguaaaacacauuaaguagaaacaaauaccuuuuaagaaaauacgugauuuuaugaauagggguguuuugccugcaucguguuuguguaucgcauucgugcauggugcucacaaggccaggagaugguaucagacuccccuggaaugggaguuauagauuaguguggguccugggaguuaaagcuggguccucuggaagaacagccagugcucuuaacugcugagccaucuaucuguccagucccaaaauaaauaagcaaaacuagucucaguccacccgagaccugcucaauuagaaacuuucacagagucuugagugaugaggacacacaaaaauguuuaggaaacauuauaacuuuguagucccaucacuuggcagacugaggcaggaggaucaugguuuugcagccgaauuaggauucauagcaagacggggagaucagccuguaggaggagaacagucaagcaaaggauaaaugugagagugaacuggcucagcagagucggugacaggacaggcagagaugcuaaguacacacggagaagcauuggcugacacuguggggucauuuaacuuugccagacgugcucuuggugacuguuagccuucaugucugaauguuugacaacccugaaaauacuuucuccccacauucaagggacagggacagaucaggucccuuacucaggucacacaguagagaguuccucaguccagcauccauuuaacaacuuuuuuuuuuuuuuuuuuuugugggagggaucaaaacaggguuucucuguauagcccuggcuguccuggaacucaauuuguagaccaggcuggccucgaacucagagauccggcugccucugccucugcuacuggagugcuggggucagugugccacuaccacccggccaagacacuuuuuuaaaauuagaucucuuccuuuuauuuuauguguaaguaugauucugcuggugagagaaccuugggcagcagcuaucuggaguuagaggaagagauuuucccaggguuccucaaacuggggaggugacucuggacugcucccuaaugcccaccuuucucacggcuuuuuuuuuuuuuuaagauuuauuuauuuauuauauguaaguacacuguagcugucuucagacacaccaggagagggcaucagaucuuguuacggaugguugugagccaccaugugguugcugggauuugaacucaggaccuuuggaagagcagucagugcucuuaacuacugagccaucucuccagcccuuucucauggcuuuuaccugcuuuguagauugguuuuuguuugcuuggggacuugguuggguuuuuuguuuguuuguuuuuuggguguuuguuuguuuguuuuguuuuguuuuuuguuuuuguuuuuuugagacaggguuucucuguguagcccuggcuguccuggcacucacuuuguagaccaggcuggccucgaacucagaaaucugccugccucugccuccggaguguugggauuaaaggcgugcgccaccacgcccagcugaggauuucguuguuauuguuguuauuuugaaggauucauaccugguaaucuaggcuagccuggaacuuguguagacuuggcuggccuuggacacacccgagugcugaauaaagguguguaccaccacaccuggcucccacggggccuuuaagcaccgagugaccaggaaacaucaccuugaaaguauuugacaguggugagaggugauggaagcacccugggcugcagcuucugucugcucaggccuguaagacuguuuuucuucuccuuacgcugcgaauauaaauauagccuaaguacaugcuggguuccuuuuuuuucugagguggcuccauuuucugaaugccuaagacccaagaacuuuugauuuucauuuucuuuccuuuuuagggaggaguuguauuuugcuauguagcucagcuggucuugaacuuggagcaauccuccugucucaacuuuccucccacugagauuguaggcauaggccaacauacccugccaagaacgcccuuaacaaacaccaggacaggagacucagaagucccacuaggccugugugucugucuggcuaugucuggcuuugggcguagaaaggaacuuguugcucucuguugagucugcacucacaugacuuccucaaucagugcaugaccucugugcccugcaccacagaucucccagcaagucuuucugccucuccaucccagauuccugggagagagcagaucugauaaguccagucccgucucuuuauugguccaucugcuguauccaaggcaggguggggacuguugggguaugagguugaggaucaggucucagagaaacugggagaggagcaacccaguggggaggagcaaccuagaaggcuuccauugugucucaccacugugaaauacuugcacaggaauuuauuacaacaucuaaacuaauguaugcaaugaauggacugucauaggucaaaggguggguaggguaggaaggagaagcacguggaguggugggaauguggguagugauuggaguggggaugagagagagaggcaggaggacaacaagguucaaguguggccuccaugacaaucuccuguaucaaacauaagaauaaaaugaagaggugauguggugugcaugugcagucgccauacaugggaggaagaagcaggagaaucaaggguucaaggcuagccaggcgguggugucuucggugucuucagcaucagcaguggugacucaugcuuuagucccaacacuuuggaggcagaggcaggcauaucucuuguuaguucaaggccauccugguccacagauagccaaaguuucacagaguaacccugucuugauaaaagcaaacaaacaaacaaaaaaaagaguucaaggcuaaucucugcuacuuagauguuugaggaggcuagccuggacuacaugggacucaccacaaaaauaaauaaauaaauaaauacauacauacauacauacauacauacauacauacuaaaaaacaaacaaaaaaguaaaaaggacucuggagauacagaaguuguagaaggcuucucuaaacauuguaaaaugagguggagggggaagcuggagagaugucucagcaguuaagagcacuugcuguucuugcacaggaccuggguucaguucccuaaacucacaugguggcucacacagcugcuucugacugcaguuacaggggaucuccaaggcugucuucuguccuucgugggcccacucuggggcacauauaugcguguggguguaggcaugcacacauacacaugaggaaaggaaagcaugggucggggugggggagaaggaaggaaggaaggaaggaaggaaggaaggaaggaaggaaggaaggaaggaaggaagguagguaggaaggagacaggauggcugacuggagaggagcugagaaacccuuggggaugugguucuccggugagacgauguuggcucaccauuaugaaggaugugcucucagugugacauccccuuguggcuggccugugcauuccaggucccuccugagcaucucugauggaggaaugucuccacaugcagcccccacccccaccugaagaacugugucccagcaccccacagcaucacagccccugggagucuuaaugcuaaggaauacagucuuagccccacuccacaccagucuccuaauaggaauccaggagugucuucuaaacuuaaagaaguguacuaagccuuuuugugcagcucacacuugucuuuuuccguggcuggaagcucuuccugucugugacuugugacuagcucagggcaguccccugggcucugauaaucacccuuuccagauguucccugaugggacugugugaaguguguauuuccugaaccuguguguguguguguguguguguguguguguuugugugugugugugugugugaaguagugaccccguucccuguagcccugucagcaagguucucccacauccgcccaucucaccacugugugugcuuugcauuuuuccuggcaggagauaguggauugguucaaugcucuccgugcagcccgccugcaauaccugaaauuggccuuuccugaucucccagagucugaggugagcuaaauguggacuugacuucugcguguuccauccccucccccuuucucugcuugucucuugaccccuaagacacacaggggcuagacaagguuuacugcaguuaagccuaggaaggcuggaguaaaacaacucucuguggggucaagggccucagccuuugaacaucuuucugaaauuucccacugaaauaugcaaaugagccuaccuauuguaugcacagugcuucuagcccauuuuaucuggacccuuccuauauaguaauuacuuagaacugagaguuggguuuggugauugcucccauugcccuuccacagcuguguccugugaugcuugguccuugggagauguugggaucugccuguggugguaaagguaacaguaagcggaggacuuccuaucgauuguccccagacaucuggguucuacaucuacuuccugcagccuugucugggaacaggaaugacauggggcagaagaugguaguuuaagccaguaggccuaggcccucacaguugcucuguuacugacauacugugugagccuuacagguaccuuucugaacacauuuccauauuaggaagaugguggcugguccaggucuccuucaggguccccucuaagcucugagguucugugauugaggauguggguuuguuuuguuuugauuuggguuugguggugguguuugugacauagucucacugaguagcccaggcuggccuagaacucacuaugcagauugggcugggcuggaaaucaccuagaucugacagccucugccucccaagugcugcaaugaaaggugugggcguguguguguguguguguguguguguguguguguacuuauauguacacaugugugucuauguguguggaggucagaagucagucucaugugucauccuucagaugcugucuaccuugacaaucuuucuccauugcccugugccuucccauuaggcugggcuggccguccagugagccccaaggauccucuggucugugucucccuagugcugagauuaugguccucaugacagaagcucagcuuuuuuauguggguacuguuguucaaagucagguccuuacacuugcacggcaagcacgcuagccaugggaccaucuuaaccugugaucucuuagucucaucuguuagagccucauugaaaaccuaaauguuccucucguccugggguuugcagggagcugaguaacugugauguacccguuucaaaguucccuaggcacaguuccagcaaggacaggggucaggcucaaagcugaggucaugaugcuuagucagcacccagagcugguuacugcugacucagugaagaguccagggugcugacugcugacccaggagaggggagggcaaaggggagggcaaaggggagggcacagggcaggugcucagccuuauuagaucuggcccggcuuccucuguuugguuaccuguguggaggaagccaucuuuugaccaauguccccaagguucucuugccuccgucaucagccauauuucuaccacacuugccugucucucgcucuuguccuuccuauaucuagguguggugcucagucuuaagaauuuagugcuggaaaccuaggaagucuuuguggaguuacaaucuuuucaccugaaaggcacaugggguggggguguggcucagcagcagagcacuugccucguuuguguuagaccuugggguccauucccagccugaggaaggaagaaaguauguuuaguggccuauaaucccagcaccuuggaggcugaggcaggaugacugcugaaaguuugaggccagccugagccaaagagugaguucaaaaucuggccagcuugggauauacaggaaaaccauguugggaguggacggagggaggagggaauugaagaugugcacauagaccugagucagagccuacugugcuguccagaagaugacauggucucugagcuucagugugcucaucugucaccauggcucccugccccugccaggcuaauauagugagccaaugucugaagugcaggaaagaauacugaaggaaaacuccagccagguggcuucccuuguuucucuugggucuagacuaacccugugccuguucaaauugagaauaugaaacaguuggggccuauuuucuccaaacuaagaauaaauccuauagaauauauuugaggagagauggaguagucugguguagauuuucauuuggggccucagcuucccucucuugcuuccuguggugauucccucaacuuugccccugcagcugcagggcccugcuauguccuuaagaaucuagacugccauuugaugcucuaggucugucuagucccuaucuccccacuaccaggaagcauaggaagucacucuaaccccuggcagcuucucugagucuaggaaugcaggcuguagggcuguuggagaucacaguagggaauggacccccagagacagaaagcuuaccaagggaacaucugguugagccagaaguggugcugagauucugguggccuccuaacaccuuggccagaguuuccucacugugucuacccugcuaucuccucuucauggccagugucagaaucugugaccgggucucagcuggcaccgguauggugaggcaucuggucaaaggccucugccaucuuuacauuuuuaguaccauggugugaugguacacgggaagcuggccugcugccugucaguccugagugcaaaucccaccuuuucaugcugucaugucagccgaaugacaucagcaaagucuucucccacaucucuaugccuuaguuuucuucuuucuuuucugcuucuucuucuuuccccucccccuccucuuccauuuauuuauuuauuuauuuauuuauuuauuuauuuauuuauuuauuuauuuagauaaggcuucucucuguagccucagcuguccuggaacucacucuguagaucaggcuggacucaaauucagagaucugccugccucugccuccugagugcugugguuaaaggcaugcaucaccauaccuguugucaaguggcucucuuaacagucuugccugaucuauauaaucugagaugaauggaguacuuagagcauaacugagccaugcugggaaaccauacuggggcucauggacuggcuuugcugagcuauuuguauuauauccagcacauacuccaaguauaacccauaagccauacacccuuccccaucccaaacuucucugugucuuggggccaaguuuaauuugaaaccuuaagcucuggguguaaauaggggucagccucugucucucccuccagcucgugccucucaucaccaggaacuaccucaaacaaggcuucauggagaagacugguccaaagguacauccuaguguuuucuguauuacucaauaugguucuauuccaaccacagauaaaggagaaaaucgggggguggggguggggccggcgagugggcgggagaagaaagggaagaacaccaguguuugugagcuucugugcugacacacugaguagagacuaggaguuggcuggugugugacccagcauggcucugagggguucuuccucucaugucccacccugucaucuucacuagauccuuccuccgaucgccauuagacucuaaccccaggaaagcgacgaggaaaaggaacucccuagagagagggccucagcagaugcuguguuaggaguccaccaggacagugucagagagagaccugggcuagucugaaaacacaugaccuugaacccuuccucggcacacucagccuggcuccccugagcccacgcccucaccagguccugugcccucucacuacaauaaggaggacaaggagcugccucacaagggaggagccuggucuuuccuguaaaccaaacgaaggcugcacagacccagauuguuaggaggcugaggcaggggacugcguuugaaguuaaccugacaaagucaaagacagucugcacaguguagugagccccccacaccugucucaaacuggaaauuuaauaaggugagguacgguguggcaguauagcucaaggcagagggcuugccucaaauguauaaggucagggguucaacgccaaaacacaauuauauaauguguuacaggacaggugauaagagaaaccugaaagguguuggaggacagugugaaaaaaagccucaggagcccagugguaguggcacacaucuuuuaucucagcacucaggaggcagaggcagguggaucucugugaguucgaggccagccuggucuacaaagcaagauuccagggcagucagggcuacacagagaaacccugucuccaaaaaaaagaaagaaaaaaaagaaagaaagaaaagaaagaaggaaggaaggaagaaagaaagagggaaagagaaagaaagaaagaaagaaagaaagaaaaagggaaagagaaagaaagaaaaaagaaagagaaagaaagaaagaaaaagggaaagagaaagaaagaaaaaagaaagagaaagaaagaaagaaagagaaagaaagaaagaaagaaagaaagaaagaaagaaagaaagaaagaaagaaagaaagaaagaaagaaagcaagcucagaaguuggaaacuggucaagugguggugauagacuccuucccucagaagccaggaacagucccuggcuuuugccucaggucuuuuccuucccugagccaagggcagcacuuucaacuuuguaagcaggagccacuucugacuucccuggcuuccuucuucugagauguauuugucacagcccaagaaagagggagguaccccuuucacuccuaggcagcaccuggaggugcagagcaaaacuaacaaggagggaaggagggaggagguugggggcagagaggggcuggacugaagccuucgggaucugagcagaugcugccuuccagcacgcugagggaucccugucccgccuagcuaggacuccacagugagaccugucucaaaccaaacaagcaaauaaacaaacaaaacauacaacccagagucugaccaggugcccagaccuguggacccuagaaccaguuuggcuggacuucugucucuguccagccauuacggggccauuuucuggggaggguaugcauucccaggaacuggccccagggaaaagcucuagugcaugucugacugcaguagccaggcuggagaaccagugugauaaccucucucugaacuggcacugaccccugugccugacuuugucacauuuccuaagagguuccuucuuuugcagcauagagaacccuucaagaaaagaugguuugccuuggauccgcaggaacggaggcugcucuauuauaagaacccccugguaagagucauuccugaucucuccuuagcacguucccagucaggcuggcuagugcugacucauaauaugccaucucccagaauccuagggcaggggaacccaggacaggacaccugaaccccugcuucccacucagcuccauucagauccuccuguuaguugugcuuaaagugagguguuaccgcucccuuguaaccaggaggucuggaguggaguggcuagggcuauaggcucaggaauaguccaguuuggcgggacccuggguucuguuuaguuucagcccugcuguggcagagccauaccuuaggcuagguaugcacuuagcucuccgaugcuacauuuccuuucugcaaaauauuggcuuagcgugaaugccuugcucagaaguggccaugaugaguauauuaguugcuaacauguaaagugcuugaacugggcccaggggcaccagccuguaacccuagcuacuggggaggcuggagcaguuggauugcaaauucaaagacucccugaacuucagaauaauuucaaggcuaacuuggguaauuuagugagaccuaaugucaaaaugagagagagagagagagagagagagagagagagagagagagagagagcucucuagccucugcuaaaugcuugccuagcgugcuugagacucuaggcgaaauccucagggaccaaaccaaagcaaaaaaugccuuugaguuccccgugccugguguauucccuaauaguuaguauuuucagcagauuugugugcaauguaauugagguuuuaacaguucaaauuaaagucaaaucuggcaaugacauacacaccucuuuaccaaacuugaccuugggacuggccaggcugcaagggcucuucugccccaaggccucugaugacucuaugccuuccauuuucaggaugcuuuugagcugggccagguuuuucugggaagcaaugagcagggauaugaaguaugggaagaucugcccaagggcauccgagggaaccgcuggaaggcuggacuuaccgucaucacuccggagcggaaauucaucuucaccugccccacugaaaaggaacagcgagaauggcuagagagucugcggggcgucuuguccagucccuugucaccccuccaccuccucagugagaagugggggauggguggggguucuuuugggugagggcagaaaagggcuccuucacuacagucccagaggggccugacucagcuuuuuuuuuuuuuuuuugagucucccucacuuccugccuuagaaaagcacacacugcacuuuuuuuuuuuuuuuuuuuuuuuuuggccaaaaagucccuacuccaccaaguuccucuauguagcaguccucaugaacuucaggaggaguuugguccuagcagaauaguagaggcuggcucuacccucugggcagauucccucacacccuuguccuuuuucucacaagaaaacccuguccugggauccuuagcagaggucacccugccugccgggaacccacagggauucuggauuccuccccacccagagggaaggcuauuuuuaguguucucuuuuuccucagcccucucugucucccuccucuucaccccagauguguuugucacaaggagacucuucccaucuguugacaacccuaugaacacugaguuagggaggaagcucuggcccagggcugagcuuauagggcauaaaggaaaaaaacgaacaggugaccccaauggcggggggguggggggagcccuggugccucccuagacucaccaguauggcuacaacuaccucagccuggugugguaacuagcccaggccuuugaucucaguguugggggcagaggcagguagaacucuguguguuccaagccagccugguauacauagugaguuccaggacagcugcagcuacauaacaggacuguuucuaaaaccuaaaacacaaacaaaacaaacaaacaaaaaaaaccuaacccacaacugucuuuaccauccaguucccaagcccaaggacacagaagccaauugacugagcacucugacagcuguucucugcucuccguggggcugaauccccgagucucugccacuccuuuccucucugucuucugucuuucuccuuuggucuguuuuuuuuuuucuucucucucucauuuaaaguuucaguguuguccuggcucccuccgucagaacacacaugucccgccggggaaccgcaccagcauggcugccuuucccaaccccccuuuuccccuugcagccacaucagcagagacuggcuguggccuggggugacccaucucggaggaucuggcuggcuacugugcaucugaaguucuggagaaguguucaccucagcccuaguuguccagaaggaagcccugaggccagcagcugccccacuagugaacuccagggugugguugauccuacgacuccccgugcuccuuccagcaaacucuccucagucuugaggagcugguauggagaagaauucagcucuccaagcuuagaaguccugaaggguuccucauaacugcaccaagagcuggccauggugacgcaugccaggcaagaggcgagggugccaugagcccagugacaaccuggacuacacuggggguucaguucagccugaguuacauagcaagaccuugucucagaaacaaacaaacaaacaaaccaaaaaccagaacagaaaaaaacagcacucaggaggcagagacuggcagaucugggacagucacagccagggcagguuacacugagaaacccugucuagaaaaacuaaaaacaaaaaacagaaacaaaagcaagcaagcaaacaacaacaaaaacuacagauagggguggauguugcaauuaaaaaaaaaaaagugcccacagcauccagacaaaauuuuuaaaguuuaaucuaaaccuaacuaugaagaaauccucagacauucauuuauuacuuacauguugcuauacagccagccuggauucuucaaaugacacgauuauaaaagguaaaaugggccaggcauggugguaaacaccuuuaggucugugcacucagcaggcaaaagcaggugcaucucuuugaguuuaaggccagccuggucuacauaguugaguucuaagacaaccagagcuacauauagagaauuuguuucaaacaaacaaacaacaacaaaaaacgaggagaggggaugauacagacagacagaccaaagccaggggugauacuaccuauaauuuuagcauuagggaaguagaggcaggacgaucagagguucugcuauuauacacagagaguaaagggcuaaccugggcuacaugaa

SEQ ID NO: 6219 - RNA, 17545 nt, Mus musculus
cggccgcgggggaacuguuugacggggacacagggccccgaggagguugccgcgaugcucccgucuuugcaggaaucgcuggauggggaugaaaaggagcuggagagcagcgaagaggguggcuccgcggaggagcggagacucgagccgccucccagcagccacuacugccuguacagcuuccgcggaagcaggugcccgcgcccugcccgcugcgcccgcggccccgccgcccggccuugcaccccgcggcccccacucaccaucuccucucccagccaaggucucuggcccgaugggccuuccuggccucagucgguucuucccggcucuucugggcuuuuaugcccagcacucccaagccacuguccucuugcagccccugucaucguagccccugacaucuguucaucggaguuugccucuuuuuccccucgguauccccggaaaaccccgacugacuuuccaggagcccuuuuggcccuggaacuuauucuuuaagguguauuuuuaauuuuuuuaauuauguguuuguguguggguauucgcacaugcauacugaugcccacugaggccagaggugucagauacaucuggaacuugaguuacagguaguugugaggugcccuaagugggugcuuggaaccaaacuaggaucauuccccaagaacaguaagcgcuguuuaaucucugagauauuucuccgggcccugcuuauuauuuuuuauuuuaguuaauuuauauuuucugaauaaaaauauuugcauugguguuuugccugccugcaugucucugugaggcugucugguucccuggaacagaagauagagacaguugugagcugccacacaggugcugggaauugaacuugaguccucuggaagagcagcgaugcucuaaacuauugagccaucuuucuaucccuuaucuuuaaagaugaauuucuucaaacuuucgggauauuaggucuuuucucuauuuauuaaauacccugaagagaaaggggccucuugucagcccucucuuaugggguuucugucaugagauuaggcagugugggcuugcagcguuuuuuugcugaacccuugcuuuuacccagcuugcgaaggcuugauugauagccuauaacugauagcacuguuguauuugcagauugacacagaaucgaggggauagugaugauggacguucagguggcauaaaugcagaaacccccucuggugaugauuucagguaaaaacaggcauaacucauugcuuuccugggcugugcauaucuaucuguaggugucaguggggugucuuguugucacugcacuuucucugagucaaaccuucagcuccuccuguccuauaggaaccucuccugaccuccuccuuggcucuuucuuuuauucaaggcaagagcagaugcaaauacugauaaugcuuuguaaacucuagccaagcccagacagugaacuuuaucugagauaaucaucuuuuugugauuguuguuuuugagauaggauuucucucgacauagcucuagcuguccuggaacuuacuaaguagaccaggucuugaacucacagggaucugccugccucugccucccaaucccucugccucucagucccugauucuaaaggugugcgcugcuaccuauggcaagauaaugaucuuuaaggagguaagguuaauuuggcucaguuucaguccacguaguuucuuagcccuguuucuggugagccuguggcaacaggaauucauagcagaacaaacagcagaagagccuguuaacuucaagguggcuaggggaaagaugcaaagagggagagaagcaggcagcucccagccagcugcccaaccagucaggguucugauauguuguuagggucauauuuccagagacuuaccuuguguccaacaaauacagguucuaauaguuucaauagcacuguggugugggagccaaaccugccuuugggggacauuccaagugugaacaaugacccucuccaacaggggcaucaagaagacagcuuucuuuuuuucuuuuuuccuuccuuccuuccuccuuucuuucuuuuauuuauuuuuuuauuuuuugagccaggguuucucuguguaagccuggcuguucuagaacuugcuuuguagaccaggcuucccuggaauucacagagauaagccugcuucgauuggugaaauuaacuagcugacuaguugauagcauccuuaagagagacucugaaauugguacagcaaugcuagccuggggcaaguuuaagguuaaccuaaacuauguaacuaguucaagaccagccugggcuacuuaggggcccuggcauugauucauuauaucugccuuauggguuugaguguaucccugguaagaaauguguguuucucaucugucaagccucuccuugguggauacuaaucuaccaucugaaguggagccggaacuucgcaguuucauugcuaagcgucuuuccaagggagcggucuuugaagggcuggguaauguugcaucuguagagcugagguaagaauaaaauaugcugucuccuguguucuuaugucugagcuaaaccugagagguguggagaaacuggaagagaucuagaccugcagaaaacgucuuuguuuucuguucucuggcaccuccugcccuuccacucccagccagagcacugaaucucacacauaaguguuacgaaguuagacugauugagauucuggcccccuaguguacuuuagucuacuuuauacuuacacagaaggagcucgagcuggagagguagccuugauagagcgcaucuccuggugggugcaaagcccucuguucuuaccaaaguggaaagcguaugcccaugauuuauaaugugcuuucacaaaugcugauguaguucuucuuacaaagggagaugggcaguuaucuuaauuucuagugcagaaguaaacaccgagaagugaacuuggaagcccaaggucacagggaagucaggcuuagucuugccauuauacuccuucagacacagcauuuguuuaaguauagguucccuuggggguauauaccucugacccgaggagaaagcugcuggguaaaccuggaacauccaagacacaugaagguuaaaagagggggaacaugcuuauuuccauguaaacauggauauucuaugaacaaaguugaaauuuguguagauuuuucuuuaaacaauuaaaaaauauuuuauguauauggguguuuugccugcaugaaugucuaugcacaaggugugugccuauugccugcagagaccagaagagggugucaggauccccaggaauuggagauacugaugguugugagccaccacgugcuggaacccaaaccugggucuuuuagaagaguaccuagugcucuuuuaacuaccacgccaucucccaggccccuggauuuaucacauaagacaguggaaugcagugaaccucuuguuagaggcuggcugguuuguuuuuaugaggcaaugucucaccauguaacccugacuggucuggaacucaccauguagaccaggcuguucuugaacucacagagaucuaccugugucuaccucuuaggacuaggguuggugcgcucaccacgccugaucugugggcugcuuaauuaaaccucaccugggucaugcuccuucugcugauaugaguacgaggagaggguuggggagcucugaaugaggggugaucugaaaguguuuccagaucaagaccugcuucagagguuaggucugcagagugaggagcgugaguacccagcuacuccacuuuacuuuuuccuuucuuuucuagaauuccagguuaccgaguugguuguuauuacugccuuuuccaacaggaaaaacugcuuccugaaauagcagcaauggaaucugaacauaacccuucugaauauguggucugcuucuuaggaggcucugaaaaaggacuggagcuauauccuuucugugguauucaagguaucaggagggagagcaccugggcaaguagcaaguuacccuucagggcauauugaaaugucauuuguggccauuugcauaggcuguguguguguguguguguguguguguguguguguguguuuguaaaagagagggacagacagacagauagacagggucucacuuugcaguccuggcauggaacuuauuauguagaccaggcuagccucaaacuuacagugauccaccaccucugacgcugagugcuagaauuaaggacacauggcacuacacucaggugaaauguuguguuucuggaugggagguaaaauauugauggaucauccugugucucuuccuuaagaacauacuuucaggcuugaacuggacaaguauauucaagggcugaagaauaacaugaauugugagguaaggugucugacuugagcuuuguaagacuggagugaugaacaugaacgugucaugacuguacuagucuggucgcuugguagccaccaacacuucuaaauuccucaccuugugggcaguagaucagugcugugugacacaggcagggaggcaaugaagguuucaugauucuacuuuggauguugcaccaaugaaaacuuauuaaauccaauugaggaaauccacaccugacaucccugugcuugggaggcagaguuugaggcuagccuaguuuacauagcuaauuccaagccuaccagagcuacauaguggaccccaucucaaaagcaaaacaagaagcuggggagauggcucaguggucagagcauugacuguucuuccagaggacucagguucaauucccagcacuuacauggcagcuuacaaccaucuauaacuccaguuccagggcaucugacaucuucuuaccucuuugaguaccagauauacaagugguagacagacauggaggcaaaauacccauaaaauuaaaauuaaaauaaaauaaaaaaaagacagcuggugagauggcucaaaaguaaaugugccugccaccaagucugacuggcuugaguuugacacccaggacucacauuguggaaagagagaacugacuuacauggugucuuagucaagguuucuauuccugcacaaacaucaugaccaagaagcaaguuggggaggaaaggguuuauuuagcauauacaucccacaccucuguucaucacuaaaggaagucaggacuggaacucaggcaggucaggaagcaggagcugaugcaggggccauggagggauguuccuuacuggcuugcuuccccuggcuuucccagcuugcuuucuuauagaacccaagacuaccagcccagggauagcaccauccacaaugggcccucccgcuugaucacuaauugagaaaaugccuuacagcuggaucucauagaagcauuuucucaacugaagcuccuuucucugugauaacuccagccugugucaaguugauacacaaaaccagccaguacacguggguuguucucugacaucuagggcagaugcaugcacacucacagagaaauaaaaugaaagaagaaagacaaaucuauguaaaauucaguggcgguuaguaacauaccugguggggaagguaucuguuaucuuuaucugguuucuaggcacauaggauucauauuuugguuagcacuagugguccauuggagauaugcuaugccauagucuauagaucucaaguuuuagaaauauuucauuucauuauuuuaugaauugguuaugucuauauugaguaauuuaucuaagccugucaaaauuauguuuccaagccaaguuugcugcugcaugucuacacucccaguacugggaaggguggaaaacaggaaaaucuggaggcuacgguuagccucagcuacagagaauuugacacccaccugauuucuguaagaugcugucugaaaaagcuacuuuuguuagacggugggagcacagcauuuaauuccagcauagcagucaaaucucugaguucuaggccagccugaucugcagagugaguuucagggcauccaaggcuacacagagaaauccugucuugaaaaaacaaaacaaaacaaaaaugucaacccucccccacuuccacauccccacccccaaaagaaagcaguauggccuggcacauuggcacauaccuauaaucuuaguaucuaggagguuuaggauuuuaaggucaagagagagcaucggcaugggaucccauuacagaugguugugagccaccaugugguugcugggauuuaacucaggaacuucagaagagcagacaggcagacagugcuuuuuuuguuguuguuguuuuuuguuuuuuuuuuuuguuuuguuuuuuuuuuuuuuuuuugguuuuucgagucaggguuucucugugcaguccuggcuguccuggaacucagucuguagaccaggcuggccuugaacucagaaauccaccugccucugccucccaagugcugagauuaaaggcgugcgccaccacugccuggcuuuguuuuuguuuuuuaaaaaagauuuauuuauuauauguaaguacacuguagcugucuucagacacaccagaagaggacaucagauaugugagccaccaugugguuacuggaauugaacuuaggaccucuggaagagcagucaguguucuuaacggcugagccauuucaccagccuccuacuuuuuguuuucuaauuauuaggaguauauugaaaggaacggagacuuggcucaucaguuacgaacacuuacugcuuuuccagagggccagcuuucaugucuagugguucauaaucaccaauaacuucaguuccagagaacucaacaccucauacuagacuccaggaggcauccacaggaauacaauuauguacauacaaauaaaaauaaaaauuuuaaauuguuuugaagaggggccuaaggaggagggaggcuuaguauguaaagggcuuacaaugcaagcaugagagccugaguuugaacucccaucauccacguaaaaaucuggguguggggcuggcgagauggcucgguuaagagcgccaacugcucuucgaagguccagaguucaaaucccagcaaccacaugguggcucacaaccauccguaacuaaaucugaugcccucuucuggaguaucugaggauagcuacaguguacuuacauauaauaaauaaauaaaucuuuaaaaaaaaaucuggguguggugacacgcaucuguuauacuagaguugaagugguggagcuccaggcucagugagacacccuuacucaagaaaguaagauggagaaguuggagagauggugccuaccaccaggacugaggaccuaaauucaaucucccgcaccacaugguugaaggccagaauugacuucugcaaguugcccuuuguucuaaacacagacaucaugacgcaaacuuguccaccaccacuccaaaaauguaauuuaaaaauaagguagagagcaauugaggaagacaccugaugucaaccauuagcuuacacagacaccauacacacaaagaaagucuacugaagaaaaaagucuaguaaguuaaaggcuucuaugauacuaaaacagaugauauucucucuugaugcaggaaaggagucuggggaaugauguaaaguccuaucugaauagcugguaugaggauguggugugucccauccaaagggugguucuccucuuucaggagaaacugaccuuucugcuccaugcuguaaguauugcucaugaacgaguauucccaguuagaaucuccucagcagaccuuggugauuagaaacacacucauuuucucuaaacauuaguuuucccuuccuguauauuucuccagacuaugcuugcuguuuagcccacaucuuacugacucucaucugaaagucuuauuauuaagguaggguucaauuguaaaucucagcaggaucuuuccacuaaaacaugggcuuucaagccaguugugcuggugcauguccgcacucccagcacuggggagguagaagcagagucaggagguuaggaccagccucagcuacacagagcauuuggcaccuaccugauuuauguaagaaccugucccauuucaugucagcugggucacauuaaaaaaauaauaaucucuucuuucuagccacuuuuaaaaauaggucuucaccaggcaguggaggugcacaucuuugauccagcacuugagagacagaggcaggcagaucucugaguuugaggccagccuggucuacagagugaguuccaggacauccagggcuacacagaaacccugucucaaaaaaccaugagaaaaaaaaaggguggggggagaagauaggaccucacuauauagucuagaauugcuuaacuuuuuuuuaaagaaaagacuuaagacuuaaauuacuugugugugugagagagagagagagagagagagagagacggagaccuuguucuguguaggguacuacaggcugguggcccuggagcuuucugcugauugucaucucuauuucccaugucacuguaggagugcagggguaauagugcauacccccaacucugacuuguuacauggguucuaggaucgcacucaggcugucuggcuuccuauguggguugugggaucacacuccgguuaucuggcuugaagagugagcacucgcacccacugagucuuuuuccuaucccugaucccaaacuuucaguccuaccuuccucagcuucuugagugccaagacuguagccuguccaaccacacuugucugaaauaaagggaaauaggugcaauuuccagaauauuugaaaaugaaaaccaaccaaacaaacaaaaaacaagguaauuuuaacuauaugaaacgguuuagggcccauacaagccugauggccuuaguucaaucuccagauuccaccagguggcaggagagaagcaaaucccagaauuguccugacuuccacauauauacucuuugagauguuuacacacacacacacacacacuaaauuauuagauagauuugggggccaguguauuugcugccacacuugaccaccugaguucaaacccuggaacccucaugcuggaaggagagccucagcuucugcaaguugaccucugaccuccacacaaaugcaugcggcucccauuaaaauaaauaaguaaagaaaugcugaaaaaaauguuaaaaguaaugacacaugcuuauaauccuagcauuggggaaacugaggcuagaaaaugagaaguuccaggcuaacuuaugcugcauagcaagacugucugaaaauaacuauauuuuaauaaauaaaauaaaaacccgucacugagcagguuuuagcugagagcacuugcagaagaugcagugguagcccuuagugccugggagacggugcguuuggaugggagugucaggccagugagggacagaggaggcaaguguuaaacugucccuucucuuucucucucauaggcucuaaguuacacuccuguugaauuuaaagagucggaugaaaaaacaaagagagacaucaacagguaaagaauauaauuucuggccgggugugguggcgcacgccuuuaaucccagcacuuaggaggcagaggcaggcggauuucugaguuugaggccagccuggucuacagagugaguuccaggacagccaggagaacacagagaaacccugucucgaaaaauuaaaaaaaaaaaaaaaaaaaaaaaaaaaagaauauaauuucugaagaaagccuccccuuuccugggccagcucaccagccacauguuaccauccccucccaguagaggaugcauuuguuuucuucgguucugcagugcugauuguggaaaggacuuguauaugucacagguuucugaguguggccagucuccagggacuuauucaugaaggcaccaugaccucguuaugcauggccaugacagaggaacagcauaagucugugaucaucgacuguagcggcccccagccucaguuccacaaugcaggugagucagaaaccaggaggcaguguuuguggaccucuugcacagaaagcacaagauacagacguguccuucuugugcaguaccaagcuugcugagaccuuaaugguccuagaaacagggggucaagucacgcuuguguguaagaaaagccucguguguacacaggaacaaacacagaaagcacucauaaagacauuuuuaaauuuuauuauuuuaagacagguucucaguguguagucuagguuggcuuugagcuggcaaucccccuaccuuagcccuccuaggauuacaaguaugcaucauauaaaggcuuauuuuucauugguugguugguuacuuugggguuuuuuugguuuuuuuuuuuuuuuuuuuuuuugguuuuucgagacaggguuucucuguguagcccuggcuguccuggaacucacucuguagaccaggcuggccuugaacucagaaaucugccugccucugccucccaagugcugggauuaaaggcaugcgccaccacacccagcgguuuauuacuuuugagaaaugguuucauauaggcuauguuggccuugaacuucuaacucuccugccucuacuuucuaagugcuaagauauagacagucaucaccaugccuugcuuaaaggcauuuucuuauuuuguuuuuuuuugggguauuuuguuuuguuuuguuuuguuuuguuuguuguuguauuucaagacagaauuucucuguguaaccuuagcuacgcugggacucauuauguuugcuaugcuggucucaaacucaguuauucaccugccucugccuucugagaguaccucaaccaccaccuggcauuaaaggcauuguuuuaggaaaguuuuuuuuuuuuuaagauucauuuauuuauuauauguaaguacacuguagcugucuucagacacaccagaagagggagucagaucucauuacagaugguugugagccaccauguucaaaagaacaccauguguucuuuuguucuguuuuuuguuuuuuuuuuuuuuguuuguuuuuguuuuucgagacaggguuucucuguguagcccuggcuguccuggcacucacuuuguagaccaggcuggccucgaacucagaaauccgccugccucugccucccgagugcugggauuaaagacgugcaccaccacgcccagcccauguguucuuuugagugugugucugugugagugcagauccauguguauguauucuagcacacaugggggucagauggcaacauugggugucaguccucauuucuaccuuguucgagaaaauuuuuccuuggcugcuguguaugacagucuagcugggcucaagguuuuggggauguuuucccugucuacaccuuccaucucaguauaggaacagagggauacguucuucugcaucuggcuuuaugugggugcuggaggucugaccucaggaccucaugcucacauggcaaagaauuuuauacacugagccacugccccaagccuaaaggcauuuccaauguuuccaauguuucuguuuaguccauauauauaugaacacaucugaagaucagaggauaacuugugggaaaggguuuucuccaucaucaggaucaaacucaggguugguggcaaauaccugggcccaccgagucaccuugcuggccccauauaaaggcuuuguauguguguguguguacacacguuuuugugaguuuaacaaguguaagugcuacagugugcaagugcaggucagaggacaacuucacuuuccaccaaguuuaagucagggccucuguuuuguuguugccugcaguguuuuggggccgagcuugcucaugagcuucugggguuucucccguccuuccuucuagcuccccauaugcugcuugcacuguguguaucagccuuuacaggguccggggacucuaauucagguccucauucugugaggcaaguacuuuuucuuuccuagucuucucucucacccacccaagaccucuuugagacaggaucucacucugccuuggauugcuaggauuaaagguguuaggcuacacauggcagccuuuuuuauuuuauuuuuugagacaauguuuggaaaaccuggaacuuccuacauaaacuaggcugcaucccaaguuggggagaccaggaagaugcacgcaaacagcucuaaagguccuuuugguuguuuugacugcggcaagaggaucucuacauaacccuggcuguucugggacucagccauccucuaccucugccucccaagugcuggauuuaaaggcaugcaccagcacacccagcuucuaacgcauuccuugauauaacagauuggaagcaaccuaaauauuuaccaacaggaaaucaauaauacacaacggaauggagagcagcuaaaagucagcuagacauacauguuaggauggcucugagacacacuguuuagugaaaccgccacuaagaaaaccacacaaagcacuaacauguacagaacaacacauacauaaggucaaggucguagccaaagcuugaaguauggauagaaaugacaguccuuucugauggggagagggaaugugauuauggcacuuaacuguuguagcccuggcucucuuggacuugcuuuguagaccaggcuggccuugaacucauagaauccaucugcugcugucccgagugcugggaguuuuaaauaauuauuuaaaaauguuuuuaugaccgccuggugguggcgcacaccuuugaucccagcacuugggaggcagaggcaggcggauuucugaguucgaggacagccuggucuacaaagugagcuccaggacagccagggcuauacagagaaacccugucuugaaauaccaaaaaaaaaaaaaaaaaaaaaaaaaguuuuuauaaagaaauucaugugcugggacuggacagaugguuaauagcaugugcugcucuuucuuucagaaacccagaguuggguucggcauauccaauacacaucugcucucccagggccccuguacucauguacacauacagcauauauacagaaggaagaguaacaaaagucaagucuuuaaaaacugacauauaugugcucugagguauuuaauuuuguguauuuccuguuguuuaggaagcaaccguuuuugugaggacuggaugcaagcuuucuuacacggugcugaagccgguaacccuuuucuuuucagacaaguccuggaaaacuuuaaacuaaagguaaugagguggcugugggcuaugggucaguuacauuguuuuuguucugcauuuaauuacugcaggugguagcaucaaugaugggcuugugcaguuacaguguucuuuaaauggggcauccucugagcucagaacacaggaggugucugcucuccagcggcacugcaugcgugugauuucauuuccaccacuuuggggugaauugcuugcuuauauuuagggugcaucaaacugacacaucucaguugaaaaacacagaaauaaauuauuucaaauucuugcaagugagggcugguaccuuaagagcuuuuuuuguauuauuuauuuauuuauuuaauguauaugaguacacuguagcugucuucagacauaccagaagagggcaucagaucccauuacagaugguuaugagcccccaugugguugcugggaauuggacuggacucaggaccucuggaagagcagucaguguucuuaacugcugagccaucucuccaguaccaggagcuauuuuuuuuuuuaaaagucuuuuuaaagugagauucuuuuacacuaaaggcaagcauuuuagcaauaggaauaauggguauuuuuuuuaaaguucaacauuagcaggguggguaguacauaacuuuaaucccagcacucaggagacagaguucaagaccagccagagcuacauagugagacccugugucaagagacaaaacaaaagccgacauuaucaguguccgaugaguguucagcuagagacgggguauuuuucaagcaucaucaucaugucacugaacauacuuacagggcaaucuuuuucuaggcuauacaagacacaaacaauuugaagagauuuauccgacaggcagagaugaaucauuacgcucuguuuaaauguuacauguuccuuaagaacuguggcaguggagauauccuuuugaagauuguuaaaguggaacaugaagaaaugcccgaggccaaaagugugguggcuguccuugaagaauucaugagagaagcgcuugucugaaguuccagucccguguugaggaucuguuucauggaguguauugaggcugcaugugggggcuguaauuaccauuguuuauaggauugcacugcccuaagaugacuggaaacaccccagcuucuuccuuuugugcuuuuuuuguuuaauuuaauuaaacacaacaaucagaggaaugucuucaccagguccuaggcagacgcuguguuacagcuggggaauuuugcugucucauaaauccuaagcacgugcugccuaaagagcucuggagaugaguuuuggcuucuugggaguuuaccguaguguuuagcaggauuuccuccuccaaaagaaacauaguaugccuuucucaguacaauguagaaguuuguaaaguacaugauccuagcaagaugugaugacacaugccuauaaucccagcuacucaggagguugaggcaggagguugugagguuccaggccagccugagcuacugaguaaguuuauguccagcuuggacuacagggcagucaucaccuuccuggucuuacugcaccaucagcucgcuucauugacagccuguucauccucugagugccugauacaaaccaaugggcaggaaugacgaagccaccuuuugaagcgaauauacacacgaauuaugaguguauaagcacuuaaaaaugagcuuuauguauagaaacuugugggcuggcaagguggcucagaagguaaagaaaccugccaccaagucugacaaccuauguucaauccccaaacucacuugguaggagagaaccaacuccacaaguugccucugacccauacagagcuacauacucaauaaauaaauacaugaagauauggugggcuggagaggcagcucagcaguuaagagcauuguugcucuuggagaggagccggcaccuaccugguggcucaauuucaggggauuugacacccuguucugaccuccucaagcgucaggcacacauguaguguauagauauacaugcagacaaaacauacacauaaaauaaucuaaaaccaguaagaaagaaaagaaagaggaagagagagaagaaaggguauacuagcuucaagaugaaacauucucucugacuaaaaagcucuuguggcaauuuacacaauagguauuuauuugccaggagccuguauuuuuuucuuccuuauuucuagauaaaaaugcuggaauucuuaagcaguauuaagaaaaagggaaauaaaacaguuaauauaggaaauauccuuuacaagcaaauauaagaaugcacauguggugauucaugucuuugaauguaaccuuccacaagacguaggcaguuggaacucccugaguucagggccagucugauuuacugaguuauauaguaagcuucaggccagccagaauuacagagugagucccugucucaauaaauaagaaaauaaacaauauuuuaaaaauuaaaaaauguaaacaaauuccucucaacacaauugcucauugauuuuagaucuuucugucugucauaagccucagaucguuuugcccugagucaauugcaagagcccuugagucgucauuucucaucccaugggugccagcugcagccacacgcguagcuguucugcauagcucuuuaauaaauccauuugguaaugaauuugguuuagaaaaucagaaggcuuauguucucacugccuuugggaugcucagaggagcaugagucugugaaacggaggcauucuuaacugcuuguaaacccugcuaggagcugaguucuaacuuucaaagagacuaaugauauggcuuucugccuuugcuucuccauaagucagucuagggauaggagucaccacgcccuuccuuucccuuuaaugagaaauacaauucaguaucuucauaaaugcuuucauauggcuuuaaaguuuaauagcuuggauuauaggcaguauagaaaagaauguaaguagcauuuuuauagcuaucugacggcuggauagucagcagcucugugguacuuuucuugaaucuuuucccaaugcacuuggugcccacuuggaaaucauuaaaaaugagcgacauuaggacaucgagauuuugagucucuaaaauaguaaucuuuauuuuuaaauucacaaucaggagcaaauagaauucuaaaaguaaguguagggguuagggaaacagcucaguguaaaguacucgcuaugcaaacguaaggaccucaguuugauccucgggacuuaaauacagaagcaggagugcuagcaugugcuuguagucccagcacuggggaggagacucaguucuuacugccagcccagcugacuugguaagcuucaggccagcagagaccuuaucugaaaacaaauggaaaaaaaaaaaagauagcucaauggauaaaggcccuggcuggcaagucuagagcccaugugaagguggagggagagcucacuccugcaagcugcucucucucucacucugucuaugcauccuucagagcuaacuauuaacaaacaagaaaacagaaggguagauggcuccugaggauuguccucugaccuccaaauguuugugcacacaaauaauaauauauauaccaauaauaaauaaaagcaaaugcucuaccaaaaaauaauaaaaauaaacgcaaaugcagccaggcaaugguggugcacaccuuuaaccccagcccucaggaggcagaggcagauggaucucugaguucaaagucagccuggucuacagaaugaguuacagaauagccaguuacacagagaaacccugucuugguaaaaagaaaaccaaaacaauaauaaaggagaugcauuaagucacguguggauauaggaaaaacauaacucuauauucuuugcuuauuuauagguacuucuuuguaauguaagcccacuacacuacacaauuguauauaguagucuuauauuuaaaaagaaucugcauaggcagagacaggcggauuucugaguucgaggucagccuggucuacagagugaguuccaggacagccagggcuauacagagaaacccugucucaaaaaaaccaaaacaaaaaaacaaagaaucugcaaaauucuguaccacugaaaaaagaugucauggaauuaauuaucuuguugauaugaaaaacagcucauaaccauaagccuauugucauauucaaauuuuaaugugaauguauuaaauuuuaaaggcuugggggauggaggaacacccucucagaacaaaggggagggggaauaggaugaagaauucuaagagggggugcugggaggggggcaacauuugaaauguaaauaaauaauuaauuuuaaaauau

SEQ ID NO: 6220 - RNA, 2524 nt, Mus musculus
cuuuuuuuuuaagcaauuuccccauucccguguuggccaguacggauuacaugagaacuggccgccuaucgcuggauacagaugcaccaaugaggguuaaaaacuuuccgagcgaaaaguggaacagaaagaaaagaaucuccuagcauuuccccaaggguucacucucccgccacacacacucuccaaaggaccgcuacagauccaacucugcaagagaagacagagcagugucaaucgggaaagccgugaggaccagacgguguucagugucgacaggcagaggacagugcugccugacccuggccccagggccagcacucaccuaugucagcuucuuggcuuugcuguagagggaguccacuacuuuacucauguucugaauaguuuccagagcagcuucauaaguuuuaucuacuggggguucaucgaaaaugaucaggacacccucccccugguccaaaaucccugaaagaaacacagugacaaaccagguggaaggagguauuagauaguaacaauaggacccacucccuagccucauuuucucccaacuuuucacagcacgccuuucuauuuacucucuucuuuauaaaaaaaaaaaaaaaaagguccuuuagggggcuggagagauggcucagcgguuaagagcacugacugcucuuccgaaggucccaaguucaaaucccagcaaccacaugguggcucacaaccauccauaaugagaucugaugcccucuucuggggugucugaagauagcuacaauguauuuacauguaauaaauaaauaaauaaauaaauaaauaaauaaauaaaugaaugaaucuuuuuuuuuaaagaggguccuuuauuauuuuaauuucucucucucucucucucucucucucucucucucucucugugugugugugugugugugugugugugcgugcgugugucccuguaugaggauacauaguacauguguauugcaagaaaccucggacgccagaagagggugucaaauccucuuaaacuagaguuuacaggaaguugugaguugcuauauagaugcuggaaacugaaccugggucuguaagagcaguuaaacggccuaaccgccgagccaucucucuccacucccuuacacauucuucaaagggaggguuacaagaaaccaucugaagagaaacucagcccauuuuaaagauacacacccuucaaauucuaaccagcuccuggccuacgugaccuuuacucaccaugaaacuucuugucaagaaucaucugugauaauuuucuuuccacgucggccuaaaauugaaguacauaauuaaagacaccaauagucacugaucagagaucagccuaacaugaaaguuaaagacucuuauaagaaauggacuggagcaaaauaccaacaacacaacuguagcccggagcccaaguucuguucccagagaggggccagccccucugcaccuuucccuacucccaccucuaacaggccugagaacuuaccuuggagaguuugaugaggcuagauauguguucaaucuaaaaggaaaagcagacagcaacacugaaaguuugaauuuacugccaauauaagaaggacagagaacugcugugugucucucgagcaugcugagucuacagggcagcuucccuguggccaucuuacuguccucugcucugccuacuucccugcugucacuacacagaauagacucccaucccaugcaccaaacacuugaaguauuuaccacauguacagugaggacaagagggaaaauacucaaaauacaaggacaggccagcucgcagcuuucuaccccaccagcuuccuucuccauuucccagcaagacaaguccaaaccccugguggccucuuaccagacagacauacccuugaaagugaguuccuauuuuggacaacuguggagaaagaaguggccacagcaccacagcuagcccaagacuguugacaaggcucccaggaagguucucaccuggacucgggaaaaaggcucgaugacccggaucagauucuguuccaguaaguuaucguacagcuuggccaaaugugugcugaugauugggucaucccggagcucugcccuguagucugucagggccugcaaaacaaaccucacaacuguuaagaucuggggaaaauauuaaggccuagaaggaauguuaaggccuagguaauuguuaccuggcuaaccugccauuuugugcuguuacuaauauaaggaaacuuucuuauauguuguuucugcuguuacuaggaaacucucucaugaccaagcugauuacauagucugcuauguucugugccuuugcaaaccaauccaaucacgacguaaagucaguagaacugcuuuguacaguuauccauguguggggcagaggaccaugccaccagacacaagaacuaguaagguaguucaaaaccccagcaaaucucguaauugagaagggcaagaauucaaaccagcuccugacuaggguccuguccuggagcacaacaccccacua

SEQ ID NO: 6221 - RNA, 12094 nt, Mus musculus
ugaaccuuucuuuuuuguauuugcaagacagauuccagaaauaaaggacacaugcacacagacacacacagacagacagacagacagacaaacacacacacagacacacacacacacacacacacacacacacacagagcaccuucaggauucuugggcccuuuccauccguccucaguucuuacacauuccaccgcauacccaacaaauacacuugacucgguaacuacacacuugaggaaaacagaagaacaaguuuacuauucgccuggugguuguaaagcgaaauugcaggcauagugauaaaaaggaaacaauugacuucgcauuuccucagcuucuaacacaaaugggaaagcggaagauacaugggaagcgggguggggguggggagcucugaugcuucaggaaccaaagcacugaacacaaacaaauuagcaaggggagcacaagggucacccgaagagacuaucucgaccuagccacuuaguucugauuguccauguugccacgccuugauuuucagaagccggaaauucuaauuugauaugaagucucucaauucuuagagggcaacucgauuuucuuggaaacauuaaaugaacuaaauguagcagcgagcccggcagcuuucugcgcucugcuguagagguacacagcgucuccccuaacugugggauuacacugccacucuccagccacuguuugccauugcagcagagccuguccagcgugaggcucucggcuuuacccugcacccagggcuggccgacagagcucuagagaacaacuaaaucuacaggaaguagaaggcucgcccaggggcggaaauggggccucggagaugauuaaauggccgacuguuccugcaggaagcccucaggguuggggaggcuuuuaucuggcucagaagccagggcugccucucgaaggacuuccaggugcuccucagcggcagacagugauuggucaauccaguccaggcccccgguuagauggcaggcguuccuggucacuagcaccaagugacuaacggacagcagcagggcgguuguccugggggggggggggggaggaagagaucagacucuguagaaaguggggaacuuugcacagaaguccaaaugaguacacacucuagguuaguguuccccaaaccggagacccuucccuggaaggugagcaguuacuuaacacaauggagccacacauagggggauggcuggcuuuaaacagaaggucucagagccuuugaugagauuaacauaacuccauggggaaacgggagcuuuucggguaguagaagaggcuuucugcaacacacccauuaacagcucccagaaggguguuuuaugaaacaguuuggauguggucaauuggaugagcagaucucuaacugcagcccacuuaaagaugggcuauauaucccucuucagugagcaucccuuauugaucacaaaucaauaagccuggggcuggcuuauucaacgcuaaagaaaauguaauugaaaaucaaauugagaaggaagguuuuguuguuguuucuuugguuuuuguugguuuuuuuuuuuuuuuuuuauuugaucugggguuuuuuuuuuguugaaagauucacucugaaaugauuuuauauggugcuagauguauucagggcuccauuaccaauuacuaacccaugggaaaagcugaacaacacuaagagugggcagagaaacgugucaugacuuacucgccaccuggcaaccauuacacaacaugucagugggagccucaccaaucaaauggagacagcagguagguauuuuauggguuuacauucgauagggcugaguacauucuggggaguggaggaggagggguucccgaaacaccugauggggagugucuuccacuguggcugagguauuacauguucucauugcuggguucaccucaccacagccccacugggcagugcuuccagcaagguguggcaccuggguaaguccaaagaucagaggaaggaauggggcguggagggcagggaggcccaguuagcauaguuaagccugcagagccaaggcugacacauggcuggcaccuuccucuuagggauucaggaggaagauugggcucuaucaccugccaggcucagcucacugaauggcucacccagagccaggggugguuggaaaucuggaaaaacauccucucuucauaacccaagcagcccaccugacaugguugauaauagcgacccugaagugagacaagaugagucacacuuccucccucucaccgugcauccaggagcuugggguccaguggaggguacauugacuucacgacgucguccacucugaggggaggcaaugggacaauugugagcauuuuccuagucccuuuuccuccuccuuccuugcuguugucacuccagacuucucuggugcuguuacacacccaccuuuaggaguccuuucucuaccugcuucugcauacccaguggagucuaacagaaagacuucagauucuacuuggggaauaucccugcucucuguuuuuguuuucaucccaaugguuaaaaugugugaggucacacauagggagcgaugcugaggauaacuacgacacugaaaagguuacuaccaagcaugagcaugcuguacccuuuaacauauauauauguguguguguguguguguguguauguguauauguauauauauguguauauauauaaacaguaaacuaaagcuaugaaaugcaagaggggacgucuaaggggaugcuugccacuuaugguggccaaucuccccaaauugggaggggguggaauuagggagcaccucacuuuucagauaaucuauuccugaaguaguuuaacuuuuauaagcauuuauuacuuuuguggguuuuuuuaaagauacaaauacagugauauagaacacuaccccccccaaaaaagucacuucaccucuuaauuugaguucaaaccucuccacuguguguauguguguguguuuuccguccuggauagucaguccauggcuaauauuuuaaguuacauuccuaccuguucugauuugugggguacaagauuuugcucccaugaucacuugguacaaagaaaaaaaacuguauaauuugauuucuaaaagcacuaagaaaaauacacagcccucacucucaggccggaggagcuggugagcacggcggucuucagcaugugucugucccacccaacuagccccuucccccucugcagagcccaaggcagaaacugcucucccugaaauaauaaaucaucaucgugacagauggagaaaauuaaacaggaaggacauggggacaaauaucagccagagggcgaacucaugaggccaaaugaagaaaacaagaggauucuggcaagaaacaugagugagguuguccagggcacucugcagagagcucugcccuccugacaaugccacacucucaccuuggcacacuguuaaaaacccuguccccucucagaaaucagcacccuaacacccuacuuauaaccugcaccucggggcggaucucaagaguaacaaaaugcacaaggaaggggcccaggagauaggggcacugcacggucuaaauauggugggagaguagcggcaacgccuggcacaagcuggagccugggagggugggcgugucucaugaagccgcugaugcuaaccagauauuuacacccaugggggaacuccagagccaggagcuauuccggccugcauccucccucucagcgucuccacucacugacuaccuagacagaguucaaguacuccaagucuuguauuucccagaggauucgccacauggcuccuccugagccccacuagguuauucuugagacagaaaagccugguugcuugugacuuaacccagacaccaggaaugcacagcggaggccauuccaggcagaggggucaggugacuugauaagaacacuuuccuggaaucccgucauuugauagccaauccacauaccagccaccagguggcagcaugcauuuagcagguccuuuugcucuaagaaaagggccuuauuuuucuuugcaaaauccaguccaacugaggggguguaguuguugacugaggcccugccggguaccucccacaggggauuuugcagacagccaggaauucaggaggucugaaugugcuguggcuucccuucccacccagugcuaggaugggaaucaagcagugaaugagagccaccauggaagaaagguaucuaucucucaaaccaguccccaguauacuuauaggguuggaccuaagggccuggcugaaaagucuaugaagcuauaacauaggagccagugggaacugcgccugcugacagccacuucguagcaggguaagggaggcugaccgguaaggguaggagcugucacuguugagugcaggcucugucagcccaguuauaccgagcuguuaaagggcuuaugcuggcaagagaaaugaugagugaccaccucagcuuaggaauacccacgggaggcaguucuguaugcacuggggguucggauaacugagacugcagaccuacuguuuaaagcaguacuuggccuugcuggcuaccccaguuuccccuguggcguugugggaccucacauccacugaccacucaccuggggcuaauccguuuggccaccacaaugaugucacugacacuugcugacgucuucaucuuggccccagaacccauugucauggcaacgaguuuuucugucagagugugacaaaucuaauauaacaaggagacaagaugugaugugggugaccuggcuccccaaccccacaccaagggcucuggcacccugaaaaagaugaacacggccccaaccugggcaccgcugguaaacuggcuccuacccuagugaugagaggaaaugggguggaaagaggcaaaagccaauagccuggguggaagcuguagggggaagggcucugagaucaaggacagaccuucagcucaaagaggacuaagcuggaauaauccaucuaagaaaaaucacgcgcuccaauuuuaccaccuugacuugggggagaaacuuucuauuacuucaugguuuagacuucuaaauggcuaauaucuccaguggggugcucacagaaauguggcuggacaaagggcaacuguuuuucuuuaggcacauucuccaauaaagacaacuaugcugacaguuuuugaggguuguggguuauuuguacguuuuuccaggugaugauaaaaagggcccuggaaaaagcagggcaaaggcaaaauggcaacacgugggcuucuuccucuuccucccgcaccacuggccagcuccaaggcgugugguucuuuucuguauucccuuaugcuaaaaccaagcaugccucuaucccugcaaagaagccccguuaccugcugguacucgaggcuaggaagcaggaagaagaguggucaagaggccacugaggaggaagauccacgcucuccacucucccaccacaggggagaauggggagcaaaggcauccuggggucucaagaggaagcucagaagcccuuuucuuuaucugagcuccccaauccaagaagaagggcccucccccuuugaugaaaaaggacaggagaaaaacaaggcccaggacauaucaugucuggacaaagguaaauguaauauggcuuccugcuccaaucugugaaccuagcuaccuuugccuauaaccauauuuguauguguagccauauuuauacauccaaggaacuuccugauucugaggccaccguuuucuacagagauagccaaagaagaagcaaauacaggguuuuuuaauauccuguauggagugaccuuagagaaaagagcgaguugucucuuuugaaauacugaauaauuaguagacaaagagauaaggucgcugaugugcagaagcucauauuugcauuuuguuaaguauuugcauguuguuauuauucuauuaggagagacgauaucaggcgagaguugagaaacgaacgcaagaaccaugcggcuggaaacaguggaacuuggaugugaucuuccaagccuuccaagaccaaagucugccuccaaguggaagagcuuguaauuuggguuuuugguaacucugauuguccuguuugucugacuauugucaccaaggaagccaaagggaacccuguaguaacugaaaccuaaguacaggcuguguucccuggacugagcucagaauucauaaaggaucccagggaggcccuugcugcugcagcuccauggucucagacacccagccuucuccaugguuggaaaauuaucacuggagacccccaagccguccuuuccauaagucacuguguuaagaugacuagacuggggaaaagccuaaagaggauguuuauaaugauaauguaaaacagacccgauagggagagauggcagcagacagaagaaauauagcaugaggcuaacaagggaccauugcaaggucaacuccauguacaccugcagugcuccauguauacuggaggcgcucccacaacugcccaugaccucacagggagaucugaauauuaccuucaagauggcgaugcagugggacaugaggccccuggggagacaagaggaaaguuaucaguacuguucugaagugcccaucuccauccagcuccccccucuguccuucagccggcaccagauugccucagcagacaacgccuccacacagaauuccccagugcuauagcauacacagccgacccacuccuccagccagcucugucaccaccugccaaguucaacguuugaugucuccgcauguccaacauguccuuuuccuuagacucagccuggugaguuccccuuugcaaacccaagucaaaaagcacccacucaggggagggguuuaugaggccccaugcuccauaagggcuuauaaguaguuaaugguuguuaaguaaaggaaaaggagaggcauuuucuuagcuaguuguguggcuacuauugggauggccaggcuccuauaagcaauccuaguuaaauuaaauggggcucguucugucucugucugucugucugucugucucucuuucucacacacacacacacacacacacacacacacacacacacacacacacacacacacaacauaaaagaaaaagauagaaguagacuacuuagggagagaaggguauuauagaaguaggagguggaugggagaugguaauggggagggagugugguuaaaauacaugauaaacauguaugaaaaugucaacaugaagcacaagcacaauuuuaaacauuucuucaaaugcaccccuuugggauauguuuccucaaagcuaccuugaucuucuuaccccaggcagaucugaacccugcuaacucccugugccacucgccauacacggagacucccuaaaaccucuaugacacuggcuuugguacaguucuaucuccugucauuuugacaucuucaaggccuggccccacacccuguauauagcacccugauauaagugugugucaguaaacaagaagauaaaaggauuaugaaaagaagugguacacacuucacaaagaacuguccuguuaaacagacagccccuguugagacacugaaagcaaaggcugccuggagcuaacucaaaauccuugggcaguccaagaaugacccaaccucacgggggcggggggugcuuuauaaugaugucugccacacaucuuacugccugggucuucaagacuacaaagugaaaggaacaggacaagaacaaacauggccaugccucaugcugacauuccucaugacgggggaaggggaagagcucuggguguccaguggaguguucugugaaggaacccagaagucccuuugccaucccagaggacuagaaagcgaaagcuuccuguggccuuacgaggcaucuucgauccaguccucauucuccaggauggccucgauguggggguuggugaugacgacaucauccagcuccagcucggaggguucagacugcgucuccauagcaccaaugagguccacgaugggccuggaagggagagccaccguuaagaguuucacgaugagugacuccgacugaaccucuucucaccgcagccacugcuauaauuuagaucuugaaggcccccaaaggccugugaguuaacggcuuguucccuuggauggcaauauuaggagauggauccuugaagagguacagccuagugggaaggcuuuaaguccggacccuaaaggggacugugagacacuagcucucuccuuugucucuuuuucugcgaugcugaccaugaaccgggcaguuuguuucuccaugaacuccuaucuggcagcgccaucagaucucuagacgcagaaaguccaccugaucauggcccagaaucucuaagcccaugaaccuuuucucuuuacaguaaguuaucuuauggauucuguuauagugacagagguagaggacagaaugcuugcccuggguacagaucuaacuguaaugugcccacagcacaagacaagggcacacagcuaaacacugggucaggaaggcagaccaacacgcaaaugaagcaaaacaagcugaacugcuggagaggggcagagucagcgcgauuccaaagaugccagagugugggguggggguuggcacagccuguaaucccagccccugggaggcagagccgggaagaucucaaugugaguucgaggccagccuggucuagagaacaaguucuaggacagccaaggcuauacacagagacacaaucuuggaaaaaaacagaacaaaugcucuucuuuucuucucccuucaaaccugugugaguauggaaagacauacuguucacccaggccuaccuaugcucuauaacguguguacagcaucaccccucugagaaacacuauguccaccuucacagcaggguucaguagaacccaagcuacagaaacauucuuugcaaagcauagccuuccagggacauauaaaugggcauucacaagagaugcugacagaguuaagguaaacaccagaaaccuaaguuugguugcuaacaccccuuauggaucucucugcucaaaaucccuacacuggucuuacuuaacaaaaucaauuucacacaacaacgcaugaugaagaagaaaucugugcaaggagacaggcaccccugugcuggggcugcaugaucuggaacaccugcugcuuagguguguggcuaagugucagauguccguucccaggguuuuggcugguaagggcuuuggcuaaucccucugccaaaugaggcagcuagcaucgcaaagucagggcuuucgugucaggugcacacguucagugacuucuccaugaccuaaugaacagagaaagaggugccucgggaugcugggaugcuuaaggaauguucuuacgcucuggagucuuuauaguaugaaguguggccugcaggaaccgcuuaagagagaauaaguugggcagaagcggccagcuccaaauuccuucugucccucgggcuuccuguugucagccccccagcucccugccccacccccaccccaucacagucuacucacuuggaaucauaacgcuguaguaggucucgaggccggcaguaacgcugccuacagaccaccaccaaagcagcaaaugaggccaggaaaaugguggccagcacaccuauggcgacgaucaccacagucuccaugcuuccaggggcucccagccucaguccacucacauccucugagcagguggaagcuguggggaacauaaagucaagcagaccugguaaagauacggcagguguggggaggggcggccgggucuuaccugcugcaaauggccaauggggauggaaaggguagcaaggcucccucacaucccccugcaaacccaagggcaucuuagaccacgcccgaauuucccuucucuauuaugguaagugguuauuuuccaguuagaaugagcuaaguuuugaagcuuaggacacauuugcaccugccuugaugacuucaugcuguaagucauguaagugaaauaaugccaggacagaagaagguuguacucaggagcuagcuccucugugucagauacuccggguggagccuagcaaggaucguauggggcaucucuauguuauggugaagaaacugaguuuccaggagguuaaagaauucguccaggucuacauagcuggccaucagaaagccauugguccaaagugaagagucaccuuccuuuuccuuucuaaggaagagugagaacccugggauggguugugaccgaccgacacuuugagaguugaaaacuuagaagcagaguggaguauuccuugugcagcaccaucuggcagcuucucucacaccaacagucagguauggcuuaacaagaugcuuuuccguucugagaaaugcacugucagguauuguggucauugucaaacacccagaccgaacuuagacaaacuaagaccagcuaggacaucaucacacgaugcaauccuuugggaccaccauccugaacgugagccauuacuuccugcagcgugacgcagccuaucaagcuguguuaaacucaggccagagccucucagagaaguggucuucacagcauccuuucagggcagaccucccauaggcauaccuuugaaaaaguuuccuccccucccuggguuuaguuucuuuaccuacagaaaggagugcuaugccucagcagucuguaggaccccaggcuggcucgccacaguacuuagucuaugugugauguuuaugucucccagaauucaaacucucuugauggucacucggggagcacagauugaccaucugcuuacagcaaacacugaauucugaagacuagagacagaagacacagaucccccucccccaugacaaugaacugguggggaagaaggaugcagcuguguaggugggcuaugugcaggcuuggguaauaaagagacugcaauuugcauggcacuuucuagaaaagccuccuucgcaaaccuggggauaauugagcugaauuuugaggaacggguaaacaggguggggacuuuacuggcuuaaguugccaaggaagccuccucagcagucugcaaacgcugcucucucacagaguuuuuugguuuuuauuuuguuuuguuuuguuuuguuuugaucuuauacucuguugggaaagcaggaaggggagggaacagguuugccuuaguuucucuagacacucugugcuguccuucucugucuagcaauguuaaccguuuucuuuccuccuuauuuuuaugucuuccucucuagauguuuuccuccaauguaucccuucuccaggcuccccacauauucccuuccacgccccuauuucuccaagcuccaccaccaucccgcaagagagugccgcuuuccucuucucucuuuuucaguacuuucuuugaggucuuugcuuucuugaacuuucccucagccgccuucugcgaucccucggugugggcguuccuuugugcgcuuuucuuucuuuguguguucucuguaucuccgugacuuuuccucucucccugcaucucucuuucucguuccaucucccucuuagcuuuccccuccauuugauuuuaaacccaucaagauccaacucucucccuucuuuggcccgccugccgcccccagggaaggcugguacgcgcgcucaacuuugguccccaacuugcgcgcugcuccguuuccgcagggcagaacaaagcagugucccagcagcccacagagagccuucccgccacccgccacccgccacccgccccgcgugcucacccaccucaauugcagcuccgggguacgccggcuccccgcgauccccccccaaggccaaguccgagugcugcccgcagcggccagcagcagggcaugccgggagggcgggcgggccgacgacccagauccacccccggcggggcggcccagccagcgcacccaaaucccccgcugccaggcgccgccguccccgccaggccccuggccgccuggggauuggcgucccgggaggccagggcagcugggagacagucacugacgaucggaggaccccuccacgugcacccacg

SEQ ID NO: 6222 - RNA, 9454 nt, Mus musculus
uagaagggcugaggucaaccugaagucgugucugauuucucccguguucucucaaugccucgugcugggacacuggcacgauuacaaaggguguccugaaccgcaucaggacuuggagccacagccaccgcugucaucgucccccaccgguucagcucugguagggaggacuccugaucugugagacccucucuccgaguccuggugcuguuagcuagaggggccagggaauagcaaaguagugaucagagauggagggaggggugaaucuuguucuggaguggggaagagagggagggaggaagggagggagggagagagagggagaggaauagagggagagagaagggggaagagggagggggacagagagaauaaauaugaauaagagcauuugcuggcaggucuguggucucugaguuaccaccagauccauuuccuuaaaccuuuggaccugcugugaacugcuccggauaaaguuaucuuuaaguugcuuuacucugaaaaauaccauaauaucacaaacacucacuggguagcagugaacuugguuuccucaucuauacauugaguauauuaaucccagcucuuugaaugguuaagaggauuagaugagcuuaaguuaggaaacacucacaaagcgccuaguccuacagcguugaaggacucagcaaagguaacaauuaucucacuccugguacuuugagaagggcucacacucuguggccaugacuucaguguacuugaguuuaagaagcauccacugaacaaccucucuacaccagcgucucuguuugccuuucaagauaugaagauaaauaggaccaggccacuguucuguggaaggucaccuuggcugggggcagggggcugauauauauuauaauccaguaaagagacaaaguuacucuaccugucuggagagauggucccugccaggaaagccucaccggggacucaccuuggaugauccuugaggcaucaauuggagcugucugugcagagggaagggagcuaaauugcuacacaguaggcaucuccagaagagugaccaauguagugucccagaacagacgguauaagugagagacaagcuggcuuuacaggaccaggucuuacaugucaauucauucuggugcaugugauagauggaggcaggggaguuuguaagaggucaagacuaaacacagggaaggcgugguggugguuugaacuuaaggaaagauugugcucuuggagggagggaucaacaggcccuugacauuaacugacucccgguggauggaggguguaggcuggagaagucaaggacagcaucuguauuccuaucaucuuugaguaagcaggugcucuaggaugugcagggaagccagaaccaagaagggcggaguuuggugggaacauuaucucuuagaugaguuuaguuugaggugacugugggguaggaacugacaagagguguucggggcucuuuuucaggaaaaaaaaaugcuacaagaggccauuaccuugcauuugcuguuaacagcaggggcauccuaggccuuccugauguggaagaggaggguuuaggguagaaacuggaaaacaucucaacauuuaagacugggucagaauuggguuaugcaaugcaggaaaaauagucagggaggagggagccuggaugaaggggguacugugggaaccagcaaaacccugauuucaacagggaugugacuggcaguaggaauguccccaagguccaucaccagaggucucaggugggugguggggaaacuugugacuccagauuagcaaacaagggagagccagguauaguggugcacaccuguaauuccagcaacucauggagccaagacuggaagauuauuaagucagcucgggcaauuggcaagaucuugucucaaaacagaauggacacagggaccaagggaucagugguauaggccagugguggagcucuucgucagccugugaaagaccugggauuugaucuccaaaacuaggaaagagaaaagaaaagaaaagaaaagaaaagaaaagaaaaaacaaacaaaaaacugaaacaaaacaagaagaaaagacaagaugaaggaacagggaagcaguggugaaucccucucagaaauuuggaugagaagaucagaaaagggagaucaguacagacaaggauaagaaacaaggaaagauauucuagaaguaggggcucucagccugaguguuugccuggagugaggaggagcagauagagaugaggucuguggaugcagggagagaaggugugcuggacagcguagaugcugggagagaaggcgugcuggacagcaaggcugggaagggaagaacugagcucagaggaaagagggaugagguagauguguugcugaaucuagguugggaagccugucacauggaaagccagugucucagagaggcauguaaagaaaagcaaccuggaaggagacaggucaacaucuccagaaaccccuuaggagaauucuggggcugggcagugguggcgcgcgccuuuaaucccagcacucaggaggcaaaggcaggcggauuucugaguucgaggccagccuggucuacaaagugaguuccaggacagucaggacuacacagagaaacccugucucaaaaaaccaaugagggagggagggagggagggagggagggagggagggagggagggagggagggagagagagagagagagagagagagagagagagagagagagagagagaaugaauaauauucuggagcuagggaauauucaugaagauuaggcaguccuaaugucuuaacacugaccaagaacaaugaucuaguggaguagggguuggggaagggcucuucuugucuuugaggcaugaaggucacaucccggguuaggaagccaggaauacagcaaaauggcgccacuaacugcagcugcuacacccugacuuuguccuugcuccugaggacuggugauagauagaaugugagaagcuccugacaaguuugaagguggaauggggcugaggcaagaaggaaaaaaaaaaaaacccugcuuuccuugguaccguaagggugaggucaccugagaacuaagaagagggauacuuaaggggagcaaggaggguucugaagccccuuugauggagccaagagaaagacgaucaaagacaagcuuuagcaugggugcuaguucaccagagaaacaauggcaagucugccuuuaaugcagagagccaauagcuuuccacucauuuucucuuuuauucuuucaaccaucuucugaggcaaguacuauuaauucccgaccgucuuaggcaugaagaaaaagagacauggagaaugucuuacaccugagacauaggaaggagcagagguggaugucaaacccauguguagaacuaggccuuagucauccuccacauucaggguaggaggcuggaaaacaagaacacccauguuuuccuuuaacuuuuuuaaugaacagagcgugaguguacaaaguaggaaguuucuuuccagcauuuuuauacaugcuuaguuuguguugaucuuccccuuccaccucuacuauucucucccccuucccucccucuccccucccucuccccuccccuuccucucucuucccucccccucccacuuccccaccccuuucucucccucccuuucucccucucccuccuucucucuucuuuauuguuuuuaagauauaaacauuuuacauuauggguauaugcaugucuauguauacacaaguucuggugccuguggaugccgauggagagcaucagauacucuggagccgguuuuacgagugauggugaguucuugauauggaugcugagaaccaaauucagguccucugcaagagcauuguauacucuuaacugcugggccaucucuccggccccacccguuccauuuuaagauugcacaaaggacagccguuuuggagauugugugaguguuucauguuuugaguuugugaugggggagaggagcuuggcgggcaaaguuugugaaagucagggguaaauguguuugaugguauuauccagggagagauuugaguagcaggcugcagaggagggaaguaugaacugaugucaagauggggacaggucagguccucaaguagcaaagguagugcgguugaaguccagugggccugaggaggugaaggaaccaggaggcuaagguaaucaguggcugagaucaucaugucauggggaucugcccacagagccaagcaacagaguaaagugagcaggaugcgugagucuuagggagcuuuugcaagguugaggacauaggagggaugguaaagaggaggcuucagcuccagaucugagugugggagcgaugucuuccaccggggagggcuccaugcuaacugugucccugacucaacuaaggcuggcggacagaagccgggggcuggaagggagaccccaugagugguguuucaggaaccuuauccaagguccccggaggucuggugucccaucagggaggggacuuugucuucucuccacccuuucacuucuuucccagggugcacucaagccccauccuuccuuccuucuuccaaggggcagcugucugaacccuugugccgggcuggugaacugucugccaccccacaguucagcccucuaccugugccaucgcauggaagcuaggagccgggcucccagaagacagcugugcccgccugggaucacuuggcuggcccuggccuaucugcucagcugccugcuugccuccagcaaggccaaggucuucagucgcugugagcuggccaaagagaugcaugacuucggucuggauggcuaccgggguuauaaccuggcugacugugagcacccuucuccccacucccuccacuuacccccugucuuuccuccuaaaauccaagguggaccagguggacagcacccaguccugaguuaacuacauacuaggcaggcaacaggcagccagauuagaaccaucccugcugguagccaggaaguuaaaggaaccuacugcuuaguaggcuacauccuaucuuggccaugaggauuaaacaggccugccaaaaguuaggaggaaaacuggacaaaccaguaacuccaaauguuacaaacgaguggcaguuucaggagcuuguaaaguacugucacuggauucgguuugucucuagccccugccuccuuuguagagcccaccggcgccuuccuaaucuugccucuaaagaguuagcucuuguacauuuauucaacaagugcagcaagcccuucaauauaccgaacaaggagagagagggaagauugacagccugaguuaggaaggcugaggugcaguccugaccuuugcuuugagguaauugugucugaccuuggggaagucacuuugaccucugacucuagaucaagccaucugcaaaguagaugggaggacaucuuuuaucuuugugggacagagggagccgguguguaggaguugauugugagcgcuuuggucugugguggcuuaaccagcugaccuuacagucagugucugucccuuguaggggucugccuugcuuacuacacaaguggcuucaacacaaaugcuguggaucaugaagcugauggaagcaccaacaauggcaucuuccagaucagcagccggagguggugcagaacccucgccucgaauggccccaaucuuugcaggauauacugcacugguaggccugcacuagccuucacuuuuuuguuguuucucccccccccccccguccuugucucugggugaagauccacaggagauggauaaggaggggggggggcaagcaggggagagaagggcuucuguggaucugaauugggguccaggcuuagagcuacaggaauggaggcaauaugggagaaggggccagguaacaucuguuuccauagauggagaagugugugugugugugugugugugugugugugugagagagagagagagagagagagagaaagauggagagacagacagagagaaacagagauacagagaggcagagagagacagacagagacagagugagacacagagagagaaaaaacagagacagagagcgagagcacucuguucucugcucccucacucuuuccucuucuccaucuccagauuuguugaacaaugaucucaaagauucuaucgucugugccaugaagauaguucaagaaccccugggucugggcuauuggugaguaacuccuacugcagucccccacuguggccagagcugguggcucacaucagggaacuagcccucagugaguauccauuuuucucuuagucaacacauuccauagguucuugaacuaacccucaguguugggaauuaugggaauucagaaaguucaguugacacaaucagagagaauagcauuggcaaucacaugaccacauagcucaucccaaauuguuuauaaauccccgugguauaauaagugguagaugggguccuuugcuuggaccagggguaggcuucuggaccauccuucuuuucauuuuuuuuucuuucuuaccuacuucaagcaauauauucuuugaaguuuccucacaaccaagaagucugagcauuacacugggcacugccauagaugucugguccauacaggcacucaagucaggugcuccacaguugcccuauuucuuuugaugggguuuuccacugaagucuccaaucucuguuccauuuaugcuuauggaagagaaacuagcagggcagggacagaaucagggaaugcuucaggaguuuggagcacugagaccguggacagauguaaugguggaaaaaguuggggaaggaagaugagggagaguguacccaucauggacacagagagaucagguauaagggacuguggaagggauucaggugcaggugacaaauggucuaagagaaaggggagggguuagacaugaucgaauuuugagauauuccagacguaguccacucauuggucugagaauaauugaagcccuaagaaguuaggaguaauaccagcucuguagaacaggguguguuuauaaaaucaggaagagacaagauaggcucauguacuauuccaagagccugcagccuugguaccccucgcuguggaguagaagaccugccccuaauagaguaaacuaaagaacaucucuguuauacacucagagugguuuuccggcaugggugacgcuugagagucugaggcuaauuggaggaagugggcccagaagggucaaugcugccugcccacuucuuuuacucaugcgcugcugaugcagguaggcaagggccaggagggugcugauccgcagagauggcugaucugcagagacagcugaggugcagagacagcugagcucuucuuuguucucaaguaucuuauagucuaguggaagagacaaucaaccucucuggcugacaguuguuuagaagucuuucuggugcucuauugaucauuaggcucuuugggguugacaucugaaagaaugccaguuuucagagcuugggauuccugagaauguugggccucaggacucuuauguucuugcuaucuuccucaagauguccaaagugauggaccugggaagacauuuaagaccauaaaaauugcucaucgcagucaaguguggacacuaugccccuccuuagaauugggaacaaaacacccauggaaggaguuacagagacaaaggagcugagacgaaaggauggaccaucuagugauugccauaucaagggauccaccccauaaucagcuccaaacgcugacaccauugcauacacuagcaagauuuuaucgaaaggacccagauguagcugucucuugugagacuaugccagggccuagcaaacacagaaauggaugcucacagucagcuauuggauggaucacagggcucccaauggaggagcuagagaaaguacccaaggagcuaaagggaucuacaacccuauagguggaacaacauuaugaacuaaccaguaccccagagcucuugacucuagcugcauauguaucaaaagauggccuagucggccaucacuggaaagagaggcccauuggacacacaaacuuuauaugccccaguacaggggaacgccagggccaaaaaaugggaauggguggguagggaagugggggggaggguaugggggacuuuugggauagcauuggaaauguaauugaggaaaauauguaauaaaaauauuuaaaaaacugcucaucgcacaagagugaaaacccaaguuugauccccagaacauauauuaaaaggcugguauguuggcauuuguaaucccagcacgaggaaagcagagacagauuucugaggcucgcuggccaaccagcccagcuuaaauugguaagcuccagguuuggugagagacccugucucaaaaaacaagguguacacauucugggacacacacccccaaaacaaagauaucugugagcgauacaaaggagugguccccaaaguguauagcagacaacaauggaaggaccuacauuggcaaucaggaaauguugagugcauuguagccuuggacaaguggauaaguuaacagcacuaccagaguuuuucauuuggaauauaggggagauaauaucuacccaaucaaucuaauaggccaucuggagacaggagggaaauaguuauaaguggguaaaaggucugcuggcauguaaaccaugagggcuauacauguguaagacaugcaaacugugagagcuauacacaugcaagguguagcucacuguccccagaagcacuuggguguaggaaaggcgcuuuggauuuaggcuccagguuccaacuucuaacccuuugauaaggacuaauggguaagcuuguuuguauccggagcauacuaguuucuaucuccagugguaaaauaagguaauauuguccuuuuuugacccucugugacugcuggcuggcuagcucagcucacuguucuccauccuccuaguccuugucuuugcuccucuucaguuuagagcccuuuaccuuuucuucucucucaacagcagcacccagaccugaagcugauguggauucuuucugcuuguuuguugagacaggguuucucuauguagcccuggcuguccuggaaucugcucuguagaccaggauugccucacguucagagauccaccuccucugccucucaagugcugggauuaaagguucgcacccucccccacccagcugcuaaaguggacucucuuccuucucguuuucuauccccagggaagccuggaggcaccacugccagggcagggaccucagugacuggguggauggcugugacuucuaggacccucucuggauggaccaagccgcauacagcuggcugggaaguguggacuuguuccugacccaggcuugggaagacaagccaaguaauaaaagucuaauuugacagaag

SEQ ID NO: 6223 - RNA, 1624 nt, Mus musculus
uguuucgcuuugcuuugucuuuauuucuuggagcccuauugcucucuagaugguccauagggcuacuuccccauguagcaucuuuacauuaccacauuaugaauuuaaaacgggagucauguugacuuacagaaaaaaaaaauaaagcugaacagagauguauuucuccuuuuucccucgcaguccugaccucugcuuucuuaaauccccauuucguuaugcuguuuucacucggcaguuugaaagaacuagagaauacaugaaucaacuugacacgaauaacacaacuacuuacacagaagauacaggaugcaaguaagugcaggggcuccgugcuuucugauuugggcaugccugugggcuuuucaggguacagagugcugaauaaagauggcaggcagggugggacacacacgggugcaggaggugcugcagaguuauggcugcaaagaggaugcucaguagccgcugcaaccccacaugcagaacacaagggggagaggcagcuccacucagagcaguggaagcugacuccacaccuccucuccgcuacacacaaugcuggcucaccuauggccaaggugguacuaauaaaguuuuuguugaaaaccugcuguggaugguugacuucagaccugucugugcucccccccccacucccccuugugcgugagacaauuggcucuagggaucaacugaccgagagaaaacaaauagucaugguuucuuucuucuacuuucuucccaggggacagaaaggcagagacagacuaggaaaaggucuguacaaugaguaugaagaaaggaagcuuugagacacaagccagagaggggacagcaaaggguggcauagacuuacuucccccgugaaggagccugaaaucacaucagaaaccagggccuccugauguggguaccucccuacugcuggagcuugcuuuauuuauaugagcgaggauaccuuuaagcaggugcucuagauuaaaggcuuucgggaucaaaguagcuguggucagacauggucccaaagccuccuuugagaguaguggagaggaaggcagcccacccaggagaguccaguuacagggagaugugucuuguuaaaguaaacaaaaucagaguuaaaaguacuaauuccauacuacaaggcaagggugcauuugaaacggauuuuugcuuauuaaaaaagugccugaagggcaaggcacaguuugaaguugugagcuacauagcuguuuucacaguagcugcuacuuacugaguacccaccuccuguuuacacaguuuauuuuugcuaucaccauccugugguuaggguggcaggggcaggaaaguggaaaggggcuugcagggaagccuuggauguccauucacacaugcagggaaggcaaaauugcucuccgagggggcagacaggcggugguuucaauuccucaguagccccagcucucagcuacacucacgugcacagauuaggaaguuggaaauaaccggugugcaaggccugacaucaggcguuuuccaguucagugacagcagcugagucucugggagcaguaagggauagagucaugguuggaagagccuuuaccuccccaggacaggccccagguccauaagaaug

SEQ ID NO: 6224 - RNA, 1886 nt, Mus musculus
cagaagugcagagagccagacgggaggaaggccagcccagcaccagcaccagccaacucucacugaagccagcucucucuuccuccaccaccaugcaggucccugucaugcuucugggccugcuguucacaguugccggcuggagcauccacguguuggcucagccaggugagacccccccagcucccuucccagcauaucaccccauuuuugaauugucguggauugugauagcauagucucacauggucagguacuuuuuuuuuuuucuuuaaccaagauaaggagcauaaagaaggaaggacaaagagccaacccaauuacaagauugcuucuggaaagcaacuagaauuuuaauuguuagaucuaaauuuggaaucacaccuucauauaguuccuguuccaguuacuucccucaguauuugggaaccugggugaucaaacagaggcuuggguuggugccuuuuuccagauagaggagaaaggggaagagauccaagauccgagcuguguuucacccagcccugcuuccagagauagcagcuuagcggaggugguugggaucagagauacucaugauuugauuuuuuuuuuuuuuuuuuuuuuuuuuuuuuuuuugcagccuacaguaauguacucagguaaucuucucaggucauaguaauuugacuucuaacucccccaaaugacaguccccagagucacauaguuuuaauggcaucccucuacccaagacugugagccuacuuuaagcugcaaauaacugagucuguugucaaagaucacaucccagaucugauguauuggcauuuauaucccauccugcugaaacugccuucuccccgugguccuucucuucucuaaggucagaagcaucuuuccuguccuaaugugcuucucuuuuacucuccagaugcaguuaacgccccacucaccugcugcuacucauucaccagcaagaugaucccaaugaguaggcuggagagcuacaagaggaucaccagcagcaggugucccaaagaagcuguagugugaguuacauaccccggcccucccugguccaaagguuuuuccuuaagaacaagggaugguccucauauacuuauagucagucacacacucagauccaauggggaaaccaaggccaagaaggcaaaggcaguucucaacagcauugucucuauggcugcuguucaggcccuuucuacuccacaagcuuaucuuagaaaaccugcaggagaagcaggucacuuugaguccccuuuuucuaccugcccucccccgcugagcucuacacagccccuccauguauaccagacugaacuucaucuaacagugucuuuucucuucccacaguuuugucaccaagcucaagagagaggucugugcugaccccaagaaggaauggguccagacauacauuaaaaaccuggaucggaaccaaaugagaucagaaccuacaacuuuauuuaaaacugcaucugcccuaaggucuucagcaccuuugaaugugaaguugacccguaaaucugaagcuaaugcauccacuaccuuuuccacaaccaccucaagcacuucuguaggagugaccagugugacagugaacuagugugacucggacugugaugccuuaauuaauauuaaacuuauuuaacuuauugauguuaugguauucccuuucaugaauacuaaaauuucuuaaaugcaagguguggauccauuuuucccucucugugaauccagauucaacacuuucaauguaugagagaugaauuuuguaaagaugaauggguaaacuuuguguuugagauuccaagguauuguuuaaaauauuauuauggauauuccuuauuauuaaaagaaauauauuauuuuuguacaccagu

SEQ ID NO: 6225 - RNA, 1886 nt, Mus musculus
acugguguacaaaaauaauauauuucuuuuaauaauaaggaauauccauaauaauauuuuaaacaauaccuuggaaucucaaacacaaaguuuacccauucaucuuuacaaaauucaucucucauacauugaaaguguugaaucuggauucacagagagggaaaaauggauccacaccuugcauuuaagaaauuuuaguauucaugaaagggaauaccauaacaucaauaaguuaaauaaguuuaauauuaauuaaggcaucacaguccgagucacacuaguucacugucacacuggucacuccuacagaagugcuugaggugguuguggaaaagguaguggaugcauuagcuucagauuuacgggucaacuucacauucaaaggugcugaagaccuuagggcagaugcaguuuuaaauaaaguuguagguucugaucucauuugguuccgauccagguuuuuaauguaugucuggacccauuccuucuuggggucagcacagaccucucucuugagcuuggugacaaaacugugggaagagaaaagacacuguuagaugaaguucagucugguauacauggaggggcuguguagagcucagcgggggagggcagguagaaaaaggggacucaaagugaccugcuucuccugcagguuuucuaagauaagcuuguggaguagaaagggccugaacagcagccauagagacaaugcuguugagaacugccuuugccuucuuggccuugguuuccccauuggaucugagugugugacugacuauaaguauaugaggaccaucccuuguucuuaaggaaaaaccuuuggaccagggagggccgggguauguaacucacacuacagcuucuuugggacaccugcugcuggugauccucuuguagcucuccagccuacucauugggaucaucuugcuggugaaugaguagcagcaggugaguggggcguuaacugcaucuggagaguaaaagagaagcacauuaggacaggaaagaugcuucugaccuuagagaagagaaggaccacggggagaaggcaguuucagcaggaugggauauaaaugccaauacaucagaucugggaugugaucuuugacaacagacucaguuauuugcagcuuaaaguaggcucacagucuuggguagagggaugccauuaaaacuaugugacucuggggacugucauuugggggaguuagaagucaaauuacuaugaccugagaagauuaccugaguacauuacuguaggcugcaaaaaaaaaaaaaaaaaaaaaaaaaaaaaaaaaaucaaaucaugaguaucucugaucccaaccaccuccgcuaagcugcuaucucuggaagcagggcugggugaaacacagcucggaucuuggaucucuuccccuuucuccucuaucuggaaaaaggcaccaacccaagccucuguuugaucacccagguucccaaauacugagggaaguaacuggaacaggaacuauaugaaggugugauuccaaauuuagaucuaacaauuaaaauucuaguugcuuuccagaagcaaucuuguaauuggguuggcucuuuguccuuccuucuuuaugcuccuuaucuugguuaaagaaaaaaaaaaaaguaccugaccaugugagacuaugcuaucacaauccacgacaauucaaaaauggggugauaugcugggaagggagcugggggggucucaccuggcugagccaacacguggaugcuccagccggcaacugugaacagcaggcccagaagcaugacagggaccugcauggugguggaggaagagagagcuggcuucagugagaguuggcuggugcuggugcugggcuggccuuccucccgucuggcucucugcacuucug

SEQ ID NO: 6226 - RNA, 1821 nt, Mus musculus
agcagagaagcaaggccagcacagagucugccagcucucacugaagccagcucucucacucucuuucuccaccaugaggaucucugccacgcuucugugccugcugcucauagccgcugcuuucagcauccaagugugggcccaaccaggugagacucacccugccuccuguuucccagagcaugcugucccuucucugggacauuucauagaaaauuacagaacaagguuuacccauagucucacauuugcuggcuuugccaaaguaggacaauuaaaagaaggacaagaagauacuuauaguccaaugauaauucuagaacuugaaccugauucccuuaggacucauuuguggaaacaagauaguucuugccuucuguggugaugggguccuaggucaucaaauaggagccugggaugguucucagguaaaagagggagggagaagaggcccaaugucuggugggugcuuuauccagcccaauuuccagagacagugguuauguagaggcugugucacaacuaaacacuauuucuuuuauccuaaaaggagacucauaaccagugucuccuuauucuaaagaacuguggcauuauaauaaugcuuucuagugacacccauuauugucaucagcucuuuuugacucuauugacuggcauauaacccaacccauucaagugagaaagaauuggggaacauaauaaaaaggagaggagagacauuaaacuagggugggcaauucuuuaagcaucaacaaaagacccacaaccuaccacaaagaaccuuuucuuguucuuucauuguagaugggcccaaugcauccacaugcugcuaugucaagaaacaaaagauccccaagaggaaucucaagagcuacagaaggaucaccaguagucggugucccugggaagcuguuauguaaguacacaacccuugccuucacccccucagugcugucaccccugaagcaguacauaggauuauaugcucaauggguagagacuguaucucuaacacaaacucacauaacuuucaaugggaaaacugaagcccaccacucucuuccgagccaccaguucagaacuucccucucccucuaaaagccaaggggucuuuuccuugaccaaugagaacugcaccuucccaucaggccuguccuuuaucuuaccuucuuccucauccauuccugggucaugucaucaacuugggguaaugccagguagggauucacagaauaaguuacauacucucuaacugagcccucuuucuucagcuucaagacaaagaagggcauggaagucugcgcugaagcccaucagaagugggucgaggaggcuauagcauacuuagacaugaaaaccccaacuccaaagccuugaagaaaugugccugaacagaaaccaaccuaggagccaagaagcaaaauuccucaccgcuguucuuucugagaacuguugaugaaauguguugaucacgguccuaagggauaggagcugucuguaggaaugugaaauggucacgccuaaggaauggucuuuaaguuauuaauauuuuuauuuaauuagccauguacuuuggugugauuugaauguaaagcucuggagaccucaugucacuuuaacguuguguuagcugcagaauucucccccuuuccccauuuuuacuuuguucuuguauuaugaagggacuuugcaagaaucagugcaaagauuuuauuuaaaaacuuuuaggauaaaaucauaauguuaugauacugugugguuuuuaaauguaugacuacugaaguuucauauaaaauguauuuuugcacaaaauucaau

SEQ ID NO: 6227 - RNA, 1490 nt, Mus musculus
cuuuuaagggguucaacacucuuuuauuaaccauucauuucauuagcucucgaauuucauucauuuagaaguagaugcaggcaacauggcagcgucagaugccuuucaucccagcacaugggaggcacagguagguggauuucugaguuugaggccagccuggucuacaaaguuugaguuccgggacagccagggcuacacagagaaacccggucuaagaagagaaagccuuugcagauacccacugcuccucaccacaggcuuucugucuguggagugcugagcuggagccauaacaaugggaguuaagcacgcagccccaucguuucugaugcccuaguucaaagacaguaaaaccaaacaggugagugacaguaaauauucuuuaaccgaacacauaaaaaauuggccagcaaauaacuggaauauaugcacuauuacuauuaaugagguauuuuacucucuuuggggaaguguuggguacuugucaguguacaguguucauuuacagcaucucucacuucagacugcuuacauuuccagggcucagcaaccgaauauauugcuugugaugaaaggguuggucagcacagggaaaguccauuggguuaagaucaacuccagucaaaauguucacgcuuccucaacuggagcccuugagccuaaggccuuccgaacuccaaacccagguuuauccugcugcaaguuaagagaaaacaaagagccuucaccucauuucaaacaccaggaucuagcuggccucaguacagcagacacucaaccuugaacuccagagagccucccucggcucauucuccaguucuguuaaagaccucgucuaucagcccuucauuucuaugaacaaauaacugagcaccucacacagauucaagcauacaccuuccucuccaucucaaggccacuuugauauggacaacagccuuuuagugagucggcuugucuuagucucuccccugaccagcuucaacuauagugaccccucacagcguucuuucccuauggaaaaaaagcuaaacucuuccucagaaauagaacuuaguuccacgaucugcacuuuauuuaccuaacaaagcccaacuguuugcccuucccagacugaacaaggccugaauacuuuuauuuuuugaaaaauuagccaucuugaacucacagagccuauuugagguuuagaagcacuaguucgcuaaaugacauaaacggggccacagucccuguucuucacauuuucuaauuaccuuuuuaauuaaaguagugccuuuuaauucagcaaaacuccugcggugcggaagacacagguggaacgacucgagcuucccaucccuaggaucacugcaaugauuuuucaacacuaccuucaauaucuaacaaucugagaaacucuaggaaguucagggacgcugcgccccaagccgccacuccaacccaacacucaguucaagauuuccggguaggaauagaacagcgaccca

SEQ ID NO: 6228 - RNA, 1490 nt, Mus musculus
ugggucgcuguucuauuccuacccggaaaucuugaacugaguguuggguuggaguggcggcuuggggcgcagcgucccugaacuuccuagaguuucucagauuguuagauauugaagguaguguugaaaaaucauugcagugauccuagggaugggaagcucgagucguuccaccugugucuuccgcaccgcaggaguuuugcugaauuaaaaggcacuacuuuaauuaaaaagguaauuagaaaaugugaagaacagggacuguggccccguuuaugucauuuagcgaacuagugcuucuaaaccucaaauaggcucugugaguucaagauggcuaauuuuucaaaaaauaaaaguauucaggccuuguucagucugggaagggcaaacaguugggcuuuguuagguaaauaaagugcagaucguggaacuaaguucuauuucugaggaagaguuuagcuuuuuuuccauagggaaagaacgcugugaggggucacuauaguugaagcuggucaggggagagacuaagacaagccgacucacuaaaaggcuguuguccauaucaaaguggccuugagauggagaggaagguguaugcuugaaucugugugaggugcucaguuauuuguucauagaaaugaagggcugauagacgaggucuuuaacagaacuggagaaugagccgagggaggcucucuggaguucaagguugagugucugcuguacugaggccagcuagauccugguguuugaaaugaggugaaggcucuuuguuuucucuuaacuugcagcaggauaaaccuggguuuggaguucggaaggccuuaggcucaagggcuccaguugaggaagcgugaacauuuugacuggaguugaucuuaacccaauggacuuucccugugcugaccaacccuuucaucacaagcaauauauucgguugcugagcccuggaaauguaagcagucugaagugagagaugcuguaaaugaacacuguacacugacaaguacccaacacuuccccaaagagaguaaaauaccucauuaauaguaauagugcauauauuccaguuauuugcuggccaauuuuuuauguguucgguuaaagaauauuuacugucacucaccuguuugguuuuacugucuuugaacuagggcaucagaaacgauggggcugcgugcuuaacucccauuguuauggcuccagcucagcacuccacagacagaaagccuguggugaggagcaguggguaucugcaaaggcuuucucuucuuagaccggguuucucuguguagcccuggcugucccggaacucaaacuuuguagaccaggcuggccucaaacucagaaauccaccuaccugugccucccaugugcugggaugaaaggcaucugacgcugccauguugccugcaucuacuucuaaaugaaugaaauucgagagcuaaugaaaugaaugguuaauaaaagaguguugaaccccuuaaaag

SEQ ID NO: 6229 - RNA, 26308 nt, Mus musculus
ugcauucaagugacuuuacuuuuuagacuaguccagaacagaaaaaaggacuuagaagcaacagagaaguggagaguuccuuuggaaaguuaccaaguccuguugggagcagcagcaguaugagaacaauuuuguuuuauggcugcuuaguuugacacacaggagauaggugggcuuuugacuacugagcugaagaaggauaguagcugugucuaucacuagaauaagccuaaaguuaguauuuauugagaagucugggcaguuaauaguaucuugauagucucugcucuuggagcccuuauccagacggccagcaugccuaugccucucugauuugaauguggacaaccucagcagcccuauauccuugggcaacccacuuagcucuggccuacguugucucaucuguaaaacccacuuuaguaccucuggguuaacacagaaagcucuuaggacccugccugacacaugguaggcaguuagucaaugugagcaguuaucauucccugggcagaauguucauuaucagauguuuaaagaauaccuaccaugugacucauguuuggggaauucaaagacaaguaucugaccucaaagcauaaagcaaaugcuaagcuuaugauuacugucugaauaaguugaauuagcagcucuuagucuacugugggagauaagugaauuaucaugcaguacgauaagcagucaggggugugaauaaaauucaauggcugcagcacagaaaagggagccgugugucugcccguguccuucucuuaggaagucuuuucagaagcuuggagguagguagauugcuggauagcacaugggcucccccgugacucucagcuuuauuaaaucaggucuauguuuacagauaagccuuaggauucuuaaugaaccauuuuaacagcucuguuuauauccagacuuuucugagccaguuuuuaucuuuucugcauauucuuccucaagggaugugguaccuaagcauuguucacugacugaauuacagccuccuuguccugggauaguuuugaucugagaguaccagacucaaaccuuuguuauguuagcaggcgugggugcuuaacaagcagguggggugguuugguugcugagguuuuguuuuggauggugcuguauuugaggggaaguguggauuuggggguuuccuuagugcaggcccuuauauacagagacaucauccuuuucuuuuguuuguccagggggagcagugccuucuggccuggaggagaaccuguguaagauuugcauggacucacccauugacuguguucugcuggaguguggccacauggugaccuguaccaaguguggcaaacgcaugaacgaauguccuaucugccggcaguaugugaucagagcagugcacgucuuccgguccugauggcuagcauugguuucuucagugccuuacaggacauagcccacgaugucugggcucaggguugguccaauacacaagggcagucuacugugagcaacuggcaguguucuuaagacuaggacaagcagaguugccuggcaugcuuguuuuagguggcagagcccaaaaccagugggaacugguucacaucacaugggugaaugccugcaucugugaucauuggauggugauggucaucaaugaagaggucuuuccagaacguggaccagucucuccuguccuaagauccauuucauacaucuguacaccacuccuccugucaaucauaaguucugcuagaaauggucuuucucccaccccacccccagcacauuuggauuuaaauuucuggucucucuggcuuucuguguguuaauguaucuuuuaagucuucucauuugccuaaaacccauuucuuucuauggaccaaaaaaauauguuaauugggccaauaguauuccucaggucagaguuuggaucaguaaacugaccucuagugagaaauuaagucuuaagugauauagaaaaaaauucuagguugagucacuucuguuuaguauugggguuggaaagaaccagucucugaccuaacugcugggaaguccuucagagauggugcuguuucucuuuggguuugacuuuguaucauccuuaacuuuggauuaugaggaaagagaaaucaaggcagcggcuuugucuuugucuucugguccucauuuuccagcaugcuaaaauacuuuaaaauuuuuucucuuccuuuggucuuaaauuugcuuacugaaagcauaggaacuucagcaaggagcuguucucuagcuuggcuguacauggaguucuuggaaagcagacacacaggacagugcaugaggcacuggauguguuagacuaugacuacggcugcugaaaagucuuaacugcacucuguucucagcugcucgggcaggucaagacaagcauucuuuaagucaugauugcagcccucccaggggcuuuacaccacugacacagcugagaacagcucaacaaagcacaaaauauacuaucagaagagcuguguguuucucugugggguguacgcucaacuuggcuaacacuacccuucacuguguagcuaugugagacuggaauaaccaaccacucacucaugacugacuuggaaaaguggagggacgccucuuaggggacuauuagaaaugcuuaggcuucuccacugaauuccuucagaggaucaaguaguuccaugaagcuguugucagagaugccaggcccacuuaccucugcauucgaaguccagaugaccagauuuugggucaaagcuuuuguggaugucagggauucagaucccuccacaaagacucccuugcccucccucccugaacagugaaugcugucguuuacaauguuuccagauuagcaugcccacugauuuugcugcuccuggacuccacugugaaacaggucugaucuuacagcucaguaagaccuaagaauaacauuaaagccggcuggcucucccucauaacugcuuucucuucugaggccuuaucucccuaccuccuguacaggaacagaaaauacacugauggcugugguuagcaacccaaguaacaaccagaacccaugccauuuaauuuggcgaucuuaccuuuaaaucuuuacccuugguguucucauuugggggggaaaaaaaccaaaacaugucaaacaacuuuauuguuaaaccaaaugaaaguuggaacccauuccaguuaacaucucagguagaaaaccuuaauuuuuuuuuuuuuuuuuuuugguuaaauaccugagcccccuuuuuguucuucacggauccuuggucuuaauguugaaacaccuaaucuuuccaauuauucuguggauuuugcugauugcaccaagauuucaguugagacuuaguuuucaaagaugcuguuucauagguuggaaauagccgguucuaaacuaauaagcuguaaaggaauuaauagucuauguuguacaaauuuguugagaucucucggauguaaauguguagcuccaaguggcuuacauuaagauuuucucaccuggguguuaaaagcauacccaaauguguauuuuuuuguuacagagcucugcuuuauaauuuuguaauaaaguuuaaauacagaugccugucccaucuggugugugggggauaaugccagagaacuuguaaaugcaggcagacaucaggccacaugcagaacauugcucuucagagacugcaucccgcuucuggaggugcuuggccaccuggucuugaucaagguacccuugcucuguggugugacucacccaagaucacaagaaugcauuggagaaacugugggacaguuggaaguggagcuaaguguaagauucucaagagcagacgggaagcaccaugugaaguuaguuacggucccacuguagaggggccuucaagagcuaaguggaaaggaacaaguuacccugaaagacugacaguagguagcuuuugaauacagacaagugugucucaaagguuggcccagccuaaagagcagacuacagaguaagcacuggccuguacccaccuaccugaagaggugccugaggggaggggaguguaucaccccugggagaacuggaugaaaggauucuacccugucucuugcugauggcuggaccuauugagcacccagcaaugaacaaugccugucaucaacuggcacuauuguaaacaaaggccacagagggcacguuuccagccgugugggagguuucaggugaugguccuuaggguuguguggaaagacgggaaaagauacaaaggucuucauacaguuuaaccucuuugcaaagaucugacagugaguuggaguaaauauauaguaaggcauuaaagggacaaagggcugaacuuuuggcccugugugaugaggaagaauagucugaugcuggaccaagcugcuugguccaaguguucaaagcgcaaagcagcuucugcuugagacuagaguuaaaugcuuuacuuaccagacugaauguugccuacucugcccucaucagagcaucuacauccaugucuuaaagagcaggugaaagauagagccagacaaguaagcaaccgccugaugggaucuuacuuuaggaguuacaugggguggugggucuguaucuuagaggcucacaaguuccauccuaguaaccuagcucacaggagguggauauguaagccugcugaguugguaagaacagagagaggauucucaagagguggcacagcauaaacaaggaaaccagucucccacaguuccuggcgagggccaggcuuagaccugaaugcgaacuuuuaacaugaguugguaagcuaggccuccuccuggacaaccucugaaccagggugugcgcugcacaccuuaaacaaggugucugagguuaguggcagcugcccagugauucagcaacagugacucuacccacuccucuugaacugaugcucaggugauaugugaugucacugguaacuugagaccauuugaaguugucuugaaacguuuaugguuuucuccagucaugccagccacauuucaaggucuugauaaucagaugagccuauuuuaggacacuuccacuguugcaaaauacccuugugugcacuuguacacagcaaucauccuucuuuacccuucaagugcaucugccacacaugauacaggagccagccuugguaagcaggguguguacauuuucccagcuauggaccugugcuccuaagaguagucagauuuugaggaggcaaauucaccuucaaggagccucugucuccaaggaagccauccuguagaugucagccucucccuccaggcagugaccuggaaacucuaaucauuggaugccacuuuguucuuucacgugaggguuuagaccaggcauaauaaaggucuugccacauacaagaagcauucgagaagaguuuaaauacagcuuuuaagaugcacauggaagcgaggagcacaggaaguaggcucugcccagccuucauuccuuagucucggaggaaaacugcagguggaaccagugggggaaggauacuuauucuuguuuaaauucuuaucccagguuagccuugaacuucugauccccaugacuucuucaugccuagcuuaagauuucuuauuuauaaaacuguaggacaguggcagagugcugugcauagcaugaauaagggucuaaguucguuaucaguaccacagacaacuaauaaaaaagacaaagcuagcacccggaucucaaaguuccaguuaaacugcuuguguccacagcaguuaacuccugauccagaagagaccaugaagaaucagaggauauaagaaaguaggcugcuuggcaaagaggccccuacccuucaggcugagccucaugugguagagugggcaggagaggacagcccaaagaggaagaccaaaguccuagcagggagcuaucagccuccguuuccggauacaugcccaaauccacucugaggagaccaacugggcaucaguguucuuuucccuguuaccuagcacauguguggcugagcccaugucaaauuccuguaccagguccccgucgaaugccacaaaguagcguuugagacguuugaagucugguguagaagguggcaaguagagccgcaccccagugaagacauccaacaguaccugcaaacagagugguguauccggaguaagccccagccuggguacaagugggacuucacccucauuacaggacagcuagggaugccuggagaaaagacagaggcaucgcuaucccuuccuucagccauucaaacugacccuggucugacaaguucuuccugacucuaagaaaaaagggagaagagaugggcucuaacaucugagauccagcuaaacuguuuggaaaaaggauguuucuccaagagccacccaaugcaaaauacccuggaagaucaaguuuguucugcacagcuaccuagucagagggccugggagucuugcuuaucaguguagaugaguucacgggcuucaggaagggcagagagaugggagugguuucuacugagaacugggugcaggccccgggauaucaacuacguaugcuugggcaugggugcaaucuguucaucguggccagaagcuagccagggcaucauagacuagcuaguagguccugauuucaggaccuguugccagaccagggacuaacaaaagggaaaauaggcuccuuacugggagcugucuaugccauggcagucucccuuuccuugcuggauagaccugcuccgagagacagacacacaaacaugcugcaccccaccgccagagugggcuucguucuuuaaugugaacuguaacaacacuggcagcugggugggcuugcagccucuccugcuaggccggcucuaucuccugccugucugcauagcuuuccuuccucuuugccggcuggcccgccgccucugcaaggcaacaagagggcacaggguggagcagcaggacugaucaccugcccagacaggacgggaggggaggggcuccaggagucuucacccccacccccaaucaacacggucagcuuuucacauucacacacaggagccuggaucuccagucccugagccaaacuggccuguguccagcaccacuauucuuacccucaccuuuuucaggcauggggucucaucaguagcuuuccucuucauucccacuuugacuggagaagacuucacagccagcuucucuccugguuucaugggggaaugcuuuggaaucgguuugaugccugcaggaaagcagaagacagguauguauaaggcacuaggucugaucccuagcagugcaaacugggacaugcuuauaauccagcacuaacgagguggagacagacaguucagaagcucagagccauucucaacuacauagugaguuaaaggccagccugguguagaaaaacccugccuccaaaccacacaaccaagaacaagaaggaagaggguaaggaacagcccugagaguuggggagagcacagagaucaaguacuucuguuguaaugaugaacgaacagggagcaaggcuaucagcuggauccuuuaccucuaagcuggcccauuccccagucagacaggcugucccuggguccucugucauccagguuugcugaguagauaagggauuccggguagaccaguuucuggcccccuagcuagucacaugcuaggaauacacugccguaggggacacccagucccaggacaucagaguugaaauguaugccuauguccuaccaucgcuggccuccccacagcccuccccaucaccucaggccccuuuacuuaccaccucugcuacuggggcuauugagcuucuguucgguggucuuggcacuggcagaggacuuacugggggggcccuugcagggcccagcagacccagcagugcccucguucucgccacugcugccuccaguaguggggcuugccucaucuccagccaccacagcaaagucugccuugucuuuggacagcugguacaguuccugggaagggggaggggggagcugucacucacagaccuaccugacccguguuugggaugagugcuuccuggcacauauagcuaaggagcaaaguagggccuuggaaccugaguaauuugggugcaagcuacuuucuguggcaaguuuuaauucuuuuuuuuuuuuuuaauuauuuauuucauacacugaaauaaauacaguacacuguagcugucuuuagacccacagaagaggacaucagauucuguuaaagaugguugcugggaauugaacucaggaccccuggaagagcagucagugcucuuaaccucugagccaccuuuccagcccaaaaguuuuaauucuugauuggcuuuaaacuuaagaucuuccugucucaggcucucugguacuuagguuauaggcucagaugaaccagguuuuuauuguuguuguuguuuugagacagagucucacucuauagcucugucuauccuggaauccaacaaguagaucaggcuggcuuugaacucagagaaacuuuuaacucugccuccugagugcuagaauucuaaagguguacaagaguacauucuaccuaaaucuaguuuuuucuuguguaugccugucugugcaccauguaaauguguaaaugucugguggcacugauccccaggaacugaaauuauagacaguugugagcgagcugccaugaguucugggaaucacauggggguccucuguaagagcagucagagcucuaaccacucagcaaucuggccagccccuaacccucaguucuuaauuaguuaggaaaguaagacuguggccugaggcaacuccuaaauugcccguggaaagcuaggcucuucagggaaccggaggaaagggagccaggaagaagagguaccaguuucaaucuugcuuuguucccauggaauggagauaauaagucaaaugacaugugaagaggcuagaugcccagcacuccaagagcaagauaaugggugaugacacuuagaaagccaagaagcuagcaccuugaguugggggagguuaguggcagauuuccaguccuugucgucccggauucgggugcaucgaggaaaucggauggagaugccaucagcagugugugccucagaucuggagaauucugccccugugaucucccacacagcagcuuucugucagaaauaaaacagguggauuaucacuggccaggaaggaagaggucuccagcagacagaaacagcgucaagcauugaaaguacagaggcucucaacagcagccaggaggccugugugccaguuaugccuccucuugaauccugucugcuugcgcagggccuguuuugguuuaguucuagaauaggccucaaaagauggaaacaaauggaaaggaauuugcuuccccccgccccaaggacaagucuucagaguuggcuguuuagcccugugccugucauuuggcugaauauccaaccaaguccuauccuggguggaccuuagcaaaacuggacuaacuucugagguacugaagaacuauaaacuacuucagggguaggggucacaaagcauuaggugaugauaccuuugggucugggacgauaaagucaggauaauagaucuuguugaucuucagccagcuggguaucuuacuaggauccugaaggagaaaagacacuguuuugggcuccagucaugcuggagcaaggcuuaaacccugucuuugguaauaagacugugaaaugacuuagcuaaaaaggaugaccucucacuccaagugaucuucccucuucagagaggcuguggcccaucuucuauaagacaggcucucugagauuuaaaagccuaauccugcuucuauggccaagaagugagcuccuuucugaauuaagaauugggacuugcagaucucaguccucaaagcacagccuguuucaggaagaacaacuugcccaggcugaggggcuaccaggugccuuccucaccuugcugaucuucaccauaaccagcucuuucugcaggcgggcaaguguggcaucaucauggccuccagcacauuuuguaacagugcaccacuuuuggcugucagggucauagcagcccaugaggaagauggacaucauuccgccugggagggggacaugaauagagugugggcuagaaggaagcaccucugccaggcccacaguagacugcuuagagaagaacgagccaaggccuuaccaucaagaguguuaagaguaagcugggcagugguggcgcacaccuuuaaucccagcacuugggaggcagaggcaggcagauuucugaguucaaggccagccuggucuacagagugaguuccaggacagcuagggcuacagagaaacccugucucgaaaaaaccaagaggagggagagagagagagaaagagagagagagagagagagugugugugugugugugugagagagagagagagagagugugagaguaaucacacuugacuuacugggcuccagugaacuggacaggaccugacacaucgcagacacaaccugacaaacugccuaaguguucugcagaucucagcuuucucuccaaucaagaaacagauuuuuugggcuggagagauggcucagugguuaagagcauugacugcucuuccagagguccuaaguucaauucccagcaaccacacgguggcucacaaccaucuauaaugggaucugaugcccucuucugguauggcugaagacagcaacaguguacucauacauuaaaugaauaaauaaauuuaaaaaaagaaagaaacagauuuuuuucugagagggaagccguuaggccuugaaacagcugguaguugagcuuuuuugugccaggacugcgcagguuaugcuugaccaacuuacuuuuaauuauuauuauuuuccuuucuuauuaaaacacuuuuguuuuuuuuuucugagugugcacuuuugugcagccagucacgguccagucucauacaugcuacagggugcauguggguggggguccauuuucuccuuuuaccaaguggauacuagugaucaguuuaagucugaaggcuugggggcagggcuuuaaacccacugggcucucaccagcucuucuuacucaaccucuguguuuaggacugaagcucccugaugucuuugccugaugugaccagggccuuagaucccaggaccaaggaagccaugacuggcagaugaagcuaguaagaaggccagugugugugucuucugauagaguaccaacacagggaccaaaccacuaaccuuugcucccuugcccauagaaggccccaagaaccaccagaucagcuguaucagccauggcccccucauucaaauaaucuuucuuaacuuucagccagugccgcuucccaggcucauauguacccugaugaaacacaaaaaauagaucacagauaauggaaacuccauagaggugggguccaucuuuuuccacuaugggcugaucucagugucaaggcacuacaggacauacaaagccauuuucagaucuaggaccagccugccccaguugagugggaaagacuccuacauugcucucccucucucccgccgccaacacuucugucaccuccagcaggaaaagacggguauagcagcuagcuuaccuucacauccuuuagcaccaacccuuccaagcccucucggaucacccgguuuaucaugucagccaggucugaagcuuucugagggacaguaggagaaaugugcaggcucagguaagaacagacuguuuauuucuagacacuaguguguauaacuuggagcugcugugccuuugagaagcagacugcagacaauuaggcaacaucggcaauggcuaacgacaaacuuaccagcacuccaccagagaauaccuaagggucauccucuuacaccccaugggguucucugcucugguuucaaccaucagaucucugccuaggauaggccuccacuuacugugacuugcuucauuucugagaacaugauccgguuacggauuucaaccauguugucaugaagaaacuuccgucgcucacagagaggccuaggggaaguaguagaucugagguaaagaggggguaaggcuucugccucucucccacuccuagcaggaacucugacacaggucagugcccagugauagaacuguugcuucaggaaaaggacagcuauggauccaagcucccauacgaacagcuguguggucaagggcugcaagggcuccaucagcacuagagauaaacaacuauaagcuguagcccacagccaguucauagcugugcuuucuacucuacugagccaagagaacaccagccuccagcccagacuacagcuucugucucacuugaacaauguuacaaaucuugugcuaucccuaacccccaggcuggcacaggccucaggacccuuccccaucaagucuuucuccuuuccuaaccauggguguagcuacagaaccaggauuagggagaauccuaagugcauaaaguaucagcuguguagguccaagcuguuggauggaguucacucgacggccagucccccugcugcuucacccauggcacccccgauaagcucacagguaaaaugcaaaacuguucacccuauauuuuuccuaacugaagccucuacaaguccaccccagauaaauucccagugaaaauaagaaucuugguuuaaagaugguagccagggaauaaaauccaaaggucuauuacauguuuaguacauguuaggcccuggguuucauccccaguacugcaaaaaaauaaaaaaacaaaacaaaaacaaaaaacccaaacaugucaaaauaugcguuaacuuaccuguccaucaagcugacaucauuaaaguagauacaaucaaaaacaaacaggcagacauuagcauccuggaaagcagcuuucugcagagaaaaugaggcaggaggcacaggagggcaugagaucagaguagcagcaguccacuucagaagccccuuguggacaguccugucagugccuccauagauggugcucacuaaacuagaucccaaguguuucucaaaggcccaaaugcuaaagguuuguucucgaggguggugaugcaggggagggaccaagucaucagcuccuaaagggauugugggacugcccccuuccucuucgccaugcuucuuagcucaugauauaaauggcuuugcucugccacguuuagugaucuaaagcuaugggcuccuguaaccucuagauacaaaaccuuucuccuuuauagaauggugguuaucucugguauuguuacagugaugaaagaacacaugcucaacagaaaccaauucaagucuaaguuagcucuaguaucuccccuccaccccuuugucagacugaaagcacauuuuuuugcacacaggacucucaguguauaccuugugcacucccagagucccaaagggcagugguuugccuguguuguugucaaucaggaguaccucggaauccaagaucaugcuuugacccccaggaaaagcuuuggguauauaguccuugaagugggccaccuagaaguagaaaggcagcuuggcaaggaggccuuggcaguaagaccuaaaacuaagccagagugaucaaggcucaggcaaaacagcccagagaaccuugcaagcccaagcaaugagugaaaugaacaacuagguugugucagucuccugaagaguaucaggcuagcugcuuuauuaccucugucuagaccccagagucauuuacuaugggcuauacagaaggcuuagaggaaaaggaagaaacagugagucggucaggaaggaccugcagggagacaaauaugggaggggaagaaaagaggaaagacaggcagguggggacuaguguccuuucagaggauugguguuaucaggcugaggacugggaaggggaaacagauggguugcagggcagacaaauaagcccugggaagaacaaggaauaagaauaggcuuuccucuacaugggagcucugaagccccugcugucuucagaguauaagcacugggacaggguucuuccuagcagagccagagcccuaauuucugauacucagugggagaagucccacuacaauuccagguauuuccugacaauggguaccagcaguugggucgggagagccugacaaugccucugcugagagcagccaagucacugccuaggguguguguguaacaggaugaggaaagacccgacugaccauccuuacucccuuccauccccaacccagccuuuuaaggaccaacagacacggacugagacacaguaagcacugagucaauccacaguauucggaaaaguaaagaaagcauauucuggaaagcuguguucaaaugucccuggucacaggagggacugccucccaccauccuuaucacagccgucccuaggugaucagcuucuagcacaccuagaacaagaaccccacuuaaagguccaugcaacacuacugcucagcucucuugcucaacacagaaaacagguggcccagccaccaaguuucuacuggaugacacaauacacccccaauacauagacucuugagaaauugagucagaacuaggaaagaagugggcagcaaagccaggaguuccacuuacucaggagcuacuggagccagcuaucacagcugcuucucuuccacagaccucacaggccuggcccuagaugcugagaugggcugaggaaugaggcucuuaauucccaucaguucugaguagggcagggaucaggaucccagacagccccacaacacuguacacuuaacacacucuaagcucaugaaggucagaauuuguaucucugucuguacguuuuuauguccacuagcuaccacagugcacaggauuugagaaauacuuguugggcaaaccaaugaaugauaauccuuguacaagaacccuaaucuugcagggacagggacacacgcaagauuuucacugagcugucugcacugcauugucucaggcagcucuuuccuacugacuaacccaagucugggcucacuggcugucccagcuaagcagccuuucauuacuagaagagugcaggaauaauaaauucccuccauucacuuacagaaaaaccaaauuucuuccuguguggaacacagcuugaaaggcccuacaguucuggcccggcaguuuguagaggcagggaggagacguccugcugaaaggggaggacaggcuugcuuaccuugugaggcaggacaggcuugagacugcggcugaaguagcugaaguggucccccuucuuaugcaccuggacucgcucaccaucguacuugaucucagagaacaugccauugggacacuucuucauugcauauucaauggauuugcaggccucagccuugggauggagaaagcaaauguauuuacauuugccuucaacagcagguuuccucagcaggggcuggggcugggacugucaggacagaacuggguucuggaacuauugcaaagggcugggcaaugcuguauucugauaauaaaaucauuugcugacauccugagcuacaaagcaagauuaucucaaauauagaaaacaaaaagacucaucaccaaaguugguuuaacaguuuacauucugaagaagacaaaugcucuccauucuugaauaaaauucuugugaaauaggauugacuuuucucaguaauguaggcucuuaccaggcaccuggcuuauaaagcacacuugcuaucacagggugaugguggagcuaagaguggagagggccagugacaguggggcuggcagggugacuggagccagagacugauagaacacccagauccagaccuacucacucacauacuggcacccaccagacccaaacaguaacuaccauuuuggggguucuugacaggccacaaaacaauguuaucucaucuuugauauggucccuuagaggacaagugcugaaugagaaacuugaaggugagggagguuaugcgcuuacuuaaggucaggcagccaguaaacaacuagacucagauguguaucuaagcccucaucccaagccugugugcuaaagcacuaagcaugcaacccacaccauucuucagacaaggugugggaaaagacucuaggaagaacucccacagaugccauaaaagccccuacuccaggcgagggaagagguucugacccuggcauggagaucacacuauuuuagcaagcuagucuauauuucugguagcaagagaacucuuuccuauuccaaacauagaaaccuaauauaaggauuuaguaugauagcguuaaaaaaaaaggcucccugcauaccgcuggcaagcccaaggagacuuauagcaagcggcagaauaccagauggugacucugcuacaccuaaaaccagaagggauggucauccucacuaaagauccagaaaucguuauguacuggagugaggcucuacuccuacagcuucuuuucugucacaggaagccuggcucuguugccagcucugagcuacccugcaggaggucacagcccugucuucaggugugaggcuaaacuauuuaguuccaugugccacccccacagggacaguaaagugcaagaggcuggacucagguuguacuaaauccccuaccuucuucugaaccuucacuucuuggcccagcaccgcucugcucaccucuacucuucccuagccaccuaccagaguucuugccuuucaucccuaugagaugccagcaacuugaagagccauggauaagaggggcaaggcaguguuccucaccagcaugggcugcacaggcgucaucagugaggccuggacccucagagcccgucgccggccuggguccuucuccaccuccugcucauugugaaggacucgcuccaccacauccugcagguugcgcgaugcuuugaaggcuucauaagcauuggggucaagggcaucuaaccugucaaggagaacaggagcaaggaaacaaagcucuacaucugacauuauggcugaggguagcagucugucagacaggagagguguggggaaguagccugcuuccauccuuuaacuugaugaugugacuaaccuauagaagugggcacauggagccacaaauaguuaugaaaguaucccaacacaaaauuuauuuaaaacacuuuuuuugcuaucuugaaugaacaguucuugagcaucaauucucuagauuuugcuauaucaaucggcuggaagucaaagcuggcacaggaaaagacaaaagagagaauucaggauuuugagccucaugccuuacaugguacagaauuggcagagacugggucuggaauggcuucuugccauucauuucaguuguagcagcuuuguguuaaagguaguuaucuccacuuugcuugugagaaaauggaucuggaaguggguuaggauccagaagaaauaauaaugaggguucaaaucuguagcaggacuccccaaucuugagagcagccaggaacgagguauuggcaguucugggcugugagcggcuguggcacuuacacguguuuugcacccgaguucaucuucagaucauguuugaucagccgaauaaugcacuuaaggucauuggcuguacaccuaaagagauaaggcauacucagcuucaccucucaaggacuuugaucccccaaaccucccuuccaugcccguggggucugcuuuccauggggccaccucucaccgggaggcuauguccugcagggccugcugcugcucauccucuuuggugagcuuggagaggugcaggaggaaggcauccacuuccugaauggugaggaggcuuuuggcagcuggggggaaagacuugcucugcucaaagaagauucugaucgucucugacacgucacccugucuccaaaaaccaaaaugccacugcugcaaccccagggagcuugggacggaugccaagucaagagguccaguacaguagcugucccuaagucguucuucuuggggacucucucccagccaguucuuaggaggggcccaucuauccacccgccugcuuuaucugagcagaggcacagcacuaaucuaagaccgagccaaucugauccugauuaagagucuggaccaaaagacaugcuccauccuuaguagaugcuuggauuaaaaacuuucuauggcaccaaggcaggagucauggacaaccgaagaugaauagaaaguccaaagacagaaggggaaaacaagcuaguagauaaagcccagcuuaguccuaggagagacaaaggaagucgcaagcccugacuuuucagagaaggcuuuuauggcuuggcagugguauguuuucaguuauccaacuuaggaaaggaacagcuguauauucacacuuggcuucccagccuaauggaaucucguucacuaaguuucgguuuccuacaccagcaugugcuuaguuauuguuuaaaguggcuaugggaaggcuauugugguggagucccaccuagguuaugaccucccuacacccgugucugaccuguucuaggucccgggccauaucaucuggguugcaguuaaaaauucggcuaaaaaguuuuacaaucugcuuaucauucaaguuguaaacacucuugaugacaccaggcagcagcagcuuaacugucagguacacaucaccgugaaagccaucugaaaaacaaagcaaaggaagccccauuaagaaauggagaugucaggugugaugcugcacgccuuccaucccaggacucaggagacaagccugaaugcagaucucggugaauucaaggcuacccugcucuauauaguaaguacuaggacagccaagguuauagugaggcccuaucuaaaugauaauaauaauaauaauaauaacaacaacaauaauaauaacaauaauaauaaugaugaugagaaaggggaagaagaggaggaggaggaaaagaaggaggaggaggaagaagaaagcagacacugcuucccacagcucccugcauguguaacugucucaccuuuacuccauagucucccaaugggcgaagcccccaacuuucacguugugaugaaauaagagauaccaaaugacaaugugcuagauccaugaaagaaccagagccaggggauucuacucuacacugggcaugugguuugccuaaucauauaugcuagugggacauuucucuguucugucaaaugugaugggcuccucugccuucuggggacaaaauaugggcagaggaagaaaucugccaagcauccaagcagaacuggccacauaacaugcagggucuagugagaauuccagcuaugagaucccauuucaagaugaucaagaauuccgauauacagccgggcaugguggcgcacgccuuuaaucccagcacucgggaggcagaggcagguggaucucugaguuugaggccagccuggucuacagagugaguuccaggacagccaaggcuauacagagaaacuccgucucaaaaaaacaaaaaaacaaaaaaaaaaccaaaaagaauuccgauauacaagugucugcacaucaagcuggccauggcucugagcuuuucagaggaaaagcauauucaguauauguacaguccuaccuccuguggagccuuucugcaagaagucauggaugaucugggucuugguguuauagcuaggauuuucagccaccauggcgcacagcuuccggaacucucguagcagacaaucuuugugcuuagggucacauuuacuugcagacagacucguuccaggagcagggcuugagggggcuugcucagaguuguuggguuuugcugcuggugagagaaacaacacagaugauucauuuuucuuuucuggggaagcacaaaaaggaggaagacacuaaaguuuugcugggggcuuaugccauuuuaugcaagcccccaaagagucccuagagagagaugucccggauccguguaucagguauagacauggaggccaaggaaucaguacaaauaccacugcauaaagucuacacugagaagcacccguguaugugaguaccucacacaggaacaaaggcugcuuucaugccacaagccaucaagcggaucucagaacaauugucauucugacuccacauugcugggaugaagagagaagaaaccaaaggaccuguaaagcugaaaugacagucaccguggacugucaacgcuacagcaaaccugacagguuauagaguuuacuguccucuuacugaugaguccaaggcccgagagcagacaguuuucaagacaaucuaccuccuuggaagaagaggaaagacagggaugccagcaacaaagucagggcccaccagugugacccagcucaucuuuucuuuuugucaaaauaaaaagcaccuuuguuuaucugagagaaaucucagugauucucaccuuauuguaaccacuuucaagagcaaggcagaguuguuauaucacggagcugcugacuaaggcuucuuguuuggguuuguaaacuguaagucugucaucaucucugaccuagaaucugaucugggguggagaucuuuccagaacauugauauuagccagguucacgaagaacagcacccugaucuucucuagaaauccaucuuuaguaucaacuggauucuucggcaucccuaucauugguccacuaccaagcacaacuggaguuuucaaauaauaacaucugcaagagauggcagcacaugccuggacuucuaacacccaggaagcagagacacgaggaucuuaauuucagaacagucuggacaagaagaccucucauauuuuuggguucggcguagccuuuaaugggugagccaucccuccaacucaagacugucucauaaacaaaacaaaccaugcaugcauguguguaugauaaaacuccuacagaaccaggcgcuauuucuauaauguuaucucccauaguccucugacaggacugaugucuuaauucaccgacaaagccguagacacucaaauaagugaagacuugcucaaagcaccaagcugucaagcauggagcaaaccucaauucuccugacuccacaucuaggcuucuuuaaaucuccagccuguucaaguccaaagguuucaucuuguuauuauuuucuucaauugaaccagccauaagaauuguuuaucucaaaccauaaaggguaaauaacacacgacugggacaaacagacaucaaaguaacacuagcuccccugucagccuaaacuucaguccuuucacagaacgagccugcgaguaacagaaaagcaccuccucagguuaagugaagaacaaagccccuaggccaaugcuuccucuuaccuacauccaauaaacaacccuuucaaggccuauaugcaccacaccuucuagcauggacugaucccauguccacaagcaguuauuguuaugcaacagaaacaacuuacuuauauaugugcaugauaacaaauuacuguuuaucuuaccaagccuuaagcaagagauaggagauggaaucugaauucagagcccauuacaaaacucuauacccuccauucagaguucccucugguucuaagcucauacagcuccacuuuaggaacucaugggcacagaaaaucaagagaaaucaaaggaaaacguuuuaugcauggccucucuccucaguuccggcaaguuugagcaaacaauuucccagaauucugucauuuaaaaauauaagaggagcagguuagaaaaaaaucuuuuugacccagguaauaacuuuaaguggaagaacucuugauaaaccaacauguuccugauauaucagagauuaaaguacacaaagaaauauuguccaaguggagcacagaguuaaaccauggccagacugcccagagagaagccagguauggacacuugguaaagcaguguuuucacugagccagagacuuaagacaccaaacagggggccuuaacaggggaagucgcuguaacacgucuuaccugaaaagccagagaacuuccgaggauugguacugguaauaaacgaagcaccuuucacuggagaugucaccuggccagugguugucagcuuagccuggacagcagcuuucuucuuagguguggcagcugccuuagaagacaggucuacaggacccacaaagaacaaaagcacccuucaaagacugccaagaaagcuucugagauuuuaucaacaguuuucaaauccuuauuugguaaguuucuauuguauuaugaccccaggcugcccagucuuuuugaguagaaggagaaguuaaaaggucagagaagaggaaauugccuaccuuuuauccaguauauaagaauuaguauagaucuggggagaaacuaauaauggcuuuuuauuaagauuuuuauuuuaugugcauaguuguuuugccugcauauaugucggguauaugugugugccugguacccaggcaggccagaaaaggguguuggaucccuugggaugagaguugcagaugguuguaagcugccauggagguacuggaaauugaacccagguccucuagaaaagccaccuuugcucuuaacugcugagccaucccuccagccccagugaucacauuuugauagauaaaacuuggagcuagcucuguagaguagccucaaaauauagaaacaacaaaguaaaauagagaaagcagagcaugucugucuggcacagguagggaaaucugggugcucacuacacuuccuuccuagugaaaugcaagucaggaugaaggccaagaauaacugaggcaugucuuuagagccacagccuuuagcucuauuacuuuagagucugagaguccuaaaagguuggugguugcguguauucuuuaaacauaucacuaucuaaaagaaagaccaugaguaccaggcuuuguaacacaagccuguaaucuuaguccugagaagacaagacaggaagagugcuccaaguuugaggccaacccaagcuauauggcauagcaaggacacaucucaaaaaaaccaaaaccaaacauaaaacaacaaaacaaaacaaacccccaggaaacacugcagaguuaaggaggccaaagagauaugacaaugaaauguaaugcccaguccgauccuacaccugagcccugcaauggaggaaaauguacugcucaauuauagucuucagucaacugacaguagacagauaaguuuacugaggcugacagguaaacuaugaucucggaagaagagauccuauuuuuuaagauacacacuagguaccuccagggccuggugauacaacuuucucugaauggcucaauaaaaaccaagccugguauggaagagggaaugagcacauaaacagagaugauaaagcaaacugacuuguuaucaagaaggaaaucuguguagagagccugacuguuccuauucuuuuaacuauucugugaauuugaaauuauguccaagaaggaugcacagagaaagaaaucucugagaccucagucuccuggcacccgguccucucagcaccagcaagcugagagagcaggcucuccccucaccugcaauaugcuggcuuaucuguuccuuuucguuaucuuccagcucuucccagccuuccagcucugugaggucuucaauuuucuuugugguggcccgagcccguuccaguuucucaaacaugcacuuaaugugguaccacucuuucauaucacccccagacucugagaagggguugggcaccacuuugccaaugcggcacacgcccuuuacaaucuucuccuugcauuucuugcauccagcugugccccgcuuggcauaguccacacagaaccgcugcucugccaucgcacaggggccaguacagagucccacaugcgacccuggccagaaaguaagguggguggcacguggucuuagaugaccucucuggagagcuaggacaggcuuucuucucuggagaaggcagcacccaccgaggagauuuguuuccgaccacuggcugaacugacuuauggcagcccagcgauucuguucugggaacaggcacaguucuuuucugccaagggcacaaagguuucucgggaagaggaucuugaaagccaaagucauauagcugcauaaaaggguagaaacagacagacagacaugaagaauccaggcuuccaauuucucaauggcuagaaucucauacagagcacgugguuaaccaaacacuucccaaugcauuaaauauuuaccacccagaguucugauacaggaaaaaccaguuuccaaaggggugugcaacaccaacacuguagagacugauuguaaagguacucauaguggauggugaccuuuaaauaguaccaagauacugaagcuuugucuuaaaaaucaagaaaaauuacauuauguuuaugaaguuucccugugaaauauaacacaugagacacuuucagaaaacaaugaagccacuauaacaguuuuaggauuucagaagagggccccuuugagaaaaaaacuaaucagagucuauaaucagauggacugcccaaguucagagccuuacuuagccauuuagcugcugugugagcucuguucaguuacuuucccucucugcuccuauuucaucuguaaaaugcagcucacaguaguaccucauucaaagaguagcuguuucuaaguuguuccuuagaaacagaauacgcaauucccuugcuuaauucggcgaccugaaucaggggagguugaaauaacuggacuguaagaaucuaagcaagugaugaaccaauucaaguggaaaaugauuauuccuaucccuucuuauaucuguaauuauuuaaguggcuuuacaguuuuaauuuucaauuuacuggaaacuauuuuuaguccccacucugcugagaacuuuaauugauauugugucagagcagcaagaaggcugagguagagcggagcacagcagguguacuacuaaagaaaggguuggagaccaagccuacccaucuacagcgggguggggaggugggggcagauaucaggcgacuugguuuucuccaacaagguggacccuagccagacaccuuaguuggccgauccgauccucccaccuccagcccuagaauuauagguaugaaccaccaagcaugacuucaguuuauuuucuauuauuuauuuuucgguuuuuuuguuuguuuguuuuuagauagauuuuucuauguagcucuggcuguccuggaagucacuaggaagagcaagcuaguguucugagugcagggauuaaaggcgugugcuaccacacccggccccaguuuuaucuuaaaaaacaacaaaaaaacaacaacaauuacaacaggacuaagagcuaguuauggugguucucgucuguaaucauaucagaaggcaaagacagaaggauugcugugcguucgaagcuagaaagucugguuuacuuaguaaauuucugucuagccaggguacgucgucaagaccgucucaaaaggaaaacaagcaagaaaacaaaccccccaaagauuagaacuacuucauggggugguuaggaaaacuacaaggaguacgagggcaagccggacguggaguucugaaguuuguauaccaaacuuguguauuugacaauguucgacuugggggaggggagguccguaacuggcagacucagggggucacacaagcccuaaccguuaagaaucugagaggcgagugaaggccggcaagggcugaggaggagcucagggcgaguaggaguucaacuuuccgcagaguaggguggguagggugucguaucgcccaucccgggauacgacaaauaacuacccggggagaccggcgcgaggaggccgggagcccgaagagcaagcagcacgccguucugcccacaggcugugcgggcgagccgcggccgcgcaacaaggcggcggagagggaccggcggcggcccggccccgacccccugagaaugcccacucuggcauccugcccuucccgguggcugcccagggucccgggggccgcgggccucccgugggcucccgugggggcgccacgucacggagggugugcccccaggcugagcggcgggcgggggaggagccacggccacuccagccacgccgcguucggccccggcccuccccacacggcgcaccgcggcccgccgcuccgcgccgcgccgccccucaccugccuucucggcugcccuggcucugacgcuccgcacgagccaccggaccaggcgcccacaaggccacgggucccgcacgaugaauagaccgccugucucuuuaaauacggguacuccagccggaggcagggcgcaggcgcaguaaccgacuugcgcccucggaccccg

SEQ ID NO: 6230 - RNA, 7645 nt, Mus musculus
cauggauuuaacgcuccgucuuuccgccucgguucuccuccacguggggacgcaggauggcggcggcgguggugguagguguacgcgcacggggcggggaugccgggucuccgcgugggguaccgaggcccgaggggaggggagggggacugacagucucgcggcuugauucugcaggaagaggcggcggcaggcgacgugcagcggcugcucguacaguuccaggaugagggcggucagcugcugggcuccccguucgacgugccaguggacaucacgccggacaagcugcagcuggugugcaacgcgcugcuggcccaggugagcaccccaaaacgaagccacgguguuccggggacccagcugcucaccgacagugucgguggcguggaucggccccaggaaaaauguucuccgcgccgacucaccuacagacaggcuguguuuugaacgcgucggaugcaguguuuccgugacuucuugucacagcccaacauaagcauccccauuuuacagagaugcccagcgggauuaaauuugucgcauggugguaugcaguaguugggauugagccgacucccgcugagggcaggcauucaucccuccgagcagaguuccucuuuacucuguucuugccuucaggaggagccccugccccuggcguucuacguccacgaugcugagauuguguccucccuggggaagacgcuggagucccagucuguggagacagagaaaaucgucgauaucaucuaccagccccaagcugucuucaggguccgggcugugacgcggugcaccagcucauuggagggucacagcgaagcugucauuucuguggccuucagccccacaggaaaguaaggacaugggcagaaucuuugggauguggagguguguccucugacagguggagaggaccauccugaguuauuauucacagggucuuaggcugccugccugucauagacuuggggucuggacucacguugcaaguaacagacuuucuuauugggguuugguccccaaaggcuaagaauaguaccuggcucagaagagccuaucuugguuugaacuacuccuuuccgaagucagguuucugcaucuguuacuucccuaugaauccuuucuuguaggacucuaagaauaagaacaguugagccagguggugguaguccacaccuuuaaucucagcacucaggaagcagaggcaggcggaucucugugaguucaaggccagacugaucuaaauaguuccagaacagcaagggcuacauagagagacucuaccuccaacaacagaagaauaugaaaagcuucaaaagcuuuuucuagaaauuuccaaggagguagagacuaggcgggcaggucuuugugaauucuaagccagccuuuucuacagaacaaguucuaggucagccagggcuaaccagagaaacccugucuuuuaaaaaaaaaaaaaaaagaaaggugcggggugggcuggagagauggcucagggguuaagagcacugguugcucuccuagagggccugaguucaauucccagcaccccguaagagcucacaacugucuguaacucaaaucucaggggauccaaugugcacauuguguacagauacauguguaggcaggaugccuguucauguagaauaaagauuuaaaagcauuaaaaacacauacaaaguggauggaugaauggagugagugagcuguuccuguugggaaggaagaagagagaaguggccuccuagggucuuuuccuagauggcauuaguguccuauuucuccucagggaauggagagucuguucccagaagaugguuggcuaggcagcaggaauacccaugcgcagugucucagggugggccccaccacugcagcagucaagcggccucucuuccccagguaccuggccagugguuccggagacaccacugugcgcuucugggaucucagcacugagacaccgcacuucacaugcaaaggucggugugccuuuaaccacuuacgggggcuuagugcgugccaagugguuagcucaguagcuccugguagggccucagaagacuccaacccauuagcacccuguucacagcugccugcuccuugaggccagucagccacuuagaacgaagcagauacuggacugagugugggguauagggaggagcuaaacuacugguuguagggacagcuugaaaaggcucugccagcuggguggugguggcgcacgccuuuaauccuaacacuuggaaggcagaggcuggcggauuucugaguucaaggucagccuggucuacaaagugaguuccaggacagccagagcuacacagagaaacccugucucaaaaaagccucugccacaaagguucccagacauccggaauccuggagagcuuguugaaaucaaguggucccuaaccacuccccacacccuagacuccccagagcuuuuguuucagcagaucuagggcagggccugaguacauuucucagaaguucuaggucugaagacugcguagaggaguccuauacauggcauacuccuuauauuuauauuugcaucuggaagcugaggguaauucuugcuuuucuuccgagagcugauguaccuucugucaagugaggaauuaacuagggaguggcaguguuaucugcagaaagcugcagcuguagcuuuuggcuguguucucccucaccucuccguugauucgguuccucugaccauugguuaaggaggguuuguagugccccauacccugcugggcacaggcucgagauaaaggugaaacggagcuucuuucucgcccuccccugcuuucuuaggacaccggcacuggguccuuagcauauccugguccccagauggcaagaaacuggccucaggcugcaagaauggccagguagguaaugucaggauaaauggaccgagaacaggcucuggggucuuuagaaggguguguuggggggucagcugggagacccuugucaggacaggucgcagaacguuacuuuaugagcuucuguccuucagguucugcugugggacccaagcacggggcugcaggugggcaggacccucacuggccacagcaaauggaucacaggccugagcugggagccccuucacauguaagugacacgaagcugagacacugagcugggauuaacgcugccccuccccugcucaguacagaguaaaggaaacauccccaugacagcaacggcuuggccuacuauggccacaccccuugcugcuggggggggggggcggggcucaucacaugaccugagcacagccuugcucugcuguuagaaagcuguuaagagauuguccccagccucguugaguucagaaugagauacaauaugggcagacaggugcugccaggucagaccugaggucacaucucccacuucaccaggaaccccgagugccgcuacguggccagcagcuccaaagacggcaguguacgagucugggauacaaccgcaggccgcugugaacgcauccucacgggacacacgcagucagucaccugccuccgauggggaggagaugggcuucuauauucugcuucccaggaccgaaccaucaaagucuggagggcccaugacguaaggggcauucugaagccagucugcugggucacgggugccagugccuugcugcuugcaaacuuguuaucagagggucugguguuuccagaauuauaccaagaguccagcugguccuucugcggaagcagcuccaugcagccuuguggggauucugguggguuuuuuagagccuauuucguuguuugccaacucccacacucaaauccauuugacuagguaaacccuuuuauucccugaagaggggcccaagcuuccagaugcaguuugaugagaugaccaugcagccgugaugaauucuuagguuccugauucuugccuuaugucaccuguccaaugguggaguauaggguauaaucucuccccuugaugcuagguauguauguguauaugugaccugucuucuccugcccuagggugugcugugucguacucuucaaggucauggccacugggugaacacuauggcacuuagcacagacuaugcccugcgcacaggggccuuugagccugcugaagccacagugaaugcccaagaccugcagggguccugugagugagagggaggaggggagcaggcugccuacgggaaggagccuaguggguggauguguaaccagucugguucuuucucucucuccccauuccugcacagugaaggagcugaaggagagggcaucgagccgcuacaaccuugugcgggugaguaugugccaccaacaugaagucccagcucuggacucuucucauccgaccacagaaacuccagucacuugggccucucucccuucuagccccuuucaguguuucuguuccaaaaaguuguucuugguugucuuaguuaggguuuuacugcugugaacagacaccacgacaaggcaagucguauaggggcaacauuuaacuggggcuggcuuacagguucagagguucaguccauuaucaucaaggugggaucauagcagcauccaggcagacaugguacaggaggagaugagaauucuacaucuucaucugaagccugcuagcagaagacaggcuucuagaaucuuaagcccaugcccacagugacacaccuccuaauagugccacucccugggccaagcauauucaaaccauuacagucacuguccuccauaaucuucaaucuuaacacgccgggcaucauuuaacuuguaucuuauuuacuacuuuugucucgucuuuccuuugucaucuaaggagcacauuuacauggucuaagguucaaaagauauuaugaaagauauuaucgaucuuucacagaguccugcauuguucccuugggaagcauccagcuuuaccaauaucucauaguucauagugucagcaugcacacuguauacauaagguacagcuugccuaggaaagccacccccuucuagcaccguucuguaccuugguuuguaucuuaggacuccuuccacuuagguauagaguucccucuccuuacuggcuagccuggaguugcauguaagcuugugucccugccaggccucauuucccuaguucugaucucggucagucacauagccaguaucugaccacgucccacgcggugugcuuucuugcccagggccaaggcccagagaggcuggucucuggcucagacgacuucaccuuauuccugugguccccagcagaggacaagaagccccucgcccggaugacaggacaccaggcccucaucaaccaggugcucuucucuccugacucgcgcaucguggccagugccuccuucgacaagucuaucaagcugugggauggccggacgggcaagugaguggcggggcgaggcugucccuuauuagugggguuuggcauggacucgacacugcuugcucuguguggcacuggcugggucugauuuccucgcccacacuucugacacagagaccccucaccucagcacugaauuuggaguaaaauggcaucuuuagggcuagugacagggccaggggcguagaggugaacaguagcuagaaaugcauccacaucaggcaguucucagccacauguaauucaggcuccaggucuuuggccuucacaggcaccugcagucaugaaauuuaauaauaaaaagagaucucugggcugggcagucguggcucacgccuuuaauccuugcacugggaaggcaaaggccaguggaucuaugaguucgaggccagccuggucuacagaacgaguuccaggacagccagggcuacacagagaaacucugccccgaaaaaaaaauaaauguguguguguguguguguguguguaauguguguauauauauauauauauaaucuuuuaacaguuaaaaaaaaugaauuagaaucugauucugauaaggucgccugaugauugugcagucggcuaaagucugagaggcccugaaggaggggguguggugcaccagccauuauuagguggagaagaggcaugcugugugggaaaagaagaaauaucuaucacuauguauuuucacacagcaguucuuucaagugguaauucagauugucuuuagaaagccaggaaacugagucuuaauggcuuaaccagacaucacagcuagacucgauuaacuugaaagcucuggcuggggcuggcccaccguuaacuccacaccaccugucagcugcaccuguuaugucggaggacaccgggcagaugggcuaagcagguggugcauuggccuuucaggcaugcggugucaugccgcucuggaggcuuagcaagagggagccucaaacccacucagcuggagaaguuccacaaaauacuaauggccgauaaugaucaaaaccgucuagcaugggacccaggcaaugcuagcagguagccaaggugagcgccacuguuguggaugcagaggacauguugaagaucuaauacucuuuuuucccccccggcccagguaccuagcuucccugcguggccacguggcggccguguaccagauugccuggucagcugacagccgacuauuagucagcggcagcagugacagcacgcugaaggugugggaugugaaggcccagaaacuggccacggaccugccuggccaugccgaugagguaaggcuugcugcauagaggcugcgguuggcccuggcccucugcuuuucacugucugacccugucugacccugucuauagguauaugcuguugacuggaguccagauggccagagaguagcaagcggcgggaaagacaagugccuccggaugugagugggggugugguagaagcuggaguguucgcuucuccuggcccacacuggccaguccuucucugcucuuuggcaugguguggaauucagagggaccuucuugaggcacaagagccagauucuccaugggagguagagauaggggguuauggagacucugggagaaccuguaggucuccacaaugcaguaguucauuguuaaggucccaggcuuuucagucgugggaccugcguucggauccugguucccccuggccgugugcaggcacagcggcaccuuucuagacaggagggucacaccuaaagcaccgugcuugugacggcaacuugauacuuggcaguaggcacagcggggucacagggcaggacugagggaaggagagggguuucuggcugaggugugucguggguacacaguugaguuucagagcuacaggugccaggcuuuugacagggcaguaggcagcgugguucccucccaugccucuccuuuccccccgcagauggagaagaugacuccacagcuuauugacccccccuccccggauucaacccccaccugcccugccagagaccaaggaaugcacacgaccaccugccugcccaggacaggucuccagugugugacagucaggacauuacagcguggagcuaagccaugggcacuuccuggcaguggggaagccaggcaucuggcucccauguccuuuuccaagggucagcugugaaggcccagacccuaggcuaugcguguguccaaauaaauaacuuauauuuuuguguuca

SEQ ID NO: 6231 - RNA, 13443 nt, Mus musculus
agccaauucgcugugaccacugcuagccaaacccaugcuagacccggggcugcuccucugaaccucacagacaggcgaccaguccacaaaugaaacaccaccuggccacagaccagaagauucugggccggaggcugaguucgggaaggaaagggagacuuacauuccugccuguuucuaaauucugcuuucccagccggccagggaacagcgaucaaaagucuuuucucacaaaaugaaaguggugagugagagccacagagcugcgaccuucaagggagccagggacagaaggguggcccggugccagaggaaagggccuggagaagagcuuaucuccuuucgaacaaguuuuaugcugucuuguguaauucguaugaauagauuccauaaauuaguugguaaauagguacacuugggccggugacagaacacugggauauaggaagagcuaggaggaaggaggaagaaagaaguggggagaaagcagauaccaaaagaaacuaaaaacaccaagaacaauccgaacgcccaauauggcuaagguucagaauuauuaaaguuuaguuuauuaagcacauaugaguuucaagcuucccgguauuuagaaggcuuccuauuggucucugcccgcgggcgggagaggguggguggagagucaggcagugaaaaggaaaggcgggaauuccacgccaccuccgcgcgcucugcgcucugggauccggagcgaccaggaccuggugagacccucagcuccccuccaccuuccccgagguccagcacaccagaacuggaaccugagcagcccagaagccaggguggcaccacugugucucuccugucugaagacccggauauuuucucagacuuggcgacacguuccuuuaaaaguaggugcugaggacuggaggggccugggagugaaaggggaugauuccagugggugagagacugaccagcccagcacaggagaagggggacccagaugggugaagggaugggggagggaggcugucucugucacucuagcuugcucuggcuggcaaucucaacaggaagucucugagcugguagagccuguuacucuuaguaggugcaaguuagaguacaagcuuuaggccccaagguacagcuugaaaugacaauguugaaagggauucuguagaugccacugagcgaccccucucucucuaagauacugucuuuaacugagcaaggagccaagaggcagaaauauaauugcuacuaucuaacccaggguuuauaauccagaagcuauggaaaagagccuaaaauccggggauuucaguuucccaacuagcacaccuucuaaagccuguuuccuuucuguccugauuccgccuaagauggccagucccaauuuguuuugcccaguauacugccccagcccuucuagugccuuguguguuccacucuuacuuucuacacacagucaucagaggccuaaucuuccaccgacuguuuauaugguuguguaagggagacaggaucaccuuucugcaggucucagggaauggugccauuacuauagaccaguugucccacaagccccuacaauccuucaacauuggcaaacauccucuaguucagccuuauucugggucacaugacaguuuuaggauuuuacucccuaaaaaaaacucaauuauauaggucuggagagauggcucagcguuaagaacacuucuugucccugcacaagacccagguucaauucccagcacccauauggcagugagcaacucucauaacuuugguccuaggggaucugaugcccuuuucugaccaggcaccaggcaggagguauacaggcauauaggcaagcaaaauacucauaaaccacugagccgucucucugggucuguugucuuuaauuuuuaugcaaauacuaucauaagguaaugccuugcuagaagauuguuuuuucaagucauuauuacaauuuacaaauuuguagauuuguuuauuguuguguccggccagcagcucacaggucuggguucuagcccggaaaggcauuuuggaaaccuggaagagaagaggggcuaggcggggcgagauaaagacggagcuaagacagucauccugaucaaagcucaauuuuacuguuccaacaagcaguuaugaagcaggggaaggggggcccgauucccgccaaauaauccuggaguccaguggcagggugaccacguguaugguuccggaacagcaaagcggcgggcuccagcagugggcguggcagaacaauugagcgggaagcuccaucccaauguaaacaguggaaacugggcgggcagguuuaaggcugggggaggggaggcuacaguuuaugugggaugcaugaagauuagguauaacggcacucaccaucaacuuauuggaugugaaaucuccuagggaaaaggccuccaggcacacacaugggaaaggguguggcauuagaagacucucccuacuaccucccugacaucuguaaccuaaccucaaccaugcccccuguuugccuuucuccucuucuucaccuucucccagcuccuggaccaccaccauuuccaaacaucgucgcucagaauucuguuguuucagucccucagccuccugcuccaucuuuaaguuaacuucugugcuggcucucucuccuccaugguaaagauuguuaacauucccaacuuaaacagaaccuugccaaacuuucuuucuuucuuuuuuuuuuuuuuuuuuaggggggggggggaguccgagacaggguuucucuguguagcccuggcuguccuggaacucacuuuguagauaaggcuggccucgaucucauaaaucugccugccucugccucccaagugcugggauuaaaggcaugcaccuuuacugccugacauuucacuaaaucauuuaauaagacugccuaaucucaauguccaccucugcucagcaguuuguauacacagagaaucucagcagguguccuugagcuccaugcccagcaccauacuccucuuccuuucucccaccucugggucuucaccucugguuugacuucuccuucuaguauauucuuccuucaucccuuaauuuauuagaaauauauaccaagcugugauaucucacuccauggcacacccuuggauuuauugauuccuccuggucuuguaccauaaugacaauggcuacauccugacacuucugguaccuaggcaucauugucuccuccugagagcuuuauugcaucacaguuuuauagccaaauuaguuuagacaccccaucaauuguuuguccuccaauagcccaugucacauuugaugauaaguucuacuuugauugcccccucaaaacaguuucuaaacagaaaggacuauuuuuaucuuacuugauauuuuauuacucugacagaauauauuuaccucauaguaaauauguuucaauacguggaugagugaauugugugcaugggagaauuaauuuuuuaguaaaaguaaaauaaauguguggauuguuuugcuauaggaucagcauggagacauaucucuccuuaguggugaaacggucuuacccagauuugaucaucuaugcaggagaagugacucugggagaaaaaguucgaaauaaaaaggacucaaagaaaagaaagcuggagaagacaagaauuacacaggcugcaugugcucuguuaaacucuggaggaggagugauuguuauacaaauggccaaccagagugagcaaccugagaggaugggacaggacuuggaaacaucuuugagaaaccuuauuccaucccuugauuugcaggcuuucuuugagaccaagcaacaggaggauaaguuuuacauuuuuguuaagucuuggagcuccagcccugaagaugauuccacuaagccucgaauuugcagccugggcacuucccuguacugucgaucucucacuucuaagguugccauggauucaagagaugcauuuuacuuucugaaaaaaaagaaggcauauaucaaaugcaguccgacugaugacagagcuccaccugcuaaaauucccagaaccaugagucagaaaagccuugaaucaaauccagcuuuugaaauuuuccaaaguaagaaacuugaauauggccaacgcuugcuuuuuucugaauccacaucuauagaguuuaaacaauucgauaccgaaaaugcccaaaaauauaugaaagacauaauuccagaguacaucuccgcguuugcaaacacccagggaggcuaucuuuucauuggaguggaugauaagaguaucauccugggaugcccaaaagacaacguugacccugacucuuugaaaauuguggcaaaugaagcaauauccaaguugccaguuuuccauuuuuguucaucuaaagacaagaacaaggugucuuaugagaccagagucauagauguguuucaagagggaaauuuguaugguuaucucugugugaucaaaguagagccauucugcugugcaguguucucagaggcucccauuucauggaugguagacaaggagaaaggugucuacacacugaacaccgaggaauggguacgcaugaugguggauguuggcccagguaagaggagagagguuuuccuucucugucaguucugccucucuugagugccucuguauccuucacacucuggaaaucugaguucauuacacccacugaaguuggcuuucucugcuuuuuguuuuguuuuguugguuucaagacaguguuucuccauguagccuugguuuuccugaaauuugcucuguaaacagcuggucucacauucacagagauccaccugccuccacaucccaaguauuaggauuaaaggccuaugccaccaccaucuggcauauauuguuuuuuguauccuacuacugaaaggauguuguagcaaaagaggaggaccaaggaaugccacaaaaaacacaccaugcaaaccuuggggcugguauggaaaugauuugccucugagugggguuggaaaagugagagaccgggccauaauggugacagcuuuauacaggguauugagcaugcaaaccauaaucauggcaaugguggaaaugucuguuagugaugaugauagggcugcuggcacugagucacuguagaugauuugauucagagagcaaauuaaucauuaaauggagucuaaaaggaaaaugcaguccuuuuuguuaaaaugagccauaaaccugggcccuucagcacuuagcaugguuggaagaaagacccaaagugauggagaagaaaaaaaaucccacuaacauugcagaaggcagaggaggaauucaccuggaauugucuccagagcaagcaucucuguucuuuggguuuggcuggauaucaugaaagacuugggagacccuggagcaagcaaccacgucacagggagugaacagaagaagacuggggagagagaaaggagggucuuuaaaccgaaggguguuuaagccagcaugggaaagaagcuuuucucuucugggauguggguggaguagaaaggucagcugggugcuuucucuggcucucugagcuaccaggauuucaccacagugucugucuacuaaguugucauuugguaaaacaagcauuagggauuuuguuuuaaaaacaacugauugauuguuugauuagauauuuuuuguugcuguaaaaucauacagaagaaguugacaaaucagggugcaauuaguaauagcaggaaaaugagaagcaggggucaggaagggcaguuaugcaacucccuauuucaaagguucucaaaaggcccaggggcuggcucaucaaguuguucauuacauuuuuggagaucuguuugaaguuguuggauuuuguuuuuuacuauguccgauugauuggcacagaaguagcacuccucuugaaggaagaggcauuucagcuagaagaagauccagugcccaucacuuugggagaacauccagggagccaggguggguugaugaggagagccaguugauagagagggagaaggggagacuaaggagcuggaggaagagaaggagcuguggguggaagccagcaaagcggggcuuguuagcgggaucaaaagcaauggaggaaucauuuuguucagacuucaaagcuagaaggagcugaguuggggaacagaaggaacagagagaagacuuggagcagacguaaaagaaaacuuugauauaggaacugucauuuccuccaucacuggcaauaguuguaaaaaauguuuuaccugcugaugaaauugucacccaccauuauuguaacuuaacccaucuguccuuuaguaccgguaauguuuuaugaaauucaaugcacugauauacaguguauacauauuuauucacugcuaacaagcucuugccuaccagacccucaauuaucuucagguugugggcucaguuuuauacuaccuagagcaagcuaccacccccuacaccuucacuuucuuuaauuuuuuuaagugugugaaugcuuucuugcauguauguauuuacacuuuguacucauagagucugaagagaucaaaagaggucauuggauccucagaacuggagcuaugaaugauugugaaccaccaugugggugcugggaaccgaacccugguccucuccaagaucagccagugcucuugaccucugagccaucuguccauucccaaccuucacuuucugugaccaacuuccugcuaccugaaauauuuggcauguuuaucuuucacagcugucuccuacccuggaacuguagcaggcuggcaccaggaucccugauuugagauucuuacugucaggaucccaggguaccaaccagcuuaguaccaaccaguggcucucaaucaaggugccagccagagaauugacaaaaugguccuccucuccaccacuuacccaggaugccagaggggucucuccuuccucagauccuccaauuggauuugaagcuuuugaugauggugccuuucucacauggguaggacuucuggucucuucaccagggcugcuuauauuaccuucuggaucaaguuucagcuuccuuucuuugugguuucugauguccuuaacacacauacaauagggccuaugcucuuuguuauucuaacucuucauuuaccgugucacacagaggcagcuuccaaugaucuaucuagagauuuugaaugucagcugagucuauccgacagcccuccacacugcagaccaguguauucuaaaaagggacuggaacauaaagucgaccugcagcagcguuuauuucaagguaagaacggacaguuuucaccauuaagagaaagaaaccaauuaauaacuuugguuaaaaagaaguuauguggcagcagugccacagacaucuugggagugggaugacccuugaagucaucuagcugggggcuagcaaaauuugauaguuaaauauuuagaggcucaguccccuaccaggggugggaccuaaccauaugcauaugaagacacuucuaaugaaguucugauccuguguccagaacucauugaccagacaaucauagcaaaauccuugcaugggaaccacaaugauagaauugaccguuuagucagcuuuuaaggauggagggaaaacauaggacagauaagauggcacagaggagccauuagugauuugucucgaaagaaaguagugagacagagccaccagggucuaaucuugguacaaaguaaucauuucagaccggagauauuguuagacuuucgcuagguuuugucauaaaauuccaacuuagaaaaagauucauguuucucaagguagaaaauagcuucuuuagcuucacacuuugaacauaccugagaucuauuaaucaaaucugauauagagacauccuguuuaugguauaagcauuuauuagugcucucauaaucaauauauuagaaggaccuuagauuugcuuucaaaauagauuuaucugaacuuauuauuauuaacuuaucagaauuguuuuuaaacuuuccacaaaggaaucugaugcaagcaagaaugacugcauuuuuuaaaggaauauaaaacuauuuauugaccacuguucaccauuauuuacaauaaaguaaauauacaguuggaugacauucugaaacuacaaaguuacuuuucuggcucauugaaucauaacucaaauacugaaaagauugauccuaccaguaaggaaugagucaggggaaaguaaaaacaugcaggucauuaaaugauauuagcaaauuuuguucacucacuuagucagcaggucuuaaauugccaaagucagcuccaaccacgauucccuggcuugggggggaggggaggcgggaggcaggcgggcgggcaggcgggaccucggaggcuucucucacugggcgugggaucccaaggcuuguggcaucaggggugguacuuggacuaaauguccuucugggagggaccgagugagaaccccuuugggacggguagaaauauuuguguggcucgagacuauuugugcggacaggcuuggcaaaggcguagcugcagagagcacacuuggguggagagggccgcacgccccagcgcaggccuaagccccucccgacggccuuauuucaaacugaaugacugcauuuuuuaaaacuuucuuuaggcucaauaaauuccauuucgguuggcacagauguauguauguauguauguauguauguauguauguauguauauauguguguguguguguguguguguguguguguguguguguguagauauagacaugugugugagucugucuguuugagcacacgugugcauguguguguauguguauuccccagacaaagcauaugacacaaauaucuuccaaaaauauuggccaccuacuugacucuccauuuuaaacaauaugugaguuguuugaaacaaugcaaauauuuauuugaaaucuugucuauucuuuucauguccagugucaccagacuguuuaaaguauacuccugaaucucucuggagugagcuguguucccagcaugagagacuagaggauuuaguaaagcagcaaauacguucuuucuccugugguuugcugauccucucuagaagcugggcuguggaccugaaccuggaagagaagcaggaagucaucugugaugcucugcugauugcacagaauagcccccccauccucuacaccauccuuggggagcaggaugagcagggucaggacuacugcacccgcacugccuuuacucugaagcagaagcuggugaacacugguggcuacacugggagagugugugucaugaccaagguucucugccugagcucucagaacaauaacaagaccagugggggcucagucucuccuauugauuacccaagcuccuauaaccuugcaaacauccaggaaaugcagggcuugcugcaggcccuugugauugucuugcucaacuucagaucuuucuugagugaccagcuuggcugugaaguuuugaaucuucucacagcccaacaguaugagauacucucaaaaagucuccgcaaaaccagagaacuauuugugcauggcuugccgggcucagggaagacaaucauagccaugaaaaucauggaaaagaucagaaacacauuccacugugaaacagauagaauccucuacaucugugaaaaucagccauugagggacuucauccaguaaguguuugaaucuuugucuggguguguucaaucuaagaugaacuuuucuguucuuacccugguucuugggaacuagucagucaaaugaucugagauagcaguucuguauugcugggacuaugacauacucagagaaacaccuaaugucuuuuucacuguuacagggcaaaaaauaucugccaggcagugacccggaaaaccuucaugaauuauaaauuuaagacagagagguuccaacacaucauuauugaugaagcccagaauuuccgcacugaggauggaaacugguaugagaaggcaaaaggaaucacucgaggaaugaaaaacuguccuggaauucucuggaucuuucuggacuauuuucagaccagucacuugcaggagaguggccucccagauuucucacuccaguauccaaaggaagagcucacacaagugguacgcaaugcagauaaaauagcugaguuccuacaacaagaguugcaaaaaaucagagauaacccuccaugcagcauuccucaagagucccuaaauauucuccaugaauuuaaguggucccaagguguaucaggcaccuaugagauuacauacuugacuuuggaaaagaugguaagcuauauaacagauaagugugauguuuucuugaguaaaggcuauucuccccaagauauugcagugcuuuucagcacagauagggagaagaaagccuaugagcauauguuccugagagaaaugaggaagaggaggagagcaucucacaugaaugacgagucugucugucauucuaacauguuugacagcauccgucgauucucaggacuggaaagaagcauuguguuugguaucaaucccauugcaacugagcagcccauuucccacaaccuauugcucugccuggcuuccagagcaaugaaacaucuguauauucuguaucuuucaacuccugaggggcagagcucaaugguggcaugcugaaugggauauaugagacccuaaguucaaucccugaugaugagaaaguuaaaucgaguugagguccuucgggacaagaagaaagauaaagauauaacaaaaccuuguucuguaguuuugacaaauguaggaaaaaauuaccaauguguauaucguaacuaacugaggcugaaaacaaagcuggagagaagacuggcaaggcaauguacacaugacauaggcuaugggaacguugagaccauaaggacugaaaccagagaugaagacaacucaauacaguaagucauauccaauucuuaaaacagacuuccauuuuaaauugguuaauacauuuaugaaaauauuguauaaggauaaagauaaagacuaaaaacauaauauuaaguagcacuggggucugcgccuggagcugauuuugugccacagcgcuccaaucccuaaauaccacugggaaagaacuggccucccacaaguguggacaagccugugagcgcagguaaguccaccacuucugcucagagguacacaccuggaacucucagaacacaggaaccaaaucacaugaggcaacagcaagaacacaagcaacagauaccaaggccacuuggcaucaucagaacccaguucucccuccacagcgagcuaucauggguaccccacacaccagaaaagcaagacucugauuuaaaaucagauuucaugaugaugauagacuuuaagaaggacauaaguaacucccuuaaagaaauacaggagaacacagguauacagguagaagcccuuaaagaggaaacauaaaauucccuuaaagaauugcaggaaaacacaaccaaacaggugaaggaauugaacaaaaccauccagaaucuaaaaauggaaauagaaacaauaaagaaaucacaaagggagacaacucuggagauaaaaaaccuaggaaagagaucaggagucauagaugcaagcaucaccaacagaauacuagagagagaagagaaucucagguaccgaagauaacauagaaaacauccaguggaaaaaagacagaauuuccaacaaacaguacuggucaacuggcagugaacauguagaagaaugcaaauugauccauucuuaucucccuguacaaaucucaaguccaaguggaucaaggacuuccacaucaaaccagacacacugaaacuaauagaagagaaggugggggaaaaucucgaacacaugggcacagggaaaaaguuccugaacaaaauaccaauggcuuaugcucuaaagucaagaaucaacaaaugggaccucauaaaauuacaaagcuucuguaaggcagaggacacugucaaaaggacaaaacgacaaucaacagauuaggaaaacaucuuuaccaaucucacauccaauugagggguaauauccaauauauacaaauaacucaagaaguuagacuccagcaaaccaaauaacccuauuaaaaaauggggaacagagcuaaauuaagaauucucaacugaggaaacuggaagggcucagaaacaccuaaagaaauguucaacauccuuagucaucagggaaaugcaaaucaaaacaucccugagauuccaccucacaccagugagaaugucuaagaucaaaaacucaggugacagcagaugcugccgugaggauguggagaaaggaauacuacuccauugcuggugagauugcaaacugguacaaccacucuggaaaucagucuggugguuccucagaaaacuguacauaguacuacuuaaggaccaguuauaccacuccuagggauauacccagaagaugcuccaaaauguaauaaggacacaugcuccacuauauucauagcagccauauuuuuaauagucagaagcuggaaagaacccaaauuuuccucaacaaaggaauggauacagaaaaugugguacauuuacacaguggaauacuauucagcuauuuaaaacaaucacuucauuaaauuugcaagcaaauggauggaacuugaaaauaucaucuugaguaagauaacucagacacaaaagaacacacgguauuacuaacugguuaguggauauuagcccaaaagucagaauauccaaaauuucaauucacagaccauaugaagccuaagaagaagcaaggccaaacuguggaugguucaguauuucuuagaagggugaaccuauuacuuacaggagaaacuaugaagacaaaguagggaacagagacugaaggaaaagccaucccgggacugccccaccugggaauccaucccauauacagccaccaaacccagaugauauuguggaugccagaaagugcuuacugauggaagccugauauggcugucuccugagaggcucugccagagccugacaaauacagaggaggaagauuggagccaaccauuggacugagcaaggaggaguuuuagaagggacugaaggagcugaggggguuugcaccccacgcagggagcaacaaugucaacaggcccccagagugccugaggacuggaccaccaaccaaagaauacacauggagggacccagggugcaggccgcauauguggcagagguuggccuuguuggacaucagguaugaagagaggcccuugggccugaguguguuugaaaccccauuguuggggaaugccaggguggcaagaugaggcagcacccucagagaggcagggggagggcauaggggguuucugaaugggacaccugaaaagggggaaacauuuaaaauguaaauaaagaaaauauccaauaaaaaagaaagaaaacauau

SEQ ID NO: 6232 - RNA, 1128 nt, Mus musculus
ggauaagggguuuccgaaugggacaccuggaaaagugaaaacauuugaaauauaaauaaacaaauauccaguacaaaaaaaaaaagaaagaaagaaaaaauauggguugaugagauggcucagcagguaagagcacugagugcucuucugaagguucugaguucaaaugccagcaaccacaugguggcucacaaccaccuauaauaagaucugacacucucuucuggugugucuaaagagagcuacaguggucuuaugaauaauaaaaaauaaaucuuuuuaaaaaugcuuaaaauaaagaaaaauuuuuugaauuugucuuuaaggucuauguuuaaaagagaggaagagaaacugacucaaaaauguaauuugauacuuuacuuuuuuuguuguuguuguuuuuagauagauucuccuauagcucaggcuggucucauacucacuaugcaguagagguuguccucgaaugucugaccuucuugcuuuaccuccuaauuucuaggaguauaaaccuuauagaccuucauaacacacucagaaaccucaacuuuuuaaauaaaaaauguuuuuaauaaccugaaaucauugccuuguccuuuugacuuucaagguuuauuaccaguuuucagaaaaaauagccugaaaacauucuguguuucaaaguuaugauggauaacuuugguuaaaagaaucuuagaagaaaaauaaaagcaguacuggauagucugguucuuuccaccuaaguuccagcuuucugcaaccguggaugcagccagauuaagagggcaauggaaggugagagugcacuugaauucagcaguguccuugcagcucuguucuuuguaccacucgauguuuaaaagaagaagaagaggaaggaggagggggaggagaaugaggaggaaaagaggaagaagaagaggaaaaagaaaaggaagaggaagaggaggaagaggaagaagaagaagaagaacaagaacaacaagaagaagaagaacaagaagaagaacaacaacaacaacaagaggaagaggaagaacaagaagaggaacaggaacaggaagaggaagaacaagaacaagaagaacaagaaaaagaagaacaagaagaagaagaagaagaaga

SEQ ID NO: 6233 - RNA, 18655 nt, Mus musculus
ccaguucgcuguuaccacugcuagccaaacucacaguagaaccagggcugcuuuucuggacuucacaggcaggugacuaguccacaaguggaacacuacccggccacagaccagaaggaucuugucaggaggcuggcuucuggaaagaaagggagacuuacauuccugucuguuuccaaauucugcuuuccaagguggccagggaacagggaucaagagaacuccacuggaaguggugagugaggguccaggugugaccuucaagggagccagggaaagaugggaggcccggcuccagagggaaggggcuggagaagagcuccagagggaaggggcuggagaagagcuuaucuccuuuugaaaaaauuuuauccugucuuguguaauuuguaugaaaagaucccauaaacagauugauuagucgguauauagaugcagacagauagguccaugagggaacacuagcauuuaggacgagcaaggaggaaagaggaaguggggagaaagcagagaccaaaagaaacuaaaaacaccaagaacaauccgaacgcccaauauagcucagguucacaauuauugaaguuuaguuucugaguuucaagcuuuccaguauuuagaaggcuuccuauuggucucugcccacgggcgggagaggguggguggagagucaggcagugaaaaggaaaggcuggaauuccgcgccaccuccgcgcgcucugcgcucugggauccggagcaaccaggaccuggugagacccucagcuccccuccaccuucccugagguccagcacaccagaacugggaccugagcagcccagaagccaggguggcaccacugugucucuccugucugaagacccggauauuuucucagacuuggcgacgcguuccuuuaaaaguaggugcugaggacuggaggggccugggagugaaaggggaugauuccagugggugagagacugaccagcccagcacaggagaagggggacccagaugggugaagggaugggggagggaggcugucucugucacucuggcuugcucuggcuggcaaucucaacaggcagucucugagcugguagagccuguuacucuuaguaggugcaaguuagaguacaagcuuuaggcccaagguucagcuuugaaaugacaauguugaaagggauucugcagaugccacugagcgaccccucucucuaagauacugucuuuaacugagcaaugagccaagaggcagaaauagaauagcuacuaucucacccaggguuuauaauccagaagcuauggaaaagagccuaagacccugggauuucaguuucucaaauagcacaccuucuaaagccuguuuccuuucugucccaguucugccuaagauggccagucccaauuuguuuugcccaguguacugccccagcccuucuagugucuuguguguuccacucuuacuuucuacacacagucaucagaggccuaaucuuucaccgacuguuuauaugauuguauaagggagacaagaucaccuuucugcaggucucagggaauggugccauuacuauagaccagcugucccacaagccccuacaauccuucaacauuggcaaacauccucuagucuggccuuauucugggucacaugacacuuuuaggauuuuacucccuuaaaaaaccucaauuauauacaucuggagagauggcucagcaguuaagaucacuucuuguuccugcagaagacccagguucaauucauagcacccacacagcaaugagcaauucucauaauuuuggucccagggaauuugaagcccuuuucugaccaggcaccaggcaggagauguacagacauacagacaucuguaaccuaaccucuaccaggcccacugcuugccuuucuccucuucuucaccuuuucccagcucauggaccacugucauuuccaaaccuuggugcucaggauucuguuguuucagucccucagccuccugcuccaucuuuaaguucauucugugcuggcucucucuccuccaugguauauauuguuaauauucccaucgcaaagagaacuaucaauuucucuuaauacaaauuuuucugugccucucucucucucucuuucucugucugucucucucuuucccucucucuuuuaguaagucuaucuaguggccuuuucuguaccuaguuuucauuuuuuucauuucucaauccauugugacaauucauagacuuuugcuuauugacauauaugagccaaagaaucugggaacuuuuuaaaguuaaaaguuaugucauuucaccaaacaucccccacccuccccuucuccugcccacagacaggguuucucuguguagcucuggcuguccuggaacuuacucuguagaccagacuggccucaaacucagagauccuacuggcaugccuucaagcgcuaggauuaaaggcgugcaccaucacugccuggcauuucccuacaucauugaauaagacuuccuaaucucagugugcauuucuggucagcaguuuagauaccuggagaaucucagcaucuacccuugagcuccaugcccaacaccauacuccucuuccuuucucccaccucuggguuuucaccuuuuuuucgacaucuucuucaaguauauucuuccaucaucucuuaauuuauuagaaauauauaccaagcugugauaucucacuccauggcacacccuuggauuuauugauuccuccuggucuuguaccuuaaugacaauggcuacauccugacacuucugguaccuaggcaucauugucuccuccugagagcuuuauugaaucgcagguuaacagccaaauuaguuuagacaccccaucaauuguuuguccuacuauaacccauaucacauuugaugauaaguucuacuuugauugccccuucaaaacaguuucuaaagagaaaggacuauuuuuaucuuacuugauauuuuauugcucugacagaauauauuuaccucauauuaaauauguuucaauacguagaugagugaauugugugcaugggagaaguaaguuuuuaguaaaaguaaaacaaauguuuggauuguuugacuauaggaucagcauggagacacaucccuccuuagcagugaaauggucgugcccagacuugaccaucuacgcaggagaagugacuaucggagaagaagauagaaauaaaauggacucaaagaaaagaaagcuggagaagacaagaauuacagaggcugcuugugcucuguuaaacucuggaggaggauuaauugcuaugcaaaugacuaacaagagugagcauccuguggagaugggacaggacuuggaaaagucuuugagagagcuuauuauguccccuaauaugcaggcuuucuuugagaccaagcaacaagaggaccaguucuacauuuuuguuaaaucuuggagcugcaggccugaagaugguucuacuaagccucgaauuugcagccugggcucuucucuguacuguagaucuauaacuucuaagguugccauggauucaagagaagcauuugaauuucugaaagauaagaaggcauguaucaaauacaggccuacugaugacggagcuccaccggcuaaaauuccgagagccaugugucagaacagccuugaaucaaauccagcuuuugaaauuuuccaaaguaagaaacuugaauauggccaaugcuugcuuuucucugaauccacaucuauagaguuuaaacaauucucuaccaaacacguccaagcauauaugaaaaacauaauuccagaauacaucuccgcauuugcaaacacccagggaggcuaucuuuucauuggaguggaugauaagagaaucaucuugggaugcccaaaagacaacguugaccgugacucuuugaaaacuguggcgaaugaaacaauauccaaggugccaguuuuccauuuuuguucaucuaaagacaaggacaaggugucuuaugagaccagagucauagauguguuucaagagggaaauuuguaugguuaucucugugugaucaaaguagagccguucugcugugcaguguucucagaggcucccauuucauggaugguagacaaggagaaaggugucuacagacugaacacugaggaauggguacgcaugaugguggauuuuggcccagguaagaggagagagguuuuucuucucuguccuuugccucucuugagugccucuguauccuucacacucuggaaaucugaguucauuacacccacugaaguuggcuuucucugcuuuuuguuuuguuuuguugguuucaagacaguguuucuccguguagccuuggcucuugugaaauuugcucucuagacaucuggacucaaguucacauagaucuaccugucacugcucccaaguacuaggauuaaaggccuaugcuaccacaaucuggcauauauugcuuuuuguauccuacuacugaaaggguuuugugacaaaagaggauggccaaggaaaugccacaaaaccacaccaugcaaaccuugggggugguaugcaaaugaguugccugugagugggguuggaaagagagagagcaggccauuauggugaaaacuuuauaaaagguauugagcacauaaauaaugaauauacauaaccauggcaaugguggaaaugucuguuagugaugacagggcugcaggcacugagacacugagugaggaagggggaugggagcaccuggaucuggaaugugggagguucuauuggcuaguaaugauuucagcuugguaugaauacuugucgcuagcuuaaucaaucuacuuuagacauuaaguaauuucuccuuaagaaaugauugcuuguugcuaggaguggagaggcucuuugccuggagaauugugauuguuagcagggugacguggcuccuggaacaacuuggauuuuuuucccaguaguugauuugauucagagggcaaauuaaucauaaaaugaaaucugaaaguaaaaugcaguucuuauugcuuaaaugaacccuaaagcugggcccuucagcacuuagcaugguuggaagaaaaacccaaagugauuggagaagaaaaaaaagcccauuaacuuugcacaaggcagaggaggaauucaccuggaauugucuccagagcaaacaucucuguucuuugaguuuggcuggauacccagaaagacuuaggagacccuggagcaagcaaccacgucacagggagugaacagaagacagaggagagagaaaggagggucuuuaaacugaaggguguuuaagccagcaugggaaaggagcuuuucucuucucggauguggguggaguagaaaggucagaugggugcuuucucuggcucucugagcuaccaggauuucaccacagugucuggcuacuaaauugucauuugguaaaugaaacauuugggauuuuguuuuaaaaacaacugauugauuguuugauuagagauuuuuuguugcuguagaaccauacagaagaaguugauaaaucagggugcaauuaguaauaacaggaaaaugagaagcaggggucaggaagggcaguuauccaacucccuaaucucuaaaggcccaggggcuggagucaucaaguuguucauuacauuuuuggagaauuguuugaaguuguuggauuuuguuuuuuacuauaacugauugauugacacagaagcggcacuccucuuggaguguugcauccaccccaaccagcaggaaagaagcaacaccaaguuguccuucuucaagcagguuuauucaggaacacuuagcauuacaauacaggaacaggaauucccccccccccaacaacccuggcacacaccuuacauacccuacugacuccucccaaucaccccagucacauaacacaguccauaaguucacagcaagugaggacaccucaggccagcugacgaggcauggcaucugggcagugcaggcagcugggauguggcuaagucugagauaaugagguagucaggcacaggucauaagaccuggcagucauccgcggcgccaaauugggauggcagccgcacccacuggaggaagaggcauuucagcuaggagaagauccagugcccaucaguuugggagaacauccagggagccaggguggguugaugagagccaguugauagagagggagaaggggagaccaaggagcuggaggaagagaaggagcuguggguggaaaccagcaaagcggggcuuguuagcgggaucaaaagcaauggaggaaugauuuuguucagacuucaaagcuagaaggagcugaguuggggaacagaaggaacagagagaagacuuggagcagacguaaaagaaaacguugauauaggggcugucauuuccuccaucacuggcgguaguuguaaaggaugguuugccugcugaugaaauugucacucaccauucuugaaacuugacccaccuggcccuuaguuccuggaaguauuuuaugaaauucaaugcacucacauacagugcauacauauuuauucacugcuggcugggccagugcuucuaacaaucucaugccuaccacacccucaauuauuuucagguugugggcucaguuuuauacuaaccagggcaggcuacaacccacuaccccuucacuuauuauguuuuaaaugugugaacuuuuucuugcauguauguauuugcaccguguacucauagagucugaagaggucauuggauccucagaacuggaguuaugaaugauugugaaccaccaugugggugcugggaacugaacccugguccucuccaagaucagccagugcucuugaauucugagccaccuguccauucccaaccuucacuuucugugaccagcuuccugcuaccugaaauauuuggcaugcuuaucuuucauaacugucucuuacccuugaacuguagcaggcugacaccagaaucccugauuugagauucuuacugucaggaucccaggguaccaaccagcuuaguaccaaccagugguucucaaucaaggugccagccagagaauugacaaaaugguccuccucucuaccacuuacccaggaugccagaggggucccugcuuccccagauccucccauuggauuugaagcuuuugaugauggugccuuucugacauggguaggacuucuggucucuucaccagggcugcuuauauuaccuucuggaucaaguuucagcuuccuuucuuugugguuucugauguccauccaacucccaacccccacccccagaauagaaccuacucauuguuauucuaacucuuuucauucacugugucacacagaggcaucuuccaaagaucuaucuaaagauuuugaaugucagcugagucuaugcaacagccccccacacugcagaccaguguauucuaaaaaaggacugcagcauaaaguugaccugcagcagcguuuauuucaagguaagaauggacauuuuuuaccauuaagagaaagagaucauuuauuaauuuugguuaaaaaguaguuaugucguggcagugcuauaaacuucuugggaaugagaugacucuugaagucaucuagcauggggcuaccaaagucugauaguuaaauaugcagaggccgagucccccaccagggauuuaaaacauaucauuccagcgcagggccuaagcaaaugcacuuggagcagcuucuuaaggaucugauccugugucuggaacucacugaccagaacaggcacagcaaaagccuugccugggaaccacagugauggaauuggccguuuaaucagcuuuuaaggauggagggaaagcauagggcagaucagaggccacugaaaagccauuagucauuugucuugaaagaaaguagugagacagaggcaccagggucuaaucuugguacaaaguaaucauuucagaccaaggauauuguuagacuuucccuagguugugucaaaaaauuccaacuuagaaaaagauucauguuucucaagguaggaaauagcuucuuuagcuucacacuuugaacauacuugagaucuaguaaucaaaucugauacagagacauccuguguaugguauaagcauuuauuagugcucuaguaaucgauauauuagaaggaccuuagguuugcuuucaaaauuaauuuauauuaaauucuuauuauuauuaacuuaccagaauuguuuuuaaacuuuccacaaagaaaucugauguaagaaugacugcauguuuuaaauauuucuuuaggcucaauaaauuacauuuagguuugcacauacuacuauaacauaagaggagaacaaugucuuuccaucaguuuggagggauaugacugaauggggauauauacagauggaauuucuccuacuugucucauguagacuacacauaaggcuuaguacucuuuauuuuuuaaauuuuuugucuccucccaauuuuuaaauauuuuaauaaauuuauucuuuauugaggauagaguuuuucacacaauauauucuuuuuuuggcacacaauauauucuaaucaugauuucuccucccccaacuccacccagaucuuuccccaccuccuacuccacacucaacuccacaccuuuauaucuucuguaucguuagaaaacaagcaggugacuaaaacaaacaaacaggaauagaacauagcgggaauaagggggcgagaaaggaaccuaaggaaaagaauaagaaacacauacacauauguaggagauacacauacauacacucucacacacacaucccauaagaacacaaaaucagaaaccauaauaaaaaagcaaaagaccuauaagauuuuauauauaugucccaaccagcgggacagucgaacauggucugaagaauuaccugugcagagaaugggggacaagaaacacaaagaacagacugcaagacugauugaucaagcugacaaauuuuauuuuucccaggcagguuuuauaccaaauagaagcaggauaugaggagggggaugacacagauucaguuuguuucugggggaacgcaccuguucccaaaagcaggauauuggcaagguaaaaaguuuaucaggaggaacagaagagucuggguugcuagguaccugccaacaagaucuauagcuauuuuucuuaacuaggggguaguacuuuccuacagaggccucaacuuuucccacagaaaucccaaauaagcuaguacuuuuccauaaggccaagacuuuguaaguaagcacguaugacugacaaggcaguuaacauucaaacagggucacucccaacagcuucccuuccuuuuaguacagaaggagcguggcaauuuuauucuuugcuaaggcagggauagaggccugaccuccagugacuaaaggggaucuuguaauggcucugguccuccugguguuguucagugacgcaugggggccauaccuguccugaugccuuuuuccuggagaggggauaguuuggacaucaaccccuaugcagucaggcuugucccugagggaacacagaaagauauuuuuaguuuuugcuuuauauucccuugcagugcuuugccucacagcccaagcaagaacuuaaucugccagucagaggggguucuggguggccccucucuauuuguuccuggugcgggaguccccuuucuuagguugggcagagauggccuuugggaacacccuggagggaauaacaaccucaucuccagucuuuugguccuccauagcuaacuuaugauaaugcaccuagaaagguuuugcugccaaaucaucuaucugacauuucacaaaguugguaagucuguuaagggcccaggaaggaaggaaguaggguuaacaaccacagagagguugaaaaccaauuuuuauucucucucucucucucucucucucucucucucucucucucucucucucucucucucucucccucccucccucccucccucccucccuuccucccucucucucucucucucucucuuucugucauuuuuuucuagacguucucugacuuuuuuucaugcuuucuuugaccaucccugucuuauuuacauaaaaccaacauucuucccuaagagcuacacacagcccucccugcuauaaaaagaguaaaucaaguccucugcgguuuuguaggacaacuucagcuaaggaguagagggaaucagugaggucgucgauaccuuguuguagacacuggacgucucugucaauggugacacugaguucuugaucccuagacuuagagagaacauauggggagaugccagucccagugcccacagcaccaaggccuaggaaaugaugaaauggugauggcaguuaggggcucucuucccugguggaccagugaaggggaggaaucaguagaccgaucccacaaaugaaaaauuucuucugaacgauaauaaaucgaucaaggaaccaauugcacaagaaugcaaaaaucagaauuuucucuagaaaaggcacuggcugagaggcacgggguaaggccaucaaggcaaacccaucaaguaucauuuggagaaacuaaauauuggauacuaaucucaggugcaaggguaacauugcaaagaugggcauacuguggaggagguggauuaugagucacacagggcccaaucccgagaccugaaagagagauaaaccauucgacauuccugguugccagcgacaauggugggaguuauuugcagggauaaaauggcaaggaagagcaauaccuucauaaaaaggugguugggaauuguugcggucggccagcagcucgcaacgaacgguucuacugagauggcaacucgggcuguaagagaagaacuagacgggcggaagaaaaaacgaagccaagucaaagucacucugaucaaagcucaauuuuacuguuguggacacucaguuaugaaggaagggggaggggaccugauuccugccaaauaaucucagaguucaguagcagggugagaauguguguggcuccaaacaacaaaacggcacgguccagcagugggcguggcagaacaaaugaacaaaaaccuccaucccugagcaagcagguuucaggcugggggagagaagacuacagggaaugauaacacagccagcaaucaucaagauuaggggaaguggcauuaagugcaagaaagguuugauucacuaaggugaggauaugaaggggggaggauuggcuaugggagcaagagaaauuucugagguaaagauaugagcaguuucuguaaaagauggagggucagguuuuuuggguggcuguggauaggggacuagaacaggguugggaccaauaaaaacuggcaauuuggcauaaacagguucuuuaaggaguuuaaugauaaaggugaggccaguaucugugccugauugauaaagguggagaucccaugagaaacccugcucccaaucuauggacuuaguauggucuguaaauguaauggacagggggaggcaccaacccaaggugacauggucagaauuuuuacagagagguuugacaucuaaaaaauucugggggugugaaaauguucgggagagaguaauauaaucccgggagucguaggauuccaauaaaccgucccugaggucucacaaccccagcuggcgcaauaaagaucagcuuugccaucgcacuuaugauggagggaguggccacaguggugcccugggcaaacauaaaaaucuguaucuugaaguaagguucaccuaauggaauuuucccagccagguuaacugaccaauaauacgaaaaaauuaaagaaagaaaacuaugaggcuuauaacucugggugcugggcacauuaucucuggggcuuuauauaaaucuggcugaucuucaauaccccaagggaccucugcucccugcacuaguuuacaaagauuggggcuaaggcuggcuggccaccaaauauuaguggaagucuugggaguggcccagacaacaucauuucucucugagaggaccauccaaguauaauuccaagggaggugucuaugacuaggagguuuggguggaggcaggugaagguugguggucauucugguuagccacgggaucaggaguaggaucgggaauaucuucauuuggagcaggaucuggaaaagaaauaagauuugucucaggaggggaugauugcuccauucuguacacagacaggauaacaguuuuuacuagccucucugguaaccaucuugggccagcauuuuuuuuuugucauaaaugcaagcagacccucguccccauauaaggaugggaucugguccuuuacauuguccaguaaggggaucucuccaucacaguagugcgugagaaucucgugacuuaggaugcgacaggcagucagcugcugaccuaccuucauuauccagggacaagaaguuaagaacaaagagagcaugauugagccuguuucagggagucaagggggaguaagcaucuguaacuucagucaaccgcugaagcauauuuuuuagagucugaugggcucauucuacgaugcccuggcccugaggauuauagggaacaccagugacauguuuaaugucaaacugggaacaaaacuguuggaacuugguuccugaauaacuggggccauugucaauuuuaauaaucugugguuuucucauggcagccaugcacuguaaaguauguguuaucacgucaugugaugccucuccagaauggggagaugcguguauaaauccacuauagguaucaaauguaacaugcacauauuuuaaccuuccaaaguagagaaaauggauagcauauaucugccaucauucauuaggaaugaguccccugggguugacucccaggugaggaacuggcagguaucaaauguaacaugcacauauuuuaaccuuccaaaguagagaaaauggauagcauauaucugccaucauucauuaggaaugaguccccugggguugacucccaggugaggaacuggcagcagaguggcacauccaccacaggacuuaacaauuucucuugcuugaucucuagaaaucuugaacauuuggcauuuaaaugaugcaaagcaugagcccguuuagccaaaucuauggaaucaaguaagguggggaaugcugcucaaguggccccaucggcuagggcauuuccauaugacagaggaucaugcaggccagaaugggcacucaagugucccacaagaaauggcacuguccuuuuaaugauuagggauuggaucuccacaaauaauuuggaagcggugggagcagacuuaauauaugugaaugugucuaagacaggaauagaaugaaccacguaagcacuagcaguauacagauuaaaugggaucauugguaaaauuuuaaaaaccugaagaacugcaaacaauuccaccagcugggcagaggaauauggggacugcacugaaguaacccgaucuuguacaacauaggcaguuuugcccguugaggaaccaucuauaaacaccaaggugccaucauggaguggaguuuuggagguaacuuuggggaaaaccaaggaaugcaucuuuacaaauuguauaaggggaucauuuggauaaugauuaucuauaaugcccgcaaaagaggcacaggcuauggcccaaucaucauuagauugaagaagccauucaacuugaucugagguauaagggauaaugauaauaucaggaccuuugccaaaauacugucuggacauuuuucuuccuuugacaguuagggcagcagacaaggaauaauagguugccaaaaucuuacuuggauuuaaggggagauauacccuuacaaaggacaucccuuuuuggugggaguccgggucugugccagaagaccucuaccagaguauauauugcagcacaaacuauaaaauaaaguggggcaggguaauaaauuugaaaugagguuugggaagaaauggcuugaccuaucugcugcagggcucccauaggaaucauaacuuuauuaaucgcauggagaucuuguaagagucuccacuuacccaacuuuuucuuaacugugauccggcccaggcggggaggacagucaaggcugucccugaguccccaggccaccuccuuccugcaggcugcgacuuugcuauggucuccacugaggucucaagaggcacacguguaccccgguuugugagcaacuuacacgacugccugcgccaugcuggacggacuggaacggccuccacuuugcuccucaccucagaaaacugcaggcacuuguccacuggcuagcaggguguuugcagagcguucaggcagcacucagacuggaacuuagggcaggagaaaagcagccacagcagacagagccaaagggaggaagggacuuuuggauuggcucagccaguuagcaguggaggaggaugcuuacagagcagagguuuuaaaucucaucaaacucaaaaaucccagggugcugcuaaaaaucaggaaaacucuaaaggcaauacauagaagcucaaauugcuucgcaagcaguucccccuggugacuuuuauuagccuauacaggggauacacagcuagcccuggaacucacugccaccagaaagaagacacauugcuccgguacagcagcaucuauaggugcacaugggagacaggagcaggaguggggaaaucugaaacaccaucagccacagaagguggagcagacaaaggauccucuugaaggguacaaaggagguguaugagucacaagauuagcagaaggaggacaggggacagguucuuuaagaaacuguucuuccaggaacgucacaggugaaggagggcaaggggaagaggcagaguuuaagggaucgcucucccucagacacgaaaugcuggaaaucuggccauucaggggagguucuaagaaugucauuaaugagggaccaguaacuaaaggcaguaaaagguauuuuuguagguccaaaugcuucauaauaaucuuugaaaggaucaccaacucugcaccagcguuucucaucaauucuccccucuuggagauucucccacaaaaucuaaaaauguuauuauuucccuuuucuuaacccuaguuccucauguuuugagugacuccuuaagcccuaucacaaaaagugacugcuuagaaaauucuugacccauaucucaccacauuuuuuccuaagaucugcaccacauuauuuuuuccucccugacugucucaaggcaggaaggacuguggcuucaugucaaacugaagucacucucuggcgcuucucaagacgaccggguaggccuacucuccaaugaugaguggcgugcucuucucugugacccccuagagucucuuuuccagugugaauuugucccgacccaugggacagucuaacagagucugaggaaccaccuguggaaagaauuggggaacaagaaacacaaagaauggacagaaagucugauugaucaagcugacaaauuuuauuuuucacaggcagauuucauacccaguagaagcaggauauggggaggggaaugacacagauucacuuuguaucugguggaacgcaccuguucccaaagcaggauuuggcuagguaaaaaguucagcaggaggaauagaacagagaggguugcuaggaaucuguccacaaaaucuauauuuuuuguuuuuuaacgagggguaguacuuaccuacagaggcagcaacuuuucccacagaacucuaaacuaagcuaguacuuuuacaauaaggcuaagacguuguaagcaagcauguagggccaaaaagacaguuaacauucaaacagaguugauuauagauauagauauagaugauacagauacagauacagauagauacagauacagauacagauacagauacagauacagauacagauacagauacagauauagauauagauauagauuccccaggcaaagcauaugagacaaaaaucuugcagaaguauuggucaccuacuuaauucuccauuugaaacguaauaugggaguuguucaaaaugauacaaauauuuauuugaaaucuugucuauuguuuucauguauagugucaccagacuguuuaaaguauacuccugaaucucucuggaaggagcuguguucccagcauaagagacuaaaggguuuaguaaagcagcaaauacguucuuucuccugugguuugcugauccucuauagaagcugggcuguggaccugaaccugaaggagaagcaggaagucaucugugaugcucugcugauugcacagaauagccccccaauccucuacaccauccuuggggagcaggaugagcagggucaggacuacugcaaccacacugccuuuacucugaagcagaagcuggugaacacugguggcuacacugggagagugugugucaugaccaagguucucugccugaguucucagaacaauauugagaccaaugggggcucagucucuccuauuaauuacccaaguuccuauaaccuugcaaacauccaggaaaugcaggacuugcugcaggcccuugugauugucuugcucaacuucagaucuuucuugagcgaccagcuuggcugugaaauuuugaaucuucucacagcccaacaguaugagauucucucaaaaagucuccgcaaaaccagagaacuauuugugcauggcuugccgggcucagggaagacaaucauagccaugaaaaucauggaaaagaucagaaacacauuucacugugaaacagauaguauccucuacaucugugaaaaucagccauugagggacuucauccgguaaguguuuggaucuuuguauggguguguucaaucuaagaugaacuuuucuguucuuacccugguucuugggaacuagucagucaaaugaucugagauagcaguucuguguugcugggacuaugacauacucagagaaacaccuaaugucuuuuucacuauuacagggcaaaaagaaucugccaggcagugacccggaaaaccuucaugaauuauagauuuaagacaaacaguuuccaacacaucauuguugaugaagcccagaauuuccgcacugaggauggaaacugguaugggaaggcaaaagcaaucucucgaagagugaaaaguuguccuggaauguucuggauauuucuagacuauuuucagaccagucauuugaaggagaguggccucccagauuucucacgccaguauccaagggaagagcucacacaaguaguacgcaauggagauaaaauagcugaguuccuacaaaaagaguugcaaaaaaucagagauaacccuccaugcagcaucccccgacagucccuaaacauuguccaugaauuuaaguggucccaaaguguaucaggcaacauuaaaacugaacaauucacuuuggaagacaugguaaucuauguagcagauaaguguuaugauuucuugcguaaaggcuauucucuccaagauauugcagugcuuuucagcacagauaaggagaagaaaaccuaugagucuauguuccucggagaaaugaggaagaggaggagagcaucugagaugaaucacgcguaucucugugauucuaacauguuugacagcauccgucgauucucaggacuggaaagaagcauuguguuugguaucaaucccauugcaacugagcagcccauuucccacaaccuauugcucugccuggcuuccagagcaaugaaacaucuauauauccuguauuuuucaacuccugaggggcauagcucaacggaggcaugcugaaugggauguaugaggaccuagguucaaucccugaugaugagaaaguuaaaucaagucgagguccuucaggacaagaagaaagauaaagauauaacaaaaccuugugcuguaguuuugacacauguaggaaaaaaauuaccaauguguauaucguaacuaacugaggcugaaaacaaagcuggagagaaggcuggcaaggcaauguacacaugacauaggcuaugggaacguugagaccauaaggacugaaaccagagaugaagacaacucaauacaguaagucauauccaaaucuuaaaacagacuuccauuuuaaauuguugaaaacauuuaugaaaauauuguauacaguuaaagaaaaagacuaaaaacacaauauuaaguaguacuggggucugugccuggagcugauccugugccacagugcucaauacccaaacaccgcugggaaagaacuggccucccacaaguguggacaagccugugagcgcagguaaguccaccacuccugcucagagguacgcaccuggaacccuccggacacaggaaccagaugaugagaggcaacagcaagaacauaaacaacagacaccaaggccacuuggcaucaucagaacccgguucucccaccacagugagccaucgauaccacaacacaccagaaaaacaagacucugauuuaaaaucacaucucaugaugaugauagagaacuuuaagaaggacauaaauaauucccuuaaagaaauacagggacaggagggauggcuuagugguuauaagcacugacuuagguccugaguucaauucccagaaaagacaucguggcucacaaccaucucuaauggggaucuaauacucucuucuagugugucugaaggcugggaccguguacucacauacaugaaauaaauaaaauaaggg

SEQ ID NO: 6234 - RNA, 654 nt, Mus musculus
ucagccccuacauuucuuuuuuuuuuuuuuuuuuuuuccacugguuaucagauagucuuuuauugaaauauuuucuuguugcuucuuaacuagcugggcacuccacugcaccacuguugaugucaucuaugaugucaugaggguggcggccauccacauugcagcccacagacugugcaguacccaggaucuccuugguaguuccagaaaguucucuagccagagaccggugucucaucugccgggcaauguugacaaucucaucaaaaguaauguucccacuguguuuaauguucuucugcuucuuccugucucucgguggcuccuugagggcuuugaugaucagggcugaggcagagggcaccaccucgaucugggccugucuguucuggauggucaguuucacuguaauucugagaccuuuccagucaccgguagccuuggcaaugucaucgccaacuuucuucggagacagacccagaggaccgaucuucggggccaaggcggauguggcgccgaccucgccuccggugcaccucagguacacgacuuugaccucguuggggucgaacuugggcggcaugguggaggcggcuggugucggaugaacccccccuacauuucuuuaagggaguuuuuauguccuucuuaaag

SEQ ID NO: 6235 - RNA, 5581 nt, Mus musculus
cagucugugcaaugcuuuaaugcagcaaggaacaaagaacucacaugggcuuagaggugaacacacaaccagggcugcaguuagaacucuuccaagugccaaagcccaccggcgaagacaucugcuggccaggacuuguugcagacagagggucuuucucaggugacacuagccugcuuuaccaagacugcugacauggguacuagacuugaggcaacugagcaaagcaaccacagaacucagagguaaguaaccacagacauauagucuacucaaguccuaccccuaaugucauuucugucccucacuuccaacccuggguacagucuaguugcucugggaccaugguuaguuucugucucuacuggcaucuuggcuccuuagagccuugguagcccauuuuaacaaaguguuaacaaaccggcugugaagggauuaggcaccuggugagcugucugggagggcaaaugccugugucuucuugguucaggggaggaccagggagagagcuuagguucugcuuggccugagccugaacuauugaggcagacggugggaggaugaaaaugcaagccaggcguuggguacuuuuggcaggucugugccaugguguaucccugagaaaauaugucaugcaacagaucucguguaagagguuuauuugggagaggagagugaaaggugccucagaguugaaacaguaaggagggaaaagggcagacaggcagagagagacauggaaacacacaggagguaagguugagagaaaugagagcagaggaggagaaggggagaggaagggggagagauaucugugguguguggggcccuuuuauccacacacagcaggcaccuggcacaguuagcaggggcaggagaagaaauaagcagccucuagucccuaggaaaucaggcuccugcuggucaucagagcaucuugaggguuccccacuggauccugugggaggauaaguaaaugugucugagcgacaggaagaaggggaacuguauucaagaugagaaacgagauaggugcacuagagcccugaaaagcuuauaauguucucuuccaccaacugccaagcacuuucagaggugugcaaagaauucuccaucucuucuuuuccuccaagaggcagcuacuacugcuccugccucuguguuugccugccaaucugcagugccugcaucuggaugccaugcucuuucccucugaggacagcuaacaagacacuuuaaauuccagaccaaagucucugagaacuuucucuagucgacacuagcauuuuggggguuggggggguuggggguugggggguuggggugggagcggcggaugggagucugaaugguaaagcagaccuaaaacugcagggugguuaaugaguuuacaugccuggguuuguagaucacccagccuuuuuuuuuuuuuuugugaaggaacaagucucagauacaugccuaaaagaugcacauuuuaaacaauugacaauuuuccauagucacggauguacgagugcaauggccuguaucccaggcuaccccacagcuccuguaaaugugacugcacagagaccugugauuucugaauuucccggggcuggggcauguugugaccacuguucuuuuguacuuuggugugagcuguggugcuggcugagaacagagccuggcucaggggauucuguaugcgugccugggugggaauggggaagaacagagacugcuuaggagaguagggcgggggcgggcugcagcuucugacagggaggaacugaaacgacuucugaaagcuugcuuuugguuaguggguuugaauagggagggaaaaaaaaaaggugguggcuuaacagggauguauuccggucagacugaguauugcugacauuuuaaauauguuacuuugguuucuacccugcuuugaucauucaguuccugguuaaaagacccacacagcuuucauuauuuacaauaagccuuaaacagcacaagagccgggcagauaucuacccucugugcuauuagaaucuacuuuccuaucgauaacucugaguuauuacuuacuguguuucucugggcuccucuuaaauccacuggccaggcuucagggccacauuuuuaugagcucaucugauccacggugguggugguggcuucucuuccuggccccaagcccggaaacacuaaaaccugucuaugucuccucugcccagguuauuggcaucucuauucaccaauaagaaauaacuuggaggcaaggucauguggugucacuugggucuaugcccagacccuugucucuggggcacccagaucuugaggaaccaauauuagcaucagaguacaagcagcaucaggccaacccacuacaacugacaagcagucgguuaugcuggcuauguguagaucaaccugacacaaacuauacucaaucaacucagaggagaaaccuugaugaagaaauugucuuuguaagacugggcugcaggcaagccuguaggauacuuucuuagugauugauggaagagggcccaguccacuguaggugguaccauccccugggucggugguccuggguccuggggucucuuuagccuuugcaucagcuccugccucuagguucucauccuguuugaguuccuguucugacuuccuucaaugauggaguaugauguggaaguauaagccaaauacuucccuccucaucuucuuuuugaaccugguguuucaaaauaaccauaacuaagaccucaagucaacuuaugaaaguagaauuaauuugcuuuaggguuuuagaggguuauaguccauguugacagaagaguugagagcucacaucuugaaucagagagagagagagagagagagcgcuaacugggaauggggugagucucuuaaaacuucaaagaccauccccagugacauaccuucuccaucaaggcuacaccugcuauauccuucugaaacauuuccaucaacugggacaauuguucaaauauaugaaucuacguacaaaacuacaguucaugcuuuagcaauccgugugcugggaaaguaggugggcaccagcaucuauggcucucaguggugauuccaaauggagacagaggcuuuccccuauggagucaguggagcaaaugggcucacaucugggcacaucugggcaggcuuccuaagauagaaaaagauacugggauuacauguuuggaguuuggaggucagaggucaaugucagaugucuuauuacauucauaauaaucauaaauaaucugaaacuggacuggagagauggcucagggguuaagagcacuggcugcucuucucaagcaccaggauucacuucccagcacuaacuuggggcuaaccaccaccuguaacgccaguucuuggggagaugaugcccucuucuggccuccaggguuacugcaugcacaugguacacauaugcaggcaaaacaccaauagacauaaaauaagcacgucuaaaucauugcauaacuaaagccuaugguacagaaaagaccaauacagauuccacugaggguuuauugaaagaagacugaauacaauauuaaggacaagaaaagagaugaacaaggauuaaaaugggauugaacaucugaacgggcucaaccauaccuguaacauuacgucuaaaaacuaguaggcauaaaaguucuguuaauaagugcaaagugcggaaaaacaacaaccauuucuccaccugcacacugacgagccuguagagcaauuugcuuuuggguuuuagaggguuauaguccauguugacagaagaacugaaagcucacaucuugaaucagagagagagauagagcuaacugggaaugggugaguuauugcaguuggucucacgguauggaagaugcucucucuugcuucacucucauucuuuuauuuacuuauuuauuuuuuaaaagauuuauuuacuauuauucauaaguacacuguagcugucuucagacucaccagaagagggcgucagauuucauuaagggugguuaugagccaccaugugguugcugggacuggaacucaagaccuucagaagagcagucagugcucuuaccugcugagccaucucaccagcccccuuugcucuuauucuaacggcucugucuguuuuccaggaaugacauucagcuggaaaaugcaaaggcugcugggaaaaugggcaucaguguugaucuggaagccaaauaugcuaagcugggucuaaaucucggagcaaucacuuuuggagagaaggauaggaagaaaaugaagaauucucaccucagaaaacaggagaaugcaaacaucucucuagcuguaugugcucuccugaauucgggagguggagcaaucaagguuaaaauugaaaaugaaaauuauagucucacuagggauggccugggacuagauuuggaagccucucuuuguaaaugucugcccuuuguccaguggcaccuggacuucacggagagcgaaggcuacauuuauaucuacgugaaaucguggagccaagaaaucuuugggcugccuauuggcacccuaagaaccaauuuguauguaaggagcaugucaucuucuguacaagugagcgccgcugcugcccuggaauuucuccaggaccuggaggaaacuggagggagacccugugucagaccagaguugccugcaagcauagccuucccugaaguggaaggagaauggcaccuggaggauuuggcugcugcauuguuuaacaggacagaauuucaguacgaggaaacuuuccccuuuaccagauccagauauguugaaguuacauugcuuucagcgaaacgccugcgaaaacgcaucaaagagcuccucccucaaacuguuucugcuuuugcaaacacggaugggggauuuuuguucauugguuuggauggcaaaacccagcaaauuauugguuuugaagcagagaagagcgaucucgugcuucuagagagugaaauagaaaagcacauccggcagcugccugucacucacuucugugaggagaaggagaagaucaaguacacgugcaaauucaucgaagugcacaaauccggagcugugugugcauaugugugugcgcucagaguggagagauucugcugugcaguauucgcugcagagcccgaguccuggcauguggaaggcggcugugugaagagguuuaccacagaggaaugggugaaacuccagaugaaugccccaucagguugaagggggauuaauaaucuguaugagggcggcagagauggcucaguggcuaagagcacugacugcucuuccagagaucugagcuguaaccccccccccccagccugaaaccugguugcucagguuucacuguuagcaagaagagagcaugggagaggggggaggagccugccgcccuaucguucauccuacccuuuguccacccgagacuagagggguguguccguuccacgcagacaaaggggcccagagggucuguggcaguggucaccugaaacuggacuccaggaugauuuggcgggaaugggccccuucccccuccuucauaaaauugagcuuugcucagaac

SEQ ID NO: 6236 - RNA, 3055 nt, Mus musculus
ggaaaaagaaagcaaaggcgccaaagucgccuggggccucggagaugaaagauggaccugaacaggagcagagacgcagagcuggccacacauggaagguaaugccaggacaaaucgggaugaacuagaaaguugguuggaaaucugcccagcuauaggcuuaagcuuuaaaauacccgauagccucugugucaucauuuguacugcuucugggucagaaaguccugcuauauaacugaaaucacacggggggccucuuuagaagaaacugaccagugcggaaggaacaauauccucagaucauggagagcaagagaaggaaacacagaaaauaaccaugaggccugagaaauguuuugaauguaugugagauuuaucacauccuuccugcaaccgcuccugucacccucccugaaggcugucaagaaaggacaaggagaccagcaugugguuuuaguuucugccacaaggcucacaugagucccucuguaucgccuggcuggcccuuccuuccuccgcauccaggcuaacuuuaaaauccaaccugaagguuuuaaaaauccaauuauaaguuagccuauauauuagaugggggggggggggaggaaacuucauauuaaaagcccuguauaaaaugcacucuuuacugcauugaguuuggucaagaguuuucguggcugccuguuaguuuguguuaccaaaacgaaacauugaaacaucggcauggaaguuucuucuaggagccugcccccaguugguaagugaggaaacaugcaugccccugccugaauuaagggggaggguuggguacaaaagcaggaaguacguaaagauauguguuugcuucuaauuggaccugaugggaaagccaaauggcuuuauggguauacgccuuuagaugacucugcaaacuaccucugccgccauuuucuggggacccggagugguucugggcaaaauccuucaucuuggcugaaugaaaaagagaaagaaagaaagaaaacaugacugguccugguuuucggcgccauguguaugagaaaaagaaauaaaaagaaaggaagaggacuggucccagguauaguggaagagaaaguuuguggauugaaagggaggcagagccacggggcagaaucuucuuggagcguccagaaugaacaugucccuagcuuuuuuaggagauggaggagagggagggaggaaagagagguaccaggugcagcagcccggguuggcauuuugucuaggcucugcccacaguuucuggcaacagccagguauaccugacucacuauaaaagggacugcuugcccccuccucacuuuugcucucugcucuucuccucuugcccuugcucccuuacucacuuccucccucuccucauuccccucccuacucuccacgugcucauggccagccacuacuaucucugccuuucucugucucuacucccucaacucacaucccuaugcccuacauucuauucuauauuauaccaucccguggcugguaccucagggggaagggaugccucagcaugagccagcaaagggacccuuuccccaacaccuuacuaugccuccaccaaacauaucccugccuucuucucuuucuuuuuauaaaauacaacagccaggaagcccaaaggagagagagaugggucugguaaccaaaaugguugaauuggaagugcaguuggggaaagguggcccaacacugagcuggagaguucaggguaggagcagaacaugccuuccaggaacgcccuggaacuggcagggacugagggaugcauggagaaacuagcagcucaugucugguuugauaugauaacuaggcacuuuauccauuugcuugcuucaauuuugacucaaaacuuguggaacugacucuugugauucucggguugaacagggaggauaauagaaccucugugauagaugaaugaaaauauauacccaaauguuugguuccaugcaggaggaaaaccaaauagccuuagaacucauggaauuugucccaccgguuagcacaaccacaucaagaggcagaaccccgacuguccugaggacuucuugcuguuguggaguuuugcucugcucaccgucuucaagaucaccacaucccucuugguccgugaguugcaugaaaacuccaaaaaggcugccagccccucacuggacaguaucauugguaucaagaauagugauugcucuuuuucaaguguugcagcuggagcagauuacugauucaaccaccacccucagaaaggacauagagcuguagauugcugguaauguccggcacucuuagaaagaauguggaaaugucgguuguaguaaaguuaggcuaagaugcuuuugcuagcggcuuggaaguagaaaaccguggggaacaauuggaaauucagagaggcacacucuugauaguugagcuagacccuuuugaugucagggacaagaacaauggcaacccagcuaauacuggcugagguggguaugccuguuuggcugaagcagcgcuggugaucaaggugaugacuaagaucuuauacccaucuuacccucagauuccugacaggauuuaauaaaaaauuguuaauaaguagaugugcacccuaaggauuuauaggaaaaaugauuuuuauaugaagguuuaaguuugugauacucuuaagauuuuuuuauaagauuacauuuuaagaugaauaauaaaauaauugccgugugucaauaauuuugagagaauuaucuugguugcuuacacuuuggcaauaucacaaguugguuaguuacaaauguauaaggguucuugagaauaauuuguuuuuauuuugcuuauccagaauacauaaaacauuuuaucaugugaggguauugggaaagauguuuuuucuuauguauagucauuguaaucauccacuuaaagaaaaauagaauauagccacauuaugaugguuguacuacuggaaagauuuugcugggacauacaauaugugugagaaaaauaaaguuguuggaucuugcucauuggagccuugcuccuaccaaagaca

SEQ ID NO: 6237 - RNA, 3055 nt, Mus musculus
ugucuuugguaggagcaaggcuccaaugagcaagauccaacaacuuuauuuuucucacacauauuguaugucccagcaaaaucuuuccaguaguacaaccaucauaauguggcuauauucuauuuuucuuuaaguggaugauuacaaugacuauacauaagaaaaaacaucuuucccaauacccucacaugauaaaauguuuuauguauucuggauaagcaaaauaaaaacaaauuauucucaagaacccuuauacauuuguaacuaaccaacuugugauauugccaaaguguaagcaaccaagauaauucucucaaaauuauugacacacggcaauuauuuuauuauucaucuuaaaauguaaucuuauaaaaaaaucuuaagaguaucacaaacuuaaaccuucauauaaaaaucauuuuuccuauaaauccuuagggugcacaucuacuuauuaacaauuuuuuauuaaauccugucaggaaucugaggguaagauggguauaagaucuuagucaucaccuugaucaccagcgcugcuucagccaaacaggcauacccaccucagccaguauuagcuggguugccauuguucuugucccugacaucaaaagggucuagcucaacuaucaagagugugccucucugaauuuccaauuguuccccacgguuuucuacuuccaagccgcuagcaaaagcaucuuagccuaacuuuacuacaaccgacauuuccacauucuuucuaagagugccggacauuaccagcaaucuacagcucuauguccuuucugaggguggugguugaaucaguaaucugcuccagcugcaacacuugaaaaagagcaaucacuauucuugauaccaaugauacuguccagugaggggcuggcagccuuuuuggaguuuucaugcaacucacggaccaagagggauguggugaucuugaagacggugagcagagcaaaacuccacaacagcaagaaguccucaggacagucgggguucugccucuugaugugguugugcuaaccggugggacaaauuccaugaguucuaaggcuauuugguuuuccuccugcauggaaccaaacauuuggguauauauuuucauucaucuaucacagagguucuauuauccucccuguucaacccgagaaucacaagagucaguuccacaaguuuugagucaaaauugaagcaagcaaauggauaaagugccuaguuaucauaucaaaccagacaugagcugcuaguuucuccaugcaucccucagucccugccaguuccagggcguuccuggaaggcauguucugcuccuacccugaacucuccagcucaguguugggccaccuuuccccaacugcacuuccaauucaaccauuuugguuaccagacccaucucucucuccuuugggcuuccuggcuguuguauuuuauaaaaagaaagagaagaaggcagggauauguuugguggaggcauaguaagguguuggggaaagggucccuuugcuggcucaugcugaggcaucccuucccccugagguaccagccacgggaugguauaauauagaauagaauguagggcauagggaugugaguugagggaguagagacagagaaaggcagagauaguaguggcuggccaugagcacguggagaguagggaggggaaugaggagagggaggaagugaguaagggagcaagggcaagaggagaagagcagagagcaaaagugaggagggggcaagcagucccuuuuauagugagucagguauaccuggcuguugccagaaacugugggcagagccuagacaaaaugccaacccgggcugcugcaccugguaccucucuuuccucccucccucuccuccaucuccuaaaaaagcuagggacauguucauucuggacgcuccaagaagauucugccccguggcucugccucccuuucaauccacaaacuuucucuuccacuauaccugggaccaguccucuuccuuucuuuuuauuucuuuuucucauacacauggcgccgaaaaccaggaccagucauguuuucuuucuuucuuucucuuuuucauucagccaagaugaaggauuuugcccagaaccacuccggguccccagaaaauggcggcagagguaguuugcagagucaucuaaaggcguauacccauaaagccauuuggcuuucccaucagguccaauuagaagcaaacacauaucuuuacguacuuccugcuuuuguacccaacccucccccuuaauucaggcaggggcaugcauguuuccucacuuaccaacugggggcaggcuccuagaagaaacuuccaugccgauguuucaauguuucguuuugguaacacaaacuaacaggcagccacgaaaacucuugaccaaacucaaugcaguaaagagugcauuuuauacagggcuuuuaauaugaaguuuccucccccccccccccaucuaauauauaggcuaacuuauaauuggauuuuuaaaaccuucagguuggauuuuaaaguuagccuggaugcggaggaaggaagggccagccaggcgauacagagggacucaugugagccuuguggcagaaacuaaaaccacaugcuggucuccuuguccuuucuugacagccuucagggagggugacaggagcgguugcaggaaggaugugauaaaucucacauacauucaaaacauuucucaggccucaugguuauuuucuguguuuccuucucuugcucuccaugaucugaggauauuguuccuuccgcacuggucaguuucuucuaaagaggccccccgugugauuucaguuauauagcaggacuuucugacccagaagcaguacaaaugaugacacagaggcuaucggguauuuuaaagcuuaagccuauagcugggcagauuuccaaccaacuuucuaguucaucccgauuuguccuggcauuaccuuccauguguggccagcucugcgucucugcuccuguucagguccaucuuucaucuccgaggccccaggcgacuuuggcgccuuugcuuucuuuuucc

SEQ ID NO: 6238 - RNA, 6371 nt, Mus musculus
gaugguugugcucuuugugagguuaagcagaauugccucuaacuguguagauccuuuuguaaugacucugucugucuuccaggaaaggacuucaucugggaaacagaggcagugauuggaaaacaaacaucauuguugaucaggacacagacuaugcugaacugguucuguuuauuggagaaaucacacuuggagagaaaaauaggaauucaaugaaagauauucaacugagaagaaaagaagccaaaaguauauuacaggcugugugcacccagcugaauucuggagggggcgugaucaaggcucacauuaaaaaucaaaacuacagcuucaccagagauggaaugggacuggauuugguaaauuccuuacccgguaucgugcaccuuccucaugacuaucuagacuucaugcagcacaaagacuacuuuuucauuuuugugaaaccauggaagccaaaucagaaagguccggggaucaccaccuugaaaacgaacuuguacaagagaaucuucucauucucaguugaacugaaagcagcgaaugcagugcaguuccucaaauccagaccaaguucccauggaaaaacagucuguaaugaaacacuaaaugaaugucuuuccuuauuuaacagagacuggcuugccuauggggagacauucuguuucacuaaauccacacaugcugaaguaaaauugacuccuaaggaaaagauuucuccuaaggaaaagauuuuagagcuccuuccucaaacuguuucugcauuuucaaacacugaugggggauauuuguucauuggcuuggauggcaaaacccagcaaauuauugguuuugaagcacagaagagcgaucucgugcuucuagagagugaaauagaaaagugcauccaacagcugccugucacucacuucugugggaagaaggagaagauaaaauacacaugcaaauucauugaagugcacaaauccggagcugugugugcauaugugugcgcgcucagaguggagagauucugcugugcaguguucgcugcagagcccgaguccuggcacguggaaggcggcugugugaagagguuuaccacagaggaaugggugaagcgccagauggaugccacagcagguagagggacggagauuaauaaucaguuuacauugggcugaggggguuggaagauugcuuucugggcuugggcaaccugaaaacuccucacauacuguaagacccccuuuuggggacccccacucuagucucgggagugagagagcacccaaagaaacacuagaauccaucuugcuguaaucacaugaggcaguuuaaugacggagcucggaaccgacaugcaucccacacaggagauaacggauaucagacaagaggcucggaagcuagggguuuuuauggggaagggugcuuaggaguguggaauucagcauagcaacacacuauuggcuuauucaaacaucagcagaaaaauuacauguacgugcagggugucagaguucugugaguuguuaacucaguucccauagcccuguuaugucaucacauuccucuuuaucuuauggucaagcuguucccaggaauguuuuaacuacggggcauacccggguuuguuuuucuuguuuuucucagcccuaggcagccucuaggcuuacaaacaaccagcaauuucugaguacuuuauaugacuuacaggucuugaaauuucaucuuucuuucauuccccucuucuucuacuaaguaguucuaaucuuagaauuuuagaagucuauaucucuaugugaagaauagaaaucauacucuucuucugucuuaacuauagguugguguugacgcuggaggaccauaagcuauacuguaucuuuaacaugggaacaaaaacagaauaagaagggauaguaaacagaacuaggcagggacccuucuagugaggcuugagggucugggcaugauguauguguauguagaucagaucucuggcuggaacuggugagaugucuuuggggcacccagcuuauucacuguagccaguugugacuggacuucuuucugcaucaccuguaagcuuuuuaacauagcauacagauuauuauuacaacaacauagguuuaaacacaucauuuaagacaguuaugggcaugggagccccauaaaggaucucaaaaagaguaagacugaaucaagagggaguauuucuaguuccaaauagggcaaggggaaggagcaccaagucugugccagucuccaugguuaauuuugucaaggucucuuuuagaguucuauucauuuuuucuaucuguccugagcucugaggucuguacacacaauguaauuuucauuugaccucuaaauacuuggccacacccugacuuaccugggcaauaaaugcagggccauuaucugacacuauuguuuuuggcacuccaaaccuuggaaauuuuucuuuaauaaucuucuugaugacuaucugagcaguuucauuuuuacagggaaaagcuucuauccagcuugagaauguucacaaaaaccagaagguauucauacacauauuuuucucaguaaagucuauuucccaguagaugucaggucugucuucccaugggaggacuaguuuucuuucuucaguuucuacuauuccauacaggguuucuuuuaucagucuuaauuugucuauaacuugauagucuucagacugucaggaucauugcucuuugggaugccuguuuggugguuagaucugccaucuaauuucuuuuagccacagcaucuuagaucuuucucugcagaugucaacagcccucuuugucuguauauugcuccguacaguggcaaaagcauaccuguugucaguguagacuucucuuuugacauuuauagagcuguaucaaagccacaaauuuagcuuucugucuaccacugcacugcugucccagccuuccacuuaccuucaaccgcaaggcuacugccauccguguaccagcucaaacucuaaggccaaggcugaucugauccuucagaucauuucgaguaucagugucuucugccagaaugucagagcagugauaaguaggugaagucucaggcaguagaauagcgagauugaggacaguagggggagugaaggucacuaguucagucaacaaaaagcucugauaauguguccaucagucaggggaacgguugaauaauguuuucaagagcguuagucagccaucggccaggggggcugaaccacacuuucuagggcaugugccaaguuuugucucagagucaauuuaucuguguccuugaccagaagccacuaugugcaaacaagcaggccauccuacagccacaaggucuaauuucuuacaaguaugccacaggucuuuuccagggucccaaucucugaguaagaaccucuuuggcaauacuuuuguucucagucacaucuaggagucccaaagcugggaacaacauuagggcagucuuaauggcauccaaggccuguuguucuuuauuucucuauaugaagggcuguuuaucuguuuaauucagcaaaaucugaaauacacaaucugcaaaagcccacagugccuaggaacuuuucuaacuugcuuugaaaugguuggugggggaauaugaaacacagucucuuuucuagcugcuucaacagguaggccaccggccucuucuaaggacucagcuucuguguuagcaccccuuuugcuaucucuuuccuuuuagccacgaacaggugaaggguuuggucaugaggaggggauccucuucuuuuuguuggggcagucucucacucagugcccuuuuucuuuacaguaaaaacauugaucuuuagccaaacgcuuucuuuuguugccagguacuaucuaaguuuucuaguuuuccugacucuuguggccagcauuucauuuaaguuuuucucuugucucuuaucucuuuuuaauuuuuuggcucccuguuucuuacagaucauuucuaagugccagcauuauuagcaugugccacuuuuccagguucuagucuuuguuauuuaccucucuuuguuccuguuuccuaacuguaauggagaucucauauaacguuuuauauaaauauauauauauauauauauuugaaugaauauaugagagagauacucugaaugagaaauauuuagaggaggaaccaguaaauaagagacagacaagaagaagaguuaaggaaacaugaggcugacaaagacagagaccagagucagaaucauauauauauauauauauaugucuuuuuguucuuccuccuugucuuugcuuccuuuggauguuaucuaauuaucacaucuauauccugucacuuaucuucucucauaguucaccucuacccugguuuaucuuucuuucucacugcacagcucugauucugacuucacaacucaguucuucaccagacugcauuuuuuuuuccugggcuuaacugauguuaaaggaaaccaaacauggggaauuuucuuaguugguagaaugcuagccuagcuuguuagaaacccuggcuucacucacugugcuacauaaaaccccaagacuugucaugaugauccacuuaugauccacagucuuuggaacuggaggcagauggaucagaaagucaagcucaugcuuggcuacauaguuugcugccacucugggcugugugcgacccugucucauuuuacaaaaccaaguagcacaaaguaaaacauauccacuuaauuaauacauugaacuaguauuaaugcacaucuuacuguuacuuuuuuuguauuuaggguuguguagaggacuucauuaacaucaaaguguaauuuuggaauuuguauuugacuucaguucaacugagacuuucgaugcacuugcaauaguuauugaauagcaugcccuauggaaauuuaaaauuaccuuugucuucucaggucuuuccagacaagacaaauacacucuucaaucaagcagacugccacacagucccuuuagcugcuuuccuuauggcaauccuaaugcugcucaacagagugcucaccuuccagguaguuucaccguggcugccuagguugguugcugugacuuagguuccagccuccuugcucaacugggcucugaggugaaagaugucuccaagcuccuacacugggaguguuacuuguuuucaugucccuccaguaacuugguuuacacacacacacacacacacacacacacacacacacacacacacaaaacaccuggcaacaugugacauucucaccauaaggagacaagcaaaaggaauuuccucugugacucuaaucugucaguagaagaucccuucgaauuccuuuacuaaauacaagucuuuaaagaacuguaugcuaucuuauggcugggacugccagucuguacucaccagggaagucuagccucccuugugauccacucugaugcauccucuaccccaucccuggagcucuggcaaugugcucugcuccccgcuuugcucuguggagccuccccauuucuccaugcuuuucuccuguuucaucaccugacuguucuguccucaacauuagccuguccuuugcuccccugauucuucucauccauggaguuccccagaacaagccucugagacugugaguguucagcugcuuccauggcucccucuuuggcaguuugaguguccaagucccccuucaucugccuccuuccaguucuugaaucaguguuugguaucuuguguucaccuucucgguugggcugcaaaguguggaauuuacaaacugcuugguuaugugucauaccugacauuccaggcauuuuacuuuuuuaauuuguuauguuucuuuucuugucuagagaugccuggaaaggugauaugcucuccagaagcccucugcaugaaaccauucucacuacaugaaggcuaugagcaguuaguccggacagaguugggcucacuuagaggaaaacugguugucucuaagagcuuggcuauggaucugggcuugcaagagaagcagggagucaucugggaugcacuucauauuucccaaggcagucuccugacccugcauggcuuuguccggggagaugaggaccuggaagacaacagcauccuucugggggaacuaggcgcugaguuaaagggcuauuauaaacaaacugcccuaacacuaaagcauacacuuguaaaccauagugauuccccuucgaaaauagguguuauagucaagauaauguacuugggucauaagacagugugucuuuaugauucaagcucaaaaauacguuacccccaaaaauauuaucugacaaucaagacaguaagggacuuagagaaggcuuugcugaaguccuguguaacauguguagccuaac

SEQ ID NO: 6239 - RNA, 3024 nt, Mus musculus
ugccucuaacuguguagauccuuuuguaaugacucugucugucuuccaggaaaggacuucaucugggaaacagaggcagugauuggaaaacaaacaucauuguugaucaggacacagacuaugcugaacugguucuguuuauuggagaaaucacacuuggagagaaaaauaggaauucaaugaaagauauucaacugagaagaaaagaagccaaaaguauauuacaggcugugugcacccagcugaauucuggagggggcgugaucaaggcucacauuaaaaaucaaaacuacagcuucaccagagauggaaugggacuggauuugguaaauuccuuacccgguaucgugcaccuuccucaugacuaucuagacuucaugcagcacaaagacuacuuuuucauuuuugugaaaccauggaagccaaaucagaaagguccggggaucaccaccuugaaaacgaacuuguacaagagaaucuucucauucucaguugaacugaaagcagcgaaugcagugcaguuccucaaauccagaccaaguucccauggaaaaacagucuguaaugaaacacuaaaugaaugucuuuccuuauuuaacagagacuggcuugccuauggggagacauucuguuucacuaaauccacacaugcugaaguaaaauugacuccuaaggaaaagauuucuccuaaggaaaagauuuuagagcuccuuccucaaacuguuucugcauuuucaaacacugaugggggauauuuguucauuggcuuggauggcaaaacccagcaaauuauugguuuugaagcacagaagagcgaucucgugcuucuagagagugaaauagaaaagugcauccaacagcugccugucacucacuucugugggaagaaggagaagauaaaauacacaugcaaauucauugaagugcacaaauccggagcugugugugcauaugugugcgcgcucagaguggagagauucugcugugcaguguucgcugcagagcccgaguccuggcacguggaaggcggcugugugaagagguuuaccacagaggaaugggugaagcgccagauggaugccacagcagguagagggacggagauuaauaaucaguuuacauugggcugaggggguuggaagauugcuuucugggcuugggcaaccugaaaacuccucacauacuguaagacccccuuuuggggacccccacucuagucucgggagugagagagcacccaaagaaacacuagaauccaucuugcuguaaucacaugaggcaguuuaaugacggagcucggaaccgacaugcaucccacacaggagauaacggauaucagacaagaggcucggaagcuagggguuuuuauggggaagggugcuuaggaguguggaauucagcauagcaacacacuauuggcuuauucaaacaucagcagaaaaauuacauguacgugcagggugucagaguucugugaguuguuaacucaguucccauagcccuguuaugucaucacauuccucuuuaucuuauggucaagcuguucccaggaauguuuuaacuacggggcauacccggguuuguuuuucuuguuuuucucagcccuaggcagccucuaggcuuacaaacaaccagcaauuucugaguacuuuauaugacuuacaggucuugaaauuucaucuuucuuucauuccccucuucuucuacuaaguaguucuaaucuuagaauuuuagaagucuauaucucuaugugaagaauagaaaucauacucuucuucugucuuaacuauagguugguguugacgcuggaggaccauaagcuauacuguaucuuuaacaugggaacaaaaacagaauaagaagggauaguaaacagaacuaggcagggacccuucuagugaggcuugagggucugggcaugauguauguguauguagaucagaucucuggcuggaacuggugagaugucuuuggggcacccagcuuauucacuguagccaguugugacuggacuucuuucugcaucaccuguaagcuuuuuaacauagcauacagauuauuauuacaacaacauagguuuaaacacaucauuuaagacaguuaugggcaugggagccccauaaaggaucucaaaaagaguaagacugaaucaagagggaguauuucuaguuccaaauagggcaaggggaaggagcaccaagucugugccagucuccaugguuaauuuugucaaggucucuuuuagaguucuauucauuuuuucuaucuguccugagcucugaggucuguacacacaauguaauuuucauuugaccucuaaauacuuggccacacccugacuuaccugggcaauaaaugcagggccauuaucugacacuauuguuuuuggcacuccaaaccuuggaaauuuuucuuuaauaaucuucuugaugacuaucugagcaguuucauuuuuacagggaaaagcuucuauccagcuugagaauguucacaaaaaccagaagguauucauacacauauuuuucucaguaaagucuauuucccaguagaugucaggucugucuucccaugggaggacuaguuuucuuucuucaguuucuacuauuccauacaggguuucuuuuaucagucuuaauuugucuauaacuugauagucuucagacugucaggaucauugcucuuugggaugccuguuuggugguuagaucugccaucuaauuucuuuuagccacagcaucuuagaucuuucucugcagaugucaacagcccucuuugucuguauauugcuccguacaguggcaaaagcauaccuguugucaguguagacuucucuuuugacauuuauagagcuguaucaaagccacaaauuuagcuuucugucuaccacugcacugcugucccagccuuccacuuaccuucaaccgcaaggcuacugccauccguguaccagcucaaacucuaaggccaaggcugaucugauccuucagaucauuucgaguaucagugucuucugccagaauguca

SEQ ID NO: 6240 - RNA, 2941 nt, Mus musculus
ggaugcaggcccgaagaggcggaggggagaggacgcgggaagccagugugccccggacgcaguguccuagcgcucaucgggucauccucugcagcccagauugucccuguccaagacugcggaaugaagaauccagguugggagccgauugaagccccgacuccguccucaguccucuuucccuaccaaggauggcuucaggcucccgaaguuggcggguuuggacuuuuaucuuuuuuuuuuuuuuuuuuuuuuuuuuuuuuuuuuugcuuugagaaccuguguguaaguccucucuggucagcaaaggaaucugugcagagcgccaugaauuagaggaugggggaaugagugcuugaagaugcccgagguaugguccuuauccgugugacauuuggagguaagauggcguuauaaauugugcucaugcauuucuaauuaaaagccaugggauuaggcuuaccaaggucacuuaauugaacccuuuuguuccaggcuguuaacacgcuuccccaguucuuuaggaacucagugagauggggcuggugggagagaugggggaaaacucgugaacuggcgcauaguuggcacaccaguugccaugagaugagugcugugaggcagagaacuagguaccugcuggcauggcaggaacuuggaaucagguaccaccaugucugucuggaucuuuaagcggaaucgguuucacaaacuuugcuucuguaauucaaagggcagagccuuccuuugggauuaaucgagauaagguuuccuguguaaaguggcagcaguauggagaggcagagcugacagcaggaaggguuucucuggggcaggggaacacaagcucuaauaguagauuugagaacuuuaauagucuagguuggguagucuguaagauucguuaggauuauguuauuaacuaguuaagggguaaauggguuauuuugggguuuuuauuuuguuguuuuuaaaagauuuauuuauuucauguauauggguacacugucgcugucuucagacaugcuagaggaggcccauuacagaugguugugagccaccaugugguugcuaggaauugaacucagaaccccuggaagagcagucagugcucuuaaccacugagccaucucuccagccccuuuauuuuguuuuaaagacagagucuguauagcuagcccaccauggccucaaacucaggauucuucugccccagccucccaaagcaguaggauuacagguguaaccaccacugccccuggcuugauuuuuguuguuuuggagguuguuugguuguggugauggucuuucugggaauugaccuaaggccucauucauuguuuugaaaucccuugaauaccacaguaguuuguauauuauuuccuggaccauggggagaaaguggaugcuuuagugacugaauuacacuuuuauagguuuaaagucagcauauauaugugcuggaauccagggaaaacagaggcagaagacccacugaaucacaguguugugaaacagaugagcuuuaaaucaguuauugacccuaugcaagagcagccagugcucugaaccacugagcuaucucuccagugccuguaguuucaccuauuauuaguaaaggguggauguugagaaguuagagauggaaaaauagaaaccugguauucagaccuuccuaauucugcuauuaagugguauagagcuuuagaagacccuaaccucucaagaaguuuuuuuuuuuuuuuuuuuuuuuuuuuuagguuuccuucaagcuauuuuuuuaaauuagguauuuucuucauuuacauuuccaaugcuaucccaaaagucccccauacccugcccuccgacuccccugcccaccuacucccacuucuuggcucuggcauuccccuguacugacucucaagaguuuuugacugaaauuaggaguuucugguaggaaaaaaauuaugauguagagcuuugcuuguucacuguacacuuuccuguguugcucaggacuccuuggcucccgucuuacccacuggaguagcuggaacugcaagcacgagucacugugcccgacauugugacuaugucuuuuaucuuccuuggcaguugaauucuauguuaaauggauaauaggaaaucuuuucuacagcuacuacuuuuuuagacuaugugucucuuaacaaauaucccuaagauuuugucaaaauaaauggagguuggacucauguaaauaacaacaaaaccuuuuuguugcuguuuugagacagggucuuguuauguagcucugagggcuguccuggaacucacuguguagaacucaaacucacagagcuccuacagccucagcuucccaagugcugagaucaaagaugugcaccacugugcuuggcucuaaaaacuuuuuuugagugauaaaugcuucuccacucuguguugugaaaacaaaaaagcccccuacccacaaaaaacccaaaaacuuguuuuaaguuuuuuauuauuauauagcaguuauuuaccacauaguggaaaguauugaaacuucaaaguugaagcaugugagaguagcuuuuugaguguguaagccuacauuugacuggaugugaaauggagccaugcaaugaugagcgaaguauagucugaccugguauugccauugcuuuggcgcuggcucugaccagggugugaccccuuaaucuucucucugagcugauucugcugaccacauggggguauuugaaccuauguggauccuggcuuauaauguguaagaguauuucuuuuguauccuuugaauuacugauacuuucauguuuuccuucuuagguccaggugagaaaucaggguugaaaacugcauggaggauucaucauuucugcccugaauuggaaucaauuccuuauugacuuauuauuacuguauuaaaaguguuuuuaauuaaccaugguau

SEQ ID NO: 6241 - RNA, 4743 nt, Mus musculus
ccuugcagaggacucugagacagcacaugcaucucccacagccucugccgcggguaccaugaagaucucugcagcugcccucaccaucauccucacugcagccgcccucugcacccccgcaccugccucaccauguaagucgaggguucugaccaucacagccccacucugccucgaugccaacccaucuugauacccagaccuccccuucuuuccaauccuacuguguaugcugcuguacauucuuacgcauccuugacacggcuacccugucaucacuguuagaugucuuguauacuaauggcaggauccucugaggaacuuuucugugucuucaaagaugauauuaugaauucugcaggcacuccuuauugugaacuggugccgggcugaccuuugaaaaaugacuugcucauaucugucaccagugugguuucuaagaaaugugugauacuguuuuagguaggauggucuuucauuucauagugagaaaagaaauggggcuugcaaaauaaauagguagauagauagauagauagauagauagauagauagauagauagauagauagugaacuaaguaccuaccgugggucaggcacugugcaaaugaguuuaaugugccauccuguuuaauacaaauagucuuucaguaguugcucuuguguugcagugggaaacagaggccuaagaacacugagauucuugucuaagggugcacacugcuacaauuguggaaacugguauuccaaaagcccuaucugacugggaagcuaagcaccacagcucugcugugggaugaauuaagugaccaccaagagcuucucuggucagagccccucgcuacaggccagccaggucccaggaugcuaugugcacuuucaggccccucuuaggaucgucacuaaguuauggagcuucggcuugggcacucccccagaacucaugcuacaccucgaagacaccaagcuuugaauccaccaggggagcucugaaagcccugcuaagggcagaaggcacagagcgaggagagggaucccagcaggggcuuacgguacagagcacaaggcacaggcuuggcucacggaccagacaaaacaggcuucuguugaacucuccaccauggcaaauguguccucugagccauuucugccaaggucgacaacgacagucacugcuuuuaagauaaaucguguaaagagcccagcauagcuggcaaugaauaaaaggguuuccuuucuuccuucucccagauggcucggacaccacucccugcugcuuugccuaccucucccucgcgcugccucgugcccacgucaaggaguauuucuacaccagcagcaagugcuccaaucuugcagucgugugagucucagccccauggguuccucugugggguauagaagccaucccacaaccccgccgugauccuucucaggggugcccccucucacucccacucacucucugggcuccucuaauagcuauggcuccucgucuccagcucagagucuccaacuguaacauuaaaggacuagacacagggagcccuagagcagcaguucucaaucugugggucggguccccuuuggcaaaucucuaucuccaaaaauauugacauuacaauucauaacaguaacaacauuacaauuaugaaacaguaacaaaaauaguuuuaugguugggggucaccacaacaugagaagggccgcagcauuaggaagguugagaaccguagccuuagaggcuccugccuauagagauagacacaguuccuaggacaccaaccuuugccuaauccucugaggaacuagggaggauggaucaaggucaguucccuaauuucaaucaaguaaauaaaaucuaaaacccuauccauuuaagaaguuauaaugagacucagcuuuaaauaugcauauugauagauuuggggaauauaauagggugcuugcuggcauguugugucuauguguacugucucuaaauugugcauagcccuggcggguaugcacaaauuucuccacguaaugaaacagauucagaggcauuugcaggccuacucaaagcugcacaguaagugagggaugcagucugucucuggaccuacuuccuguauuaaaauaaagucauuagugacaggauagcuuaagaagcuuaagaugauaacgauuuacagagugaaaacggagagcuggagagauggcuccaugguuaagagcacugcuugcucuugcagaggaucaaccuccaucccaacauccacacguuggcucauucguuacaagguggcucauucguuacauggugacucacucguuacaugguggcucacucguuacaugguggcucacugguuacaugguggcucacucguuacauggcggcucacucguuacauggugacucacugguuacaugauggcucacucguuacauaauggcucacucuguaacuccaguuccaggggauccaauacccucuucugaccuccucaggcacacauguggugcacaaauacaugcagaugaauacucaucuacauaaauguaaaaaagaaaaagaagaaaucauaaaguuuccaauaaaagguugaagaguuuuaauccaaugacuuuuuuuaacccuggcaaagaugaacuucaguguaauauuacuauuuaauauuaccaaauuuagcucuaaaauaaaacuuuuuaaagaaaauccuuccuugagaaccuauuaugagccggcagagaugaauaaaauugucauccuuggcuauggaaauuucaucuaguaagacugauaaguuggacacagaaugaucuacggcacccuauaaaaccauacuagaggagaggagggggugugucuagcuucaagggugaggcaggugauuacuguaaaaagaugcuauuugugucaagauuaggaguagagaagugugugugacauggguguaucugaugugugugacacggguguaucugagaacacauggacaccuacguugguuuguagggacauauguaggaaagcagagggcaccucaagugucaggaaacugaagcaaaaccuagagcuggcaagaguaaaaugaccagguccagacaaagccuaggagggggucuggagaagaggcgguugaagucacccacacguguacuauugucagcagaguggugguaccuggaggccagaagaaacaagagucaggagugugggaggaugagucagccagagugagggacuuguggucaggagcaaggacagaagagaugcagaugcugagguucccagucagagacggagaggugugcaggugugcaggucuagagggccaacuguguaaagaggaaggaaccaagcaaaguuccagcaagauaauccauggagaugccagauggagugcaacccaagggcugaagacagaguccaggaacugccaauaaaagaggcugggcaacauugucuuagucauccuuggccacccagcuggucugcaugcuagaauccuaguuauguuguuugauaaacuggggccccucaaccucucugagguaguuccaaaagaggauaauuaaggcauuucuuucacuaggacacagaaaaaaaaaaucacuuagaccauucccuggcacauaauggguauaaagaaguaucaacuuacuauugauauuauuugugugucugugugugugcgcacacaugugugcacaggugugugugugugugugugcgugcgcacaugaaugcauacaugugguaagaaugaaugaaugugauucuuucauccagucauucauccaauauucaccaagcaucaacuauaugcaggccuggggccagagauuggaaaagggagaagguaagggggacaauuucuuugaggacaccugcucuuaagagacagguggaaggggaagucagaugaacagaggcuccaaaaguggaggaaagaaggaaagacuuagcaaaggagauuuguucuuugguaucacauacuguauaaaggacggggaaaugggggccugagcaaucuugauagcuggaguugguauccuagccuuuugacucccuggcuacaggcuuagaaugccaagagcaacaacuaggcagucuuagaguucccucuuaauuuccucaacucaacugauuuaagugaaucaaacgcaacgucucuaaauucgucacucagcauaaggccuggagcaaggaaaggggccaagaaaaggccagagcuuggccugcucaaugcuggguuccaaaucuguguguuuguagggaauuaacccaaauggaacucugccuguagcucagugccucugguuccaaaggagaagacuuacccucuaaaaggcagaaaacaguauggagcuacaaaaacgcacuccccggcucuugucaccuuuaugcuuuuccgugcccguacaccaaacgcugccccaguguugaccuuccucucuccugcagguuugucacucgaaggaaccgccaagugugugccaacccagagaagaaguggguucaagaauacaucaacuauuuggagaugagcuaggauagaggguuucuugauucugacccuguauagcuucccugucauugcuugcucuaguccuagccagcuuggggaugccacucaguaauccccuacucccacucgguccugggaaaaugggcaucucagcugcuccgaggcucugcacagcaaacccaagaaaucagcauuucauuaaaauuucagaugcaaggacaaag

SEQ ID NO: 6242 - RNA, 5218 nt, Mus musculus
gaacuagccuguuguguauuauguagccagggacagcauucugaacucuacccuggcacuuccugaaccuccuagcuuauaaauaccagggcaggccagagaaucagggaggagugagcaaaaauucucagaccagcugggccuguccuccaggaggaugagaaacuccaagacugccauuucauucuuuauccuuguggcuguccuugggucccaggcuggccucauacaaggugaguucacuugagcccucucaacccagggggcaagucugugagaccugcagaacuggaggggagcuagagaaggagagcacugcccuccuggaaauauuccauccuugacauggugauggaauucccuaagaagcagcaucaaguuauagaucugccucuguagccuuuaggcucugaaagaaaugcaacacagaggcuggcucccacuuggggaaauaauuaugcuugacgaguuuauuuagcugacacaggaccaagcauuaacucauaagaauaggaguaaaauuauaagugggaggguagcagucuugcaggaggcaugaugguugaagugucugacaccaccucuacaaagccaucauuuugaagaagugggacaggcagguaaucaauucaacccaagaccauuuaaccacgcuguucuuuuauuugacaagugcauuagcuagugcuucuuaugugcuggacagacagcuacuguaggguagaugucauacuaaacaaugggaaguugcauauuuuuuuuuguacuggaaaacaguaagccaucaaugauuuuguauauuuucccucacuaucaugguugcugucauuuuauaaauaagaaaacuauaucagaaguuuaagauuaaggcuagugaguggugggauuaggguagggaccagccugggauggaguauagaaagauauagucauuugggaucuuuucuggguuuugcaaggucuaccuagacccaugaaguaugcuacaauguaucuacaugccuccuuagaguacgccauacuaauuacaccauuucuggguguccugggacccuagacccauguggauaucaaaauccacagauuucauaucuauaacccacacacaucuucaucuguguguuuaaaaaaaaucucuagauauuuuuaagacuuaaaaccacuuaaaugucaguaaacagucacuauauuguuauccagggaaucauggcaaaaagucucuaguguuccaguuauauuucaggaaauguuuucuugguugacucuguggauguggaagcuccaaagacguagaccaacucuauaaaagaaaucagcuaagaacaauggaagaugauugcuggauaaguugauagcuuaauccuuacugccaaaaucauucauuuuugcuuugguauaagaagugaaugccacuauuuuaguuagacuuauucuguuuuuaugcaugcacaugucugaguaugugcaugcacaccugugugcaaauagaugccuuuggaggacagaagaaggugguggacccccuggagcuggaguuacaggcaguauaaaccaccugacauggaugcugagaaaugaacucugcuccucuguaaaagcaaaagugcuuuaauuauugaaccaucucuccagccacuaaggaucaacuuuuaaagcuaucuguuuaucugugauaacauaacuaucaguuagaagaaaagggaaauugggagggagaaaggaaaggagaaaggagggaugaggggaaaguaaaagggagggagggagaaauaaggagggaagguuguuugaguugcauuugucuaauuaucacaaggcagguuuacaauacuuuauccagaaucuuuggcgcuaugugaauuuugcaaugcauaaguagaguuuugauaaguuaacaugacacacagcaauaucauuauugagugguagcccugaaaauucaaaauagauacauagagagauuuucaugcaauuauuuucauucgcaccacacaaaagaagaaacuacauacucaucaguagguugaguguguaaguaaaaugugacaggcacacaucuccaguggaauaguccucaucguugagagggaaggcauucuggugugugcaaccaaaagcaagaacacugaggagcugguaucaccagaggaauaugccagucaggaagggcagguacugccuggcuccauucacaugugccucuuaaaggagucaauuuguaaagacaaaagagacacagaggugccugccuguaacuccaacuacugggaagcuaaaaugaggaucaugaguuagaggucaguuugagcaacacaauaaugccuugucuuaaaaaaaaaaaaaaaucaaaccagggaguacaauggugcucacuaagcugacaggggaagaagcagaaagguaacauugaauagguucuggguuuccacucugcaggcuagagagguuaugacuggaugggguaguaguuacacagcaguuugaauguacuugauacuauuaaacuggacacuuaaaaaauuacuuagagccccagaaccuauguaaagguagaaggaaugaagcugucuucugauuuccucuugcacgcacgcacguacacacacacacacacacacagagagagagagagagagagagagagagagagagagagagagagaggaggcuugagccugucucuuaugccagauacaaucuaagaaacguaguaacaaaauaagguuccuacaauauccuuauacuaaugggacaaacauaguuuaaaaaacaaaacuucacuacacuaugaaggacaucauagcaccaaauggguugcuaagaaauuuguuucuagagucccauagauggcagauguguagacacaacuggccuaugacaaacugcacuuucaguuaacuuaccuguguuagguuugcagcucaucuuuaguacuuuagagucaacagaauguuuuuauuucugaaauauuuucaaagggucacaggguggggaaaauuuuauaguaacaagacacacuagccuggagcagaccuuugacccagacggguuaacagagauccaacaacagaaccugcuaccuucaaaugggagaaggggagucaggcauggaggugcacacaguguucuuagcacuccaaguuuggugcuguagaauugauaguucaggccacccugggcugcaagaucuugcuuuguucaccaaaaccuaaggguggaauauguggugagugguggggcgauuauaauacagcaaccaugaauuuauuuucccaccuuuucuguuucuuccagaaauggaaaaagaagaucgucgcuauaacccuccaauaauucaucaagguaaaugaccagauaugacauguuuaaaggagcuggguggauaugccauuauagcuucaccuccccccauggcagaacaggauggaaggguccugaaggugcugagcaucucuggaaagagugagaugugguauagagacucaccccagugaugccuucucugcauauaccuggguacccugaguccaccugcuaagaacagaagcaucccuugaguucuaacccuucucaauuuccaugauacacuucuccccacgcuccccacacacacacacacacacgcgcgcgcgcgcgcacacugcacuuuugagagcaauagccuggccauuugucuuccuacaggcuuucaagacacuucuucagacugcugcuucucuuaugccacacagaucccauguaaaagauuuauauauuauuuccccaccaguggugggugcaucaagccgggcaucauguaagugucaaacucgcucaguguguguuauggggagggggagccuccaggaucuuaggugaccugguggauagacuuccagaaaaggccaauccuuggaucucaccagguggcggggggugaggggguuuggggggagacuucaggguguagagaaggagacagcugacagagucacuccaugaguccuuagagacccucacaggucuagaggggaccccagagaggggaugauggugcugagcuaccuccuggaaagaacagacuguugaguggaaaaucagaggguucagaagauggggcucccaccaccccuuuacuagagaacucugauuauaaucuuucuucucccuuuuucuucagcuuuaucagcaggaggggaacccaggucugugccgaccccagcgaucggagaguucagaggugccuaagcacccugaagcaaggcccaagaucugggaacaaggucauugcuugagaaggagggcaggcauugucacccacuuucuucugucuuccccagugaccgccugccuaggagaccuuguuuuuauagauauuuaaagcauuuauccuucuguucagguuuagagcagucaacaguauucauguggacuccgccugacacgguuagagccaucuggaguuguaaacaucaagauugucuuugaguaauuguuggguuuuuuuucgguuucucagcagauuauaaauggauacauuauuaggguagucuuuggggcuuuggaaugugucugguucugauacaagcuuaagccggguaauaucuagcugagaugaaaucaauuuugcccuaggccauacauauguccagcuuuguggguucccaguuguucgcccugccacaauagagcaaugagugcccccaauaaaguccacuccauguagccacaggacugucucuuucuucagauucauagaacuacggggccagucugaaacugggcucuuggggugaaauuaucucacucacucaccuugaguacaggagggagaugggaccauauaacuuugaauauucuaaaccaaaagacaucaugguauaauuuuuaaaaauuaagaacacgguuuauuccucugagcuuggugcaaaacagaggaauaccuuuuccagcagggcgucuucuucucugccugacuuuuaucugcggaaccugaccuucacacccucuaccugaggaaguucagguaguuguuggcaaaucuacaaguaagaaccugcacaccaaguaucugggauuccuggaaugccucuccaugcaaaugaggcauucccaguacuuuaaacuucaucuaguaauuuacauuuacccugaaaacuccuuccuauacuccaagguucauguauagcccugguuuaccccaauaaaguguaugcacacaagcuguuucacugaaaau

SEQ ID NO: 6243 - RNA, 873 nt, Mus musculus
caggaugaggcgcgccgccuaccucgggggccacgccgccgcccucgcuguaguucucggagaugagcuggucgaagagcaggugaaucuccaugcgggacacggugcugucauccggcugcagcgcgcggagccuggcagacaagcggcggaacccaucguccugcuccggcgacaguucccgcggggccucucgcggcugcccacaaggaagagaggcggcgaccugcaccgccgccauuuuuccuccgugagaaagccugggaaauacuuccggggcaccgcuuggggcagggccugggugugugcuccaguuccggaaagccaucauuugaacuguagguugcaagucguucugugauuaggauagguaaaaggcagcagaaauaaggccacccaccaccccuuacccucucagaaaguuugcucuugggcagggcugacguugcuagaguuucagauucuggcuggaguuggagagcacucuucuacauggcagugacagaaaagugagcuauauggcuuccuucuacucuugauguucugauaggacacaagcuggaguuaucacagagaaaggagcuucaguuggggaaguaagugccuccaugagauccagcuguggagcauuuucucaauuagugaucaagggagaagggccccuugugggugggaccaucucugggcugguagucuugguucuauaagagagcaggcugagcaagccagaagaagcaagccaguaaguaacaucccuccauguccucugcaucagcuccugcuuccugaccugcuugaguuccuguccugacauccuuuggcgaucaacagcaauguggaaauuguaaccugaauaaauccuuuccucccuga

SEQ ID NO: 6244 - RNA, 935 nt, Mus musculus
agagacuugggccgggauugggacuugccagagcccauucuacucacgcuggggggcuccaaaucuucucuaccgauucuguuuaucagccaaacuuuaggugaccuuuggacugguaaagcaagcggcuugcagccugggcugggugggggugggggaccuuuccacuagcgacagguucggcuuuaguccagaaagaagaaacugcgcuucggggguucaggugagagagcuggacaaaguuggggugccuuggcaagggggagggggggagggugaggagagcagaaagccuccagguugucugcagguagcaagccuggagauguagucagaugguggcgaaucagauucuuugggaaugggcgccaggaauaagaguggcuuuaggcgcgguuacaacgaauuggagggaccccauuucuuuuuaccucgguuacugcucuccagguccuccucagcuccgccugguaguuuggauuugccggauuccugaccaggaccgcgcguuguuaacgugcuagaggccugcgggacccuugaaaggagacgccgauucguuuauggccagagggaguagcgaaaguggagcucugccgcugcagggcucaccagcuaccugccccgccaagccaagggggagcaggacaccuggagcucgccuucugccuaaacccggaacccaacagcgccugagcucugcacccaaaacuagggcuacggagucuccuuucuaguagugaauguguagauugaccuguggcuggaccgacuguugcagcucuggauuacccaggaccacuguuuugguucuuaauucuaggaaguccguuguaccgggaguuaagaaucgcgcucuauaaacacaaguucacuguggugguggcaggagucuuguaugccaccuagagcaggcaccccuaaagccacugaag

SEQ ID NO: 6245 - RNA, 2131 nt, Mus musculus
guuuuacaguguauaaacacagcacaguaguuguuuauuagaacguacacaagggaaaagcgacacaccaacuuuuaacauacaggaccauguuccacaucacacacacaagccggcuguuucacggugggcuugcgacauucaucauaguaguugggcuacagcugcgaugugagaggucacaggggaccuguuuaaaagucacuugcacuauguucaccauauaaagaauggaaccaaguaaaauuucauugcaauuauacuuuguuagaaaagcacuuguaaagcuuucuuguuuuuguuuuuguuuuguuuuguuuuuuuguuuguuuuaaaacugagccguuucacauaagcccuauuucuuggcuggacuuggaaaggagggggcuuuucaauuauuuggugugcccuuuccacauaagugguacccaaucuagacaaaccacaggcuacacacaucuugaccugcauucuggcaucugcuggaaugucuacagcaggcuccaauggcuccugcaugacagaugucugaaaaugucagaguucauuuguuaacuguuaaagcguguuugaccucgauguuacuuaggggccuuagagcagcccucagugcaaagcaagcauuuccaauuucuguuugagaaaucuuuuugaugacacauaaauaggaaaacaggaaauaggaccaaaaauaaaaacaagcaaaacaccuaaacaccuaaaauacauauagcaacacaaaauaccaauuuaaaauguguuucccagaugguaugcuaacuagcagacugagacagggaagcucagaugguauccaugggcaccucgagacccuucugucucaagcauggccacacaggucacacaccaaccacaggacagaaggcaaggcacggcacccaaacccaagugcucauuagucgccauucaaucugugggugaagcugcccgacacaauguacagcauugagaacgguaaccuugguuacuguuuccaaggacacggaccaggcucuuggcuaacaagagcugagguaaagcugaaugcaacaugagucauuucaauacaugcaugcaaagaaaaucagccggcuaauguugcgcacucccccuaaccccugcuggaggauucuaacuaagccuuugaagcauuaaacagucaauaauuuucaugguaaaggcuuuuugccuacgccuacugaguuuuccucuggcaccucccaaggagugacuaacuaggaguggagaagaucuagcucacagguacuuuaacagaugucauggauacaggccacugggcagaaaacacuucacacagcauuuccagaaacgcuucagugguauaaauguggcuaaacugggaccauuccuaaugcuaaggucaauccuguuacuaauaucuagaguauagacuggagggcucacuuguuacucuggggcauggagagacacugggggccauuacaagagugcacugaaaagcagccuaccucugaguguggagccucccuccacacuccaccagcccuggggaaggggaggccauguggucacaaugcagacagcuuucugacugucaggagcuggagaugacgucaccuggaacagaugaguaacuggacucgccagcuuuucgcccugccuucugggccacagcaaggccaaggagagcugcaucaccagcugaaaaugaucccuagcuuggggauaauacacaagguacaagaaggaagagcacagagaccccucagguuuuguccccucggggaagaugaugaauuacguaaaagcaggagugagauagacaaaacccaacauuuuagacuuccaaaugaaaaccacaucagaugaggggagcaugugagauccagagagcaagucuucccaaagcccggacccacacgccagaaaaacagcucucccagacucccuggcuucuccugggaacaaccccucuuaacaacuuaagcucccguucucuugguuuuaugcaucuuguuuaucugacaaauuccuauaccagugugagccuuucccuuugaaaauucagugcugcuaaccguuuuccuuugcugcauuugaaguguauguacacacacacacacacacacacacacacacacaccac

SEQ ID NO: 6246 - RNA, 8045 nt, Mus musculus
cccuaccucuccuuagacucgagcuacgccgggggcaauuuccaggccaaacgaacaaggggcgggcuaucaacaccuagugauuugcaaaaccaguguacuaggaccucccaagcuuccagaucucgcugcaaucuaaucccaacaagucuuuuuaaauauauagguuugcuuuuacccccacccagaacucugacuuccuccgcgccuccuuuccgcgcuuccucccgccuacugucaauccuugaugccgaaacggacgucuuaccaaaccuggaaggggccaggacaucucgcugcuagucgccggcaccgcgcgggcccgccgccacugauccucuaaacgcggucuccccgcauucuccccggccgggggggacgcagaaugguuuacagaaggaccgcgaggcgcugauuggucacagacugccgugacgucggcgggcgcugcauuaaggcgagggggcuuccagggcucagccaacagccaggagcagugaccgagccgcuggagcuggggagagacgcgcggaagacugggccaggagacuagggaccgagggacgcgcgccuggggagagccaacaaggaacccgcgggccggacagcgacaccggcaauccgcgccaaacuguuccagccgcuggccuucuauagccgcagccccaggacauucuaaagcucuccaagacgcccccuccccuggcuucucgcguugaccaaggaaaagaaaaagggagggaaaaagaaaggaaggagacuagaaagaaaacccagauuugccaccgcacaaaaagagaggugggggggacaaggaaaaaaaaaaaagucgagcgacuguggggccggaacacaggcagcgggaucgugggccgagcgaugcaaggcugcgcgcccaagcggccgcgaguugugacugaagccaggaugcucguccaggcgcagugaagagccagaccguguugccuccccaggaguccaagcgcagggagggccgcucggaggacgcggcagacugccuggcaggccaccggccgaggugacagggcuggggcgguggggagcgagcgagugcgcccggcugcguccgcccgaagcggacggucccuuuccauuuuugacuggcacaaaaaagaaaacucuccaaaggggugggggcuaccuaagcaacaacuacaaucaacaaaauauccuacccaacccgccaucucccccacaccucggucugcccccgcccccuccccaggcccagcgcgggcgcccagagcgucccaacucacugcaagaaaccggcaauguaggauccaaagcuuucuacucccguguucuuuucuuuccguguuuuuuuuaaaggggaaaacccgguggugggcagucugacacgcacacaaccugccuucauacucugacaaaagcagaugcacuuugacuucugacagcucuaccucaagcuggagagaacccagcuuucccgaauccugagcucuuggcgucuuccuuuucgucuguuuccauuuuauuuauuuacgucccgccgccucucacggugaccuucacuccuucgcgggcuuugagcagaagagccgcuuucuagcccgcuugagacugauuuuccucgcccggugagcugagguggcgcugcuccaucccguugccccgggacuccggggcugcccucuaccagccuggucucucccccuuuugauuugcuaguacggguuuuuugcuugcccaacuagagaggguuucuucuuuuuggaggagcugguugucuucagaagucauccccucgacucuaauugcccugucgcuccgggccucaccggaccaaaccaaagaccauggugcacugugcgggcugcaaaaggcccauccuggaccguuuccucuugaacguguuggacagggccuggcacgucaagugcguccagugcugugaauguaaaugcaaccugaccgagaagugcuucucccgggaaggcaagcucuacuguaaaaacgacuucuuccggugaguacuucccucccgcgccucuguugcuccuuccccaugggcccuuccaggccagcuucggaucagaggucuguguggcucuagcagccgcguuaggagcugccuuuuacuagggcagcccagucuuuucccgcuucuaccuuuuaggaagcuagucgguauugcgagauauauuaauuuucucuuuaucuuuuuauaaacacaucagcuguaguacuugguucuggaaagcgugguccggguuuggcugcccgcgccugggaagaaagggucugagauggcuucagcucagcagcccuaacaaggcgagggagagguggagcagccucgggguugcagcucucgcuugccuuucccgaagccaagcucuccagcaaccaaagacguuuucugguucucccagcuuguugguucuccaaguugagcuuagaggcuccagcuuuauuccagucccugccucuuccuucuccaagagaucuugucggaacuacagagcccuuguggcccagaaagccacaauaaagaguccgaccuugaggccaauccuguaugucuaugggucuccccaaacguggauuggccucuaagcauagaccugggagaaccgugcgguucgauuuuggccucagaccaaugcucaggcuccucuucgugccuuuccagccaaugccccacaaggaaggccaccucuuggcggcucguuagaaccgggaaaauucucuucuguuuaccauuuuacauguauuuucuuaaacucuuugucccgaucacaacucaacagaacagaauggcuccgaauguaaauuauauuucccagugauuugaaaucccacacuuuacuucgcuauuuuggucuugguuucugaggcuuucccaaaucugggggagaguucgaagcuccccggccuccauuugcccaaaggcccuggaagcgcaguccccagaggcgauucaggacgcgcguggcuuguguuugcaaaagagcccggaagcaaagaucggugcaaucugcugcugaggaaaggcugaguuuuggaguuucugcagacugcgcagguuuuuacucuggaaagcagagucagagucugagagccuaagccacaccggcuugcggggcccgcggggcccuugaggccucgcuaaccgcaaagcucagcagggcaccuaaagccggcucaacccggcgucagcucccgcuugcgccaaucugccaggcuuuugcgcaagagcguggcaagagcccagcuacgggcacggaggcucucggagucaggguuuguuuacucaccgcgagaucggacuuugccaacuccccgccugagcgcaggcccuuuuauggugaaagaaaggcaaagcaagcggaagauagcgggguauuuauuucuacggagcucuuaauuuggauuuaacuucuuugaagauaaccgggaaauaugugcuguuuccccuuaugcucucguagcuacuuugaggcuuuuuccugcgacgcuuuuuucguggggggcaauaacuaggcaugagguuagagauaggggccuuaacucuaaccgaauguauuuuccuccuuucucccugaugucccgcauucucuccugcucccucgcucgcuuaauaaauuauugcauuuauuuucuccccaccucaacuucuucucuggcuaucuuuauuucaucccggcucccacuucuuccuaacccucacccaccuuacgcagauguuucgguaccaaaugcgccgguugugcgcagggcaucucuccaagcgaucugguucgcagagcgcgaagcaaaguguuucaccucaacugcuucaccugcaugauguguaacaagcagcucuccaccggcgaggagcucuacaucauagacgagaacaaguucguuuguaaagaggauuaccugaguaacagcagugucgccaaagagaacagccuccacucgggugaggcgaggauucccaacuggcuagaggguggguaugggggaggaaagcccgccaagaccccugcucaccaauccuuuccccucuccccagccaccacaggcagugacccuaguuuaucuccggauucccaagauccaucgcaggaugaugccaaggacucugaaagugccaacgucucagauaaggaaggugguaguaaugagaaugaugaucagaaccuaggugccaaacguaggggaccccggaccacgaucaaagccaagcaacuggagacguugaaggcagccuuugcagcuacacccaagcccacacgccauauccgugagcaacuggcccaggagacuggccucaacaugcguguuauccaggucagaacccugguuugucacucugucucucaaagacucgaauggccacuuagaggaaccuaagcugauccugguccugggagaagucuuaaggucuggggaagaaaugauuggggcuaggaaaagucuagaaaggccuaggagaaguggaacaugagaaaacacccacagagcugguaguggcuuaaaggguagggagugguuugggagcccaggauaaagcaggaggaaagcccaagguccaacacuacacugacaacagcuagcacccaucuuucuguacacauccagucccucuuccacccuuuagaagcuggcuguggguuccagagucaucccguucugguuucugccuaaccagcucucuaauuccucaaccccagauuuguuaguuuggugccccaguuagcaaagccucagaacagagaguugcucuucccaugcagacagagcaccauguauugaaggagagauuguucuucagcucuccggagaugcugucuggaguaggaugggaaggcuaagccaucugcagauagcugggcuuuugcauugggaagaggccagauagcguguggcucaggcacuaggagucuggccuuaccuauacugugugugugugugaucagagugccuggaagccaggugaaggugugggugaauaugccugggaugcugauugugccuguccugguguuggaaaagggcagucucugagaggcugugugaaccugugcucaugaaugugggguugugugucugucacuauuggugagaggcugugacuaaguacguuuggcacuuggagauuguguguggguaugaaaagcugauuguggguuuuggugucacuacccuugggaaacaaacagcaggggacuuuaugagucuccaucacuaucaugauaugggguaggggcuacaagagacccugacaugggagccuuugcaugugacacuaucuuggagcguuucaauaucugugauuccuaagauaaugcaacugcaaagucagacaaggcaauagucugcucagaugcuuuucuugggaauccugcacauccuuagccugguccuacucagagaccaacauauccgcgcguguacacacacacacacacacacacacacacacacacacacacuaacgcccccuccccuccaaccagcugggccccguuuuguacaccggcugcccaguggaguuucccgcggucugacauugugccugugcgcuucaggucugguuccagaaucgacgcuccaaggagcgaaggaugaaacagcuaagcgcgcuaggcgcgcggcgccacgccuuuuuccgcaguccucgucggaugcggccgcugguggaccgccuggagccgggcgaacucauccccaacggccccuucuccuuuuacggaggugagugaguguggcugaauggcaaggcggugccccggcugugcgggcuucgcaggauccgggugggcagugcgggagguaccucuugcuuuccgucgagguguaagggcgaaggcuggagagcaagucaagggaugugaccgaagucccaacaccguuaagagggucccggauagggagcaguuccaagaguuuugugccaaguguccagccugcuccguuaccccacaaacagccaguuucccgagccaccuagcgaugcuugcuggcaagccugcuuuuguaacuugugggugcuucuagacucgggguugugccugauaucuuucucuucacucuccuuacuggcccgcagauuaccagagugaguacuacggucccggaggcaacuacgacuucuucccgcaaggaccgccauccucucaggcucagacgccaguggaccuacccuuugugccaucaucuggcccuucggggacgccccuuggaggucuggaccacccgcugccuggucaccacccuuccagugaggcgcagcgauuuacugacauccuggcacaucccccaggggacucgccuaguccugagcccagcuugcccgggccucuccacuccaugucagcggaggucuucgggcccaguccaccuuucucaucucugucggucaaugguggagccagcuacgggaaccauuugucucacccuccugaaaugaacgaggcagccgugugguagcggggucucgcaugggccacgggagcucgugguuguacagagacgagcuuuuauuucagaaaaauagauuaaaaagacaaaaaaaaaaaaacccccaaaacaaaaaagcaagccuccugcuccacuuccuucagccucggggaccagucuguuuggggagacuggauagcaaaggggguccaaaauaggauccaaauccgccucacaguagagcugguauauccacacacuggcuggcaaagcgcaaaacuggggcuccggaaggggaauuccgagcuauccccaccuucaugaccuggauccauggacagacuccaccagcgguuccucugacuaaugggaagacgucuuggacagcugaagccucgccucgaucaguccugggcaaugccaggaggcugggaccgagaccuuccuagaggcgcucugccagaugaggaaggaaaagaugucaggggcgcuccaguccagaggguucuaguucuaguuuugggagaucccuucuuaguguugucucagaguucagcgaugacaacaaacucuuaauagcuucagaaacaccgaccugcugugcaucaggugggacuauauauauauauacauauuuuuuuugucucucuggguuuuugauuuguuuuugccaaaauugcaaaauucuaaauguaaagcccucaguaucaacucuucuaccuuaacaucucucucucccucucucucuccuucucucucccugucucucccucucucucuaucucucucucccuacacacauacauacacucacacacacacacucacacucacguucucuccacaggauggucuccagccagaccucucaguaaaaugacuugaacaucaccucuucaaaaaaaguauucuaccuucacaugaaaguuuaaaaaaagaaaagacuaucgaacuaaaaacagucaacuguuuacguacaaugauaaauucaggaguucaguguuuuacuaauauauccuguuuugaaaccucuuguucaaaaacaaacuuuugagcaaucaaccaaaauuguuccuuuucuuuuccuguagacguucugacagauuugcagggcuugcggcucacugugcuaguauguaaaaagguguuguuuacacgaggcaaaggaaaaaccaugauauucagacaguugccaaauagaauaaauuauagcacaaauacuguaauggugccuggcaccagcaaccugagaaaguguuuuaaaaaaaaguguuacaagguuuaaaaaaaaaaaaacaucuuugcuaacuuuuaguccuguuaaacauucaugaaauuguuaauaugacuuauauagacccacacagguuuuauuuuugugucuuuaaaauaaaaguccaaaauauuuaaauuuuauggucaaauaugcagucaacagcugcuacuuuuuucuuuauauauuaaauuucucauaugucuuuuauuguucuaauaaaccuaagcuugugugaccuccagugcauauuagaccauucacuguaugaaagaaaacauguugaauaaauuugugaguuuuuaauaaaaauagaaaaccugauguuuagaua

SEQ ID NO: 6247 - RNA, 15958 nt, Mus musculus
auuacagaggaaaggaguguuuauuuauugagcaccuacuacauacaucuuccgaggauauaaaggaggcauggaggcaacucaccccaacucuuacaacauccaggauuccaauucaaggguugcuguccucccaucccacccucagggcugucggucagauacccguccauguguggagacaguuuugguuucauaaugagagauagggugcagacuucuugccaucugguggauaccucucacgaugcucaggacgguuccuacaacagagaauuauccagccuagggcucagauguagcucuguuggcagagugaaugccagcuugcacaaagcucugggaucuauccucagcaacauauaaauugggcauagugggguaagaggaucaaaaguucaagguuauccucggcuaaauagcaaguuucaggagaccauagauacacagaacugccucaaaaacaaaaagaaaugguacugcccaggguguuccugcccuucccagcagcacacaguagcugcuguguuggccuuguuccuuuaaagcuuauuagguguuccagcaugcagcccagagugaaaccacuacuuggcaauaucacuucugcuccacuugugggacucuagaggacggggcaagccuagucggauuccacaaaaguaauccugauuucacagccucucagacucaaagaggcaacaagggccugggaucacagguucccuccacggggcuggacuggccagugucuagaagcuguuggcuauuuucccuaucucuaagccuuccacucccaccuccacagagggcucuccuugcaaggggccugcaaaaccauggugcaaagagcaagacugccaccuaauggagagacugggcaugacagcucagcggcucagggcucgcugaugagaucugguguccuauccccaucaucccaagagacaggaauaugcaucuguucagucagcuucccucuacaaacucacccucacaucccacacacccugcgcuggacugccuugcuccuccgcaugccaagaacagcccccugacuuccacugggauccaggacagauacugucuguccuaacccguccuggaaacuagcgaacuaccauuuccaacuggauacgaaacuucuuuuggucucuaaaguucuccugacuguagccaguaaacaggcucuuacaaguagagggcccauuacauccaagccugaggacggaugugugacucauugcgguuccuacacacgcacaucucagacagucaaugucagcccacauuuggccgguuuuucugaccacagugguaguaguccuggguacugggccucucugaguccuucagacguagcuaaggguucucaggagucuuggagaaguuguccucucuccuguacagggaaacccuucuucugacugcaaauggaguguagaagaauaccuaaaggcaagaagaggauaggguuacaacacaggcagggcacgcuugcuuuacacacacaagggaagcacagagcgggaagcuuguucagguuaaaucaaucagaaaacgggaggggaggggaggggaggggagggaaggggaggggagggaaggggaggggagggguagacucaccuguggccacagauacauucaaggacucaagaccaggaggcagguggcgucugggcagaauaguaaggagcagcuggcaggaggcaaaaaccuccugggacagaccagagcccucacugccugcagaacacgagacaguauuagccagauguccacaugcaaaugauguccacaugcagaugacaucagcaaauauaaaagcagguauacccuaccuacccagcaccaggaggguaggccggucccagacgaacucuaagcagcuagugauggggaccuuggaggacugggagaucucaggaccugggcagcccacugugcccaccacgagccaccccugcugggccuuggccuagaagaggaaagaaaaugccaugugcuggugcaccgaaucuucaucagagcuacacggucaaggacagguccagccuugcacacgcacauucacugagaaaugucuucaacuuaggaagucagccaggaccucuaccuggucuggauuugcucugggcacuaaggucaagaacauacagacuaaaaucccagcugugggacacagugaugguagaaguccccuuugaagcgauggcaaaaagacgggucugaagauaacuaacgaguaaguucucauagacagugggagaagguuacagacuuccaggaagaucugcaaguauggaggcacgaagaccccacccaccugucauaccuaaagacuauuaaguuggccaguggcaggacaaugaucacauaggguuaggucucaagggucacuggaaacauagggcuuuuauacuaauaaaaaaagcuuugaacaguugucuuaguuuuuaagauaugagcucaugagcuggagagauggcucagugguuuagagcacuaacugcucuuucagagguccugaauucaauuucaagcaaccacaccauggcucacaaccaucuguaaugggaucugaugcucgcuucuggggugucugaagagagugacaguguacucauauacaucauauauauauauaucucccaggcuggccugaacccauggugaucuuccugucuuaaguuucucaaucaaguacugggauuacaaguaugaaccacagaccuagugcuuugaaagguuaugagccaagugacgcagugugacucgggccucagcagaaucauuaugccugccaugcugaggcccaagccccaguccagggagcuggggacuccgacaaggguagcagaggaaacagugagaaauggggauggugugacaguaacuccaaggacaaggaucuggggacauagcugugggaucaagaagucagagguaaugucugggcuggacaacugagcugggcagguccuagaaaaacagauagccauggucagaccuggaaacaaggagucugaaaugcccacugugggagcggagggagagagcuguguagcagaggaguggaguaaucuggaacuggggaauggaaagucaggaguacccuuuuucuuuuucucucugcccuuuccccccuccccuuuccccauggccacuucccuggccuugguccuuggggacagugaacucaaaauaaaccugccuuuaauuuaaaaaaaaaaaaagaagaagaagaagaaagaaagucaggaguuuaaaugugacagugaugggggagguggugguggcggcacacaacuuuaaucccggcacuuggaaggcaggcagguuccugugaguucaaggccaggcugaucuacagagugaguuucaggacagccaaggauacacaaagaaaccccaucucuaaauaaauauauaaauaaauaaauaaauagauaauggcaagaaagaaccaacuccagagaguuguucucugaccucuacaugcacacacacuguagcacacauacccaacacacacacacacacacauauauguauauauaugaacuugagacacugaaacaggaggauugugaaucaugaaucugagguuggcuacauagccgauccuuuucucaaaaagccaauacaagggaauaaaugaagcuaggcaacuagauuaggggggaaaaauuaagccaauuuacacaaaagagauccaaggccugagacuuggaacaugacaguguuuggaggucaugggaucaaagagaauucacuggagaugccuacaggagagugcagaggcaaagggacggccagggggagugggugaggcugugacucacggacaaugugucugccuaguguaagcugaguuugauugcugaaaaaaaaggugauuaaaaacaaaacaagacaaaaucagaaugaccauaugugcuagaugcuguagaccugucaaguaccugagaacuaagaauggaccuuugaagcaacaugaaggauacugugacuguccggggcuuugaugggguacgaagggaagguucugauuaacaugaggucagaugaacacagaagacucuuggcaugcugcaguggggcugguaucgauggagcaggcuuugguaggcaguggguggggcacagggcuggcugcugccuccagcucuuccccaguaaccaggggaaacaauucuguggcccaaugcuggcagggaguguggggugugaggagagaacuccacuucccaccagucucggacaguuccucagaaggggggcugccugugagaugaagccagacaugcuucuagacaugugcuggucaauaugaaaaucucagagcacaccaagccacuuccuacagauuuuaacuuugucuucuuguuuuguuuuguuuuuuacaugagaguuaaacugcauguaaguguacacaccacaugugaucgaugccuagggaggccagaagagggcaccagaucccuuggaacuggagucauagauggcagugagccaccacgugggugcugggaauccucugagagagcagucggugcucuuaacuguuccaccauuucuccagcccuacuacacgugacuauuaaggauugaaauauggcuauuccaaauugagauguauuauguauaagcauuuuaaaacgggauuuaagccgggcaugauggcacacaacuuaaggagguuaacacaggaggauuucugagggaucugaggccagccugggccacacaauaaccugucucauuuuuuuuuucacuaauauuuaaaauguauguuuuaaugauaauacuugugguauauuggauacaaucauguuucuuuuuaguuuucuagauuuguuguugucuuguuuuguuaagacuggguagcccagacuggacuugaaauaaacgaucuuccuguguccaccucuuaaaagcuggaauuauagauaugugucaucacgccugcaugguuacuggaaaaaucugaaauuagacauauggcuugaauauaaguuuaucaggcagcuuucuucagccucuuuucaagguuauuuucucacugagggaugaggguggggacaggggaaggauagaggguggagggacugccaaaugcggggcaaugcugcccccuagagucuagcuaggaaacacacagcuaaagaacacuaaagcucgccccuuggaaagccuuguuuaaaucgcuuugaaguugagcuuccggguacccacgacuccaguccaccagcucccuggaguacugcugaagucccacgguugucagacauugacuugccgacacagguggccauggcguguaguaaaugagacgaggaaaucccuaacuucagacgaugcucuauuuaaaaggcccugggaucuuuccuggugggacuuagaaggucguaggaaucaaugccaccacgucccuucucuuccuccucccccaauccacugcguuggagauagcuuuaacaucccuaacuagagucaucgccuccgccucuucuuccccucucgccccauuuuaccugcaaaaaaccgggcaggucaggaguggcgaacacguccaucaccuccauagccccagcgcuggccuugcugacuacuggaguaagcggacagcugcaaaggauccccacgauccguguuaaaaccagaaaaucucuagccccgcgcccuacacaccccggggcuccccgcccagugcuuaggagcuuggcuccgccuccagauugggcguaaacugaauuaagggacguccgugccuguuucucuggcuggugaugacucugucuacgccgaggaagugagcggagcgcaucacagccccaagauugcggggauccuggagccccucaaggacgagccacagcugcugagggucgucgccugagcucgugucugccgccucaucgcaaggccggggucgcagcgggcucaccuccaugcacacgcccuggugcacuugguagccgcacaaggcauccaguuucugacgccugggccucaagacagggaugccccgagccucggccacccggagcagcucggcucgcucccccugcagcccagccuuaccggccuggagcaggagccgggccacgcgccgacgggcagcccgcaaggccaggaggcauggggacaagccaaauagacguuccagccgcugggccggcgccaggucauccagaagcaagcgacucagcuccuccccgccaggccguuccccgcgccgagccaccgaggagaaauggcgggcaaucaggcgacugaagcacccgaccguccagagucgccgcauugcuccagcagcgcccgagacuccacugacagacagcuggggaggacccguugaccucccacacuucguccccucacaaggacugcccacaaccugacccucgagccaagacagucaccucccagccucccacguggguccccagcuuccggguucuggaggcccagcccccuguccgaugacgcacaugugcgcuuggcggcaaccacgucuccacugcacccccuacaggagugagucgcacugccuccgcugacgcaggcgagccuagaggcugugcuggugcugagcuaaccuuggacugcucccgggugaaggaagaaguuagaaggcguucaccugcucguccucaaagaccaccgcaugucagugguuuggccaucuguucaauccucagucuuggagccauccuacauccuggcacaaugucauaguugggacuuucucccagaagcauauccugucagacccucagcaccagccagcagaaccccuagaauauuucccaucucccgaaagccccaacgagccuacgguauuucugcugacaagcagccgaugcccuuggcccaugguaauucuacgacuuccuugcucacugcccagacuggcucuuuucagccuagucuuuuaaaauaucuuuuuaaaccuuuucccuuuuccuaaugauuccuuuuuuuuuuuaaugugcauuguuguuuugccugcauguacaucuaugaagguguuggauccccaagaacugaaguuacaguugugggugcugggaauuguaccaggguucucuggaagagcagccagugcucuuaacauuugagccauuucuccagcccccacccccucuuuuuuaaaaucaaugucucacuaagcagcccucauggauggccugaaacucguuguguagcccaggcuggccucaaauccacagaggucucccugcuucugcuucucaaauguugggauuaaaggugugcaauaguauuaguauaccuggcuccaacuuauuuuucaaaauucuuucacaugugcgggcauauuguuuguccguguggcugugcaccacaugugugccugguggcccagcgagagagaggaggauguaggacucccugggacuggaaucaacauggguccucuagagcagcaguggauguacuuaauuauguauuuuggggacauuuguauccuuggcuccuauggcuggccuggaacuaaccaucuccugugcccacuccagaagugauguuccgaaucuacccaccuuccuagcuaccuggaaggaauucugagacaccaaccacacugaucaccaggaaggggggaaaaaacugaaagauacuucugaagguagaguagguuguaaucucucucuuuaauuguuacagugaaauguaguaggagacagacccugauacucuguagccgugguaaggaccccagggugagggccaaaacuuggcuggagagcugggggggggggaggcaggaggguugggaagggaaccuggaacccuggacaaccacacagguaaaagaugaggucucugcugcuccaacccuaaggggugggggguaggguguaagaggauagagcaaugccccuucuagguacaucccuuuccuaggucaaaaggaagaggcacaggagagcaaagguuacggagccccaagaggacucagaagaaguuagauagaacagucgagauucugucuucucuucccggcccaguuuuucacauuuguaaugggaauagucugacaagcugucuaucccuuagugggguggacauagaaaguaagcugcagaguccagaaaucaacaccuaaaauccagaggcaggaggcgagccgugaaggguggagaagguaggaucuccccacagaacacuaggucaccugcucugugggccucaucuggaugucaccaaccuguggagagcggaggguuugaggcagccaccugcuuagauacucccugcugggcacgguuaagcucuugcuaguggguaggcagccaagaccauacuuaccugaacaugugggggugugcuaagaacguagaugacagccucagccacguccucuggucugagacacugaaagcaggggugggggguuguugagacaagaguagaccugacccugaccuaaguuccuuccccgccucugagggacucuaacauccaucugcauucccaucccagcccuccaggagugacaagcacagcagaggguacaguuugagggaacuuaaggacugaguggcuuucauaggcccagaaggagacccaccuuuauguguucauagguggcagcugcuucccccggguccuugucauggaguuugaaggcgaacugugucucuaccaagccuggagagauacacugggccaacagagguccugcucagccugggcuuuauaggccuugaggagguugaggggaaaggaucaaggccacagggcuccugcuucacagugacaucugccucauguccucaacuauccuccuccuuccaaagucaccacugagaguuccaacuggcaacucucacaagacccugcacuacgcauggagggagcccuuccucuauguuucauuaaugcuuuauaaaguguuccuuaaagcaucauuccauuucacagaugugaagacugaggcuuagggagguucagugauuuacccagaguccugugguuuucuagggaagagccaagagugcugguaucacagucacugugugauuucccuuagucccucucccccucaaaucguaaguccggcccuuggcuuugaggugacagucccuguaaugagcagcagcgcccaggacuuuuucacuguugagcgcagagucucucagcaagucucccugggcacucgcaggcaggagggcugggcccacgccauucccaccagggcuagaccacagccucaccguggcccggauaugggucugggccuccagaagcucuugccugagucccucugucagugcagugacggcauacuuagucgcacuauagaaauggaucacagacuggggugggacucgguggccacacaugcuggguggaagaaggggaagggagagaggagagagugaaguuccacaggcacgggcagugcucccauuauccuggucugcuggaaaccuugucggagggaacccugaugacuacccuacaguccacugaauacaucuagucucuguugucugcacagcuccugaaaccugcuuggccuggaagcuguccuucuguggacuccacacccacuccugcagucagccggccucacaguguugucugugugcuuacugauauguguccccugggagaucccuagggcugcugcgggccaugcccccaucagacagugagcacuccuaugguagagccugugcagucucuuaguaccacaaggcagauugaucccagggccugaggaagaggcacagaggcucucaguccugggagaguucucaggcacuggcuauggacggcaggggcugagcugccugcucuauagacaaccagaagugggcauuccccuuccucagaaucaugccguuuggauacuaaaucccucuuucacuacugaagagacugcugucuagaggucgaaugagcuucagcagagagaucccuaucggaagggugucccaaagccugagccucugcugcugcccggccucaccuguugauguuaaugaugugcccgucgucuauguuccgcuccuucauggacugauaagccucccgagugcagaugcugagggccagcacauucaccugcgggccagggaaggcaagagaggggcuccaguuugggcccagugagcagguguuagagccguggggcauggggguccgggggugggggugccuucucuguggaugccccgcgccucacagcugccuccuccagcugacagcagaggcaugaggaaugagccucccacccgagcccaggacacugccagccaucucugccacagucagaccucucucccucaggaaaccagucacucugcucagggacaguguccagaccuaaacagauugaaaucccucuuggaaugcccuaaaucuuuuucuucauacaaagaacccaggcccucucgcccugcccuucucagccacccugcuccgacgugauccccgcccauccuguauggaggaagcucacacgccugccuuuaaccuagacccuggcaacaggcccagguguggggaggcuucagaagguggggucacuugccacucccggcaggcuucaccucgaguccccaccagucacagagcagaggucuaaggagcuaucugcuaugaagcgccugucuucggucugcuccacccaucagccuugccagagaggccagcagagauaaaguuuucaucagcuccuccugccuccccccucuccagaggagagggacagcuggcagauuagcugguucacuuuaucaggugucacccaggcaucaggacagaacacccucagcaaagacccgccucagcaacacuuggguuguagaaaggacucagcccugcuucugguccucuuaacaggguggaaacguggagaauauggaagacaaacgaauuccuaggagcaugaaucuccugggacaaacgaaucuccuaggucuagggccuacuaagauggggcuaaugaacuuaggagauauucaaaacaaaggggccuuggacacuuaggaguccuucauuuuacaggugggcgagcugagggucaggguuagcuauaugccucuacacaugagguugucacucugaccucccagaggacaaagcuuccuuuuucuuguucaguguuccacuucuaaguaccuaguaauaccgaccuaaugauaccagauguagagagggcuaugguauugcuuucagccucuuaaauacuuucacacccuaaagaagcaguucucagccuuccuaauccugagacccuuaaauacaguuccucauguugugcuuagcgccaaccaugauuuucguugcuacuucauaacuguaauuuggcuacuguuaugaaucauaauguaaauaucuguauuuuuuggaguucuuagacaaccccuguggaagagucauuugaugcccuucuaaagggaucaugacccacagguuaagaaccacugcccuaaugccacccuauaauacagccuggaaguuggaaaugcaugccuuccaggcuggguuuguccuguagacgcucuuacuacauuaacuuacuuacuuagugugugugugucacacugcuaauguggaggucaaaggacaacuuguaggaacucucuucucccaccauaugguuucugggucuuaaugguaagcaccuucauccacugagccaucucacuauccccuggccuauacaugcucuggcaucaaagaucugcccauacugcaguggaacaacuaaccuggauuugagcaggggccaccccuuuauaaaggccaugugcucucccacacucuguaguccauaccuggcgacagcggaguuugugauauugaugaucucuagguaucaaacuuaauuaggaauacagguaauguaaaccaauuaaguuugacaggacugaagcucagaggcuguugugaacuugccugagccgcaguuacaacggggcuggguugcaaacauaacuucucucaucccuguucccuuucguccccuaagaccacguucccagguauccagcaugggcagggacauuaaaaaaaacaaacaaacuauaguuuucuccccugcaaucuuucuuccaucccaaccagucuagaguuugagaacuauugggagcuggaaggauguuauccacucacuacccuugagacacaagucguaagugggaaaucaaaacugccccggugggagggaaacugucccuaggguuccuuugucuugcaggccccuauuuucuucuuuccucucaccacccagccucuggccccacuucuggaacccuuacauugaacauguccuuccauccgcuggugcugcccgagagcagggugucaggccgggccaugccggcauuguugaugcagauauccacgccacugugcugggaucggacagcugagaacauggagaggauguccuccucauuugacaggucacaucuguaggggaucaaagucccgggguagccugcacucuuacauucagcagccagcuccuaugaaacccaacaggagucuaacuggggugugcugcucacucccaaaccuccccacccagggucagccuucccucccaggucacuacccagagagcucuaguggcagccaccuuuuggccauacgagagaggcagggucugcccauccccaaagcuuggucuguuuggucaaagucuaaggggcugaggacacucccugagugaaggaaaauaaucaagccgaucaagaaggagucucacauauacgugaaagucuucagugcuaaggaaaaggggggaggcagggauccugagaugcgaaggagauucucuugacaccuucuaauaccuggaaguaaaucuacauauaccucuggccccaugucauuccuccaccacugacugccaagacaugcugagcugguuacuccagggcccaaauucucuuuaacaucagccagucccucccagaagggcucagcucugaacugccacuuucucuucccaggaggcagacagaacuuaaaggugaguccuauacacagcucucaacggagugcuccucuuucucccuacaaguggucaggaugucaagacagacucucuaaucucuacuaccccagccccauccugaguuuuccccaccuacucuuagacacucccugugcauauccucaggacauuccguagagcccugagaaagcagagccacugagcuuggagggaacugacauuuagaaguuggaagcaaguaggcugugggaggccagugagugacugagccuugugaaggugacugugugauugcagcggggugcggggagaagcugccauagaggaaagccaauuuggccaacugcccuggccuagagcccuccuccuccccagugaagcuagaaauaaaaggcucaaucaggugaccaaauaaauucuuuccugcucuuuuuuuuuuuugagauggagucucucuauguaguucuggauguccuagaacuagauagguggcuguuguaacuuucugugaguuaagaaaugguaugccccagaugguuaagagcacugauugcuguuccagagguccugaguucaacucccagcaaccaccugguggcucacaaccaucugucaugggaucugauacacucuccuggugugcgucagaagucagcuacaguguacucguacaacuaauaauaaauaaauaauuuuuuaaaaaauagugccccucugggacucagaagcccccuuccaccugacuuuacuguccaugucuaccucacagaauaggauuucucccaguagaauaccagaacccaaacuuaguuuuaauaucagcaaauucaucaaugaauaaaaacagauaguaagcaagaacccagaaaaggaauucaucucccuccagacuaaaaguccucagcagcaaagcuauguguuuauguguauacuuaucuauuuguauguguaugucucugugucuauguguuuguaucugugugugugucuguguauauaugugugugucuguguguaugucugugugugugugucuauguguguauguaugucuaugugucuguauguguauaugucugucuaugugcguaugucuguguguguguuugugcaucugcguguguuucuauguauacgugugucucuguguguaugucugugugucuauguguauguaugucuguguguguguguguguguauguguagaacauuauccaucucucugucauugucccuccuugcuucacuucugccaucuccaucugaucuccaaaaugaccugaaaucagggcuguccccacacagcaaagagguucucucuuaaugacaugcagccacccuaggguugacugaucugcuuggagauucccuuaggauucggggaaucccuuugcuggcuaguuuaggguagagaaguggaaaagaaggcaagacuggcuucagaauuagggaaucaaaacuaaaacaaacaaacaaaaaaaaccuagggaauccaguuguccaauccuggccuuaauccucucagcuccaaagauggggcugggcccugugcuucuccagggaaggagaagggugaagugaggcaaugguggaggcaggugaccuugggauuaucugagaggcuauaaaguguaccuuuggccaguagcuggggaggggacaguccuccuuccugcaacaacuucucccuuugccuccacccaaggccuccuuacccuuuucugucagaggacuuugagccauggugaagauagagcccugcaggugguccugccagggcaaauaaugggaauuucucuugucuucucccaaauggcaucuccucccuaucuuuucugaucugaugcugcucauaacuccaggaacccccaaaagaauguuaagagaaaaacuagggaguucuggauccguaacauuuuauuuucucaagacuuacagguuuaaugcccuauuucaccuacucagucccaccuaggaaaaugaaucagaaaagagagagagagagagagagagagagagagagagagagagagagagagagagaaagagaucuacaaguaaauauuccauucacucuuuaggcucauggcaugugaguugagcucagauuugaauuaaaaggagagcuagcuuccacccuaaccucacccucagucaugggucaaacacuagcuucuuguucauugguuggccagcacuuuacucgguguggcuugggugagguuuggggacaagaugaaacuaaccuagucacuuagacuagccaguuuuuuuuuuuuuuucuuuucuuuuuuucccccuucucccuggcugccuagcuagcccuugaccucuggcuuccucuuucaccugccaguauagggggcacaagauggcagggguaagggaagagaauaccaggggucaggauuugguacucugcugcgacacgaacuaucaggagugaauggcucuuauaaaaauagaacuuagagagaacuuagguccucucgcuacuaaacagcacuccugcucucaaggccguugcaaauggcccuaggguaguaggcucaaaaagagcagggucucuggcuccggccacggcaacucucccuccccucacucaaagcccugccccauggaaacgacguacuccccccucccccaagagcguccccgcugccuggcggagccuuaccucgauguugccaacggugcgggcacaacccacaaccuucagucccugcuggacuaaugcccgggccacggccgcaccgaugccccccgaggcucccgucaccagugccagccggucgcgccaccgcuccaugccagcucuagucauggucccgagccgucugcccaccucguucggcgaaccaggcacugggagcggggagcuuagucugggguuacugaagaucgguggcucccuggucacugcagugggggacgccggcaacuu

SEQ ID NO: 6248 - RNA, 1693 nt, Mus musculus
cacagccuugaggauaggggcccaccgcggaaguggggccugacagccgguggaguugcuuuuaccgugagcgcuucccuuugcgguggagagccuccaucugcgaggaagaggacgcacgcucgcacgcacucaaggccuccuuugcucaaucagcccuacuuccaaaggccugaggacaggaugggggaucuaaagguuacuccagugcccucccaaaccacuggugacugacaguaaggauucaauccaaaaagcuuaagggccucugccaucaaggccaguugaccugaggaaggguuauuguucacuguaccugauccuuuggcuucacuggccaaguaaaugguuaaaauacccaaguacucuacaccuaaauggcaccacgucuucaaccguccuugacaucaaccacucccaguccuacaacggcgcaaauguuacacgauguacaucaauagucacccgcagaagcugacaacuugaauaucacgugguagccauaacuuuaaacagcaugcauaauauacccuuauaagauuuuugagccgggcgugguggcucaugccuuuaaucccagcacucgggaggcagaggcagguggauuucucaguuugaggccagccuggucuacagagugaguuccaggacagccagggcuauacagggaaacccugucucgaaaaaaacaacaaaaacaauauuuuuguuuuucuuuugugcaggagccaacagagcucuaccacaaggcaugguggcacaagccgguaaggggacauaagagacagguccacgaguucaaggccauccuuuaguagagagugaauuccaggccaacugaaacaugagccccuuucucaaacacaguaaguauacuggcacauuaagugugaaaaacaacaaaacaaaacaaaacaaaacaaaacaaacaaaaaaaagagaagugugaugaaggcuagagagauggcucagcaguuaagagcacuagcugcucuuccagaggucccgaguucaauucccagcaagcacauggugguggcucacaacuaucgaaaaagguccgaugcccucuucuggugugucugaagacaccaacaguguacccauacaugccugauaaugccagcuggugguacaugccuuugauucagcacucagcaggcagaucucuugaguuuguugccagccugguguacagugaguuccaggucaacccgggcuacagagaaacccugucucaaacaaaacaaaacaacaacaacaaaaaauaaaaauaaaaaaccaacaaacuguuugaugucuaccuucuucagauagccauccuuuaugauuucuggacauggauaagaagcucaaagaccaggcgcgugcgugccuaccacagucacacaacccaugcugaugcaguccuaggaggcugaggcagaauuguaaacuugagguuagugugaacuagugagacccugaguuuaaaagaaaaaaaauaaauucacuuggggccagagaugacucaagaggcuaaaaacacugccuguccuucuagaggacccugguucaauucccagcacucaccuagcagcuuacaaaggucugcagcuccagcucuaagugaucuaauauccucacacaauuacacaggcaaucaagaauaccaaugcauuuuuaaaauaggaauaaaauuuuuucacucacu

SEQ ID NO: 6249 - RNA, 5438 nt, Mus musculus
uguuuagguaaaagagugagcgcgggugucuucugggaagucauggcgucgcugaauuguaggacugcggucuguguggucuguuuggagaagccgaaauaccguugcccgacuugccgcgugcccuagugagccagagcggguaguggguucggagggaggccgggcugcgggcggcggcugcgggcaagggguacgugcugcggccgcucgugcugaucgugcugaccugagccugucugucucauuacagcuguucgguccccuguuuucagaagcacaaagguaagaccccgggacaccgucgcagcccuugcuccuucuuuguaccguacaggccccaugcccccaggaacccgaagcgggaggauucccgccaguucaaagccagccugacuacagacugagacccugucucaaauaauccaaagcaagucagcugcuuucuugggaaaagucuuagcuauuuauucaucuugacauucuaguguagccccucacuaucgcagaaacugccuuggcugaggucaauuagccagcaaugguugucuuuaaaauaugguuguuuauuauuuacaauaggagaaauuuucuuuuucugugugugguauuuugagacagguucuccuccuccuccucuuuuuuuuuuuuuccgaggcaggguuucucuauguagcucuggcuguccugggacucacucuguagaccaggcuggccucgaacucagaaauccgccugccucugccucccgagugcugggauuaaaggcgugagccaccacgcccggcugguucuuuuucuucuuucauuuuccuucuuucuuuguuugcuuuucaauaaaggguuucuggcugccuucgaacucgcucuguagaccgggcuggcuucaaauucauagcgaucugccugccucuugccucccaagugcuguuuuauuuugugcugagaaagaguaucucagauucacuauauauuccuuuuuuuguuuuguuuuuguuuuuguuuguuuuucgagacaggguuucucuguguagcccuggcuguccuggaacucacuuuguagaccaggcuggccucgaacucagagaucugccugccucugccucgcgagugcugggauuaaaggcguacaccaccacgccuggcugaacuauauauucuauacuccucccagacucacaauccccaugccuuaguuuccuaaugcugggauuaaaggcacaagccaccacggcccagcugagacuggcucuuuuuuuuuuuuuuuuauguaguucaggcuggccuaucuaucaugaucaugcuuugucauccucaaaugcuaggauuauaggagccaccagaacugguuaaaauaaguuccugaccuauugagaauggagcuggagcgauggcucggcuguuaagagcuucuuguugcuuucccagagguucugaguuugguuuucagcaccugccuacuauaggcaacuuguagguccauucccaggggcucugacuccccuucaggggcucugacucccucuucuggccucuguaaacacugcauacauguagcacauucucccucugucucugcuguuuucucccaccccaggcucagaccuaucccugccgaaaugcuugcuuucugcuugugaaagcucgcuccguuaagucucugggcuuccucagguagacuuagagcagacuuuucuuaccuuauccauguguuccaugacuacuaaaccccucugaccugggaguuaugaccuucauguccuagcggcacaugggugcacacauacaguaacuguugaugaauuguguuauguuuauagaagucacugccauuaauccugggggaaguccugugaagguaggguggggcacacaaccaccuugcccagguccaagcucagucggcuuccucgccccuucugcuggacucggaauuacucacgguucucugacugaucgcuugguuugaccugucucucccucugugugucucuacccaguacacauucaguacacuggccgugauggggacuugcggccucguuggcuggcauggaggguuguguuuggcuaugccugaaauuugugucucucucagagcagugcagcucugaagcccgaccuguugagaagagaagagcagggccuccugugaggucugaggagagcaaaggugaggugguuggggcuuuuguuguuguguuuguuuguuuguuuuucgagaaagggcuucucuguguaguccuggaaaucauucuguaggccagacuggccuuccuugccucugccuccagagugccgagauuaaaggcgugcaccaccacuaccuagcaugguggucgaguuuaaacaacacacuucaauugauuucaaagauacuaaaugguaaggaaaggagaggggguaaauggacaggauacaggaggaugccuuuuugggggagcagcagccucagcaggguggaguacaaacuagcguccugaagcauggcucuggggaggggcccugggccugggguuaggcccaugugggaggcuuccuuugaauuaggucaccuccuugcugcugaagucgccuuagauuuccagcaguaaugggcuguccuccacucacacauuucaugcauccauggauucgucugucuuuaaugccuccuggguguuguagaucugcacacagccccuucugugccucaaagagguucuuaagagucacagaaagaguugggcuauguguccuuugagaaacgucuaguaugggcuuggguguaucugccuuuggugaaaguggggguacuaugcuugucaggguuuuauaggccucguucacagucacagcccugggucacgacgaggccaggaagggugcugucugcagaccacagcaugucaugcucuugugaagcccagucaccauucugccaccuacucuugguuuaauugugaagccagagaagcaagcugucauuuuauuugaacacgacuguuagugugcccucccuguggcaccucaguacacacguggucgacguggcugcccuggcuuccugaggccugaccagcugugcucuacacuccucagaugaugacuccuccguagcugauuuccucaacagugaugaggaagaagacagagugucucugcagaauuuaaagaaucuagguaagucugugcugggcuuguuaacuguuaggcuuguuaacuguuaguuugugcucuaaggccguggggcaugggagaguggagcacggacuaagucgugcagcagccagcuuuauacccccccccuccaccccccgggggagagucaccugaccaaggugucccaucaucaggacaagcugcacuuggcagacacguuuuccauagaggcauauaaagaaguaacaaucaccaguuauaaugacugacauaaacucccauuggcugcaccugggaggaugugaaagcauaugucaagaaaaaaauccguguuauuaaagaaacugaggucacuaaagucuuguuucuugggaguuuucucacaaauacugagaauucccucgauaugacuauucuugggugguauucugacaccauuuccucuguauagaaugugguuggcuuucugaauuguuuuggcuggaagcucggcuauaccucagggcuacucugcuucugagugauagucuuuuucuuauuuauuuauuuauuuauuuagugagacagagagucguauuguguaguccuggcuagcuuagaacucacuguaacccauacuggcuucaugaugccauccuccugucucuauguccucaugauguuucuauccucagaagaauugcuaauuuuuuuuuuuuuccgagacaggguuucucuguguagcccuggcuguccuggaacucacuuuguagaccaggcuggccucgaacucagaaauccaccugccucugccucccgagugcugggauuaaagacgugugccaccacgcccggcuccuuuuuuuuuuuuuaaucuuuaaagauuuacuuuuggggcuggaaagauagcuuaccugcuagcucaccuuuccuagcuggcuccuccguuacuguugcuaaucucacuguguguguaugcacaggccagagugcaaaacccugugacccacccacccaccagucucugccuuguucagugcuggaguuuuagguauacauaggaccacucuuagccuuuaagugggugcugagauaugcuuugcacagcaagugcucuuaaccacuguaucuucucuccagcccauauuuccuuuguucaccuguauauugaaguuuaauuugugaauacaguaaucuuucugaugucuaaggcaccuugauuccaggaccuauuucucaaaaauggcauaauacauauaacugucucugccucccaagcgcugcgauuagaggugugcauuagguuuugauguauaguugguguacagucuuuuuuuuuguuuuuuguuuuuguuuuguuuugagacaggguuucucuguguagcccuggcuguccuggaacucacuuuguagaccaggcuggccucaaacucagaaauccgccugccucugucccccaagugcugggauuaaagacgugcgccaccacggccggcugguuguacagucuucgcauaugggagugacagcauaaggguggagauacaaguccuuccuagcuuucagcuacugccacaggucccccuugaacuuaaagcugguauugaucuuuaaggugaaucggaaacuuuaagaagcuugcugcugaacccacaccugaggcaguugaugauuagccucgaucagggugacaacaaagcaaagcugaugcgagccuguaugcaggagccccuuuucguggaguuugcagacugcuguuuaggaaucguggaaccaucccagaagagggauuccuaagacuggauguguucucugcucaaguuaccugcugcugcuccaagagguggcuguuuucaaggccaccauacgcagcaugcacacgugggucuuccucuaccacauggcucgcugcagcaacuucaugaagaggaaacuuguagcccuggagugauggcucagcaguuaggagcauugacugcuuuuccagaggaccccaguuuucagcaccuauuugacuacuuacaacuguaauugguugcagaggaucugacagucuuuacuguaugcaugugcauagccauauguacagggaaaacuccuacauacauaaaauacuuaaaacaaaaacaaaagguuggcuauuuauauuuagaugguucuaaauuuuauuucuuguacaguucagaguugcaucauaaauaccaaguauauccauuugaauuaaaaacauaguguaacaauuuaaggugugguucucuugaugcugcauuguucauuguucuugguaacauuaaauaaaucaguuuauuaaauauuau

SEQ ID NO: 6250 - RNA, 48138 nt, Mus musculus
cacacgcagccccgcccaugcagagcugagagccuggacggaacugggcucgcucuccuguugggaaugugaggcucucgguacggucguggucugcguucguccggaucuuccguggccgccgcuaccgccgcuaccgccagcaccaucugcccucaggccgcgcgcgcacgcagaggcccggcagccggguccgagaggcgcgcgcacgcccgcucgcccgcguggucgccgccccucggaagccuccggagccucacacggguucgcuacggagggaggcggaggccugcgggaggaggcggaggaggagcgagggaagauggcggccguggagcucgaguggaucccggagacgcucuacaacaccgccaucuccgcugucguggacaacuacauccgcucgcgccgcgacauccgcuccuugccggagaauauccaguucgacguuuacuacaagguacaggcgaucuguucuaucggaccccgccgcugcuccugggccgcacccccuuccacguccacggcccggccuguagcucucgagguagcgucggcugcgguggccgcuuuccgauacgccgccacccccgcgucugccucccggucugugcggcccggggggguucuugugugagagcuauccgccauccccuuaggggccccaggguaggccugcgggaaugccugacccagccgagucccacccgguccucuagucgcugggguauuuucugucuucucuaguguuuguaucagcuggacuuuuuuguuccgcuccaccccuaauucucccuacuuugucaucucgucgauccucuuuacccgaguaacugcuuucuuucuuuuucuuuuuuuuuuccccucccuucucuaauccgaguuucgucccuuuccuuucuuucaauccgaaaugauuuaguuagggcuuaaugaaaauggucugugggcuucauuugcauauccuugaaagcuuuuuugugugguuucuagguuuguuuugguuuuucgguuuacacuuuggguuaaauugggaauuuuacuaauagauuaguaauagacuggaucuuuagaaaggacgcagugaaauucccugaaagcaagaaguagaaaucugaauuauaccaauguguaugaaaagugcgauuuugcagcauucuugcgucgcucccucucaaaaaucugcacagaaagucccaaguugcucuccaaggaguuucaaggguaaguguucauagacguggacaauuuuugcaguguucugagagggaggagaacuuuauggacucggagccucccuuuuccucucccccacguuugagugugaacacuggccuuauucagggauccuugcuuugagucagcgagaauuucaguuuccaguagccacuuuugcaaaauaugaccaguagagcuuuuauuuuuagaucuuuaguauuacuugauuaguuaguugucucccagcaguguaauuugauauuuagcagauuuguauauucuuaucuuuguucgguguuuuagggcguuuguuuuauuagagagauugucugcuuuuuccagcuugagaacauucuuucagaauuagcaacugacauacugcagucuauaaacccugcugcugcuuugcaccaacccuuacuuaacagguaaacucauuucucuccuaaauaccuggagaagauucaucuugacagcauguguuaaaauuuuucgauuuagaaggaaaccucccuccauuccaaaugguuuugauacauugauuacuugugugugacuaauguuaguuuuaugcauuuaggcuacaucgguaccaaggacaaauuaauuuguuuugcucaaccuggaaaacugcugcaguaugugcuauuucuguugauuuuauuaagucauauguauaguguacaccuucuagagcaagucacugggaaucuaaccaguaaaaauacccuuacucucugaauucugucaaaaugcuuuuaguaucuuuuaguacccuccacugaaauuaaagccuuuccuuugaagauuauuguuagugaguaugcuuuggccuguguccugucucuguguaggucagaguuuucauauugcuuuuuugggaacauuuuauuuuuuagucagauacuugauguggaccuuggugcagggcuuggagcuggguuaaauacggucaucuguuacauuuguuuacgucuuauaacuaaauucaccuguauaguagaguauaacccugcaaaaacuuguuuccuuuuuuuuuaaaauaagaauuacuuguuuuauuuaugaguacacacuguaucuaucuucagacacaccggaagagggcaucagauccaauuacagaugguugugagccaccagguuguugccgggauuugaauucaggaccuggaagaacagucaguguucuuaacugcucagcuaucucucuagcccuucuuugucuuauuuaugcuuuuacuguucuggaaguugaaucuagggucuaguucaugcuacacaagcagucuacuacacuacauccccagauuuuuuuuuaaagagauguauuuauuuauuuauuuuauguaugugaauacauuguagcugaacagauggcuguaagccuucaugugguuguugagaauugaauuuuuaggaccucugccugcuccgguugucuccgccauucuggucaacucugcucacucagucccugcuugcuccggcccaaagauuuauuauuauacaugaguacacuguagcugacuucagaugcaccagaagagggggucagaucucauuaugggugguugugagccaccaugugguugcugggauuugaacucaggaccuucgaaagagcagucagugcucuuacccgcugagccaucucaccagcccuucucuuaacuuuuuauguauuuauuuuaagacagaauuuuuuuggcgggccuggaacucuaugaagaccagacugguuucuugacucagagauacaccugccucugccuccuggugcugagauuuaagggccuuagugccagacaaaucuccgugaguugaggccagccuggucuauacauaugugaggaguuccaagcuagucagaacuaugcagagagaccuugucuuaaaaaauuuauuuauuuaaagauuuuauuuauuuuauguauaugagaacacuauagcugccuucagacacagcagaagagggcaucagaucccaguacagaugguugugagccaccaugugguugcugggacuugaacucaggaacuuuggaagagcagucagugcuccuuuuuuuuuuuuuuuuuuuugguuuuucgagacaggguuuuuuuguguagcccuggcuguccuggaacucacuuuguagaccaggcuggccucgaacucagaaauccgccugccucugccucccgagugcugggauuaaaggugugcgccaccacgccuggugagaagacuuuucuaagugugaagccagaagccauaugacccugcuucaagugaaugagguggucaguguccugagggacaacacucaauguuguccucugugucccaugugcccagucaaaauacaaccugagagaaaaaaagaauauuaauuaauagaagcuacuaccaugcuuauggaguacaaacugacauaucuuuguuguuuuugguuuuuugagacaugguuucauuguauagcccuggcuguccuggaacucaaaaacucugccugccucugccuccugagugcugggauuaaaggcaugcaccaccacugccuggcuggcaacauaucuuuuugguuuuucaaggcaggguuucucugcuguccuggaacucugcagaccagguuggccuugagcucagaaauccgccugucucugcuucccaagugcugggauugaaggcgugugccaccacuacccggcuaacauaucauuuuuaauguuuaaaguuuauacuuguguguguuccauguauccauauauacaccugaguauggaggccagacagagaacaaccuaggguaucauccucaagaugaccacccauuucuuuggacucagugucucauuggcuagacuggcugacuacagugucucagggaucuuacugucuccaccuucaagugcuuugauuauucagcagagugccuuacauggaugcuaggguuuaacucugguccucaugcuuacaagcaagcaagcacuuuauugaugaagcuaacuccccugccuccauuuccuuccucccucugcuccccuaccuaccuuucccuucucuucccagccucugaugcuguugauucauagucucuuguagccagugcugccauaaaacucaugagcuucuagcccagugguucucaacccguguguugaaauccuuuuuugauuucauaucagauauccuauauauuauauuagacaguagcaaaauaacaguuaugaaguagcaacaacuuuaugguuggagucacuacaacaugaggaacugcauuaaaggguuguagcauuaggaagguugagaaccgcugauuuagccucuuccuccuaagugguaggauugugauuguguguacauacuaccauguuuaguuuaguuuuguuuuuugguuuuggaguuuucuguuuguuguuuuuuuuuuuuuccccgagacaggguuucucuguauagcccagcuguccuggaacucacucuguagaucaggcugaccucgaacucagaaaucugccugccucugccucucaagugcuggcaucaaaggccugcgcuaccacugccuggcuucucuuccauucgugagccucagagagcaaauucaggucaggcuugguggcaagaaucuucagcugcugagcugcauugccugccaugcuuuauuccuauuuuacuuuuuuuuuaaagauuuauuuauuuauuauauguaaguacacuguagcugucuucugacacuccagaagagggugucagagcucauuagggaugguuguaagccaccaugugguugcugggauuugaacucagaaccucuggaagagcagucggugcucuuaaccacugagccaucucucucuacacccccccccccccauuuuacuuuuuaaaugaugcagaugaugcaguuacacuuggagcgcagaaguguggcauccccugaagcugggaguuaggugugguuauaaaugaacuuguguccucuguaagaacaguugugcgucuaacugcuaagccaucuucagcuucucuucccugcuagaaguagagugcuugccagcauguugaggucuucucuagcuggauccguacaaccauaaaauaaacuuuucauguuaaauuaaacacauacauagaauagggugauggauggaccugcaugugucuuguacacagcucuaaaagugacuauuucauucauauauauauauguguguguguguguguauacacacauacauacauacauacauauauacauagguauauguaugcaaauacaugcauacauacauguuuaucuauugugugcguaugcauguggagaucagagaagccuuugcaaguguugguucucucccuccacuguguguguucuggggaucaaacuuggguccucagccuuggcagcaagccuuugcucacugaaacaucuuguuagcacagagguaccauuucuuauaaucuagcaugguagcauaugccaaacuuccagcagucaggaagcuaagacggggugggagucaagaaauuaaaggccaaccugguagccugauguaaauagugagauccugguauuauugucauguccucguuauuuuuauuauauaaucuaauuucucacccauuuuaccccgucuuguauuugggugcaaaucuagauauuauuucaccuauguuuuuuuuuuuuuuuuuuuuuuuuuuuugagacaggguuucucuguguagcccuggcuguccuggaacucacuuuguagaccaggcuguccucgaacucagaaauccaccugccucugccucccgagugcugggauuaaaggcgugugccaccacgcccggcucuaugauauuuuaauaacuaauacuugagcauaaugcgugucugauuucaaauugcuuguuucaauuaggaccuugaguucuacuacuuaguaauggaacuuauuuggagauagaaucucauauaucauauagcccaugguugccuugaacuucauauguggcuaauaaugguccuguucugggcuggagagauggcucaaugguuaagagcacugacugcucuuccagagguccugaguucaaauuccaguaaccacaugguggcucacaaccaucuauaacaacaucugauguucucuuauggggugucugaagacagcuacaguguacuuacauauaauaaauaaauaaaucuuaaaauaaaaaagaaugauccuguucugauccuucugcaucuuacguagugggauuacagauauguaccaccaugcgcaggucugccaaacacacuauugagcuacagccccagugguccuggaauauaucuuuugugugcuuguauugaauguauguaacauguaaugauauguaauauaugugcacgugcacacauguguacacuaagacacuggggguccuacuuugucacuaugccuuauuaucuugagaguuugucacuagacccggagccaggcuauuagccagcaaguugcagugguacaacugucuacacucccacagugaugguguuauacucacaugugccaagucuuauguuagugauggcaaucugaauuuagguccucuugcuugggcaguagguacucuuuagccacugagcagucuccucagaccagauaucucucuuaagucucuuuuuagcuguaaguucauuuucuucuuuuuuucuuuucauuucuuuuuuccuuuuuuagaaauggguuauuuuguucugugaacagaauuuuauauauucuggaggguuuuuuuguuuuuguuuuuuauucuggaguuuugaugguuacuagaugaugaaugucaucuccccaccuggguguuuuuacauuugucucugagaacuucaugaguuucauaacagauuuguuugguuuuguguagaagugugguuguagguuaugcaguuaaggugugguguacauguggaggccagagguauguaugguaguccucaggccuuguggaccuugguccuuuuguuuguuuguuucuuacuauuuagaccauucuggccuggaacucagagauaugccugccucugccucccgcaugcuugguuuaaagaugugggccaccaugcccucuccaccuugguuuuugagaaugggucccucauagccauaugcacaaaugcaugggugugugcuuguaugaauguguaugugugcauuucagaccagccagcuagggcuuugaaaucuuguuuuaagaaagggggggcgggaucugggguaagugggacuagcuggccaggagcuccagcugcccccacugccccccagccuccccggugcugggauuauaggagauguugggcauugaacucagggcgacaugcuugcucugcaacuguuuuugaugacugagcucacucuugagcuccuuuuucaauuuuuuguuuauguuuuucugugacagcgucauuaauucagaguggccuggaauuagaaucuucccaccucagccuccggucugauaccggaguuacagaugugcacuacugcacuuugcugguaggccagguuuuuguuuuguagccccgacucuccuggaacuuacuaugcaaaacucaagagauccaucugcuucuguuucccaagugcugggcuuaaccaccaccagcucaaguuuuaucuucuuaauuuuuggcaacuguagauuuucuguguucaaaagcuucaaaccagucaggcagugguggugcacaccuuuaauuucagugcucaggagucagaucucuaugcguuugaggccagccagggcuacaaagagagacccugucuuaggaggagggaaaaaaagaaacauauuuuugucuaugaauuaaagcagccauauucagaauuuguuuucaaguuuuccaucuuuguuauauucuauaguagaaaacugaggcugcuguucaccagcuacuagcaccuugcucuaaaaagguuaguuagaucacauauggcaguuaacacagagacccacagcugguugaggugcagagaauaaggcuaugggaugcuuagccccuucuucccaaaaaguggaguaaggaacugaagccugugagggucagagggaggagauggccacagugagacagcagggcagcugcacgugugaacuuucggcaucugugacagcaugcacaaguccugcuuccagccagaugguagccacugggagaagaagagucacuucucuuugaggauguggcccuuggagaguaacccaagcaccaguggauagccuacaaucaagaggguguggacaccgcaaacugaauucuauguuuuguuuuguuuucaguuuucuuugaagagggcacagaaugguguugacaaguaaggaagcuggaucugaaaggaacugggcaaggaagaauugaauaugaucaaaauacauuguauaauagugucaaagaauuaauaaacauuuuuaaagggggauggagagauggcucagugguuagguuaaaagaauuuacuguuuuugcagaggaccaagguucaguucccagaauccacuugauggcucagaaugacguguaacuccaguuccaggggcuaugaugccgccuucuaaacucugugggcuccuguauggaugugguacgcacacacacacacacacacacacacacacacacacacacauauuaagguccauacacauagucagauaauacaguuuuuuaaaauacuuuuuuuaaaaaaagaaaacaauaaagccaaguacuuaaaaaauuuuuggaaguuacugugaaaacuuaagcaugugagauucacuguuagaucuuucuuauaaauuguucauaacaugguugggaugacauaucuauguguaaaaauugggguuuuccuuaggaucauauuuaccaacuucugaacuauuucaaaaaaaauaauagaauaacaacaguacugaauacuugguugcuaauuauaaacuauagaauagagacugucuugaguuugucucuucugaguuucaaguucauccaaaguugggaacuaacaaaauuauucauuccaaaaauuuaaaugcauaucuaguaccaggaaucaugcuaaagauugggaauauaguagcgacugaagccacuuaauagguuauaggauguuauggagugaugguuaacaaauaccuuccccucauuucuucuuugaaauauaaauauacuuuuuuuuucauuuauucuccucacuuccccucucucccagaucaacuccuucucuguuucccuaaaaaaaaaaaaaaaaaggaacagaaagaaacagugggccuacagggauauccaccacacaaggccuaaaaagauacaaugacugggcucaaacccauaucacagcuggaugaggcaacccaggaggaaaaggguuccaagcacaggcaaaagagccagagacacccccacucucauuguugggagucccacaggaacaccaagcuacauagcuagaggguauauacagaagaccuggcucagacccauacagagccccuguuugcuacuucauuuucugugagcccccaugagcccugauuaguugcuucaguggcuuguguucuuguaauguccucuggcuccuccaagccuuccucccccucuucugaggagcucuccuggcucugccuaguguuugacugaggguccaugcacucgcucccaucauuugccucucugaagacaauacaaucugugaguguagcacaguaucauuaggaccauuucauugccuuuuuucucuucugcuaguuguguuugguucuauccugacaaauaccuuuuuagguuaaugcuuguuugucuugaaccugcuuggaagaaagcacacuguaucauagggagaauauaaugaauggaauuugaauugagaacucugaaagagcuccaugaggaaguaacaucuuaguagagacaacuuaaguuauaaauuaaccaaagaauucuggccagucacaagauuggcggcuggaagaucacugcacagugaguucaaggccagucuggguuauaugaaacuuagucucaaaagacaacaaaacccaaaaaucaccucuuaaucaggcagguuuuuuuagacugauaauuuaucaagcaauuaucuauauauaggcauacccuacuuuggaaauuaaaacaucagggauguuguuucuuccugggaucuuggaugagaagaaagagaggaagcuuuggaaaaacaggccaggaacaggauacacccagugaaggaacagauuggauagugcaaacuuagguagguagauuuuguucuacuuacauguaugucugugaggguaucagauccccuggaauuggaauuacaaaaguggugagcugucacaugggugcuaggaacugaacgcagguccuuuggaaguuuccuuuauaauuuucuuuaaagagaaaagagcucuauuuauaagggcuuuagggcagcuggaggagaugaaggccuugggagaaaaggaggagcugaguagaagguccuuguauuucuacccccccccccccguccuccuuucucuucccuccucacaucugguuagagucuguuuaaaaguucacuacagcauugagauugguaauggagugccuagagguuggagguaaggauucauuuaccucugcccuuuguuccuggggucuaucugcagcaaaagcuuaaugggcuauagccccauuuccagcuccacuugggacuucuggauggauguggagggugguuggggaccucagaaaaagugacaucaggcaccugccgauugggauaaugaggcucacagucauguuguguguuaucgugcccauaucccccuaggaccucaagucggaaggugcuuugcugaaguguuagaugauaguaaggucaccaggauugaaacugaagaggggucagagaagugagcauuugcugaggagcugagacucuacaguuuaucaaagaagcuauugaccuaggcuucuaguaaggagagccuugaggcagcuaugggcuccagaaaagccagguggcuuuaggugucaucugagauuuggauaccuuugugcaggcaugacccuugauguuggagaacuuaaaaucuguguaguuggaguucaucuuccagauuuauucuuggguugguguuccuaguaccaucauuucuuuuuuuuuuuuuuuaaagauuuauuuauuuauuauuauauguaaguauacuguagcugucuucagacacaccagaagagggagucagaucuuguuacggaugguugugagccaccaugugguugcugggauuugaacucuggaccuucggaagagcagucgggugcucuuacccacugagccaucucaccagcccaguaccaucauuucuaugagaaauaguuuacauacugcccccagggagcaugagcuguccaaguagagggcagucaguguuuagccaguauucagccucugaccacaugauagagacaaggcuuaaucauugaccccaaagaugagcucuggagagcaguaguaccaaaaacaaaugcaggaaacccuggacuucacagggagauaguaguguugagauccaccaguauguucuggacugauaggugacauguaccgugugaauugauguagccaauuucuaaaacuguuguguaaaccuuaaccuagguauaaggauaaucagcucagccuuugggccacuaggaacucucucagccaugugaccccauaccagauuaaaguacaguucaucuuuuuggagagcaaagaugucuugauuaggguuuuauugcuaugaagagacaccaugaccaaggcaacuuuuuuuuuuuuuuuuuuuuugguuuuucgagacaggguuucucuguauagcccuggcugucuuggaccucacuuuguagaccaggcuggccucgaacucagaaauccgccugcuucugccucccgagugcugggauuaaaggugugcgccaccacgcccggcgcaaggcaacuuuuuauaaaggacaacauuuaguuggggcuggcuuacaguuucagagguucaguccauuaucacucuggugagaagcauggcagcagcuaggcagacaugaugcuggaggaucugagaguucuacaucuuuaucggaaggcagccaggaagaaggacuggucucugugcuuggcagagagccugagcauaggaccuuaaaacucaccucccacagugacaggacuuucucccaacaaggccacaccuccuaauagugccacuucccaugggccaagcauauucaaacuaccucaaaaaggagagaugugagaaaaaagcgaggcagaggcugggaagguguguagagaauaaugagagaggaacugggcuuauuggaaaggcagguaagaaaacaugggauuagaguggagcagucccuggguacccuaaggacuuaauaccuucccacuggaguagaaagugucauggccucacaguguggcagugguucaucuugaacauaaccauaaccuuguugauggggaccaguucccuugugucuaguauauuccaaaugagccuugucacuuugauaucugagccaccucuuaggagugcucuagguuuuggucuagggugaauaccacuguggucaccuuucuacugucacaggcagcccuacucugagugacaggaaauugguagguuuaagguuuuuaugccuccagccaugucccuuagcuaaugcuucugccaccuaguucugcuaguagcugaccccccccccacacccaaacacaccacacaugcacaccccuaugaccuaccaacaccuuggcugcagggcucagcugcuaggcuccugcuucuuccagguucccccugucagacuccccaguucaucuuuuuauuggcucuccauguaacuaauucucacuuauuaguguuacggguuuuuauuuuuuuguaguauuuuauauucaugaauauuuuagguuuuugguuuuugagauaaaagagucuuagacuguagcccagauugacccagaauuuacuaacuugcuuugacuagcuuugaacuugugacaguuguccugccucagcuuuuugagugcugagauuacagguauaagcuaccacgccuguuacauuuuagaauuuuaugugaucauuuaacuccuugguauuuuugacugggauauagugguugcaaagucaauguugcuagguuccuuuuaauauccugauguguuuauauguucauauauauagguugccuguaucugcacaaaguggaaaccagaggucuguuucaacucucuaaccuuggguuuugguuugguuuugguuugauuucuucagacaggguuucucuguguagcccuggcuguccuggaacucacuguguagaccaggcuggccuugaacucagaaaucuuccugccucugccucccaagugcugggauuaaaggggugcaccaccacugcccaaccccuaacuuuggguuuuuguucuuuguugagacaggguuucuucacuggccuggaacucacuaagcaggucggauagacuggcuagccugugagucccaaaggauccuccaguccccgccuucccugugcugggauuacaggcacuuauccccacccuuguuuuucucagggcuucugaaguuagagcucaggcucucgugcuugcacuagcuaccacucuacaguggagcucacccccaggccuaauuuaauuuuuaacauuuaaaaauuuggaguuguugaauuagcccaguggaaaaauaaaagccuuccgugcaagccugguguucagucuccagaaccuguaguggaaggagaaaauguuuaagaaagaagaaaaucuuccuagaagauguucuugcaaucacaccaaaaauuaugaauaagauuaaaaaguaaaacauuuuuuaggggucagauaauauuuuuaucaaaaguucauaucuccaacaaccuuuuuggucugccaauugcauugauuuuuacuuugggacaaacuuaaggguuaaacagaaugcaacuguuaagucauuacccugucugauaauuuaaauaugaaucacugagacagguuuucaaacucauagaagcagcuccuuacauugguuucaaauccuacauaguagguuagacagauuuucaauuaaaggauauugagaacugcacaauauauacaauugaguuuguuuuuauuuaacuuccaaguacaggcaaaaugguuauauaacuaguuuucauuuucuuuauuuuauaaaagaaaguuuaagugauaaugaugagccaguuguuuuggcgaggguuaagggggaacauguuuauauaugacaugcacguuugaacguucauuugugugugaaugugcauaugugcugugggacacuuguugcagaguguauauggaagucugaggauaaccuugggugucaguccuuccucaccauccuucuugcuuuccuucugugugcuauucuccugucuccaccuccuaucuuccccauaggguuguugugauuacagccuggggauucaaacucacccucacacuuguguggcaaaugcuuuagccauggagccauuggaaaaagauuuuugucuuaguguuuuuuuuuuguuuuuuguuuuuuuuuuuuuuuuugguggggaaaugucugaguaucuugguuaguaguuuuuugguucugcuuuacauuauuuugcccauaaaauugggauuugguuauaaauucucagcuuuauuuuuccuuaauuauucuguaaugcuuaauugacaaguaaguauaacugauuauugguacuagcucuuauuuuucugaguacaagagucauuuccgagauuagcaguuuucuacuuaugagccaguuuuuuguuguuguuguuguuguuguuuuuaaagacuuauuuauuuguaugugaguacacuguugucuucagacacaccagaagagggcagcauauccaauuacagaugguugugagccacauugugguugcuggaaauugaacucaaaccucuggaagagcagucagugcucuuaaccucugagccaucucugcagcacaugaaccagguuuuaaugguaacuugaaagcucaucauuccacgggcaucacagucugcuccccuccccagcgcuggcuggguccgcagaaaugugcaccuguuucucuucccucucucaugguggaaauggaaccuagggcuuaaucuggccuuuuuguguuacugauaaucuuaaguccaagaguaugcuuaauuuguaguuugccuuccucauuuauuuauuuauuuauuuauuugcaacuaauguucucaucaauugaguuaaauauuaaggagcuguaaauacaaacugaacuauucuguuuuuguuuuuauuuuguuuuuguaugaaugauuugacugccuauauaucuguguaccauguuugccuggugccaaggaagccagaagaaugaguuauauucuacuaugucguuggaguuacagacaguugagagccaccaugugggugcuaggaaucaaaccuggguccccugaagagcagucagucuuuuaagccaucucuccagcccuuuuucauauguguuucucuuuaacgauguuauuaguuauuuuuacuguuuuuacauuugugcgcauauguggagcucagaagacaguugaaggagucuguucucuccuuccacccugugggucccugugacugaguucccguuaucagauuuagguagaaaguuccucacccacuaagccaucuugucaguuccuaaauuguucuuuuaaaaaaccaguucuaacaagucagacuauaugaauccugucaucccuggaucuauagauagauguacuauauaaaguuagugcuugugaaauuuaugcagaacuaaacugaggauuugaaaugggcugaagggcccaguguagcaucuugacaggcuguuuucuagaugcuagccuugcuguuagugacuuaaaauuaucuaguuuugguuaaagaaaaaaagaggcagauuuaaguuucucaaauuauagacuuacuuaggcuaguaauauacuuacauaccacuuccugguacuuuaccauguuccagaugcuucuguuucacaguaguaauccugagcaguuaugugcaauuguuaaaguuuuuaauaugucacagaaauuuauucauuauauuuuucuuuguggagcugggcaguaguuacacauugcgaauaucuuuaauccuaggcagauggaucugugacuucaaggcacaguuggucuagacuugaguucuaggacacccaggacuacagacagaaacccugucuaaaauaguaauaguaauaauaauucuuuuauuuuuuuuaaacaaauagcuuaaguauuuuauucguuugcaacuaagcuuguuaacacuauauaaugaaaauguacaaagaauaauguugcagguuuugguuagauuuaaaucaaagacauucauuaauaaggaaucuucagaugugaauaccccagaaauguccgcaagccagcugaucacaacaacugucucugaauaucaccuuacuuuguaagguauuagcaaacauuugaauuaaaacucaagauuuuuccaaaauaaagccguaauuaauauaacuauucuguauucaaacuaaaacaguuuucauaaaacuuuccuuuccaaaacaacaguaaaggaaccaaggcauuuuguaaaaugugguccugaacaagucacaguaaaaauaaauguauacuuaaaucccaccuccucaaaacagaggcugcuuucugcucacaaccuugggaccaaggcaaagaacagccaauaagcaacuuccggcaggguauugccaaaaccaagcucuaaggguugaacacggacaccucaggagaguuugggguaaccuggacaaaggguccagauucuauguugaaacugaugcuaaggugagcggcuccucccggguagcagugcugugagccuggcccagccccgcacucguuacaugcuccgaggacacccugaucuuccgcuccaggggagaucuuuucccuguagaaguucagcguucagggagcuccgugacuguaugaaugaggugagcucagacuccacaggauauuuuaaggcuuggagucaaaguauuuuuccagcacagcuaggcagaguccauguacugauagccugucucaguuuguucuaauuucucacuacguauuugcagauucaggacugcagaccuucccuagaucaucauaaucacaucuaauguccauccuaacucacauuucaaauucuaugccugggaacagucccuguauuuaacgauaauaccuacaaauaagcaacccacuguuacaaccuauauggucaccaaacauuaaugauauucuguagaccaagaaaauguuuuuaaccauaauugucgugcaucaaauucacagccagaauccccaagaucaaaaaaauuuuuuuugcacaauacaaauaauaacuuaaaacacagacacacacacgcacacacucucacuucucacagagcugugcuuggggagacuccacguguugagugccacugaaggcauucuuugcuagacugcuguugcagguacuuugucuggaaaaccuaucacaguagggcacagcuguuuaguggaugaacagaaaagaaagauaugcuuguggcaaccagaaagguuuaaggucuuucaaguuguauaaaauggaccugcagagacauuuaaguguucucagggugcaaaguuggagcugaaaugugauaucaaaccaguugcaaaaaguguacagcagccaucucuugaggucacaccugguaccagauaggcaagaaggcuucaggauacaccugggaguuugguacugagggucugcucauacuccucucggacuuuaucucauaguauuuuaagagacgcucacacauuaaccccacuugucgaaggguaaaggugggcuggcccuucuucauccagaaagcaccuggagaaccuggugcagugagugccgaggaggaaggcugacuuucugaaguauaggcuucgcuuugacugagaacaacuucuaaaugucuccaucucugguaacgauuauauucuuguuuuauguucugaaaaauuugcucgggaguuggaagacaacucucgcugccgggcggggcaggcugcuggaggcucgccgguggcgucugcaucugaagugguggcggcucggcguccggggggccugaggcccggaguggggccgggcagaggggcgcagcguugccgauucggggaaccgggcuaauaauuccuuuauuaggauccauuuuuuucuaucacaaaguugaaaguuaaaacguuugaaauaguuauuuuucuuuuuuuuauuauuauuacagcuuuaccaacagggacgcuugugucagcucggcagugaauucugugaauuggaaguuuuugcuaaaguuuugagagcuuuggauaaaagguaaauuuguguguauguguauaagcuuucuugcuuccuuccuuccuuucuugucucauguggaucaagauggccuugaacuuguuaaacuucugauccuccugccucuauuuaaaugcuuggauuacagauaauggacagggucacccccuugcccccaaaauauccaccaccacuacaacaaaaaccugcuaaaauguauauaacauaaaauuugccacuuguaucauuuuaaaaugcauaauucaaggacuagagagaugucucaguggucaggagcacuggcuguucuuccugcagaccuggguucaauccccaguauuaccugugagcucacaccugucugcaguuccacuuccagggcuucugacacccguaugcagauauacaugcaggcaaaacaccaauggacauaaaaauaaauuauuaaaaaugcacacaauucaauaauauuaaguauacuucccuuguuugaccauuuaguaauagacauugccagaauguuuucacugucaagacaaaaguuaugaguaaacaagccaccacugagugcuaugauagcaaaugccauggcgugggaaguagagcucaaugaaaagucuugaagaacagaaugaugauagccacacuuucucuauagugggaggaagucagagagcacgcuuuauaaaugcacagaacacuugcugaggggucaggcgguuuuguuuuguucugaagcaaggggcucaugugugggcauugguccucgccuuacaccuucuugagccaauauuucucuucguguucucuguugaauuugccaggcuggcugaccugugagccuccagcaagucuguuguucaagccuccaugcucuucuagggugcacugggauuauuggugcuugugcugcuguguccagcucugugugugcucugcagugcagacucagguugucaggcuugugaggcaaggaugagccguuucccuagcucauugucuuuuuauuuuggaauguaugugacauuuuuuuuuucagacuuagcuucaacucaccuuauucuuuuggggaaaacuaauacacaaauauguauguacacacauauuuacuagguauauuaauggaggagcagcuagcuccaaagggauaccaucagugacuucucaagaacugcuuuucuuuuuucugcagacauuugcuccaccacuguuuucaggcucugauggaccauggcguuaagguagcuuccgucuuggccuacuccuucaguagacggugcucuuacauagcagaguccgacgcugcaguaaaggagaaggccauccagguuggcuuugucuuaggugaguaauggcaaaggagagggcauuugacucugcagugggccuguaguuaaaccuucuaaccagaaggcuucuuccaagaguucccagucuguacaggcagguugugagcaacuguuauaccuguggccuacucauauuuagucuuaaguccuaaaccuuucuggcauucuauccuagggagguaacuuaacgacagcguuuacauaugaggaaguagacuuagagaagcugaguaagugaagcagcccauagcuuugagugagcuauguuuagcaugaguuaugucugugaucccaagcaugccauucagcagugucagggcagcaccaccccaaacuccuuagcuacugacuacuuacuguaugcuguggcaugaggcauacaucuucucagggaccgguuuugguuuucauuucuaaaaguaguuauuuuuaauuuugggcgagcuacuguaaggauagcagaaacaucgcuuuauaauauccuggaaagauuuuuacauauagaaaaauacuguuccauaacuuuguagugaguaguuucacaacuguacagagugaaaaaguauguuuuaggcaauuauuuauucaaauuauuuccuccuucuguccagaucauacuuuuuaaaaguuaacuauauacgauguuaauauuauggaguuuuuagcucagugauuuaguguaagcgugucucuaacguucaggcagcuuacugagucauuuaaugcugcugcuuuuguucuucagguggcuuucuuucugaugcaggcugguacagugaugcugaaaagguuuuucuguccugccuucaguuguguacgcuacaugaugagaugcuccacugguuccgagcaguggaguguugugugagguaagcagagcaaauccugugauuaagugcuacuuaguuauagugguacuuagugcuaguggugcuuaguuauagugguacucagugcuagugcuuugggcuuagaauucuguccuuguucccaacaguugauuaaaucuuuacaucauggucucauuagucuaaucucgcaucuccaaaacacacacacacacacacacacacacacacacacacacacacacacacaaaacguaucaccuacacacaggcauaguccaggcgagucucaaacucugccucccaaguacuggaauuaaagugugcaacaccaugccuagccuauuuuguuuuuuauuuuuuauuuuauuuuuuuuauuuuugguuuuucaagacaggguuucucuguauagcccuggcuguccuggaacucacucuguagaccaggcuggccucgaacucagaaaucugccugccuccugagugcugggauuaaaggcaugggcaccacgccuggcuaggaaacaauuuuaacauggauuuaaagagaaucagaauuucauaucucaauuuccuaaaguucaaagguaaauagaaaugagaagcuaaaagaaaauagugguaucucaguguuugaaagaaaauaguauauauaccucacugaauuuuuaggacaaaggaaaauauuucaaauccaagauccagcagguccuaauguguacagguagauacccugugagucuuagaaggcaaacccucugagucagucacuagcacaggguguggcauccuuacugugauacugcuucagguuagucccagcuuaucuaccccucgguccugugcaguuguuagugccucugcucaggcucucucaucaagcaggaggaauaggaauggcugacagagagcuggcugugugcugcaucgcacagugguuucuuuauuagcuuaaauccaacuaagugaaacaggacagaaucagaauugagccauggcugcugaccuagagguuaaagucuccuaugggaaucuuaugggaaguuguacauuaucaaucggaaauuuagaauaaaggaacacauuucuagacauguacaaacuauccaaaugaugauauaaaaaaauugaacaucucaacagacccauaacagguagagauugcaaguuuguauuaacaaauagaaauugcaaauuuucuuauaucaaagacaauccaggacagaagauuuugcuggugaauuguaagaguuagcucugguccauuccaaacuacuagaauacugaagaggaauuccuuuccaacucauuuuaugaggucauuaugaccucauuaaugaaagcccaggaaauacauaagauacuuagagacuagugccuccuuaaauacagaucagaaauccuuaacaaaauacuaauaaauaaaaccuaaaaaaaaucuagaacaauuuauucugugaucuuaauuaaagugaggucuaaaccaagaaugcaagaguacuuugacauacgaaaaucaagaaauacacuauaccguuauaauauagacugaauaagaaguaugauaaguuuucaacaguggacguugaaaaguauuugacaaaaucggcuauccuuauuuaguaaaaacauguagaaagcuaggacuagaagagaaccuccuugcuuugacaaagaacauuuaugacagaccuacaggacaucaggcuauaacacuagccugagcuacauagcaggacacugucugaaagaaaaaauagggugguacuaugugagggaguucgggauggggaagagagaacaguuaacuugguaauacacuggaugguuuuucuccuuggaucaagagaaagguaaaggaugucuucuacuggagguagucaauauuauguuguaauuuuuagucaaaguaggcaagaaaaagaaauaaagaacaucugaauuggaaaugggaaaaggacugcauucauugaacucagagacuugugacugggugcaguggugcacaucuguaaucccugcaaucgggagguagcgguauuggcauugcugagaacaaccaaaacccccggaaacuuugcagaggacacuaucaagacagugcuuuauuuuuguaaucucagcacucaggggacauuccuuccugucuuuucacccagcuuguucuuacuuauuuccuuucagauaggaucucaguauauauccaaggcuggccagaaacucagucucuuacccgagccuucugaaugucagaacaggguacacaucauucucacugauccugacucaaauaaagacagcuugcagacuggggaaugguauuuacagcuugcagacugggaaaugguauuuacagaucagguauuggacaaggguccaggauccagaguguaccaaguguacaacuuaacagcaaaugacccaagguuuuaaaaagacagggacuugaguagacccuuuccaaagaaccuguguagauuacuguugugcaugugaagaaauguuagugauagaccugcacgucugugacuuaagggaacuguaagucacacauguuccauaccacuucacauggaccaaagccaugcaggauuuuuuuguuuuuguuuuauugcuuuuuuaucuguuucuuuuuuuguuguuguuuuuuagauuuauuuauugauuuuauguauaugaguacacuguagcugucuucuggaacgagcagagguacuaaaauucaacuucauguggcuucucaacagccgcaugaaggcucacaaccauuuguacagcuacagugaacucauacauuaaauaaauaaaucuuuaaaaaaaauccaagucucuaucugcagauaaaaagauacuuguucuguguauacaugagaucacuccauuacccaggcugaccuugaacucauucuguaauccaggcaaguuacugugcaagccuugagcaaauugccucauucaaguaucuguugaguuuuacucuugugugcuucuuuauacuugaguucccugcucuaaaacagucauuccaccuaccauucuagagcaguguaauuaauuaucccucucucucucuuugucuucugcagagugguagguaaugaacguagggccucacauaugguaggcaaagguccuaccaccuaguuaugccugccucuuaggugguuuuguuuauucuuaguuucauuaucuaggccuagcuuugugucuagagugugcugguauaaaugccaugcucuuuuuucuuuuuuuuuuuuuguuuguuuguuucuugagacaggguuucucuguauagccuuggcuguccuggaacucacucuguagaccaggcuggccucgaacucagaaaucugccugccucugccucccaagugcugggauuaaaggugcgcgcuaccacuccccggccaugcucuguuuucuuugagaugucuuuuaugcuuuuauugucucuaagcauuuucaaaaaauuguauuggcccuauagaugauuguggcauucaaccagcaguguaauaaaugaguauuuguucuaauaacuaucuuucuuguuucauauagucuguagauguauagucuacuacugccuagcauuuagucugaucuaaagcauguggauacucuuucauaauuugauuguuagcaggcugcacuuuauuuuguguagcauacucaggauuuucugucacaggggguagaggacaaauaggucucccaguuguaucauugacucuaccuuagugggcagucagcagaaaugaacacuuaggaagcagccugaccgggagcagcggcaagugcugaagugacggcaggugggacugggucacauucaucugucuucacuauuuucuguguuagaucugaauuuggaacagaaaggauuuuuguguauuuguuugguuagcacauguuggguacacaaacuauuugaauauuuagagaaacuggacgagauuaaucacaaaaagcuuucagcacuaucagugccucucuagagaaaaugguucuuucaaauacagaaacagggccugucucugucucugccuuguuggcgcugccugguuggcgcugcugcaucauuguaagagguggucagggucacuguccuggcagcacccaaaguaaagaacuuuuguuuucuacagguugcuucaugugcgaaauggaaauuguaaauaucaucuaggugaagaaacauuuaaauuagcucagacauacauggauaagcugucuaaacauggccagcaagcaaauagagcugcucucuacggagaacuaugugcacuccuguuugcaaaaagccacuaugaugagguaaguuggcuuuuuguuuugagacagggccuguuucuagcccacacuggccuugaaaaugugauguucucaccucagccucuaaagugcugggguugcaggcacgugccacacagugaaauaagucccucuuuuacacgucuucuaaauugcauuucauguauugggugucuucaggguuauuuuucuguuuaguuuuucaaauaagacauagaccagguagccccgaccaagugcaggcucaugauccuucuguuucugccucuugagugcuucaaucagguuaaaggccugaaccacuauucccagcuuucacauauuagguucauguaauagauuuuuguugggccaggcaguggugacgcacgccuuuaaucccagcacuugggaggcagaggcaggaggaucucugaauucgaggccagccggaucugccgagugaguucuaggacagccagggcuacacagagaaacccugucuauaaagacaaaacaaaacaaacaaacaaacaaaaaaaaagauuuuuauuacaaaguggaaaaauacuuaauuuucuaaugaaauauauaacaaccaagaguguuugugagguggaccuuaaguacugcaagugaaauauauggcuuuuaaaguuuuuguacggguguuugucugcccaacuugcuuuaagggaaauccuggugaaucguaaugcauuugguuaugucauucugaguuaaguauuuaaacaugaguucgaacauaaguauuuaauuugccaagcacccuacuacagaaauguuuuaaaacuucauuauauuuaacauaguucuaaaaauguuuuuguacuacuuugagacaaaauuagaggucuuagccuuucuauugcugugauaaaaugccgugaccaagaaagaacuuuauuucaucuuagcaucaggguaagaacucagggcagaagccuggaggucucacccacaucagucaucagucaagcaaacgcaccauaggcuugcccacaggccaaucaaguugggcauuuuauuaaauuuccuuccucucagaugacuuaucccugucaaacugacauaaaaacuagauagcacagucucuuaaaauugcaaaccagguuuuggaauccaagucuggugaaguuaguagcucuuauuuuuacauuaguuauuuugaauagcauuguuucuuaagugaaauagaaaaacccggaacuuucagaagauaacaaauaauucucuuucuccauccuuuuuguggguguguugugaagggggugcauaagcacaugacuggaggcuggaggucaguggugggguggucuucggaagcugucugccuugaguagauuucuucuuacguguuugcauguaugugugucuguugcuaugugcacaugaguacagagauuccagaggaggcuagaagaguuuguuggacccuuguuacaguaggcaguugugagcagucuaaucuggaugcugggaacugaauuuguuuugugugaaagagcagcagguccucuuaaccacuaugauauuauguuugcauguuuaguaugcaugagugugcauguauguguucacaugggugugagagcauguaugugggcaaguacaugugcaggcaugcauguggaaguccaggguuugaacaggaaaucucagucccuguuccaccuugagauaggcccucucaguuaaacccaggcuuuaucaauauggguagucuagucagucagauugauggggcagaacuccccuaucuccaccuccugaggcuagaaaaagaggugaguuuacccccaccccaccccaaccccagcauuuaagacagauucucucauggguaccuggugcuccaugagcaggcccagguaagccacugggauaagugcauaccaccucagugaacguuuugccuggguuugggagaugagacucucagguccucaacugcgcaguauacacuuuacugaaguaucucccuguccccagaaacuuuucuugauauaauagcaauugucacuauccaggauaauuucuuuucccuuuauuuuuaaccugauaaucacuaagaaaagguccuuuuuguuuauuucgccucaaauuacauagaugcuagcucauucccugccacuugaccucuaugccagaagccagcucuggcauucugguuugcucuugaaagauugucagcagggggaagaauuggucuugugagaaauuaggguugcuuuuuaauacuaaaacaguuaccuaucucaagucuaaauuacuuugccgugagagccuacgugucugaguuccuccuagucccaacacugcagaaucuuugguguuuagcaccuuauuauaaacagugggggcuaaguaaaggguuaauuguuaggauuuuuuuuucuugucgggaacagagaaggagguuuggagcaauaacuuuuuuuuuuaaagauuuauuuacuauuauacauaaguacacuguaacugauuucagacgcaccagaagagggcgucagaucucauuacugaugguugugagccaccaugugguugcugggauuugaacucaggaccuuugaaagagcagucagugcucuuaccugcuaagccaucucuccagcccagcaauaaacuuuuaauugaaccaagagaagagagucaauugcagaaggaaaaacuuuuacacaagcaaauaugcauaaacucacguucauagacaaauuuauaaacacacaaacaccuucaugcaauccaguuggguccaccuacuuaucucauaauuacauacuuauauacacauccauccauuccugcaugugcauauggagcccaagcaccagugcagaaaggacucacuuauuaugaauggaaagugagcuccagucuuuacugcauagagaaagaaaacuucucuacccuuuuauugcuaaaugaauuuaacccacauuuguaagaaaaaaagcuuuguccucuuuaguaagacuaauccuccuuugcuguuaagaaaagaccugagcugucccguggugccugcugcuucugcucucugcaccucuucucugccccucuuucucugcauucuggguauuguucucuucugccccugccccaaugcccucuuuauuuuuaagggaaguaaagggggaagaccucucaggcuauagaugcucgcuagauuucucuaguuacucuaugcugcugucuucccugucccagugccaugcaguguaauugcccuuaguuuuuuguaccuuuucuaggagaauagauaaugguuuuuuuucaagcauccuuuuuuuuuuuaaacaaaaguucacuaaaacuucaaacaugaauucaaaucauaaauuaaauaagaaauuuacaacagagauauauacauguguuaagacuagacauuaucucacuagcuucauagguucauggagaguaaaagaucuuaauuuuuguaucuaaguugacacugaaguuuuguauagauaaacccagucaauauuuuaucuucuguccuuguacccacaauaaauuguuaguuccccuuuaugacauuugguuaauuguuuuacagccucuccuaaguuguaaaugccugcuuucuaucucagaagcaauucacucuugacacuugaagacacuugaagguucuaacuacaguauucauaucauagaagacuuacaauagcaguccuauuacaaagggcuuaauaguuauuaguauaauuuuuuaaaauucuuuaaaaggaucaucauuaagaauuaagaaaucgggcuggugagauggcucaguggguaagagcaccggacugcucuuccgaagguccggaguucaaaucccagcaaccacaugguggcucacaaccauccauaacaagaucugacucccucuucuggagugucugaagacagcuacaguguacuuacauauuaaaaaaaaaauaaauaaauaaauaaaaucuuuuaaaaaaagaauuaagaaaucuaaguuucugggcuaauaucuacuuaucagugaguacauaucaugugaguucuuuugugauuggguuaccucacucaggaugauguccuccagguccauccauuugccuagggauuucauaaauucauucuuuuuaauagcugaguaguacuccauuguaccccccccggagcucaugucucuugcugcauauguaucagaagauggccuagucggccaucauuggaaagagaggcugauugguauugcaaacuuuauaugccucaguacaggggaaugccagggccaagaaguaggagugggugguuaggggaguggggggcuggguaugggggacuuuugggauagcauuggaaauguaaaugaagaaaauaccuaauuaaaaaaaaagaauuaaaucauuuauuugucuauuuagcauuacuacaagucauuacaucuucauuaauacacagaaaucugccuaauagaguaagcuaacaccuagugauuauucuauauauuuaauaauaacaggaagucguauuaauaguaggaaucuuucuuaagauauggccuugcucggccuugccuagaauggcuccuccaucgugcuguuauagugcauggugaauucgucucaggaagaucaccuccuaguuuucagucucuuuagauagcuccuggcaccuuucuaucccauuuuuguuuuuucuuuguguagcccucacuaucuuggaacucauucuguagaccaggcugaccucaaacucagagauuugcuugcucagcugggauuaaaggugugugcuaccacugccuagcuguaccuuaguuguuuguuuguuuguuuguuuguuuguuuguuuguuuuuaauaauaauaauaauaauagugcaugucaugaugcugugguaucaguuaaaugcauuaaugaacaugaauugcuuauuagaacaauagcauaaaggaggcacuacuaaacagacaauaguagcuggauauaauagcacauaccuuuaauccuaacaccuaggagacaggccaguuggcuuggauuucucugagucuauauagcaagcuccaggcuaaccagggcuacauagugaacccugucucagauauaaaggagagagugaguagaagagugggagaugggggaggggagagaaugauaaaguguuacagaagggaaaggaaaauacaggaaacaaucuaggacugacaucuaaaagaugagcuugguagacuaaggggcuggaagaaggggaaugguuccuaaggcaguaggggauccuauauaccaaggccucugggaaaacuagaaugugucuguaauaguauaauuuaggaaaauugugguuuugagggggaguguuucauaggacuccuagacucaccuccauugaacacgggaacauccuucuucugccuccuugauuuugaaauuguaaguaugcaccaccacacuuggcuucagaaaacuuguggauguaaaaauacaaauagggugaucaguucauacuuccaaaaaauugucucagagaauuucaguuguaaauauuuuguguguguauuuaaguauuugugggguaacuucacaguuuuauuaaagacgaucauuaacugugucgcuguucuuucgcuuuucaauucuuucaaaggcauacaaguggugcguugaggcaaugaaggaaauuacagcaggcuuaccagucaaaguugugguggauguuuuaagacaagcuucuaaggugaguaugauguuuauaacauuaaauguaucauaacacuuaauugccuuuaaauaguuaaucaagucuucauaauaacuuacuuaguugauuuauuaacuagaucuguuuucuaagcuucucugcuuaguuuuagaaacuuaguuucuaaucuaaacugucuuauggcuguguagugccuuuaaucccaauacuugggagacagagacaaguugguuucugggguuaaccuggucuacauagugaguucuaggacagccgagacugcauagagaaacccuaucccaaaaaacaagcuuacaaaaagaaaacuaucucaucugcuuuauuuaauuuuccuuuauaaaagaaaccugagaagauaauuaugaaguucacauggugcuaauuuggcuugaaugcuuguuuuuccuaaaucuguguggggaccucaauuucucauucagaagucaugugggaccugaugacauuucuguaggcugcaggcuggaacuucuaguguguuuaacuuucuccuaagauuguguuucacucaagauagcuuguuacauucgaccugcuagacugucuuuguuucuuuucccccuguaguuucuuuuucuguaaaugaguauaugaauguuucgaagcuguuuauuaguaccucaaaguuacugcuucaguguguaauaguuaaagcuuuggugaacuuucacacacucucuuugucuagaaguuucucacauuugaauaguccauuuugguugguauaaucuuaguucaaaauuuuggauuagaagacaccauuguuuuugugaaauacuaaaaaaguuguuuauugcucuguaaccuuggcuauccuucagcuugcuaauaguuauaauuguccuccaauuguaacucuccuuaggcuucaggcuugucccagucauucacuuuagaaggagaauagcagcauagucagguagagucuuucugagaaaaaaauguuagcauacuuauuuaaaacauuaaauauguguuuguaugaaauaauagcaugcaaauuuuauauaugcacaugauauuagaguuuagaaacugguaguccggccuggagagauggcacagugguuaagagcacggacuguucuuccgaagguccuaaguucaaaucccagcaaccacaugguggcucacaaccaucuguaaugagaucugacgcccucuucuggugcaucugaagacagcuacaguguacuuacauauaauaauaaagaaaucuuuaaaaaaaagaaaagaaaagaaacugguaaucuucaugguucaaauauuuuuuaaauaauugaaaacuuggauuucuucuguacauauaaaaauuauugugugaaccuguggccgugauaaccauaugucucagaucuuguuugaucucauaagcugaggggggaaagcccugaauagcauaagcuguaaacagcagauggcagguaacaaaaaggucugguuagaugacucgguggguagagacaucaagcauggcagcugaguugaacccugcaggacucauugguagaagggaagaaagagcugcugcaagcuggccucucaccuucacagauucucuuaugcugugcuuaugugcacgugugcacucuaaauaauuaauaaguaguguuaaagugugggaccagagaagcagcucagcaguuaggcacuggcugcuucuccagaggaccucggucugauuuucaguacccacauggcagcucacaaacaccagauccaggagcucaacgucuagcaugcugugggcauaguaccuacacacacauaaagacagugaaaaagcuuauuagaauucaucccauaaauggaguguguguguauguuuguacacuuaaaaauacuaugcugaguccucuccacaacauuuuauuuuaauauuauaaaaugcacuagcucguggauuaccuuuguacaucaggguuauuuuugggggguggguuuuuuuguuuuguuuuguuuuguuuucugaggcaagguuucuuuccuaguuccagcuguacuggugcuugcccuuuuagaccacuguagguuggccuggaucugagaaaucaaccugccucugccuucugagugcugggacuaauggugugcaccacggcagccugacuguuacaacagguuuauacuggaaaugucucagaauuuccccaaauuguuuacagaucuguuccuuauaaaauuacuagagauuuggaaagaaauuaaaaauugaaagaaucauugaagguuuuggguuuuuuuuguugguuuuuuuauuguuguugguuuuuuuguuuugguuuguuuugguuuuuccagacaggguuucucuguguagcccuggcuguccuggaacucacccuguagaccaggcuggccuugaacucagaaaucugccugccucugccuccugagugcugggauuaaaggcaugcaccaccaccgcccgacaaaguuuuuuuuuuuuuaauuauuaacuauuacauagugaacucaagcuauagaacacuaaugaagcauuugagaguuauuuaauaauuucccucuuuauuuuuaggcuuguguagucaaacgugaauuuaagaaggcagaacaguuaauuaaacaugcaguguauuuggcacgguaagugauuguuacucaaggugcuguuuuaauguguuucucaacauuagauacuaauacuucuucuauaucuuuucauagagaucauuucggauccaaacacccaaaauacucugacacacugcuagauuauggguucuacuuacucaauguagacaauaucugucagucuguugcaauuuaccagguauguuaauaguuaucucucuuugcuuuuacccuaaguugacuuguuugucaucuguaaaucauauguaagauaacucuuggaggaacuggagagauggcucagcaguuaacgacacuggcugcccuuccaaaggaccagguucaguucccagcacccaauugccacuucaaaacugucugucacggguguguguuugugugugugugugugugugugugugugugugugugugucugggggacuuuugggauagcauuugaaauguaaaugaagaaaauaccuaauuuuuaaaaaauguagauuauaggacauuuaucuggaaauaaaaaacugucacugcagucugacacgcucacacagacauacaugcaggcaaaacuucaauacauauuuuuaaaaagcaauagcagaccaauuuuaaaaaauaaauaacucugugagcaccccuuucuuucuccuguaggccccaccauuacuuuacuaaguguuccuccauagaaggccucagagucaaaugucuuaagcaucguucaggauugaaaccaucaggcagcaagcggaucugguuuccacuggacuccugucuguaauuugcccagaugauggccuaacuuuguggaggauuuauaaacugucaaucuagcaguaauuuuagaucuugcaguuguuauuucagguaaaaguacucuaccaugacacuagacaggaugucacugacuuuacaguuguuuauuaaagaaggguguuagaagaagcuguuaggcccgaggccuugacacugguggaaccaacuuacugcagaaaaguagccagugugguuucucagacagugucuucacagaaccaggucuuucagggcaacuuugagauucugcccuucuggcaggacuguccuguuugaaauuuaagggacuagguacauagaguguguguauauaguuuguugaacuuagguaguguaccauauuauuaaaugucuuuaugauucuuuuaggcagcccucgacauucgacagucaguguuugguggcaaaaauauucauguagcaacagcucaugaagaccuggccuacucuuccuacguucaccaguacagcucuggaaaauucgacaaugcacuguaagucccaccuuucucucugcgaaggcugaugcugcucccaggacaguaguccuuaaggauuuguauggauagcuuugucuuccuggggggauaaaaugguuuugaagucauuuaaaaaccauccuaauuuuuaagacauacauuuaugcuugucuugguuucaaacuaagauuuaugcauuucuauaucagaaugggcuuuuuuuuucaguauuuucuucauauguuuguguuuguuuguuuguuuguuuguugaguaauuaguagccuuugugucaaugguaaauuuaacaaccuacaaacuuauugauggagaaaaaaacccaaaaaagugggucagacaugcucauuuauuccuguuuccuacgacuguuucaugccgugacagcagaguuaaauaguugugaaagacuauugccaauguuaacaaaguauucacuguauagccccuaacaaauuagcuuucuggaucugauaaaaacgaaacuuguaauauuuuggaggaaaauuguagccaaaaauaggccaagcauuauagaacagagccauaauccuagcccuaaugcuggguuuggaagaccaagaacuccagguacuuggugccaaguaugacugccugaguuccauacuugagacaaccaauguggaaggagaaaacugacuccagcuagcucucuucuaacagggccagcuugggcuacacagugaguuccaggccaacuuaggcuauacagcaagacaccuuucuccagaaaaacccaaacauuuccaaaggcagacuugacuuucucgaagggguucuagcuguuaacaaggcuggccuuauacucugggcucacacagucuccuugcauccucuucagagcugggaauuuuaaacaaaacaagauaaaaaggauuagauucuaugugguuuaaucuguuuauguccagagcgacaaaucuauagccagaaagggaaugauccucagaggugggguguuggaaggauuugggaauugcuggguauauauauauuuagacuuuuuuuuuuaaggucacagauaaccagauguuacuguggacagacaauuagagaggagagggauuugggggacuugaugugcucugguuagugacagugaaccaccagcauguggaggggaaaaucccacagagaaggaagagcagaugcuggagguguguguggcucggggcuaagaggguugcuauggggauggcagaaaaugaugucagagagguggcagggagacugaguuuuauagaccauaaugcagacuuuuaucuugagggaggugagaauacauugguguuaaaaguuaauucaugggcuggcgagauggcuuagcaguaaagagcacuaacugcucuuccagagguccugaauucaaaucccagaaaccauauggugacucacaaccacccauaaugagaucuacaguguacuuacauauaauaaauaaaaucuuuaaaaaaaaaaaguuuaauucacaacaaaaugaaguuuuggcacugagaaugaagucauguuugcuagcaugugugagauacugaguuugaauuuucaucccucaaaacaaaacugauucucucucucucuuuuuuuuuuuuugguuuuuccagacaggguuucucuguguagcccaggcuauccuggaacucacucuguagaccagguuggccucgaacucagaaauccgccugccucugccucccucgugcugggauuaaaggcgugcgccaccacgcccggcucacaaaacugauucuuaaaacuuuuuuuuuaagauuuauguggauuuguggggguguguguguguguguauguguguguauguauguaugaauguauacguacccaugcaugccagaugauugauuguaaaugcccacggaggcuaagaaaagggugccauccucuggagcugaaguuacagccauuugugagccacccaaucugugugcauucugggaccugaacuuggguccuaugggagaguaacaagugcuuuuaauugcugagccaucuucuggcccaaaaacucuuacucguuuuuauaguuuuauuaguacuuucuguuaaugucauaacauguguuguuuaacuaaagagagacgcuaaacucuguguguauugcagauuucaugcagaaagagccauugguaucauuacucacauccuaccugaagaucaucuucuucuggcuucuucaaagagggugaaagguaccuuugugauccagucucaaugauuguaaagugauaugcggcauaaauaaaagaaggcuguuagauuguuugcauaugugacuaaaauaguucccucagcucugcuucacuugagcccuuugauacagugguguuguuugcucaucugucuuccuccugccucugaguaaggcugagaguaaugcaggugauuccacaggcuugcuuacaguggggcauccuuuuaccucaacuuguaacuuuauugcuaauucucaucuaugcuuucucuuaaugcauugauucuguuuugacugcaucacccuugugguccuugugugcaugugaugggucuaacccuaauucuggguuuccuugcuucaguuuaacacuugcacauaagugagauaggaaagagaaagaguaaaguuaccaaagccucacuaauacuaaucaccauuuuguugauuagucugucccuccccccucccucccccuccuuccuuccugcccucccucccuuccuccuccuccuccuccuccucucuuucucucucucucucucucucucucucucucuuucuuucuuucuuucuuucaaguuaaauuaagguccagugauauggcuaaaggugagugggcagcugccaggcuuauauccuaagucagucccuaccacauacagguagcagagagagcucccacacaauguugggggggggggaauuaguaacucuuccagcuuuauaacuugauauuuuucaccucuuacaucaugaguuuuuuucauuucaauacacauaauuuuccucuaggcuccuuaaucuguucucugguaucaaaacuguuuuaaaccuucuuuuuaaaaaaaaugcugccaugagguagcuuucuguucacuaccuuuauauaagucggugcuaagaaauaaaauuaguugauaauaucuauauucuuaagguuuuauauuggguuugaaauccuugaauagaacuuugaaauuaaaaugucuccuggccugauuggguuguucaaauaaguaaggaaagaagcugggguugguugguuuguuuguuuguuuguuuguuuguuuuugguuauguuugguuagagauuuuguuuuauaaagacugguugcagaauuguaagaauuacugaaagcacuccuuggcaguuggauagcuuuaacuuucaugucuccuaucauuuuacucuuuguuucuuguuuauguauuugguugguuugguuuuuugagacaaggucucauauagucuaggcugcucuugaauuugucuugcauccaaggcuucuaguccuguugccuuggccucccaguugcuuacauaggcauucaccgccauucccaggugaccauucucuuuuaaaagcuaauuuccaucuauaaaagguagcagguuaauacaguagaggcugauucugcaagauaauuuaagguacaccauuuuccccuuaauuuaaaugaauauuuucuaugaauagaacaacuuucccaaaaguguacuguugaagaagucuugggguggaccacaacugcacacacauggaauccuagcacuaguugaagcaggaggauugccaugaauucaaagccagccugggcuacaaaucaagagcccaguucaaaaacaaagaaaacaaacccuacaaauguggaaagcuuugaccuuggccaguucuuaacuacagucaguuaugucuucgguacucaguaaauacuacauuccuuaauuuucaguuaaguguugggcccugggacguggguuuuuggucuguugaugugucacucgccugcucucuuugugcagcacuuauucuagaggagauugcgauugacugucacaacaaggagacggagcagcggcugcuucaggaggcacacgacuugcacuugucuucgcugcagcuggcuaagaaagcauuuggggaauuuaauguacagacugcaaagcacuaugggaaccucggaaggcucuaucagucaaugagaaaauuuaagguaaaaaagguuuuauauucuacacuugaucuuagccaaaaggcugagaagcgauaagguuuuauauucuuugucucugaauaauuaguaaauuuaaugugauaaauuuucaguaaucuuaaauaauaccccaaaggagcugagagaaaacugagcuaguguaaaaacccuguagugaaauuauaagagagauuacagagacaagaccauaaagcugguauuacuguaacaggcucgucacagcucucagcucaguuguuuagguuuaaccaaaugucugaccuacauuaaguguucagugagacugcaguuaauucuacaguuaucaagaauuaggagcuaaaaaauuuaacaauacacuuacacucauuuucuuuuggaauuuucaguucuaguucauuguaguagugcauuccuuuacguuuaauacugggaaggcugaggcaaggggauucuucauuuggugccagccugggcuauauaggaacucuuaacaauccccucccccuuugucucugcaugucaccacugcucaugcauugagcaugcaagaucauuaggcaauaagaucaaagaacaucauuugccuuuucugaaagcugcugcugagaaauaauacugguuuugguaaacuggaccaaguugaugacagugaugguccuaaagccuaaaaugauaaaguuagaaacugucaacauucuaagcuagguguggggauacaugucugcacguaugugugcaugcacaugucugcauaagucagcaccaccuuaacaagucuaaguuaauuuuggggauguaguaauucaaauuauuaugaugaugauguuguuguuuguuuuucagacagggucucacuauauagcucugccuguccuagaaaucacuauauagaccaggcuggccucaaacucagacuggucugccucugcuggaauugaaggugugugcaaucacacccaucuuuauguucauuucauuuugaugguuuuguuguuuuugugacagcaucuucucuauguagccuaaguuggcuuuaagcugucaguccugcugccucugccugccugcuguuggaaauacagacacauauucccacaccuugcuuagaaugccuuggucuucaggaccaucgcugucaucagcuuggcacaguuuaccaaaaccaguaauguuuugcagcagcagcagcuuucggaaaaggcagaugguguucuuugaucuuacugcauaagcuguggugauguuuagaacaaacucuuucauugaguagaauuguccuaagaaacagugcaaucuaauauuccacuuggccuguuuuucaggaagcugaagaaaugcacauaaaagcaauucagauuaaggagcagcuccuuggccaagaagauuaugaaguggcccuuucagugggacaccuggcaucucuguauaauuaugacaugaaucaguaugaaaaugcugagaaacuguaccugcggucgauagccauugguauguuaccuuuccguccgucuuccuuaguugaggucuagagagcuugucugugcuccuagauccugcugacaaguaagugccgcaugcacgaggcagccauagcagagcagagcacagugcucucucucugcgccacuccucucaggcucuuccuccgcacugaagccaacaagcacagccugugauacaagccaccauuuaaggugucuguccugcugcugcccccgagccuccugccuccuggagcucuuacauccucaccucuguguauuguugcaucacagucgauggugacuuccaugacugaggaauguuugacugaacuugcaugucgccaucaucuagucuauguugaaugaacacagagcauuugaacuguugucauuugacagcauuaccucauuguaugaaauuguugugguucgagcucauuuugaauugucuauaucuccuguaacugaggccucuuggucaccugugcgucaaggucucucauccuguggcuuguuuucuugagagcgccuggauaggacaguucauuucgcuucauuuuauuuugguuaguugguguugacacagggacuuguagcuccugcuucuuccuaaugcugggucccaggaugcacuaccacacccugccuaaggaugccuguguuucuauagaaugccuugaugucuuuaauuuaucaccaguacuuuuuaaauuuuguuugaggaauuuugguuuuccuaccaguuaugaaguuacuuugcuaaaauaucaucuuuuagacacuuuacuuauauucauguuuugaucugcaauacuaagauuagcguguucaucuuagaagaaacuuuacuuuuacuguguauauaguugaccuggaaccauuucuucaaugcucuguccuguccccuuugcugucuuuguuacaaacagugguccauauauuugugugcuagucaguuauacauugacuuacuugauaaauccgaguguuggaaauacuaauguucuuuuuuuuuuuuaaagauuuauuuauuuuuauuauauauaaguacacuguagcuaucuucagacacuccagaagagggagucagaucucauuacggaugguugugagccaccaugugguugcugggauugaacuucggaccuucggaagagcagucgggugcucuuacccguugagccaucucaccagcccacuaauguucuuaaaaucaaaaaguaauaggcaagcacuuuccuugugauguguaguuuccuuaauuuucuucuaccuaauuuucaacacuuguuuguuuauagcuuauuuuucuauauaugauuuuacauaaaggcacaugcauaaguauuuucuuauauuuccuuuucauacaaaaugagcaucguguggcuguccacuaugcuuuuguuuuucuguugcugugacagaaacaucgugacuaaagacaacuugggcggagaggguucauuucagcucacacugcagauuaaccugucauugagggaagucauggcagugacugaaggcaggcaccauggagaaacccugcuugcuggcuagcuuacuggcucaccauggccagcuaguuuucuuugauagccccagauacugccugucuaagguauugcccacuauagccaggcuuugccaaaucagucaucaaucuacaucucucguaggcagugaccacagaccaaucugguucaagcaguuccucaguuaagcuuucuucuucuugccugucacuuuaaaguuguaucaacuugguggggggaggggggauacuugcuuuaaaaacaaaauuuacugggugguaguggaacacaacuuuaaucccagcucucaggaggcagagauagacagaucucugugaguuggaguccaguguugucuacagauugaguuccagaacaaccagggcuacacagagaaacccugccuugaaaagccaaacaccaaaacgaaauuugucagagaugaugucgcaccccuuuaaucccagcacuggggaggcagaggcugugauagcaugcgaguuugaggucuguguagugaguuccaaaacaggcagggcuacacauaaagauucuacaaaucuuucauguuauuuaaaaauaucuuuaaaaacauuaguccuaaaccugaacuuuggacugguagguggcucaucacccuagaugacuugaagucuuucuugagaagucucaugauaggagggaaggagacgccugaaaggcaggauccccaggccuccacacaugcaguagcuugagugugugaguacacagaaacacacauguaaaauaaguacaaccuuuuuuuaaaccggugaaauuuagcguucuaguaaagccaguuccuugaagucuuuagagacauugcagggaugaaaguagguaagagcagugauagagggacugcaccucuuuccuuccauaggacuaaaaccaagucagccuacugaaagaggagaaccugggccaggggugauggcucaugccuuuaaucccagcacuugggaggcagaggcaggaggaucucuuugaguuccaggucagccugguaugaauggcuacacagagaaacccugucucaaacaaacaaacaaacaaauuguauugaaaucuaaacaaaaaaguauuguaauuauuugaucuaagucuuuuuguguugcuuuagggaagaaacuguuuggugaaggcuacaguggacuagaauaugauuaccggggccucauuaaacuuuacaacuccauugggaauuaugagaaaguguucgaguaucacaacguucugucuaacuggaaccgguugcgagaucgacaguauucagugaccgaugcccuugaagacgucagcagcagcccccaguccacugaagaaguggugcaguccuuucugauggcucagaauguugagggaccaagcugcugagggacagccucagcuaacaauuaccuuucccagauuccggggaauucauacugugaaaucaaaccauguuguuuuuagggcuggcauuugcauugaaacacugguccaguccacccaagacccuauuucggguaguccuguauugcaguuccuguagaauaagcauauauugaguuauaucagcaugugccgcguguauaaguagucccacauucucaccccaguagaacaacaggaaaccguuuuuuuuuucuuuuuaaaaaauaauucguuuuucagaaagucugaaagaaaaaaaaaaaaagaaccccuaaauaaaacuauuuaagaguuuaaaagaguugcauucuuauuauguaaggaugauuucaaaaacuuuuuaacauauaguuaauucuuccauguggagguauucaauacuguauuguaaggaaaucuuauggaaaacucuuuauaugcaguauagaaaaguaacauagauacuaguaagaggggaggggcacccugaccuagauuuggccgucuuuuccaaaucagggcauucagccauuccagaacugucucagugacggacugucagguucgucugacuggaccaacguugaucugucgguccgucucagaaccccacguagaccagcaguuguaacucuguauuugguaccacggugagaugcucuaaagugauugcugacaggaccagaaggacuaaaaggaccaggcagccguggacggugugacuuggaccagcggcuuucaguuguggcuuuagugacugcaguugccuugccaguagaaugcagaguacuaaugcaagagcuucauuuacaucagagauaccaaacugugggaugugggcaacgccaguggcaaauauuuaguccugguacauggauggcaauaucauaagcacaccaaugucuaaccaucucugcagccacucccuuuaaucuuugcccugaaucuccauguaguuaaaaaacauacuggcuaagagucaugaaaucagucauguucagaugagaauuuuagguuuacuguaugguguguggggauuaaaaagaugaaugcacacaaaaagaaaucuuagaaaauuuguuauuguugaaaauaauuguacaacuaagucauuuuaacggaaaucucggacuccuucaguugcaauguuucacugauuggggcuuugauuuuucuaaguuuuucaagcuagccagauuacucaauguggggcuaaugcucaguuccuaaguugugacauguaacaaaagaaaaagaccuucuguuguuaccucaauucuuagcacaguggccccucuggucuggcaccucugugguuaagaaucuggguuucuccccuauuuucaggggcucugacuuggcuguuagcuacacugcucccggcagugcuuggaggugugagugaauggguaugugucagauucuguuuuguuagcauguuuguaugucggugaggggaaaacaaagcuaucauggagaauacagaaacauuauuuaagauuugccugaacuuuuuguuuuaacuuacccuuuuuuguguuuuuuuuuguuuuuuucgagacaggguuucucuguagcccuggcuguccuggaacucacucuguagaccaggcuggccucgaacucagaaauccgccugccucugccucccgcgugcugggauuaaaggcgugcgccaccacgcccgacuaacuucccaauguuuagcuugguuugaaacugcucuuuguggacuuagugguaagccagugugguauggccuuuagaagggacuuucguggagaugcaccccgcagaugaggcaggcucucugucauccugacacaaccacucaaacuuauuccuccaacugaauuuccuuuaaaauucuucaaagaacucaauuuggcacacuugcaguuuaugcagcuggcucuccccuucccccuuaauuacuguuuugugagagucaccuuuauuuccacauagucugugugaccaaggaguagcauccgguuacucagcuggagccccacaagccuauauaguuaaucccuccaaagacaguuucaggagaggcuuuuuguauacuuuuauuggauauuuagcguccugugguauguuugugguauaggaaugucaugguaaauuguuuuucaauaaauguuuuaaaacuuaaguuuucacauggauuauuuguauuuaaucuucauuuuugguggugugcacauacaguguuuuguauagucagauaacuuccgggcucaucuuccuuagcucaguucaacugaacucgcacucagugauaaaggaacauggucuuagaagccuugacuacagggugauaaugucaguuggcaaccagcccccaccgccagcagcagcucuaucagcugcuccaucugaccauuccuuaauauuguucucuguaaguuacuaaaggcuacucuaaugccuacacucuagcacuccaucuucuuagugauaugacuuuauauguucugauucuagugaaaagaaugcccugaucguuucaagggugggauucaucccucagcaagggugauguagugagaggaacgccaccguaauuuuauuuuaaauauuauuaaagcaggguguggcacauaucuauaaugucaguauucaggagacugagugagguaagagacugaguuccaggcagccugggcuacaaagggagauugucuccaaacucuaaaaggaaaaacugaauaaaauuuaccucagaauaaucaguggcuugcauguaauuuuaaauaagggccucugcucucacccuccccuggauucucguguuccuaaagucuggugcuauuccauuugggggcaugaggagccugugcaugcaugugacccagggagucacuuguucgguguaauagcgccaacugaguaaaagcucagugcacaacauuuaugguccucaaacuaggcuuugcccugaggauuuaaacccuuucuuucuccauccauguacauucauuuuuauaaacaucucaccagcacccugcccggguauugcugccugugagaaucaaugauuugaauggagcccuuuguccuagaccaugggaaugucuugugagcauucaguacagggaacugcacgugcuggcacaaguucaaucccaacuccaugggaggcugaaacaggagaaucacuugggaugccccaggauggccuagugauaagacccugucucaagaaaugcaguagugcaccagcugccagccuggaagucugagcagccauugaacuugauugucuuuauaggcaaaacgcgaugcaagcuuuuggccaaaauuuugcaaauucaaagaauguuuugcuaaguuacagauguuguuaacugccaucuuuuuucuuuuuuauauauauguuuuccccuaggguguuuagccuugcugcuuccaaucuucuuuuucuggauggcaaaguuacuacuggaaagaaauuauuuauaauuacugaauuuuaagaguuuuauuuuguuuuaaaaauuaacacuuuucaccucuuggcuuuagaggacuucagauuagcuggaauuaaaaaaaaaaagauuuaaguagaacauuuggauuaguguacagaucuuaacacuaguauuucuuuugucccaaaucucaggaauguuuuaggcagaaaacuggcuuuuccccugauggugauugaaggagggugcuuuaggauugauuaaauagcacuguuuuaauugcaguucuagguaucuauagcaugaguggccuuaaugaguuuguugaagugcacauguuuuucagaaguaaaauuuaagauuaaauauauaugcuauauauagauaucuagaaaacuugguuguggugcacaaaguguugaaucacugaaucgcagguaccauuuguauaacaucacuuguuucuguauauuccuuuuaugggaaaauauguugccauggugacuaaaaacuuuucaauuuaguuuuacuuuuaugugaaugcuacauuuuauuaaauauuaccaggucaguacuauuuuuauaccuuauuaaguaacggguuuuaguuuaauaggcucaaaauaaaaagaaaaacccuuaauggaauaauuacaaaugaaucacuaacauucuuuacaggaaaauccccacuacuagugccacaguaauuucuauaguaauaucucuggucauuaauaaauucugaagacagcucauugagucagaacggccuuucauaucauucucacuuguagugcccaccguuauuuguaauuauuaaaccacacuaaguauguuuguaaccagcauugugauauauucuguacuuguauugcuaaaugaauuauugaccuaauaaauaguguuccugcauucguaguguaugcuuccgauugaauugugauugcuuuggguuagaauuuuggcuuuuaguuuguagacugugugagagaaacgugaagcuagaacaaaaguguggucaagaaaaggaagcugugggggcuggugagauggcucaguggguaagagcacccgacugcucuuccgaaggucaggaguucaaaucccagcaaccacaugguggcucacaaccauccgaucacgagaucugacucccucuucuggagugucugaagacagcuacaguguacu

SEQ ID NO: 6251 - RNA, 2061 nt, Mus musculus
cgggggcagcagcaggacagacaccuuaaaugguggcuuguaucacaggcugugcuuguuggcuucagugcggaggaagagccugagaggaguggcgcagagagagagcacugugcucugcucugcuauggcugccucgugcaugcggcacuuacuugucagcaggaucuaggagcacagacaagcucucuagaccucaacuaaggaagacggacggaaagguaacauaccaauggcuaucgaccgcagguacaguuucucagcauuuucauacugauucaugucauaauuauacagagaugccaggugucccacugaaagggccacuucauaaucuucuuggccaaggagcugcuccuuaaucugaauugcuuuuaugugcauuucuucagcuuccugaaaaacaggccaaguggaauauuagauugcacuguuucuuaggacaauucuacucaaugaaagaguuuguucuaaacaucaccacagcuuaugcaguaagaucaaagaacaccaucugccuuuuccgaaagcugcugcugcugcaaaacauuacugguuuugguaaacugugccaagcugaugacagcgaugguccugaagaccaaggcauucuaagcaaggugugggaauaugugucuguauuuccaacagcaggcaggcagaggcagcaggacugacagcuuaaagccaacuuaggcuacauagagaagaugcugucacaaaaacaacaaaaccaucaaaaugaaaugaacauaaagaugggugugauugcacacaccuucaauuccagcagaggcagaccagucugaguuugaggccagccuggucuauauagugauuucuaggacaggcagagcuauauagugagacccugucugaaaaacaaacaacaacaucaucaucauaauaauuugaauuacuacauccccaaaauuaacuuagacuuguuaagguggugcugacuuaugcagacaugugcaugcacacauacgugcagacauguauccccacaccuagcuuagaauguugacaguuucuaacuuuaucauuuuaggcuuuaggaccaucacugucaucaacuugguccaguuuaccaaaaccaguauuauuucucagcagcagcuuucagaaaaggcaaaugauguucuuugaucuuauugccuaaugaucuugcaugcucaaugcaugagcaguggugacaugcagagacaaagggggaggggauuguuaagaguuccuauauagcccaggcuggcaccaaaugaagaauccccuugccucagccuucccaguauuaaacguaaaggaaugcacuacuacaaugaacuagaacugaaaauuccaaaagaaaaugaguguaaguguauuguuaaauuuuuuagcuccuaauucuugauaacuguagaauuaacugcagucucacugaacacuuaauguaggucagacauuugguuaaaccuaaacaacugagcugagagcugugacgagccuguuacaguaauaccagcuuuauggucuugucucuguaaucucucuuauaauuucacuacaggguuuuuacacuagcucaguuuucucucagcuccuuugggguauuauuuaagauuacugaaaauuuaucacauuaaauuuacuaauuauucagagacaaagaauauaaaaccuuaucgcuucucagccuuuuggcuaagaucaaguguagaauauaaaaccuuuuuuaccuuaaauuuucucauugacugauagagccuuccgagguucccauagugcuuugcagucuguacauuaaauuccccaaaugcuuucuuagccagcugcagcgaagacaagugcaagucgugugccuccugaagcagccgcugcuccgucuccuuguugugacagucaaucgcaaucuccucuagaauaagugcugcacaaagagagcaggcgagugacacaucaacagaccaaaaacccacgucccagggcccaacacuuaacugaaaauuaaggaauguaguauuuacugaguaccgaagacauaacugacuguaguuaagaacuggccaaggucaaagc

SEQ ID NO: 6252 - RNA, 2061 nt, Mus musculus
gcuuugaccuuggccaguucuuaacuacagucaguuaugucuucgguacucaguaaauacuacauuccuuaauuuucaguuaaguguugggcccugggacguggguuuuuggucuguugaugugucacucgccugcucucuuugugcagcacuuauucuagaggagauugcgauugacugucacaacaaggagacggagcagcggcugcuucaggaggcacacgacuugcacuugucuucgcugcagcuggcuaagaaagcauuuggggaauuuaauguacagacugcaaagcacuaugggaaccucggaaggcucuaucagucaaugagaaaauuuaagguaaaaaagguuuuauauucuacacuugaucuuagccaaaaggcugagaagcgauaagguuuuauauucuuugucucugaauaauuaguaaauuuaaugugauaaauuuucaguaaucuuaaauaauaccccaaaggagcugagagaaaacugagcuaguguaaaaacccuguagugaaauuauaagagagauuacagagacaagaccauaaagcugguauuacuguaacaggcucgucacagcucucagcucaguuguuuagguuuaaccaaaugucugaccuacauuaaguguucagugagacugcaguuaauucuacaguuaucaagaauuaggagcuaaaaaauuuaacaauacacuuacacucauuuucuuuuggaauuuucaguucuaguucauuguaguagugcauuccuuuacguuuaauacugggaaggcugaggcaaggggauucuucauuuggugccagccugggcuauauaggaacucuuaacaauccccucccccuuugucucugcaugucaccacugcucaugcauugagcaugcaagaucauuaggcaauaagaucaaagaacaucauuugccuuuucugaaagcugcugcugagaaauaauacugguuuugguaaacuggaccaaguugaugacagugaugguccuaaagccuaaaaugauaaaguuagaaacugucaacauucuaagcuagguguggggauacaugucugcacguaugugugcaugcacaugucugcauaagucagcaccaccuuaacaagucuaaguuaauuuuggggauguaguaauucaaauuauuaugaugaugauguuguuguuuguuuuucagacagggucucacuauauagcucugccuguccuagaaaucacuauauagaccaggcuggccucaaacucagacuggucugccucugcuggaauugaaggugugugcaaucacacccaucuuuauguucauuucauuuugaugguuuuguuguuuuugugacagcaucuucucuauguagccuaaguuggcuuuaagcugucaguccugcugccucugccugccugcuguuggaaauacagacacauauucccacaccuugcuuagaaugccuuggucuucaggaccaucgcugucaucagcuuggcacaguuuaccaaaaccaguaauguuuugcagcagcagcagcuuucggaaaaggcagaugguguucuuugaucuuacugcauaagcuguggugauguuuagaacaaacucuuucauugaguagaauuguccuaagaaacagugcaaucuaauauuccacuuggccuguuuuucaggaagcugaagaaaugcacauaaaagcaauucagauuaaggagcagcuccuuggccaagaagauuaugaaguggcccuuucagugggacaccuggcaucucuguauaauuaugacaugaaucaguaugaaaaugcugagaaacuguaccugcggucgauagccauugguauguuaccuuuccguccgucuuccuuaguugaggucuagagagcuugucugugcuccuagauccugcugacaaguaagugccgcaugcacgaggcagccauagcagagcagagcacagugcucucucucugcgccacuccucucaggcucuuccuccgcacugaagccaacaagcacagccugugauacaagccaccauuuaaggugucuguccugcugcugcccccg

SEQ ID NO: 6253 - RNA, 1956 nt, Mus musculus
aaugaaaaugaaauaaauauuuaaugacaauuuuaaaaggaauugucuugggagguauagaaacuguuguugaaaggcaggccagcauaaagccuuuccuuguuguuugcauuucccaugcugcuguaaauaaguuuccauuacgcuuuuugugaaaucucaaaggcuguacagaaaauaauaaaggaacacguugacucccucaaaagaauauggugcuaagaaaauauuaaguugaucacucgagaacuuauuucaauuucguggaaaucagucuaaaagcauucauuuuguuguugggacugucaacuucugugaacggagggaaauaaccgugucuuuagggcauggagauccuguuguaugcuccuuuuccaaacgguaacuuagauucugcaguaauagcuguauucaagacgaguccgaaaaaguauuaacgacgcugaaaagaggaagaaauaugcaaaauacuuaaaaaaaaaaaagggcuguaaaguguuaggaauuaaacucgccgacaggucuccgaccuaacguuaucgcggaaaacagggcugugcaacuggcgguggaaaauuccaagucuucuuaaguaaacccgacugcuucccuuaacucccagccggacaagucccacccaagccaguucacgcgugcuacgcuggucuagcgcacggaccaacgacuuugcagggcauuuucgcgccauuucgcuugaaauaaguggaaggucaagucuaccuuugaccucugcaaauuuuccacaaucgcgggaggcaaaacuggcucugcaaaaggaccaaaggggaaaagccagaagucucacguuagggauuuaaggggaaaaaaagaugacagguugaggcuucagccgcuuaguaacagcggaaaacccccaggguacagaagcccuaggcuggagaaaacaaaccgggcaaggagcgcgcucccccggucggcgggccgagcgagaucagcgguugcagagagaugcggggguggaaggagggcgggggcgagcuugcucuucuugacuccugauuggucugucucagcgagccgagugacgucaucaggagaaagggggggaaagaacgucugauuuguauggugggcgcgggcgggcggggagcgaguucagugcgcaggcgcagcugcucggcuccucucgcccgcgacucgaccggcccagcucucgcggacaagucccgacaucacgcgcccccccccaccgccgcggggaccgccuccucuucacucucggcuucgucgaagauaaacaauaguuggccggcgagcggcgagugugucucccgccucggaauucggcgggcugcgugggaacggcgggaucccgggcagccggccauggcggggcuguacucgcugggagugagcgucuucucggaccagggcgggaggaaguacauggaggacguaacucagaucgugguggagcccgagccggcugcggaggacaagccggcgccgguaccgcggcgggcgcucggguugccggcgacccccacucucgccggcgucgggccaucggaaaaaggcccggcggcggcccgcgacccugccccggacgccgcggccucgcuacccgcuggccgcugcugucgccgccgcucuucgguggccuucuuugcagugugcgacgggcacggcggucgggaggcggcacaguuugcccgggagcacuugugggguuucaucaagaagcagaaaggcuucaccucguccgagcccgccaaggugugcgcugccauccgcaaagguuuccucgccugucaccucgccauguggaagaaacuggguaaguuccccgcccgccucuuuuuuucuuuucuccccuuaucccccugggcuuuuuauagcaucagcaccgcgugggccuccccgguaccaagagcgcuauccaucaagcgacgcuguccaacaagggaugcgagu

SEQ ID NO: 6254 - RNA, 17848 nt, Mus musculus
ucaguucaauucagcaccuuuaauuuuuaaaauuuuccuuuuaaaaugaaaauauuuauuauuugaaaauauucacuuaaaaauaaauguucuaacaugauacaguuuaaacacagauuaauuuguacuuguauauuaaagaaugauaguaggaaaauauuaaaacguuuauuuucucuaauuaaacaauuauguuucuauaagaacagaaugugucagaugugcaguaaaauugguacgugcuguagcacaguugucugaagucugagcugaaguuuucaggcgggguuccuuggugucauggcuucuguucagaagcaaauucucagugaagucucacugugcaacacagagugcugacagaaaacagcagauucguucugugcuugacaugaaguuaaaucuuaaguuuuacacguucagaagccauuugcugcuccugaagcucucacagcccuagauucauuuacgcgauccccaugugggauuuauuauuauuauuauuauuauuauuacuauuacuauuauuauuauuucucaugagauaaaacugcuuuggaaucuuuuucucucuuuuuuuauuagauauuuucuuuauauacauuucaaaauuucaaaugcuaucccgaaaguucucuauacccuccccccccccccccgcccugcuccccuaaccaccaucuggaauaauaaaaaaccuaggauagcaaaaacuauucucaacaauaaaagagccucugguggaaucaccaugccugaccuaaagcuguacuacagagcaauugugauaaaaacugcaugguacugguacagugacagacagguagaucaauggaauagaauugaagaccuagaaaugaauccacacaccuauggucacuugaucuuugacaagggagcuaaaaccauccaguggaaaaaaagacagcauuuucaacaaauggugcuggcacaacugacaguuaucauguagaagaaugggaauugauccauucuuaucuccuuguacaaagcucaagucuaaguggaucaaagaccuccacauaaaaccagagacacuggaacuuauagaggagaaaguggggaaaagccucgaagauaugggcacaggggaaaaauuccuaaacagaacagcaauggcuugugcuguaugaucaagaauugacaaauggauucuuuuuuuuuuuuuuuuuuuuuuuuuuugguuuuuugagacaggguuucucuguguuccccuggcuguucuggaacucacucuguagaccaggcuggccucgaacucagaaauccgccugccucugccucuugagugcugggauuaaaggcgugugccacuacgcccagcccagcuccaugugggauucuuaaaucaguuuaagaagcagggcuccauaccauaaucuguccccucucccucucccucucccucucccucucccucucccucucccucucccucucccucucccucucccucucccucucccucucugucuccuucuccuuuucuccccccucucucccacucucccgcucucccacucuguguauguuuccacaucucauuccuuacucaucuuuuauagccagcguuuuguacccugugaguaaugccuccuaaacaucccuuuccuagguuccagguaaccaccauguagauuuuagauuuauuauauaaauggaaucagguaggauucacacuucuguaacuagcucacuucauuucauuuaccuuacauccaguuugucauaacuggaaauauuucucuuuuuuagagauggauauuucauuggaucuacauaucguauuuucauuauccauucuccucuguucauuuugcuuguguguuuucaugacugacaaaugcuagggugaaggcaggaagacaggucucucaucaagauccagauuucuguucuuuuuugauagguacccagaaguauaguuacuagauuuuuaauuugaaaaaaaaaaaaaaaaaggugcuuuguacuguuuuucaugugacugcaccaguucacaguccacucacagucuacacugagucccuuuucuaugcacacgugucaguauuuguuucuuuuaugguuuuuguaauagccauaacagauaagaggcaguaauugugcuuugaguuuccuugguuagugauacugagcacauuuuaauacuuauuuaucuauugcaugaaccuaggagauagggggugcuaaaaaaaaaaaaaaaaaaacaaaccugaagucuccuucaauacccacccguauucagaacaucagacaauuuauacccagacgauuacaacaggucagcugaguagagcucaugagcccaagcugucugagucacaaggacaugaguaccagcugcuggaaacucaguuuucuccaagacaccugggaggagcacaagaacaguucugucauuugaagaaacugaggucacaagacuugucuuguuuucuuguagcuuucucacaagcacuaagaauugacuucccaugaauccauccuuggaucccaucccaacacuuacuggccguuuuuuucuuuuuuaagcugggcuucacuguguaguccaggcuggccuagagcucaccguccuuccgccucagccgucagccuguagaauuacagaguccgacaagcugaauguggugccacacaccuauaaguguguaaauguguuaagagcaugucccaagcaagcuaauguccgcagcaucugcacucugaaacaccaaggcuuugcugggccuccuucguuguggcuccugcuugucgccccuucugcugcacacacauccaagagccauugcucaggccagcgccauugccucuccgguuuccucuuacgacucucaccuuuucaggcccuauacuaaaggcaggcuuuguguguggguggggggagggcaagguacauagugagaguccuuauuucuuuuugggcuagaaacucaccguguagaucaggcucgccucagaagacaucugccuaccacugccucccuacugcuaggauuaaaggcguguaccaccaagccugccccaauuucauucuuacugagaaauuaauuuauaaucuuuaucuuuaaccgcagguuauuuguugcagguucucccuaaacuucacaguagacaagaaaugauuuuccaugaaacuccucuagggguagaaacccagacccaaauucugaguccuggauucugaugucuguucaguuugucacacagacuuggacuucuacagaguuccaucucaagaaauugcagacucucgagaugcagcucagggcacagugugugugcuuagccugaguaaggugcuagguuccauuuccaauagcacaagcaaugucuucuuaggguuacuauugcugugacaaaacacgugaccaggagcaacuggaggaaaguuaauuggcuuauacuuccucauuguagucuaucacugaaggaagagagggcaggaaccuggaggcaggagcugaugcagaggccauggaggaaugcugcuuacuggcuugcucccggggcuugcucagucugcuuucuuauagaaccaaggaccaccagcccagggauggcaucacucacaaugggcugggcccuccccagucaaucacgaauuaagaaauugccccacaggcuugccugccuguaagcaucauuguauagagguauuuucucaauugagauucccuccucuaaagugacuacaacuagugagaacuugacauaaaauuccagcacacccagcaacaacaaaaccacagauacuuucugacuagagugagcaccguugucgugaccuucaggguuuuccuuuaccugaacggauucauccacuggcugaaacuucagaaaccgaaaggaguaauuuaauugcucauuguguggggagcuaggagauguugggucauuguucgcuucaacccccaaaaagaguaugucaggaugagaauguuguucaguugguggaacucgaacacuugcccgcugugcaggaauucuugguuuugagccccagcaucccauguccuggucaaggcgacacauggcacuugccugcagucccagcccuaggaggcagaggaagaggguaaggagcuggauccaggccauccucaguuacauaggaacuucaaacccagagcaucuaaaagccacuuuuccucccaagcuacauuuauuauaggaaaaauauaagacaaauagaaggaaguugaaacuacuuauaaauccuuugccauuauuguuuaauaucauuauuaacaagcacauacuccaacuuuagauuuacuuugccagucuuuuaaaaggcauuaacuaaaagacaaagaaauugguuuucaguggguuaaggugaaaagugauagagaaacccauucagucucaagagacggugugaauaagaugauccuggagacagagugacuaggaguuguuaaaaauuacaucauccaugagcaauggggaaaauugccucauucuuauauucuuuacuuauucuuccuuaaaaaaaaaaaaaaacaaaccugagugcauggauguauguuauaugaaugcagugccugugcaguccagaagagggcgucagauccccaguaauuggaguuacagacaguugugagccaccaugugggugcugguccucugcaagagcaacaagcucuugcccacugagcauguaggagaaaaagauacuaaguuagauuugguggcucaugauuauaaauuccaacauuucaauguaagaauuucaagguaaccugacuuuaugagacuccauuuugaacaggcaauagaauguaccaagaggcaacaggauguuagaucuacuucccauuuggugguguuucugauuugcuacucaucuuucuuguuggagccuggucaacuauaaggaaguaucuaaucaaauauuacugaucuauauaacauugcuuauuuuaaaaaguugcccccucuggugucagaggaauuuucucuuuaguagaaaauuuuaugugcccaaacugaagucaccgggucuccugugccugccuacauucggugguuuuagaugaagggcuuuaaccuagcccuuaaaaacucagcuccaugcuggagagagggcucagugguuaagagcacugacugcucuuccagaggcccugaguucaauucccagcaaccacaucaucucaaccaucuguaaugguauuugaugcccuuuucugaugugucagugacaguguacucauauaaauaaaauaaauaauuuaacagaaacacucagcuccuacggcaauccuaaaguuacuucuguuguuucuuagucucaagguguuguugaaaacaaaagcaaaaggacagccugccugccuucccugccuucugcaguguaguggggcugugagcagcucucagggucuguugcauauuuguuggggacccaguccaaggcuagaccuugacaaguaaaagaaacggaaguugggguggggugagggaguuaaguaaccuguccaaauugccacuguccugccuugggaagucugggccugagcccugcagcuaguguggccagaaaaacugaucugucuccaugcuggugucuuugagguaacuucagagcugguuaaaguguucuccuggccucuucuucuacuuccaagacugcucaggaacuuuuguucuaggaacuuuagcaugccagggugagcuagggaaagauccuagaacacauagcugaauuagacuaguugcucuagguuagugcuuguuaaagagaaacucugagccuacuacaguggguucaagcuacuacaguggguucaagcuacuacaguggguucaagcuacuacaguggguucaagcuacuacaguggguucaagcuacaguggguucaagcuacuacaguggguucaagcuacuacaguggguucaagcuacuacaguggguucaagcuacuacaguggguucaagcuacuacaguggguucaagcuacaguggguucaagcuacuacaguggguucaagcuacuacaguggguucaagcuacuacaguggguucaagcuacuacaguggguucaagcuacuacaguggguucaagcuacaguggguucaagcuacaguggguucaagcuacuacaguggguucaagccuguagucucagcuguugugcaggggacugaggcaggaggcucuuuggagcuaagaaauuagacagcccaaccugagaaacccagcaggacccuuuguccaggaguaaaaagaaaguuaaaacaaagaaacaaaaaaccauuuaaauugcaagucaugcuucauuuugauauaccuucaaccguucagcuuuggcgugauuuaaaaugagggaauguguguguauaauaaccuaauugacaagcaauggugccgcuccucgcccagggcuacccgagcauccggagggccauuuuguuuaauuuguuucuucacauaguuucuggugggaaaaugcauuucucuaauacccaaauuaacuugauugaaaugucuuagacuuugccauuuuccaguggcuaaaaagguuauuucucaaguguuuaauuuuuuaaguacaguauauauuaauuuaacugcuacugccugacagucucauuccaugaaaaauuaucacaacucaguaccuuuaagcaaauguuuauuuauacuucacuucccaccccaguguaaaauuauucaacuuugaaaauauguaaacuuuaaauugagguuuucaaaaacuugaaccacuucuugauuuguucaauauaauuuucauaauuucuuuacaguauucuguaacguguaucagaaaggaaacacuuauaaacugaugcugucuauaggagcuguccaaucaguaaugauuguaggaaggcuuccuuugucagacauguaccauauaaauacuugcacuuaacaugagaaguucauccaugaagaguacagacugcauuggacuuccgauuucuugucaccguuuucuucuuuagggacugaagcuagaagaugaaauaaaaucuuccuuguccauuuaguuaaccuugacuccaugaaauucuccaaacuaauuacuggugaccacaauaccaccuacggggggcagcggcggccuuggcccuagaccagcugccuuauugcugaccacagcugcuccugagcagagcagauguuucuccuuucgccuuggcaguaaaauuuuauugagcaguuuugcaaauucaggguagcauauucuaccugaggauggcuggagaucacagccacuuugugcaacaccauuggaucugucugggcugcccacaggcccaaccccuagggcaugugcaucucacuuggcaggcuucagggcuugucuacuggagcugugguggguuugcuucccuagccacccauguacuggaagaggagccccacuugcgguugcgacuggcugcucugaaaggcuguugaguuggcacuuugcucucccuucugcggguugacaaaaggagcaagggcgccuuguugggcuguuuuguuaggacacuucccugaguuccacaucucgucugguuuggaugugggcuuggaaaucucucuugaauuagcuucuuuuggagaccucucuggcucucugggcacuucuuaaaucgugcuuguagaggcccugaagaaaaugauauagucuaagacagugucuguuaagugggaucucuggggguccuuuugacacuggcaauucaaaggucugcuucugcucugacaugcuuauugugagucccuugucccuggauaaagggaugauucugugaauuguagcugguacuuuacaacaguaggaggaaggcagaaagguccagccacauccagaucccaggaagaccuuuaguuugauguucugggccaaccuaggcuacagagcaagcuccaggacagugggagcuauuuaguaagccccuaccuagcagaggaguggggggagacggugauggaggaggagggagagaauucucaauaauugcagacuguuucccaggaacuuuucagaaaagcaagauacuagcagcugaggguauaagcauggcauacauucccacagcgccucgggccuugggaggaagggucagauacaagaucagagggcagaggccaugugagaaugugccuggucugugguuccucagcagacaggaaguguuagugacacucaguuccagagcaugucacugugggaauugaucugaccagcuuucuggcaggcagacgaccaauccugauagcccgguaauaaggcuucucaccgcaccggacaccagaaccucauugacuauucuguguggucugcacaaggggcauaggauauguugcgugcauaggucaagaaguuucaagucaaacauucgcuuuuucgaauguuuucaugaggguuggggaugcagcucagcaagaacgauaccccuguguucaagcuccaccagugaccucaaaaaauguauacauacgaacgcuagaaacguaaagguucauuauuccaugacuuuuuuuagauuaauauuuuccucuuuuuuuucuacuacuccuguaaaauuuuaauuuuaaaaauacagaccuuaaagcaguggcugcguucccugcugcacugguaucuuacucaggccugccccccccccucccccacuggauucuguucccagaccgagcucuucuuaaauagggaugagaaacguuaauuuuaauccuccaagggcuuauuugcuagcacaaaaggucaugaagcacacaccccaaaacgguauugcugaagccuuaagcagagauguuagcagagucucaacagaacuguugagucucucucagaaacuccauuaauccaaaaguuauggaauggaagcagucuccccuuacugauguaaggggaagcccccacccaaacccucuauuauuucaggaguuucagaagacaguucuuuucaagacuuuauaaaaugauggcguguuauggccaagagucucuggguagcuuucucucugccugauguuuugguuuuaggguuuuugagauaaagccucacuguguagcccaggcuggccuugaauucauaaaauccaucucaccucagccucccuagaacuaggaucuaccauacccagcucccaguguuuuuauaaccaacuuguuauguguccaaaagaaaaaguccuuucuauagcuagccgauagaugcaaaacucuguauguguguguauacacacacauacauacacaaccacacuugacguucuugaagcuuucuuuugggaugacccaaggcauucagauaucacugccacaaagauucucaacugaaauuaaaugaggaaaguuugaaaagccccccccacacacacacacacaaaucaagguaauuaauaugagcagcagcggccacuguagaagggaagaagguuaugaaaugcgcugcuauucuccuuggauuggugcgagaagcuuuguggagagcucauagcuugggcccuggagagagaugugucuucuuggcugaauguauuucuaauuaauuugccuucuucaguauguauguaaaguaauggguuacuaaaagaaaggaagagaugaaaaucuaacuugaaacacaaauucuaagguucuggcugcagaccuguaaucccagcaggagggaagaaguaaccuuggguacaggguaaguuuggcaagcuugguagcaugagacucugccucaaaacaccaacacuaaaacuaauauaaguaaacacaaguucuagugauuucaaaccuagaucuauaaacaagcgccccuuaugagcuccuuaugaaugaguacagccaucaugucugcugagcuguugggcaaauucuagugcuuuugugagagaggaagagagaagagacucugcuucagagaacuaggccauagcuaagcaccucucuucugugucagugccuaaugcccaggggaucagaaagcacgagggagugccagagaccucagaagaauaagggugaugguacaaccaagaaagagaaagaaagcagccucccauuuuaagaccacugcagggcacucucagcaaggaguuccuacgaacacauggguugggccgagagcuggugggaagaccgggaagccaggcuucugagcugagcucuagauaguaagaaacacucagagcucuucaagaguuacugaccucagcuucugcucccuaaccaaaagugagguaggccagauaaccacuaggaaugucuuucugguucaaggaaucugugaaucuggccuuugaaaaugaguccuagauuggcugaucuccgaaggcuuuugugacugauggcuaccuugagaugcuucagagcaguaggcacucuucaugcuagagaugacucaggagcccaacacaacaauuccaccacugccuccaggcccuggcccuaccccagcaaacucuuagcccagaacagccaugucauuuccuauacaccagucacagaucacuagugcuaggucuagguguuguaagcccacuuggaaggcaaaacaaccaaagccucgacucccgaagacgcuggcaugugaccugacuuuccaaggaccugucagccuaguggcaggcuggcggagauuuuguggaugaauuugggacucacugcuggaaaaaagacuggauccuggugcauccaagacuuggcauuguugacugauguguuagucuccugggacagggcugcacaguugagaaaaguagcaggagcaucagaucuccacaggucaucuggcccccauaaaaaagccaucgcacuggggaaaaggcuagacugcugcguucccagcgcggcuggauuacuguacaaagccacccaguccaucuuuguuuauggaacucguuuucaggcacacguguuuuauagcgaggcggaggcuguaaagaagcuauuuauaaugaagacccccaaauacgugagcuucauauuaagcuugaucuaaaggaacuucccauggguggcaguuuaggagaaaaagggagcaaaggaugagaaauggaggggggcgggacaacuaauaaaaauagcugagaucacucaacaguuaucaagaaacagauacuacaguuuuauaacaugaaguacuaaaaguauaugcacucuuaaaaggcaauuaaaacguaugcuccaaaacuauaaaacauuuucuuuucaucugcaacauagagggcagauuacaacacauuaauaacguuuuguuuagaguucaguuucugaugguuuccaaauguagucuguguagauuaaccagaaggaguccaguucccuuuuuuaagagcgcuuguaaaggaaagcaaugugguaagauuguuaugaaaagagaguguauuuaggaaauagcacuuagcagggucucucugaauggcugccaggucaggaagcugaagugcaaggcuuggcccuuauucagcccccccaguuccagcuccuugaccacacaguacgucaggagcaugucacaagccagccagggaggcuuagccccgcccccgggccagcugggcacggcggcuuucacauaacccagggcuccagaggggccagaggcaggcauuccggggccacgggaacaagcaauuuuuaaaauagaaaugaagaacuuuuuuuuuugagccugggaauuaaacaguuccuggauccuuacagaacagggucccuugugccaaguguuagggguaaaagggcccuaaggguuaucucauucucuguccucauuccuuggcaguggcaugggagcagcccugaagucccugucccugagcucucuggcugcuagacugacugucacugggaucagccugguguccugugugcuccagagugcucucggggccagccucauugucuuccauccucucccucuugguuuugacucuagggguucaccccauguuguaccuacaaacuuuguaacuucucugagaagcugcugcuucuacaaaccauccugugaaccucugcuucacugucaucaagacgguuaaauaagugcaugugacagacauacuccagcaccuggcuugaugugagucuguuguuaguaauaccauucagguugugccacguuuguuuuucacgacuguuaacuugugcaguugcugaauacagagucacuguuaggaauguggccuugugaguagacugucagaaccaggguugccuaaggcagagagaguaaagaggucauaaagccaccaaaagucuagcccaaggcugccaggaguccugcgaucagaugccagcuguggaacccagguccccagguccccagggcuccuccuuguuccuguucuguuugguuccuggguuaacuuuguuccuccggaguuguggaguaucuuuuguaauucauucuccuuggcuucccugggaaaauugaggcucagaccuagccuggcuuuacuucugcuagccuagcgaagucauuggauggaaucuugucuaauuuacauauaaaaggaacucuguuggagaaacagccuucagcuaauuugccagagaccuaaauccuuuaggcuuucuucucuguuuggcccacuggggcccuaguuaaaauggcaguuguacccuuguuccuuagucaacauagagacaacccugcuggaaaacucaagagagccagccgccuuccucguguguuauuagggaacaauccccuauaaaaguuaaguggauguuuuucauuuaaaaccuugaagaggcuuagcccugcuggguugcugccggccucccucagcaggacccuggaggcuugcgguaauaacccuacucugaagaugacuuaacuuucuagcugccuacgcagcuaugagcagcauauuucuuuuuaaauacaggacucaugggcuuagaaaguagaauuguuaccucagccagugucucggugaccuucccuuugggcuccuaucccucugccaccaccugacagcagggcuauaacaaagccaucauuuaccuaaaaaaaagucaacugcaagcucaugugacuucagugagaacuuuuuuguuuuuugguuuuuuuuuccaacuuauaucauucaguuccuguauuuugccuggucacugugaaaugaccuauuuugucaccucacuuauuuuuuuccugauaccuuccucugugggccucuuguuucauuacauuaaucugaguuuguucucaaggcacuggggaacauuuuucucaaaaagcuguaauugccucagaaggagcacaaugacuuauugaaguuucguauguugcuugcucucaacuaccagagaucagcgaagauccuucaccuuuuucuccaccccagaaguggaugaaaauaucagcgguuuccgucuucugucacuugucacaaauacuuucccaagcuaaucucacauaggauuugccaaggaucagaacccaagcacagggggucacuacucaccucuggguuaccucggacaagguaagaagagaccuugagguuagacgugccgcagagaaccugaggcuggaugcacuggguggguguguaaccccagcagcugggagacagaagccuuggaucacaggguacaagcuugccccagguguguacugagauacugucucagagagucgggggggggggggggggaggaaggaaggagggcaguuggaugagcgggacuaaacugcuuuccccagccaugcucuauuuggcucugcauucugcuuuccuguuuccucuccaugccacuguugccaaagcaucacaugcagcuacuagggaggcagagacuucugcaccacagugugcauauccucaugagcaaggaguaggugucagcccugaaaucagaggagacuuggcuccguaccucucccuggguagauggcuuuacugcugugucugcugagggcgaagcuuuuccaacagaaaggucguucuucagcauucuuuuauagacuguuuuagccauacuguguguaggguuuagaggauuucugcuguagcugcuuaugugggaagcucaccacaguauucucuucccugagcuguuugugguaacauccuagcaauuuguuuagauguucagugaaugauaccuuauuauuuuauuaagugaugggcuuuaacuugaaggaaacuugaguucuugaugguuuucuuggcaagcuacuguauacauauuuccuccuagacuuuuaaagacuguaccacucauuccccuuaaaaauggauccugguuaaacagauuucugaaccuccaaaucacaauuauauccuuuauauuauacuuucugacuuuuucuuaaaccuuccuuagugacuguauguuacccaccacacccucaaccucugcugguaggcaugagccaaguggcccgguggcuuuaugcgauggaggcacuuuuugacaggaaaguuguagauuuacuuucagaggcccugaccuagaccacccuacagaggucauuaagucucuugccaucaagcccuaagcaguuucuucucugguuugcuuucuguggaugucuuugucuggggaguucaaggugucagagaucgaugucugccugguuccuuugaagacgcugagucaggaaggcacagaggaguuagaugguaaugccagcuggagauagccaaggaaggcacagaggaguuagauggcaaugccagcugaagauagccagaaggcacagaggaguuagaugguaaugccagcuggagauagccaaggaaggcacagaggaguuagauggcaaugccagcugaagauagccagaaggcacagaggaguuagaugguaaugccagcuggagauagccaaggaaggcacagaggaguuagaugguaaugccagcuggagacagggccacauaaaacagucacuucauaaggaaccuaagagguuuaggguuauuucuguccuauggcccaagaacuauuagcaaccccaggcgucaaccugcagaaaggcaagaacucaguguaguucuuaaguaugguuccaugaaagucaucagguccucucaaaaaccucuagauguuugccuuaaagcuuagaaaacagcacaaaaaugauauagcugauaaagagacugauccuggcuuuugacacaucuucagucauuucuucacaugcacucaaucauuucuuuacaaauauacucaaucucuccuaacuagaauacuccaguagucaugcaagaaucuuaaccaaaauaacugaaguuuucucaugucaacgcauuuuucuccucaaaaaccuuaaugaaccagauggugguacauaccugugagccuagcauucuagaguuggagguggaggauugucagcucaaggccauccagggcuuuuagcaaguucaagucuaacauacacugucuuucaaagccaaggguuaggaacauaauucagugguaaagguuuguguaacauguucaggacccugggguuccauccuagagaugaaagacaguugacuuauauguugcugccuuuaaauaaugucucaauugagguaugauggaagaaauggaucugggaccacccaucauauaauccaagaagugacagccuugcaacaaauaugagaccuucguuuagucuguucaaacacgagcaacaagcugcucagggggcucaugacuguucagugaaaugcacaugccgugugcacacacuucccaaacucuuguuuccacuucaguucuaacugaugcuuuccgucucgacucccacuucuugccuagaggagcccugugugugugacagacuuguuacuaagcaucucccuagcaugccuuaccuuccuagcuucauucaugugcucgugccccucgccucugacgagcccuccuuccagcagggucuuccccaaaauucccaugaacacaucacaaaauggauuaaguauuauagcagaaagaugcucacuccuuacgcccuggccuucuaauaagggugaugggccugggauaugcccucugucauguguucuggucuuacaggggaggaaacagagaacacuggccaaauauugaccacugacugucccauccuguuguagcauauggacuuguguuuguaauuccucugagauaagauuuuuaccaucccuuguaauuuuauuaauccauucuagacugacagauguugccaugagccuugagcucuugaggauucuuguuucauuucugauuagaugaugaguuuccuucuuaaacccaagggucuauguaugcacagcccuucucuccuaaagagcuuguuugggugccagaaagaaccuugcuguucccuggcugguacuggauaucacuuuucuauaucugagcccuuucuaacugguucccucuugcaaagguagcacccaguaugcugucagugcugaaguaguagcagcugcuagauggguuuuacuuuuacuuguguuuuuauuuugaagggaccugaggauaauaaggggugcccagaggacuaaucuguggaucuccauucuucucgagagcacacagaauuugagaacacugaaacugagccagauaaugacccagaggucugcuaaauguuccagggugguuggcucuuuguucucacuuauuagaguccagcuccgccuuucauagcacaguaauugcugcagggcuugggcccaggugaucugucucacaggccaagcugagguugucuguuaccguccuuuaccggucucuggcaacaaugggaagugcuaccccugaaagcagguugguuagcaucuggagcucaaugaaccuguugaacuuuuccagccauuuuguuuuuuccuuuccaucaaccuacuucuaagaggcucauguucuguuccaagggcaccagccuucgagugggcacuuguccauuccuggccuagggcaaucagguuggagaucucccguagacaccagacacccccuaucucuccaacucuccuguuggcugauccccuuagugcuucuagggcacuugaggucaucuuuuguccaaaggagugccacuguggcaucucaccgagcaggacuguggguacucuccccauugcuuuggacagacuugacaaugccucucuguguuaagcacugugcgcagcucccucgaaguaggcugucaucaguccucacauuugcccugccgcggcuguucauacacccguuucacaggugaguguaggagaagugaaguaacuugcugacgggugagccgaaagaccuggaaagucuccuucucccgcucuuuacagaaagccccugagaccccgguggugauucguuuacaccaguguccucagagauucccaggucgccaauucagugauaugagccgaaugcauacaagaguuagugugaaaacagauugccaccgccuuacaagaaagucagagaagccaaaguacauucgacaaauuggaagugaaaagcucaaguaaaaauauucaguuuaagaucaugcgcugguacuuacaugaggucuauggaaaaugagggagccagcaucggguuucuggaauaugcaauuuuacaaugggaacguguuauaaaauguucagccacuguuguuugccuuggaauuuagggugagagacaugacggcugacaacucucuuccuguuguaggucagggcuucaaggaacucuguaaucuucccaccagcuuucuucucuccuggaacucacggguaaaauuagaugcuggcuggacuucaguaguugaaggcuuucagaagccaagucagacaacugcaacggcugcucucucacagccccacgucgggagacacucuguacagacuaacacaguuuaguaaacugaua

SEQ ID NO: 6255 - RNA, 9402 nt, Mus musculus
ggucaaaucgcaugauagcguuuuuauuauuuucucgcuucguucucccucuggagcaaaaagugaaaaccugagguggggcccgugggccgggcgggcaaaaccggggugcagaggcugagggguccgcagggugggccuucccugggguucggugccuccccuuccccagcagccaaggauccuggggcccuguacaauauagaugcucauguaaaaugaaaaaaaaauuaaaugcuaugaguuaaucucuaaauauauguacacagcaauguacaccuucgaauaaauuaauacgaauuuguauccucugggaaccuuaaagcuuauuuacacaaauuaccauuuauuucauaaauaucuuuugcccccuggggacucaaagaagaagugcaacuuccuccgcugauccagaaguggacauaggaauggcgccugucuuuugugggguagaggugggaagaccaagcggacaugacuccuccuagcucaagucuacgcugacuucaggcuccccuggcuccagcauccuccacaccaguuucucaaugacacucaagcccaaggccagagauccugggaugcuuuccgaaggaacaccucuacccuaugcaccuucuggcuuccaaugggaccacuggaaggaggccacccccacaguguugaaagaaggaggugcccugguaguugacucucgaacagaaauuugcaucaaauccagggauuccagagugacuuguguucuggauagacugacuccucguuuagaccccagacccccgaccugccacgcgaggcucuauucugaccgcugaagccugcuuuugcuucuuuauuuaaauaaauacccauucugugcuguacacguccuagacagccgaggcagagagcccagcccgggaggcucguguggcagcgcagcagccaagcagccccucacuugggcgacucccggccgggggagagggcucgcuggcucucuagcccacucaccagucucuggaugcucugcaguucacuggccgccucuuuggcugagccgcugggcgauagggccccgcgggaugggccccccacuuuucggagagccagcucaggcagcggacugggcucacggcuauuuccgcccuuggagcccuccgccgccagcccggugguaaggaggcuagugcuaggugggauggugacagggaucugguaaggacugaagcgcagacggggccgggcacugcccagaaaugggcuccgugauaaugaaccagcggcugcggcggcggcagcugcagcgcugguggcggguaaagcggaggcggcggcggccgcugcugccauguaaguguacggguagggaaagaggccuccgaaagugggcauugggauucccuggaagaaacagaaggcaagaaggguuagacaucuguccgaagugucuuuaaaggugguagccugaauacugcagauaaccuuugccuuacaccuuuaggcuauaaagccagaauucacauagcuauaaaaccucaugcucacaugaggagauaaaugagccagcgugccagggccaaauccagcgaguguguccaucaccuagggugagaugcaaaggccuggugucucccugcucugcgcuguuugguucgguagggauaagggaacgagcagcaguuggcugaacuaguaugggccuagagagaaaaaccaagacaggcuuggggccagguggcaagcaaguagcugggacuaucauaugagguccugcucauuuaggacaguaguucuuccaugccuucuguuugcaggccggaguuguggcuuagaacacaggcuuagaaaaaaggaugaucgagucucuugcuugcucgccugcccaggggucuccugccuuagcugggaucaagucacaagugacaaccaguucauaaacuggccugaacguuugacagagaacuggcagggcuucuguggcagcugaggacggaaugcaggcuuuacugguggauagcagagcagccaggacacccuggacacaggacacucaguucauaaggccccgauugcuauggucugaccuuugagauaauggcuuauauucuagcgugugcgccuguggaaugggugauaccccuccacccccaacagugcuagagacagaggaagcccaaguccugguucaagcagggagagcccaagaagcagcuuagucuguaggaauagaaaggcuugcaagccccacugugcacuucagaccuggcaccucagguuggaaggaggggaggaaacgucaacuuucccaaaauuuggcuuuaccugacauacaacuauggccuuaucaccuaacaauuauaccaauugauuucucaugaguucugggguacucuuucccuggauuucugccuauuggccaggccagaagccccaggcuuccccauguccucuguaaugacuaugguuuauugggaaagaggcauucacauccacagaaagccagagcugcagcucaacccuccagcccagagucauggggauucguguaucacaggcauugcacagacccagaugauaagcucuguucaaaacucauuucagacucccccuuacacacauauucacuucugaaccaaagccauuuucucaaaaaaaaaaaaaaaucuaaacuccuguuuuccuucccugaagauaugaucucaaggguucaauuugccagaaaccucagagggaagaaaccgaaugaaggaauuccaaaucuuuccgcaggggauauuccacccaaguaacuaaagagguugcugugcgcauccgaucuccuuaugccucuggccacauuuucauaaacucuccccugggaauuuagaauuucaguaggagguugugggggagcuaaggccccuucccuggauguggcgggagaguuagggacucagaguagggcaaagaccaggcuugucacuugucacuggcgacuuccuagaggaccucaaaggggccagaaauaucugagaggugagucauuuggggagucaacuguccagaaaauaacucaaaauucccuccuucguucguucguccagccuacaguuuuucagagccgaucaugagauaaagauuuuucuuucucaaaaauuuccuaagaccagaaaagugaaccccauaaaauccaggagcaacccucauuggucauucagaagaguuuuugaaaugugcucucucacuucuugcugggguuauggaggagcaaacagguccagagaggacgaggaacauucuuaaggucacacaggguucagaagcaaugucuugguuagaucaugggcaguuuuaaccuuucaggucuagauggcuuuccugccuauagguuuugguuucucggaggaucugaguaccuauaaccucucucaaguucucccgcgcaccucagccaccaacaagccgcugcgccccccuccuuuggcugccggcaaaucacaggccuuaccugagaugccagcauaugcugggagagguggaacgggaagggagccgcggugcuugcugcgcuggcugcgggaccuagcccgccugcguccagccccgccgcgguuccgggaccggcgccuccgcuacugccacugccgccugccaccgaggcuagcagaugacccaugcccauggcggagaaggcuccggggcccauggcgaauuguccugggugcaggaagaggggcuggccagcucccagcggcccaaagaacugcugcccaugcagguggcuggagaaggccaggccaggcagauggcccgcacccaggggggacgcacugucugucugcaccaccagcggcgccaggcugggcuccuugcccucacccacguccuugcgccccucguccuuccuccgggccucgggacgcuccuucuccaggcuccgcaggcuaaacgggccguccccaccgcccuccgucgguuccuugcugcaccucuccgggcugcgccgcucccgggagcguucggguucggucaagcgagcggggcuggcgucccgcgaagggcugcggcccaggggcgcugcggagcgcuccucccccguccgcuccggcucaggaucgcugucggcugcgcccggcuucuccucggcuacggggagagagggagggagcacggguuauccggacgccgccggagacagacguggcgcccaguccccgggaaccuggaccuggucaccgacacuucagacagaccagcuguuaggaaggucaaguugagagagcuucuaggggcagcugcaggucacauaaaucaagaccccauucuuacacuggaagaaaaugagcccuggaggagaaagcuuauuuccgaccacauaucccacaagggguccagcucaaaauucuaccaaauguccuggcugccagggacaguccuuauaugggaguaccagauuggaaguccuagccacauuccgguaacuuuuauccaggacuuugagauuagccgaucacugagcaaaagaccgacuuuauggugcacccuaaggggacacuuccuugguccuucccuccagacucggaucaacuaugccgcucaccucgggcccgguguaggcgcagagggcugggcgcugcgcugggggagggcggugguucucgcgcaggcggagggucgcaggacgaggcaucggauucagcgccaucacgcuccggcuuacagugcuccucauacaaacggagagugggcagcguuagcugcuuccugugggugagcagagggagcggucagccaccauugcauccucccugcuuccugcgaccagggguacgcacaacaggccaucggcuccugucucaccuuuucucccgacggccguucccagugucccggaagcccuuggcaaagggguuguugucgaucuucagcuguguaaucugcggggccgaggaagcgguacuaagucaagaccugauucuucaaggcuggccgggggcaccccgaggucagcggcuacaagcuacacaguagagagccgggguuggggguugggucgugccacccgccugggguaguacgcagagaggugaggccggcaggcaagcaucuaggaaaaugacgggaucuuugcaucuccaaaagccuuauucaagaaauaaucccucaacacgcacauacaggccggagcaagcauaaaggcucacauagucacaaagguuaaacuauuccucacugaacacagacaaacccagugcccgcacacccaaguccgcaggucuaggcaaagucaagucauugcaccacucacaggcccagaagggcaaguucgcaaaaaauuaaaaauaaacaaacaagcuuguauagaauucaacgaauucacuugcuuccacauagagcuaauacacuccauacaauguaccuggccaggcagaccccugguuuacaaagacacaaccaaagacacugggacccucucauuuaaucuauggugaucuacgagaccauuucacuugaaggagaauucucucagccucccccaaagggccuagggccuggauggacccagacaaguggcuuagaggagcucgccaggguugugccaccugucccacucuuuggcucccuuggagaguaaaauuuggacccugcguuccuagcaucuguagagcuugggcagauugccccaggcgcccucuuuucauuuagauucccaguccugagccaagaaacgaaggaauaaaauguaaaaaugucagcgggagccugagucucuacuaauugcuaaguaaacaucuccacuccaacuauggcccagcuguguugagugccucgggggaguaugugugucuguguggguaugagggggagccgggggauuuaugugggugcugcucuucugaaucugaguggguggugaguucuugaagcucucugcaaugcugcugcuaucagguggguuugaauggaggguuggugucuguaaauguuggggggauagagacggaggggagguaggggccaaguccacuccccacucccacagcacaccuugucauucugguaggcagugacagcgaugaagucggucucugggaagacauaggugcggaaggugcuguaugggagcuucaagaugucauuggcucgcacgauguggaaucgcggcugguacuugugcauggaguucaggauggucugugaggagcaaggauucagccagcaguucccugcuauuggaccaacagcucucucucucucucucucucucucucucucucucucucucucucguuuuuuuuuguugguucacuugcacuucauuuuauauuuucucaugcucccccccuucuucacagcuauucuuucuuucuuugacgcugcccaguuggaaaaagaaaugaaacaaaacggaagaagacaaauaacaccgucuccauucuuucacuucacuguccccuggcauuucuggguccugagauacaagggaagaaaacuguguguguggaggggugcucgaggacuagcuauaaugcacugggaggcucucuuuguccaaugaaccccccaucauucgcuaggagcuuggcucagguagaaaugaggaguuccucauuauguucccuggcuggacaucugccuuaauagagcagagaucuccagaaggcuggaggagagcagauuuaaugucuggauucccucaccauaggguaaggguuagcuacaggagacaagcagguguccaagcugcauaucuccaaguccuuagcagggugaccuccacaggacucgggcggcuugacccauuccuuacagcaccugcuucacccuugauucuaggaggggcucucaaaauucuguuagaaagaaacugagauugagagcagccuggagcuuuccacaaacagucgacauacuuuuccucaggcuugcagaacagggcucuggaagccuaggcccaguuugccugggccacagacaggggcacugugggugggggguguucaacuaaugcuccccucuagaaauccucuagcuuccuucuacccacucgacugugggggccccugggcucucaacaccuucccaaccugcccacacucacaaagccaugcuugucagaaauguuguuggucagcuucaguuuguggaaggccacaggcuuggccauccacuguuccccuguggccggacuguccggguggauguacaugcguuuaggcaucucggggucggcuuugccugccaccauccagcgggaguugugaaacuuauagcggcagucaucggcagccacgauguccauuagcaggauguauuuggcuuucuuguccaggccgcugacucgcaccuugaagggggggaacauccgccucggagggagggaagggggacaugccauugggacccggcucuuuuuugucccuuuaccuucccgacaaugacaugacauccuacuugaagcuucccuaucuacauaauuugucacaauguccuccacuugugcuguguugcuaccuggaaagacccagccugugcuucuuacucccaagacauccuauuucugccggccagagccuguuuuguaaagcuuuggaugcguuuugcacucagucuggagaccuuuccuccacucugaucuaagaugaggguugaugcccaggaaaggaaacuaggcccuuuagagauacacuaggcuuuucugaauugccuugaaauucguagagaggaaauaaacucuugggacagggcuugaagaaauaaacuaucaaggucuuugucugggagaaacgauuuagaggcuuaaucagggaacccuagccuagaauuucgggggaacagggugaaccugaggccuggacuuucagagacuggagugcugggaagauuggggauuuuauuuuucuucuggcuuuaaggccucaagagguggcugguccagugcuccaagcuccaaggacaagcaagacucucuccaaggccuagcugugggcuggacaacucucugccggaaccaaguggucagccuggagcuagcaggaggcgggaugcuagucccacuauggacuccagugaucagagcggagaauccgggaaagaucccuuuucuuaggaacuuccagaccguccaggagacggaaaaaacaaaaacaaaaacaaaacaaaacaaaacaaaacaaaacaaaaaaaaaacagugagaccgcaaggggcuguggagacccgccagagucuccggggcuuugagacucagaacaguugggacuauucuuuaggaacguguuuucguuuuauuucaaucgagagauguuugcuuuucuuuuucuuuuuuaauucgcuccggagccaaacggaaaaaaaaaaaagucagcuugcuugucuguggaaaggaguguggcgccagggccggagcgggggcaauccgagagagcaucgacccagugguggugggugcugugcgguccccgagcccgcccgcccggcccguccuaccucccggacuuggugaugaccaucucggugcccagcuuguggaacuggucccacagcuccuuggccuccagcgucaccuuggggucguccuccaccucguccucggguuccaggcucuugagcgagcgcagaugcgcggcgggcgggugcgggccgagugccgagacgugcagccccgccucggccgccgccgccgccgcugcugccgcggccgccgcccccgccaggcccggguccggcagaggcuugccuagcgcgccgggcggcagcgcuagcgccgggaagaaggagggcugcgcugccgccaggaaggcggacauggggaagucggcgggccguggcgcguggaacgggugguaagccauggcgcuggcugccagcgccggcucucucaucgggacauccggcccaggcuccugggagccggggccggggccgggggcgcgcgccucggacccccggcccgggcggcggcgcgcgcggaggacggacggcccgggcggcgggcgcggcagcggcuucucccggcuccccgucccgcgcaccucaaggggcgcagggcucuggacgcgggggcggagggggcgcugcgcggggcugggcugggcugggcugggcugggcuggccggcuccggcgccggggaccacgcgcgacugguuagaucuuguccugaucucuggaaaacugugacuaucucacauguccugcccuguucggauccccugcgcuaacgagccaggccccccuugauugcugauuuuacgcuuuuuggaccaauugugggucuccgggggcgggguuuugacagcucaggccaagcucuggacgggaggggaggccagggagaaggugucggaagccucagcaguaagaaaacaugucaacagaauaaaauauuaaccaaugacgggccagcgggccccgagaccccucccccuggccuggccccca

SEQ ID NO: 6256 - RNA, 434 nt, Mus musculus
cauggccaaguucauccguaauuucacagagaaggcaccaucgaugguggccgcugccgugacuuauucgaagccuugauuggucacauuuuggcacuaugccaaggcugagcugguuucccccaaccuguggugaaaucccuacagcuauucagagugugaaaaaaaaucauucaaagugcuaaaacugguagcuucaaacaccuuacagugaaggaagcugugcugaaugguuugguggccacugagguguggaugugguuuuauaucggagagaucauaggcaaacuuggcauuguuggcuaugauguuugaagaccaaucuuuaacuucugauuugaguucuuauuugaauguucuuggaccauguguaacaggacugcuaucugaauaaaauacuagguguuggaaaaaaaaaaagaaagaaaagaaac

SEQ ID NO: 6257 - RNA, 103104 nt, Mus musculus
auacuccauuauuaucuauaaauauuucuuuuuuuuaacagauacuuaacauguauucaucauacauaauuagcuugauauucugugauucuaucaucuuuauuacgauauuuacaugcagccuuauuugcuuaaauaaaucccaucuguuucaaaaugaaaaaggccuggauagauggcuuagcuuuuaaauuguuugccggacaagcaugacagugcaaguugggaucuucaguagccacauaaaugucaggcaagugugauggagccugccugaaauucuagcaucggagaagaggagcuagggaguucccagagaaagcuggauagcuggacucauugaaucagugcgcucuagguucaaaggagagaccauacuuaauguauaaguuaggaagcaacuaaggcagaugccccaugucaaccucuggcuuccacauuaugcauauaaugugcgcagguaccugugaaucugcauauauucaaucacaucacauaacacacacaaaaaaggaaaaguauguguuuuuaaguaucauucuaauggcauuuguauuuuuaugaccuuuucuacagagcuuaacuaugguguagauuauguaacuuuuggagcuuccucgggaagcuuuauuuaugagaaaagaauuucagauuuuaaauuagugacuagaauaaucguguugcauaguuguugugaacauuagguuuucucucuuguuuaguuaaacagaauacuacuuggcuaauaguugaguuuucaguuuauuuuuuucugauugucacauguagaugcuccacgcccuacaaaucaugcccguccuccaucaaccaguuugauuuaugacucagauuuggcugugucuuacacugaccuugauaaccucuucaauucugaugaagaugaauuaacaguaaguauccuacuaaugauuaggauuaaguuaaauuucauugauuucauaacaguuugaguuuuggaagugauuuaugacuuuauuacuauguuuuagcucugaacaguaggaaauauuuuauaauaaaacacauuugauugauuuuuacucucauguuaaagucaccuugacaugguuuccuguaaaucuugauguggguauguuugaaagauagaugaucaaguuucauaguucuaccauguaauuuuuuuuucuucagucuuuagaaugauuuuucuguucuuugauccuguaguuugagaggugacucuggaauugaauuagagaauguuuaaguaauuaacauuaggacuuuauaccuuaccaauuucauaaaaaugcuaguucuuagccgggcgugguggugcacaccuuuaaucccagcacucgggaggcagaggcagguggauuucugaguuugaagccagccuggucuacaaagugaguuccaggacagccagggcuacacagagaaacccugucucaaaaaaccaaaaaaccaaaaaugcuaguuuuucucaaauuauuugaccuuacuucuguuacuacgagacauagucuugaaaaugguaaaggagaaaccagaaaauacuacuucaucguucacaccuguuuucagagaaaguugaagauaaaaguaaacacuuuagggcuggcaagauggcucaguggguaagagcacugacugcucuucugaggguccugaauucaaaucccagcaaccacauaguggcucacaaccauccuuaaugagaucugaugcccucuucuggugugucuaaagacagcuacaguguauaauacuguauacguauaauaaauaaauaaauaaaucuuuuuuuuaaaaaguaaacacuuuaaaugauuuccuagaaugucagucgucuagcaguuaauugggugcuacagugucaugaaagggaguccuuucccaucuacuuaaaaguaguuuaggaccugacuggcauauuugguguuuguugucuuauauaauauauccugugaggauaucuauugcacauguuugaacauaugaaaucuauuacagauauugguaagucagauauagcucuaugugaacauucacucuuuacccuccaguguaguguguacuagggcacgcuucacuaggaaaagaacuuugaauaugguccauauagacagaucuugucucuacuaacacccagacagcagcuguggcuuuuuggagguaaaaaauuugucaugugugugcuuuacuuacaaaguguucaacauaagacguggaacaaacguuccuucuaaaaacauugguaagagcuggauaugguugcacaugccuuuaaaccccggucuugggauaggaggccaaaguguugggaguucaaacucagcuuugucuacauaaaaacaagaagccuacuuagguuauauaaggcuuuaccuaucucaaaaaacaaacaauccaauccaccaaaaaauguugguggugagagaugcuaaaacuugguuuguuaggaaguuucccugaacuuaugcucaguauuagaucuguaaaaauauuuuugcuagaauaacuuuauuaaaccaaggugaaaauuaaagaauuaagaggaguuauuaauuauuuaggaaaucuuaauaucuuuuaaauuaagggacagauucuuugaauaucuuuugcuaaaaaaagaauuguguuaauuuuaccuuucuugccuuuuacuuguuuauugcuuauuuuccugaggaugcccuuuucucuguuaaucccaagacuuaccaaugcacuccagugauggaucuaccuguaaacugucuaguaugauauuuagcucugucguagacucagaaaaccacuuuugaugaccaguacuuaauccuuuaacuuacauauaagcgaauaauacugugugaucacuuuggguuucacauuaauauguuuuuccccccauagccuggaucuaaaaagucagcaaguggaucagaugauaaagccagcuccaaagaaucaaagacaggaaaucuggauccguuguccugcauaaguaagcaucccaaaucugagcuccagcuuggcuuaaaaacuuaacuccuuucaaaacuccuucacuguaaacagacucaccucuuuuaguuuguuaacauggguguuguacuacacacaggcacugcagaccuccacaaaauguaccccacgccacccucacuggaacagcacauuaugggcuucucuccaaugaauaugaauaacaaagaauacgguaguguggacacagcacccggagggacuguccuggaaggaaauagcucuaguguaggaacgcaguucagaaucgaggucgaggaaggauucuguagcccuaaaccgucugaaauuaaaguaaguauuuucuagaaaagucauuuccucccuguguuuucuuauaggauuaauugcuguguuuaagaauuuuuucacaguugauuuuaguguuauggcuaauaaauaugaggagggaauugugggaccacuauguaaaaugcauucaagaauaaaaacagauaauauuuauacuuuuguccauuuaaagaacaggcuagagaagauagucgcuuugauucuguuucuuuguuuuugucccuggaauauaaggcacugaaaguccccguucuuuauauuguaggauuuuucuuaugucuauaagcccgaaaauugucaaguucuaguaggauguuccauguuugcaccuuuaaaaacucuaccaagccauugucugccuccuaucaaauugccagaagaguguguuuaccggcagagcuggacuguuggaaaauuggacuugcuuccuucaggcccuucaaugccauucaucaaggagggguaugauugaugauguuauuauaauacugauugcuuguguggggugugugugcgcgagcgugugugugagcgugugugugagugcccguguguguuagagggcggcacuggagacucugcaugaguacgagccacauguguugccguuuacucacuugagacaugguuucucauuggaucugaaacuugguguuuuguugaagcagacugaccagcagcuuccuggaauaugccugucuuugccucccaagugcuggauuauagcuuguuuaguuagucaugcucagcuuuaucacaugggaucugagaaucugaacucaugucuucagcuuacacagcaagcacuuuuacccauugagccauuucugcagcucagcuuuuguuuuucuugaaguagcugguaugcuggaaauagaacauugguuuuggaaauccuaaguaaauaaauuuaaaaugauucuuguuuaucauaaugauaauagagauggauuaacucuuugagaccauagaccagaaaccauagaccauuuuugauuuucaagguaccuuuucuuuuagccuuugauucugaauuguccucuuuuuuauacugccauuuuacaauuacuucacaucauaacagauaaaguuuugcauuuuauuaccagucacauuuuuauaauuacuauggccaacugggcaguggugguacauaguggcacucaggaagcagagguagaugaucaaguuuaaggacagucuugucuauagauugaguuccagugcagccagggugugcuacacagagaaacccugucucagaaaaucgaaaacaaaaacaaaccaaaaaaucaaagcaaaacauucacuauuaccacuuucuaacacaaacaucccaaaagucagaauuuauuuuuugcuaucaguagcaauuagagucaaugaaguauggauauuuguagcauuagaaauuuauagauaguaaauaugguuguccagauguggaugcuucaugaauuuuuuuaagucuuuguguauccuuacaugacuucaugugcacuacauauguguaggugcccacagagaccagaggacaucaagacaccuuggaacuggaguuaauaggcagauaugagcuuccugauauggguccugggaaccaaaccucugaaccuauggccccccaaaaugcagcaaauauuuuaaacucccaagccauaguucuagucacugcuucauuuuauaaucuugaaucugguugcuuauuauuuuugauucuaguuagcucacaagaaucuuuauagugcucacaguaaaccugaaauaagucuuauuucucccuguaaucuuguaaugauuaccauauagaaauguccaguguugcuuggaaguguauggaggaugcuguuuuguguuccauauauuaauguguucuuuuaugcauuuguuccucuuuuuacccuggugacaacagugauggcaguaauuuggaucaggacuauggccccgccuacacaccgcaaacccaugcuucuuuugggaugccuccgagcagcgcaccuccuaguaaugguggugcaggaauucuuccuuccccauccaccccuagguuuccaacuccaaggacuccaaggacuccaaggaccccucguggggcuggugggccugcuagugcucaagguucagucaaguaugagaauucagacuuguauucaccagcuuccaccccaucuacaugccgaccccucaauucuguugaaccugcaacuguuccuuccaucccugaagcgcacagucuuuauguaaaccucauccuuucagaaucaguaaugaauuuguuuaaagacuguaauuuugauaguugcuguauuugugucugcaauaugaauaucaagggugccgauguuggaguuuacauuccagacccaacccaagaagcacaguaucggugcaccuguggcuucagugcugucaugaaccgaaaauuuggaaauaauucaggauuauuucuugaagaugaacuugacaucauaggacguaacacagacugugggaaagaagcagaaaaacguuuugaagcucucagggcuuccucuguggagaauguuaauggaggccugaaggaaucugaaaaggugccugaugaauuaauauuacugcuacaagaucaaugcacuaauuuauuuucacccuuuggagcagcagaccaagauccuuuucccaaaguggguauaaguagcaauugggugcguguugaggagcgggacuguuguagugacugcugccucgccuuagaacaugggcgucaguucauggauaauaugucaggagggaaaguugaugaagcacuugucagaagcucaugcuuacauccgugggccaagcaaaaugguaaguuugugaauuugacuuuggcuuuuuuuuuaucccucggggggggggggggccgugaguaacuuaccaguaggucacauaggaauacuaaaguuuggacuuaacccucaguuaaagacagcuacauguuggguguggugucucaugccuuuaaucucagcagaggcaggcagaccucugugcguuggaagucagccuugucuacauauggaguuucaggauagccaagaccaguaugagacccugucucagaaaaacaaauaagacuguuaccuaaugugagacuuagcuguuuagaugaguuucagcaauuaaaacguuauuguaaucuuuaacuauguacugacauagaaauguaaacggcauguugcauguuagcaaggagaaaaugagugauuguuucucaugcagccaucuaauuugucuuuugagguagcugcacugcucucgagcugugcccgggcucucaguagcugcuuacagagcaccucguucaugcucagcgcuguucaugcucacuccugagcagacacagccgcuuuugguuuugaauuuuuauucgauuguuuucuuuguuuuuccuuauguguguggguacgugauugcauguguauuuggaguuuagauacauagaaggauagccuucugugucauuccucaaaagccaucaaccuugugggccccacuccuuguguauaucagguuuuucauucacagggcacugacuggcuagguuagaaucccuuguccuuuugagccuaugauuuaguggaggagacaguuaaauaacaacaacaacaacagaaaauauauacuugcauuacauaccaguuacgaguacguggaagagaaagcagggcaaaagagcauguuugcaugggaggauccuuaugugcuauuuuagaaauauggucagacauguuaggggggagaacauuuauagaaaggccuacuugaagugggaaaagugagccagaguaguuaacugggggaagaauguuaguagacaauguaguuccaaguccuugaggacauagcucucgguaaauuuuagaaacauaaguaguguuaaguauguugagugauggucauacugauacacggugaaguguaagaggugucccaaacacuuauuuaauuugugugugagcacuuccauguuugggugcacaugugugcuuuggaaaauguguugaggucagaggccacuuugagggaguuggcucuuucuucauauccucuugguuuaaggcuugaacucggguugcaaggcuuggcaacagguacuuuuacccugguucuggguguggguuuuuaggcuaugccuuuagcauuuauuugaaaugccuugggaaugguucuuaaucggaaaguaacaccacugucuuuuuagcuuuaaaaaaaaaaucccugggaugggaagugagggaagaugagagaagcagcaguaauuuugaguagagaauagucauuuagugaagguggcagcuuggagaagacuggaagccauagaacuaguggcaguaggcucuagauuagauggagacguagaccuacagagugugcugauccacuuaagaaaagaugaaguguuaagccugguuugugccaaugcugguacuacugcagagaaagaaaauaggaggguugcaggcacacauuuggagguuaaaauucagaauucagguuguauguggguuaucaguauuaaauacuauggaaagccagguguguuguacaucuguaauaccagcacugggaaauuguaggaaaaaaucagaaauugaagaugaucuuuggcuacauaguaaguucguggccacccuggaauauaugaggcccuuucuuuucaaaggccggagcuggaugggcaguuuuggggaaaagaaggucaggaaggagucugagaaggaagaaggagcaaggaagugauugcucuuguaugagaauauuugaaggagagugauuauauguauaauaaugccuucauaaagguacaaugugacaagaccacuggaugugaccucaugaagguaguaauuagagaccuagauaaucaguucuggucaaccugauuagagugagugugaggaaaugagaaacaaacuugaaauuugggagacauugguauaaauagaguuuuauguuagguuuaacauauaguacuugugugugugcacacacacacacaucuguucauggaaagugauucuuucuagaucaaaaaauuuaaacugacaguaauuucauauaauugaguaagugugguauuuugcuauguaaauauaugauagcuuaucuaucacuuuuuuuguagugacacuuaaaaucuuuuagcagcuuuaaaauauacaauacaauaauauuaguugugcucaucauguuacuguguagaccgcuagaacauaaucuuccuaccuaacuggaaacucacucccucucuccagucuaaccuucuuccgugggaagaauuaccaugaaacaaaaggugcuguuguaggagcaaagacauuaaguaagugaggggaaauagaauacauuccaaguagagguguauauagaccuauauauaggaacauguccaucgaaacaagaagaaaagauggcauuucuuuggacaagaaaagugaaagugaccauucuuagugauuucuuuuguaguugugggugagagcaguaggagauagugacagggucauuugauacugaugucuuaauucacauacuagcagcaucacacaguaccacuuuguuagaaaugcacauuugcagauucucccaugaucuucuaaagauuuauuuauuuuuauuauauauaaguacacuguagcugucuucagacacuccagaagagggagucagaucucauuacggaugguugugagccaccaugugguugcugggauuugaacuucggaccuucggaagagcagucgggugcucuuacccacugagccaucucaccagcccucccaugaucuucuaaagcaaacucuggagauaagaaucaguuuugucacucauuacuaaugugucuuugaaaaaguaauauauuaucuuuauuucuuuaucugcauuguuggcgggggaguuuggggggagggaggguugaacccauguguaaaaguaacuuuuauuccccugauguaauuguaguuucugaagcuuccugccucugucugcuaaccuaggccaaguccuagagacuuccagucuccauacaaucuuauuuaggccuagaguguuuucagccucugagacuuacugcugaauaagcucacccuuucuaguucuuucugagcucugacuggcugguucaacucagcuguucuggcucaaacuccucuccaagcugauagagucaaucugacuucucugaauugcucugcuuggcuuuaaacuaacauuggcaauauguucuuaucuucugguuccuuuuuguucuuggacuuguucugucuucaucggugucuagucuguucugucuucaaccugucucuguaaaacucuccugguaaaaucgccucuuuucucucucucuuugaacugcucccucaaguagcuuccuuuccucucuucuugugagaguugagcauauccuauugucagaucauucucugauucaucacuuuuucugccacucaauuagucauugcuuucaaauauaugucuacaaucuaacuuuaccuuuauuaauaauguauacuaaguauuuguauguauuccaaccagagcagccagccauauugcuggauuaaaaucccucuacacuaggaucuuguguaugcuaggccaguaguuuauaacugaacuauauccccaacucacuuuauuuuacuaaugaaauaaagcuaguauuugacuugauuagaauuguaaagauuuaaugaguucauucauguaagcauaauagaucuuauguaggcuuuguauuugguauuuuugggaacuauggagguagucuacauuuuaauuguucucagccacuaagauaacuaaaauuauaaucagaaguaaaagauaauccaaauucuuauugauagaaaauuccuauuauuaauuacuauaagacaauauuaacaagcccugaaaaaauuaugugaauuugaucauauauaauagaugaauuauagauuaauuauagcaaugauaguuugagggugaggucagaauaauucuaaagacuauaguaacauguaugcuuuucuuuuucuuuuuucuuuuuuacauugugcuuucuguguguucagauaugcacacacacaugccauguuacauguugaauucagaggacacuugcaggaauugcuuaucuuucauucagugaagucuuuaggcuuagcugcaggcaccuuuacccaaugaaacaucucaccaccccaguuaaagccauuacuuuaaugcaguucugaaauaagcaaaaguaaauguguuguucauuugcacauaaaacucaggguucugguuauuucuugagacuuacacauguauagaaaggagcaaggaauagaacaaaaggaggcacuuaguagacugggaggaaguguaauaccucuuggacauggugguguauauuuuaaaucccaacacucaggaggcagagacagguggaucucugaguuucaagauagcuaguacuuuauagugagauucugucucaacaaaaacggguuuuuuggcaaugagauaauaacucauaauuauuuucaucaugauauuaaaaguaauuugugaaauaaaacaagaggaccacucaugggcucauuauuauuuaugacaauaucaagauucauuuaauucauuauacuacagggaagagccaguuaaaguaaagcacucauugagugccuggcauauggcccuccaguguuacuccaacagcagcagagagcaccagggugcucuguauuaguaguuuauugggauuaccucuuugccagacaaauacucaaguucuacuuggugcacacuuauacucugauuaaaguauaacacuguugaguauauauagcuccagaauuaggaccuacuguauggauuagggccuguggauugugccaucugccuuggauaccuuucucccucauacuuaacuugggcuccuucuugucuccuuuaucucuuguuagagguuauggucugcauuuuucauauuauuugcuuauuuccuucuuauacaugcaauauaauuuauugguuggucccuuaucccuuaaguacaccucaugcaaguucugagaauaguugaauaugaauauucauucaaauuaaucuaagucuaugaaauugguugagaauguaucucuguggcagagcaauugacugacauguccuggguuuaauccuuauuacuuuagaagaggaaaaaagaaaaucuauaagauaguuuauauauucaaguggcaacuuacuauucaagauaaaaaguugcucuuaauugucccaauuucacuguccuagcaccuccugaucacagaagaaaaacuuuuauaaacauaccauaugauucaucuauauaaaauauacagucaaaaauuuaguauuuauaguuguaaccauuuguacaaacaauuuuggaacauuugugccacucuaaaaguaauaacucauucuuaguauuuauuugcuauuuuuccccauccuuuucuuguagcuguaagcaacuauuaucuaguuaucuucccuaaaaaguuuuuuuauuuuauguuuauugguguuuugcccucacauaugucugugugcggguggugaguccucuggaccuggaguuacaggaguuaucagcugcugggacuagaaccuggguucucuggaaaagcagccagugcucuuaauuugugagccaugucuuuagcccgauuuuuucccccuuccguucagauuguuuuaagaguucuuuuuuuuuuuuuugguuuugguuuugguuuugguuuuucgagacaggguuucucuguguagccuuggcuguccuggcacucauuuuuguagaccaggcuggccucgaacucagaaauccgccugccucugccucccgagugcugggauuaaaggcgugcgccaccaagcccggcuguuuuaagaguucuuaagcauauacuuuaaugacauagaauuccauugucauauagugguauaccuuuuucaaaaucuucaaauuguucauuugaauugaacgcacuuuggcuucugugaauauguguguaugauuuuauguaugucuuuguuuccgucauacuuagauuucuugggucauggaacuaauauuuuucaaagcaucugcacuacuuuaaauucuaacauuagauguuucacuuucuccaaacccacaccaguacuugcaaucuauuuuuuauugaagacauccuagugguuaugaagugguuucuugcgguuuggcuuugaauuccccuaaugauuaaugauguucggugucuuuucauagacaccauuugugcaucuuaggggagaugcuucauaagguccuuugcuuuacuggggagugggacugagagaguugcguguggagaggaagcagcucauccugcagccccgccuggggcuugugagcuuucagcuucaccaguucaucugacuuuuuguguuuuuuuuuuaaacuuguguuucauucuuauuuuuuaaauuauugaucuguaagaauuuuuaugagcugugggugaaaauacuuuauugguuugugguuugaaaauauuuucacagccaggcauugguggugcaugccuucagucccagcacuugggaggcagaggcagguggaucucgcucuguagaucaggcugucuucgaacucagaaaucucuucugccucugccugcccaccagcccucccuucccuuuuucucucaaucaaucucuaucugucugaauucagggauuauagauauguaccacuacaucugacuucugaaaggucuuauauaguuuucuguguaugcagauauuuagguuuuuuuuuuuuaaugaacaguuaagauaccucagauauauuucuuuuuaacucuaaaguuugugucacccaaaagcaaugaccacuuacuuuuuuuaaugauuguagaugcgagcgugcaguguucacaggauauacuucggaugcuccuuucucuucagccaguucuucaagaugcuauucagaaaaaaagaacagugaggccuugggguguucaagguccucucacauggcaacaauuucauaaaauggcuggccgaggcucuuaugguaaguuguguauuguacuagauaaugacugauuuauaucuguucucagauaugugcucaacuugaauaaguacauuaguucuuaaauauuuuaggggacuaugacccaguucugauucuagcccaccuuuuuacauuugcagcauuuaguuuuccuggguucuuuaauuucccaucagcacgaguagcugcacuaucuguacaugguugacacucaguaucaguuuaucugaaggaagggugaugaguuuuguaaaacccccaaauaacuucaguucuaaauugaaugagaugaaagauugcggccaaauaauagaggccaauacuuuuuuuaaaacauaagauuuuucacauaaaaaguuuggacaaaaauagaaacaaaagcaguaggugugugcucccuggaaggaggagacucucacuuaguaggaguguguugacugugcuccccuggaagguggagggagacucuuaggugguugagauacuguuucugcaguaguguaucugggugauagcugguuguguuuguauaguguugggauugaaccagagccucacacgcaguaggcaaccaaaucgcacuccagcucuggaauaauagcuguuagcauuaaaaguucucugugguuucagaaugcauuguacacuguaguagacuucuuguauuuuucucuuuuuuauuaauaacuuaaugauuuaaauaaaucaauuaucauauaaauugauaaucuaugaaaaguucaaguuauugauacuuuuuaguauaaacuucacauuuuucucaaaaccagaacagauuuauuucugcaccuaauucugaaaauuauuucuguauguauuuuaccaacauauuaucuauagauguaaaaguauuuccaucauuauccaucaucccacccauacuccaucauuccaacuauuuucagugauuuguuuaugcuugccuuaaaucauauguguaguuuaaaauuuauauugcugaauuauacucagcaguaucaauauaaacucaaucagaaauauuuacuaucccagacuuugcaguagauuaucaggcugagaguggguuuccuggguucagauuccuacagugacuucuuuuauguugcuggauaaguuguuuaccuuuuuuauuccucuuucuuauguuuaaaaugaguuuaaaaacagugucugccaauauaugguguuugugaaaauuaguauagacaguaccuagcauguaguauagacaguaccuagcauguaguauagucaguaccuagcauguagagcugcaguuauuuucuaguauucagguuacuuucuuuuacaagaucaaacaccuuuuuuugggucuuuacucauuuuaaaauaagguaauuugucucuuuuuccuaauaauauauugucguaagaacauuuaaccugugguaaacauuuaacauuuaccccuuuaauucaguuuuaaguaaaaaaaaaauuaguauuguugauuucuguauaauguauaguauaucugaugauaaucucauagauuuauaaguccuuuuuuuauaguaaauaaaguaacuccaucauaacaaucacaaauuuguuaacuauuaaauuaaaucaauucaugacaggugugguacccgugccuguaauuugagcucuuuuacaggcugaggaaaggagaauuguuacaaguuuacgaccagacugggcuguagaacaggaacccuucucaaguaaaauagcaguaaauauuuuaaagugaccacuuaaggauauuuuuaauucugaaaauaugucauugcuugcuuuucauguuucugucuuuaauauuuuccuuauuaauuuuggaaauaaagaggaugacgugaauuggcuuccuccugauugccuucuuuauuacucaggaacugaugaaucuccggaaccacugccgauucccacguuuuuguuggguuaugauuacgauuuucuggugcuuucuccauuugcucucccuuacugggagaaacuuaugcuggaacccuauggaucucaaagagauauagccuauguuguacucuguccagagaaugaagcuuuguuaaauggagccagaagcuuuuuuagagaucucacugcaauauaugagguaaguguuuuguaauuuauacuuuuauguuuaaaguguacugggagauucuaugggcugaugaagaaugcugauguugacaguagucuuaguaauggauuauauucuugcuacauuuuuugcuagucuuuguuagguauauguuccaugggucacaguggaaaauauaguauuagagggauauaccaagggcauaaauguguuccauuuaaaguaaccuuugguauguugggugugguggugcacaccuguaaaucauauguauuuggguagcugaaacaggagacucgcuagaacuaugucuuggaaaaaauguauuaccaggggugguuguauauguuuguaaucccaacauuugagagggagaggcaggaggaucagaaauucauccuucagcaauauaacaaguuugaggcuggcuuggguuaccugagacccuuuguccagaaaaagaaaaaagaaaaagaaaagcagcuggaaauuucuaaaggaaaauaaccaugucuucauaguuacccaugcuuucaacucaguuguuaguuauaagugagaagguuuguuuuaaaugggucaaguucugcuuggauuuuauaaucuguauccaaauaguaugguaaauucacugauucugccuuuucuauauauauuuuaguccugucgauuaggccaacacagaccuauuucucgauuguugacggaugggaucaugaaagugggagcuacugcaucaaagaaacuuucagaaaaguuuguaacagaaugguuuucucaggcagcugaugguaacaaugaagcauuuuccaaauugaagcuguaugcacaagucugcagauaugauuuagguauuaaauuuguauucauccuacaagagcaaugugagcaguauggguugguucaccaucuaaguuuguaaauaaaaucuuugugucauguggccaucuccauguuuucaaacacugucucugccugcuuuuguccugcaaagucagaacugaauagauguggcaaagacugugguuucagacuuaaguaugcacugucugacuguccauagaaagucugcuagcucuguauaugggaaugcuaucaaguagucauuauugguuccaaaauauucucugcugcuucuguggagucugauguuuccugccauugaucccagcauuccggaggcagagucaggaucucugugaguuugaggccaguguggccucaagacaacagggcuacacacauaguaagacccugucuuuaaaaacauuuuuuuuugauuuguuaauaacuuacauacaaauauuuucuaaguaaccuucugcaacaccaaaaaaagucuuauuguagcuaauccuauggcuguuauuuaaaucuuuuuguuauacucuuaaauaucagugaacuucuuuuacacuuaauccaaagagaugcaauaccaaauuacugaaccuaauuagacauuucugaaaauugaaccucaugauaauaucccuccauuuuguauuuuaguuagcuaucaaucuagacaguauuucuucaacuugugauuuaacaauaguuguagugguuugaugaaaaauugcuacauacuuauacacauuuguugauguauucuaauuuuuucuuacacuuauuacuugugucgggauauaugccacugugaaccaguggaaaucaggacuacuuggcaagguugguuuucucuuuccgccuugugguuucugggggucaacuuaaucaccgagcuaucuuguuagcuuuuguuuacauuuaauuuugccuaagaaauagaauuuucuuacauuucauacugacuauuuaaaauuugaaugaaaauauggguuuauuuuuauaauuaauuuaaaacauuuuuucuuuuuuuuaaaguuucugggagggaguaggaaguuaguucgugcugcacuguuaguauaaagcaguuaagggaagauaaucgccauaaaagugucagcuacauuguuauuucuauagaagaauaaaaauaagucagugaaaucaagaauuaaauacccguuuuuguucuuuagguccauaucuugcuucucagccguuggacagcucucugcucucccagccaaauuuaguugccccuccaaaucagucuuugguuacugcaccucagaugacaaauacuggaaacgcuaaugcuccaucugccaccuuagcaucugcggcaaguagcacuaugacaaugacuucagguguucccauaucuacuucaguugccacagcuaauucaacuuugaccacaacuucaucuucaucaucuuccagucugaguaguggaguaucaucaaauaaacugccuucguuuccacccuuuggcaguaugaacacuagugguacaggauccaugucugcacaagcaaguacgguucagaguggccagcuaggaggacagcagucgucaucucugcaggcagcaggaauaucaggggagucagcuucucuucccacucagccacauccugaugugucugaaagguaccguuaaauauuaggauacuugggguugaaagauaguuaaguaguauguagcauauguguuuagcaugcuugaagccuuauguacaaugaaugaauaaguauaaaaaaauuaaguuuguggaaauacagaaucuaucgacucuuuaucuaaguaaacagugaccuuacuguggaauuuaguuuaaucaugguaauuauuuuacguaugaaguuauaauaaagauuguuuuuaaauuuuucaucauagaaucacaggguugguguuuagaucuuaaaaauuauucaacuccagauaguccuaugauugagucuggcugugucauaagcagauguaauuguuuaugcauauuacacaacugguugcaaaaucucugugugccugccucugugugcguguguggggugugcguguguauaucugcgugcaugugcuagagucucacuggagcuggcacgugcgaggcaugcagccuuucacugugcuacguacgcuucagcucugcuugggaggcuuuagacucugaaucccagcucuguccuugacucacuuugugauaaggagaaggucuaacauuguuagcauugcauccauaucuguaguauggaagcaguucuacacgcugcacagcaauugugcuaaugguaauggaucucauuguuuuuauauaaaaguccuggggaaauucccuuaucagacagucugaugcucauuguuucucugcuuccuagaaugcaguuguuuacaaauucacgcucauaaauaugagguaaaaguagacuauuaucugaacagaaaaaccuggcuucugucuggacuagcucuguuucuaggcaggcugcugagcaugaccaguuacugagaugccugucagagagaccuuuagucucuuacuguuaagcugcuugagaauucuuucuuuuaaaugcacaaagccucuuauuugaagggauuucauauggugugaaguguaaguauccugauuaucagagagguuuucugaugccuugccccaauaaaagagggauguaaggauucacuuuggugcuguaccaggcagacauaauacaacauuguucucuuucuacuucaauuuuuagcacaauggaucgugauaaaguggggauucccacagauggugauucacaugcaauuaccuacccuccugcaauuguuguuuauauaaucgauccuuuuacauaugaaaauaaagacgagagcacuaacucuucuaauguauggacuuuggggcuccuucgaugcuucuuggaaaugguccaaacucuuccuccucauaucaagagcacuguuucugugcagguaaggauuucuucauguuucagaguuucacaguuguuuuucucuguucaaaauaauuuuguuaaaagacagguuauauugauuucacuuaaauauuauaauaggaguuuuaagagaguuuauaaaagauaaacuuuauaguucugggggcuaauuagauggcuuagcagugaagugcuugcugcucuuccagaggauccaggauuaguucuuuccacucauaucugguggcucauagcugucuguaauaucagcaacuuucuguggguacuguuauauacauggaauacccacauagagacagacacaugaaaucuuuaaaaaccuugauugucauucuacaaucaugagaaauacaauuauauuggcuguaggugguguguuucuaacuaauuccaugaagcugaggcaguaggaucagaaguugcaggcuagcaucaguacauaguuccagacuagccugggcuauguaauaagauguuuguuaaccuccuaacaccaccuccuccuccaacccccaagauuauauugaguagauugcuucuccuguguuacuuguaagcacaguuauaaaguauagccuaaauaggaaaauaaugccuguauucuauguguuaauuuuaauugagacagguucacaguaaaaguagaaaguuaaagaaauuuugauuucuuuaauuuguagacuauaauaggccccggagaacuauauuuaauuaguauaacugcuauguauagaaauuuuaaaagauuucuagguaguucuuuaguucaggacauacauauauauacacauauauauauauauauauauacacacacacacuguguuacagaggcaggcaggugagagggcucagugguuaagagcacucaccugcuuuucaggacucguauucaguugcuagcacucauaaggcaucugauagccauccauaacucugguccuaaaggaucccagugcucuugcuaggcuucacagggaauaauguauaaguguauguauguauaugcaggcagaacacucgugcauauaccauacaaauuaaaaacacugugugauagaaaccaguaucuuuccauuagauguugcucacguuuaucugaggaauuucucuuacuguugcaaguugcucuguuaauguuuguaaugcucaccuuucuuuguagauuguuccuugucaguaccuguuacaaccugugaaacacgacgacagacagaucuacucccagcauuuaaaaucuuuggcuuuuucgguguuuacccagugucggagaccacuuccaacaucaaccaauguaaaaacacugacuggguuugguccaggcuuagcuauggaaacugcucuuaaaaguccugauguaagugcuauguuucauaugaacgaagcuaucauggugacuuacauuuucaaauuuuauauauaacuaaauggcuggucacuggcaguaugcuccuuuaauaccagcacucugggaggcagagacaaacaaaucucugaguuugaggccaaucuggucuacagagcaaguucaggacagccaggguuacauagagaaacccugucuccaaaaaccaaaccaaaccaaaauuuuguuuuagucuaauuucuaguuauaauuggguaaauaguaaauauuuuccuaagauugcauaauucuauaguacuuucauguuuuauuuuacagagaccagaguguauucgacuuuauacaccaccuuuuauucuggcuccggugaaggacaaacaaacagagcuaggagagaccuuuggagaagcuggacagaaauacaauguucuuuuugugggcuacuguuuaucacaugaucaaagguggauucuugcaucuugcacagaucuauauggagaacuccuagaaacauguaucauuaacaucgauguuccaaauagguacuuauuuccuuaaacaugcuuaucccaauuuagaauguuauuagauguccacaaacauacuguuucauaguaaauaaguaaccauuugaaguuuauauauauuaugauauuaauuguugagguucuggguauacuuuuuaucuacauuuuauaguuacugcuuauaauguauaauugagauaauuaaaaaaaaauuggacaggcacaugucuuuuaaucucagcucuugaaagguggaaacaagugacucucugaguuggaggccagucaggacuacauaguaagauaaucucucaaaaacaaacgcuucuucuccuugcuaaucuguuacacagagaaaaaagauuaagguccuuaacuuuuauguuguaaugcuugugacaauaauuuuggauaaagaguuugaaacuuuagggccuggcaguuaagaguuauuuguucaucuuccuagagggcuggacuuguuucuugacauacacaucugguggcuuauaacuccuguuaacucuggcuuccauagguacuugcacucauguccacauuuaccccucuucccaguacauauaguuaagaaauaauaugaaucaaauacaguuuuuuaaacauuaacuuagaaagcucuucuacucauaaaaguggaucuuguaagaugaggguggaagagugcacuuuuaauuucaguauuuuggaggccuaggcaggcagaucacugaguuagccagggcuauuuaaaaaagaacaaaaacccaaaacauaaauacauauuuaacugcuuauagcauaaauucuacaauagugaucuaucuaccuaccuaccuaaccuaccuaucugucugggagaauacaggcauuauuuuccuauuuaggcucuacuuuauaacuguuuacaaaguaacacaggagaagcaaucuacuucauauaaccuuggcaggggagggucagcaaccaaccucccucccucccuuucucucuuuuuauugaaaggcugggucaguauaacugcccuggcuaucuuagaacucccuuuguagaccagacgggccuugaacucauagaguuuugucagucacuaccucugcucagauuaaagacaugcaccaccacuccuggagguguuuuuaaaaauauaauuuuuuuguuuguuuuuuguuuuuugagacaggguuuuuuuauguagccuuggauguccuggaaugugcuauguagaccaggcuagccuugaacucacagggauccaccugccucugccucucaagugcuggauuaaagguguacacugucaauaccuggcucaaaacuaauuuucuuuaaauacauuuuugagugagauaguugcauuagucaugagauaauuuggaaauaguaugcuucucugugaaggaagagaacagauaccaccacugucaggcuuagguuaccauuuuauuuccuuacucaaaagguagaaauggggguaggagagacagcauuuagaauuauuggcuauucuuguagaggauugcauuccauucccagcacccacauuguggcucacaaucuguuauaacuguaguuucaaggaaucuagucuuuucuucugcugucugggcaccagguacacccacgguacacauacauacauguaagcaaaacacguauaaaauaaaguaaauccuuccaacaaaguagaaacagaaacaaagauuaagaauuauauugguaagccaggcagugguggugugcgccuuuaauuccaucacuugggaggcagaggcagguggauuucugaguucgaggccagccuggucuacaaagugaguuccaggacagccagggcuauacagagaaacccugucucgaaaaaccaaaaccaaaaccaaaaccagaaaacaacaaagaauuauauugguaggcaagguuaaucaguggguaaagaugcuugccucuaagccuaacaacauaaauuaccccauuacccacaugaugaagagagccaacucccaaaaguuauccucugaucuuuguccccaugccauggaauguauaucccuacacaaaauaaauuaaaauguaauaauaauaguuauuauaagauauaauuaggccuguuuucaauuaccaccccuuccugguuucuaacaguuuauaugauauugugaaaaucaggcagcugagcaauagcuuauugaucugcagugucuguagaguaguugucucugcuucaucgguguguuacuaugaaaugaauguuguguguacaccaccuaggcuguuuauuugugggguuuuuuuuuuuuugguuuuucgagacaggguuucucagcauagcccuggcuguccuggaacucacuuuguagaccaggcuggccucgaacucacaaauccgccuuaggcuguauauuuguaacagaguacaugcuagcaaauguuagcuguuguuucucauuuggaaagugguuguguuacaagcuugccuaccuaaugaagcaaccuguaucagaaaacaugcaacaauguuauuaggugugagaaaugugguuuguguuggacauucucucccuucuaagguauggagauugcuuuagugcaaaucguuggccagaauuggacaacaagucauguuuucaguucuuccccauggcacugcucaggaagcagcuuucaguagugaugguugcugauaguuuguaaagcuugaaguguacucaacuuuauaaaacaaaagcuuuggguagaauagacaggauuuaugguaaauuuaggcuuuucguagguaaacuuugaaaaaaaauucuauuaggcuaaguguauaucaaacuauauuuuaaaaaguucuuuaugcauguuugugaaagucaaaggacaaccuucacuguuacuuuucagaagcuuuccuccucuuuaacggucucuaguguggacuuuggaagcacaggccgacuggguaguaaggccagggguugagcucugugucucugucugcaucuccagguugagauuaaagcuacacauuuguucucuuaggugcugggaagguaacucagguccuaaugcuugcaaggaaagcaugcuaacuaauuaacuguuucuucaggucacgaacaacaaaacaauccauaaacuucagcccgaauaugacaucauacaucuaugcuuccugcaacuaaagcuaaaacauuaggguggaugauuugaauuuaggaauucaaaaccggcuugcacaaaacauaaagagaugccauaucauaaacuuaggacuuugagugguaaaucuuugggauuuauuuuuguaaagguuugaggcauuaaaauuaagcaaaggacaaggaauuggaaguguaugccuaucauccacaagcucugccgcgucuguaaaacagaauaaaguaaaguggaugaaccaguuggucacacauuugauuucauaugugaauuucaucaugugaauuuuugaaauacuuacaaccauuucauucaauagggcccgucggaaaaaggguucugcuagaagauuuggucuacagaaacugugggaguggugcuugggacuuguucagaugagcucuuuaccauggagaguugugauuggucgccugggaaggauuggacauggagaguugaaagguggauuaugcuuuuaucuguuuuucuuuuuuaacuuuguuuuauguugauguauauuugguucagagcacauuaaauaacgugaauaaaaugcuaaaaggcucaguacuuccuagaggauguggguuugcugucuagugcucaccuagugccucacaacugucuauaacucaaacuucaccggauuugaugcccucuucuagccucuacaagcccuguacacgggugguguacagguauacaugcaggcaaaauacucguacauaugaaaauaaggcuucaaaugcuagaauugucaguaaaaguuuuuguuuuaaacaaggaaccauauauauauauauauauauauauauauauauauauauauauauauauauaauacaacagguauaacuaguaucuauuauguauuauacaaguauauguaacaauuuuauaaauauauaaucauauauaauuauauaauacauuuuauacauauacacagacauauacacugacuucauucugaaaguaagccaucaggcauaagaguuuuaacuuauuuaugaugaccucuauauuagaagaaauacacuaauuuaaaagcuguuaucuauuucucuuucaucgucagucucauaacagagcaguaacuuuaaguacuguccuucccuauugauauccacagauuggaguuguuugcugagucgucgaaacuugcaaucucuaagcaaaaggcucaaagacauguguaggauguguggcauaucugcugcagacucuccaaguauccuuagugcuuguuugguugcaauggaaccccaagguucuuuuguuaucaugccagguuaguuauguucaguguaugucagauuuaauuaucauuguacgcguuuaacuuaacuguuacauaaaauucugcacuuacaaaaaaggaaaaugcauuucucuuuagauucugugucaacugguucuguuuuuggaagaaguaccacucuaaauaugcagacgccucagcuaaauaccccacaagauacauccuguacucauauacuuguguucccuacuucugcuucugugcaaguagcuucagcuacuuacaccacugaaaauuuggauuuagcuuucaaucccaacaaugguaaguuaauugaaccuuaaauuuuuaaucuaauuugcuuugaaaucauggucuuucuauacagcccuguuuggccuaguacuugcccagguguggucuugagcuauaucccuagccauucuuuauauaucuguuugcuauaauacggcuuuauaucaucuacuagaauauaaauguaauuuagugaaccuuuuagguuguguuuaguagaagaggaaaaaaaauaguacucauuguuacuugaaacuguuuuuuuuuuaaaaaauuaggucuucacggauccacauauauuuuaauaauaauaauaauaauaauaauaauaauaauaaugauaauaaucauuuuguuuuucaaggcaggguuucuuugugugucccuggcuguccuggaacucacucuuuagaccaggcuggccucaaacucggagauccuccugucucugccucccacaugcugggauuaagguugugugucaccagcaccuggcauaugucaucauuuuguucuuuuauuauguaauaacuugaguguuuugcuuuuuuagagaacagugcccuuuaaaacauguuugcauuccuugcuaucuuugcuuuuuacugguugcuuuuauaacauuauuaacgcaguggcuuaagaaagcaggaguuuguuccauuguaaugcucucaaagucauucucgugaggcaggguuucuuacugaucccucucaguuagccucucaguuagccuguuuccuugccuuugccagcuccuagaggccacuguagguuuugaccuuuggccuuucucuccauuuugaaugacagcaguacuuccuuuguaggccacucuucucuuuccuucauauuaguacauauuaguacuucauauuaguacuucauauuaguacuucauauuagagcugggguuaacucagugguauaaugcuuaccuguuguuuguauggcccuugggucaaucugugggaccacauuuaagaaaaaagaaaaugacuucuaugauuauagggcccauuggaaagugcagcauaaucuccauauaggucucuuuagauugaccgcaaucgcaaaacucuuucuguggcuaguggcacaauacuugcgcaugauugaugcucaggaaauacuagucucauuaacucauuuugcuuuaagauauuuuuugguugauuuuguuuuugaggcagggucucacuauguagcacugacuagccuggagcucacaauaauccuucccccuuugccucugagugcugagauuaagagcaugugccaacaugcccugacuguuguaaagcccaggcugacuuaccuagagcuuacuuugcagguuggccuuacucauaacaauccugaucacccagccuucuaugucguaggacuaugggcaugagcaaucaucccuugccugucucauuuugguuaaaauuuauuuuaguacuuuaaugucaauaaucacaguauacagaaaauagaauauuaauuucuuuucccuguacagauggagcagacggaauggguaucuuugauuuauuagacacaggagaugaucuugauccugauaucauuaauauccuuccugcaucuccaacugcaucuccuguacauucuccaggcucucauuacccccauggaggugaugcuggcaagguaauuuuguuaaaaaaaaaaaacguuucaguguauggaaaugccaucugucaauccauucauccaucaauccauccagggauuaguauaugaaauuaaaaacuuucccuuugaaauuagcaagaggugaauaucaguugagcucauguacucuuauuuagucauuaaaacuuuuguugugcaaugaucuuccugcuucuaccucagaaguguugcggucucaggcauguguuguccguggccuuuuuccuguguguuuuuuguguuuuuuuuuguuuuguuuuuuuguuuuuuuuuugaguuggagucuuuguauacagcuugggguggcuccuaacuugagagccuccugugugcugggauuccaccaaugucugguucuucaaaauucuugcuuuuuuuuuaaacauuagaaguaccacuaauuuuaugaucaaaacacauuauaugaaauucucaaagaacugauaaaaacguugggggagaagcuguuucuccugucuuaucacaguagaaggguuuauggugcuugagguacugauguaaugaauauuuuuauuaugcauuuuauuuuucuuuuaucuguuuucuuaaaguaaaugcugagaaauuuguuggccaauucaaagggaaugaauaaaagucugugguauuauaaugucuuccaaaacacuguugaaauuaauggcauuuuauagauagugcuaugggaacagagaauggaaucugccuuuugaauuggggcaaggaauuaguugaauaaguauuaggacauaaguggcagcuauauugaaccauuuguauuuuguacucaguucaaccugaggcauacucauuuugucucacaguuuuuguaacacacugcuuuuaugauauuacuacauuuaguuauuaggcuuggaauuaaauuuaaaugucacauauguuagacagguaugcucccgugaaccuagauccucagcccucuuuuuuucuuuugagauggucuagcugagaguuguccagacuaaccuugaacguuguagccuacacgggccuuuaacuucuuuuuauccuccugcuuuagcucugaguaguagauauuauuggccugucaccagguuagauguaguacuaauugagacucuuaaguaaauaaccauuuaauuuuuaguauuuuaugugguuuauugagauaguaauaugaaauuauuaauuguuguaagcauuuguauuuauauuuguugucuagagauguauuaaaugaacuaauaauacucuugucuuuuuaagggucaggguacugaucggcuacuuucaacagaaucgcaugaugaaguaacuaauauucuucaacaaccauuggcccuuggauacuuuguaucaacugccaaagcggguccauuaccugacugguucuggucagcaugcccucaagcacaauaucaaugcccccuuuuucuuaagguauuaguauuucugugccaauuccuaacgaauccuaguagauaguuuuuaguucuaauaauuacuaaaguagcauuuuaaaguuuuauagcucauuugaauuccaaguucguuuaugcuuuguuguguauauuucuguaaauggugucauaaagagaauuacuuaauaugaaacacauaauuauaaaaaauuuauaugaagauugacuguuauucuuaaggcuccuggaacuuuugguuuuaaguuguauuuucauuguaguacagaagcugagagccuagaaacacugcccugucucuuuguguucuuaucuuccaucuaaauauauuguaacuuuggaaacucauucaucuaaagucauaacuuuguaguagacaucaagauuaaagccugagucuuuguuauuugaauggacucauacuaaacuccuauuuuauuauuuugaagauuaaaaaauuuagcaacuuuguaauucuugguuuuaguuuaauuuaccuacucuaaaaaguuuccuuuguauaaauuacuuuugaguaggaugagugugauagcucaugcuuuuaaucccagcauccaggaaccagaggcagcaagauuucuguaagcuugaggcuauucugguauacauagagaguuccaggccagccagggauacguagugagacuucugucauagaaaaaagcauauaaacaacuaguugaguagguugggcauggugacuugggaggcauaagcaagaaguuuacccaggaguugaaggccagcuugguuuacaaugaguucugagugagccagugggacagagcuagaccuucucaaaacauaagcugcugagcggguuuuaggaagugagaaucuuagaccuauagauacuuauuuuuuuaaccuucauuuuauagucuaaauuaucagauggugaaguaaaaugagucaugaaagcccugugugauuauuguuaaaguugcuacuaccaguacaaaauaauaaaugaagaccugacucucacuauguagaaaccacuguaagugggcucuucauguuucaggucagaugguaacacuuuaauuucuugagauuauauuuucuauuuuuuugauacccuggauauauaucccauucugugaaagcuacuugcgauuaaacaaugggcuucugucgcacacuuauaaagacuauuaacugucguuaauaaucugaguaauuuuccccuucucuuaaugugaauuaacuaugcuaggcaagugcucugagcucucccugcccuugaauugccuauuaauaaaaauuauaguuuauccugugacuuuuauucuucucugagauauucauuggucuguuguaaaucucauuuacaugaacaucuucucaaggggcuuucugcagaauaguaggauggaaucuccacuaagcagaguuccuugguccuuugggaagugcugcccacuuacagucacagaaccuguauguacacuaaaguucuuauaauagcaguaaauaacuuugcuuacccagcauuuuccaaauuuaguauaauaccuauuuguaguucaugaccuuaguguuucagggcacacuuuuguuaguaaacacuuuuaugaaaaguccaagggacuauccagauuguuuucuacucaauauuuauuuacagagaggauaguguaaagugagcauucacccucagauacaguguaacacgauuaggacuccugaaccccagguaaggcaugacuuaacguaacuuuguucaccuuuuauuuuuuucauguaucccauuuuaguucuguacuguagucaauaaaaccacaucauauauuucuuuuuuacuugagaaaucaguggguuuuagaugguuaaaaauaauuuuuauuauaagaauuaaaccagcauucauuuacuuuguagugguuggccaagugagacuuacuuaagauucauaaauccagaauuuauaaacaguucaaacauaaguauuguuggcuauauuuuuguauguacuuuauaugagcucauacauauaugcagucaugauggagaaugcauauggguauaaagaagcaccuuuaaagaguguagaaaacuugguugaaggauugucugcgaugagcacccccacuguagcaugacauuaauacuacuauacgacuuacauacuagaugauuaauuuuacuuaauugaaaugugaaaaauaguaccacauuucuucugcucauugcuaucuguaaaugugcgugcugucguuuauaugccucugauaauuaauguauugcacaaggagucaugugugcauuguauugauuguuaaguguucauccagaggcaauuuuguuaaauuuccagcuuugcaaaaauaaauaaauaaauaaaauaaaugugcaggauuacuccuuugacauuuuauuuuauuuuauucauuuauuuuuauagcacuuaggucccaagugugacuguguggucucaauuuuguucaacccagggacaggguacacuucaggccuauggguucaguguuuccuuaaucauuugcuuuauagacuugggcagauuauauuuagaagauaauuguaaagcuuguuuuuaaggauugcuauacgauuuuuaaaaguaaggcuaaaguaaaaauuguagagagacacgauguaaguuuuacaccuuaaaguuuccaucaaaaccaugaauuuuuuauaguugcucccacagauaacacugucauaagaucaguuucaucaggauaauacauuaggagaacacagugaaaugaaauguugcuuucccucuguggcugacugcgucccucccuuccuuuguaggccucuuugcaccuccacgugccuucagugcaaucugacgagcugcuucacagcaaacacucccacccacuggacucaaaucagacuucagauguccucagguauagcucccaugaugcuaaggguucucuguuucaacuuggguaaaagagaaugguuauuaugagauauauuuauucuuuuggguaagaguucacagcguuuuauuuuugaaucauugggugauuccccaccccaccccccacccccguucaugauauagacaaagcauagugccugugcuggcuugguaaauugcucuaccucugagcuaaacuccauuuaaaaccccauuuaguuauuauuucuuaaaaacaauuuuauucuuuuuauguccauauauauaugggucuuuugucugcauacauguccauugcaccauauauacaugcagugccacuggaagccagaaggcaucagauacccuggaacuggaguucuaggcuguuagcaggcauguagguacugggaauugaauucuggaucucuggaaaaguaguacuuuaagcaugagucaucucuccagccccaaccucguuaaauuauugagaaugaauaccuuucuaaaaugaauacguuuuugaguuuuuuucuccccaccucauucauucaaaaagcggucuuauguaucuuaggcuagcuuuaaacuuccuauguggugagaucuauuccuuauauguuacucuuucauugcguauuuuuugagacagggucucacuguauuccuuugggcugccuggagacaggcuuuccuugugcuuaacagagcuugauccacuucugucacugcgcacacgugcuuuuuuauuuuuucuuuugagaggguucugauuauccuggacucagaauaggccuuggacagagauccaccagccucgucucuucggugccaggaugaaaggcuugugcugccaugucuggcucugcugcucuucuuaagaaaaugacuguguuugguggucagagcuauguuugggaagguuagacaggagaaucauuacaaguugaaacuagcccaucuuaaaacaaauaaaacaaaaagcaaacaaauagaacaaaacaacaaauaaagugacuuuggcuaggcaugaugccauucaggaggccaaagcagaaggcuuucugugaguuugaggcuaacaugugcuacaguaugaaauucuuagcaaagaggguuucugugguugugguauugaugucaucucauuguuuaggcagcaaagggugucucucucucucucucucucucucucucucucucucucucucucucucucuuucucucucuuucucucucucucucucacacacacacacacacacacacacacaccucuuugagucuugaaaguacuauccaaguguauauugaaugagauggauugacacaguuuauucgcuuucagguuuguuuuggaacaguacaaugcacucucauggcuaaccugugacccugcaguccaggacagacgcucaugucucccaguucauuuuguggugcugaaucaguuauauaacuucaucaugaauaugcugugauccucguuugauggaauuacgcaaggaaagaacgggaagaaaggauauuuugcugcaagauuaaguuacaguucucaguggaagucauuugugauggggucuaauucuuauuacuucaacaaauauuguuuugacuuggggggcggggcuauaacccuauuuuucauugacuuuacugagcucuuuaggaugaugacugauuauucaaaacguauuauaacacuuucguagcaaaaauuaaccuuuuuuuuccagucacaguauuugugaaaaguaaugagccauaguacccauuaauguuaaagaauauuaaagcauggagaggaacaugaggaacaaugaauuccaacauauggcuuuagaacaucaggauguucuuguauuggauauaguaucuaguauucaaaaaugccugcaucucuuauuuauuguaaguuuuuaaauguauaaauugucuuauauuucuuaaccucuuuuauaaaaauuuuccuagaagguuuauacugccuucuugcuuuaaagcaauuggucuaaaauauauguaaucgucuuaauuaaaacguugcaguaggguugcuuuuagaguauuauuuuuuuguaagggggugggguggacaguaaauuuguauugucucaauguacaguuuaacagggauagaggggaaauaauguccaugccauuguguguggaagauuuacagcuaagcuguaguugcagaguacauguacaguaaugaaguucacuguguuuauaaacugaaaagguaccgggucuuacagcauuuuauauaucacaccuuuacagaauaacaugauggcaauauacauacgugauauuguuagguggaauaacuuagaauaaaaugagaauucuugaguuauauuuuguacuaugguuuagggcuaugacuaauauuucaggccauuuccagugaaagaaacuuaguuuuacaagaaaacauuugcuacugaaugcuuacacuaaucuugguguuuaauguuacaugcuuaaauucuuuucaguuuucacaguggcacauuuaggcauggggauaguacuaauuaugaaauuuccugcaggaucuguucuaagguugaaauuuagcccagcucuaggcauuuuacaaauuauuuuaagaacagucacucuugauuguuuuacuuuuuauuuuuaaauuaaagauugggaaugcgugugagaguaugcauaagcauggcaggaagagaggggggagagagaaagagagagagagugagaaagaaagagagagugagaguguguguguauaugugugugugugugcaaucaaacugugguguaaauagauccucagugaauucugguauucagacucuguuccacuagugaaugaaccauuuucuaaacguuucccuuugacuuuuuuauuuauugaauuuucuugguuuggagauggcagucccaaacaccagagucuguacuuuucuaugacacagcucaaauuaaaguagggcacaugccaaggagguucucaccucccuaaagaagggacuugaauuuuagggacuuuaauucacccuuuccuucaauccagcuuucccccuucuuguuugcacaugccaagauaacugcuuuuaugcaggcuuuaccccugaaaaacuccuuucuacagugcugcucacgagagcccagccagucucaugccugcauugcugacuugaacucacagucgccaagucuaccuaucuuucuuggaagcagucuuucaaaauuccuacuuguauauucauccauuguugacaaggacaaaaucaguuguauuuacaaaacucuuaacucgguauuuuuuuuuuaaacugaauccuguuuuguaaauaauauacauuuaauguugcuuagcauaaaaaauacuuucuuacaguaaucuucuuuaaauuggguauaugaaaacauuaccaacucuuguuuuucuauaaagaaauacaguuaauaacaagguuucaaauuauuccuuuaacauuaauagaacaauccaaauguugagcauauuuugauauuaaacuaaagaucacgucucuguuuuuaaauuaugcuaacaccaccacagauuauguugacguauuuucuucuguauuuucuuggugggacuugagauuugaggaaaaaagaugcuuauuuggaauuucuauuaagaacuauccuuguuauuuucuuagcucaauaauuacucaagaaaaauaaaagauuauaaucucaguuuaaaauuacuaaugugugacaaccauaccucaguuugaaauagauuuaacaagauuauucccugacauuuucuuccauguagccauaagcagggacccagcauacaauucuucuuaccuaggaaucaggaacuagucccaaauauacaggauugagucaugguuugcuuuuuuuuuuuuuccuuuccuuuuuuucuccccuuuacacaucagauuuugcucaaauaggagguaacuaaauagccauuagaagaagaagugaagccuuucaugcaggaugauagaucuaacuuaucaauguacugucacaguacauuaaucguuuuauuugaguagguaaacaaauuugcacacuuuuccccagugaauucccaacaccuugacuuccucauuucagugcuaauaaccuguuuugugugcaguuaauccauucugaagcaggugaaaggucaguauuuuagcauuuuaaaagaugaguuauauaaugucugcuuccagccagucugcaacaucuagccauaccuuucuuaugcaagccauucaguuaucaggacugugaauuaacacuguaugaauacauuucuguacaccuuauuguuuggccagagggccaccaaguguacuuauauguaauccuuaaauuuuaaacuagcuugugauuuuuaaauauuucuaaacuuuucuuaaaccacuaaaauuaagcucuuacuacuuagucaacuauccucagcuguauucgucuucaauugucaguauggcacagaucacuguauuaaaaugcucuuucgucuucauauuuaccuucugaggucauuuuuuaacuuaauguguuacuacaaagauuugcagaucuuuaaucaagcacuauguuaauacuguaauaucaaaauacuaugucgaauuauuucagauguucagauugaauaggguaaaagaaagucuuuaaaugcuaucgcauccuagacccucuucccaccuacuauggcauugcauauuagucuguugagacauucauuguugcuugacugacauuuuggucuggguuuucuuuuaauauuuuauuuuaauuaaaauuaggaaaaaauguguucaacaauuuuuuuuuugucccaucuucuccaaaucagugggaaaagcuuaccuuuugguauaucuuaguguuuucaugggcccagaacugugguuuaaauuuuuauauguauucucauucucauauucacucauacucacucuuuuucucucucucccucucucucccucucucccccccccuucucuuuuguggaguauaaauuaaaaaaacuggauuugggaccuacaauacuccucagguugagauauucuugaaguuuuaaaauagcuuuaguuuuuaaaguaaacuggauuuguggaccuuaaaguuacugaguuuaaacuacaaauuguaacaucauuacugaacauguccgcaucaacccucugagaauaacuuggucacuuuaugaaggggcguuuuuaaguuguuuagcagugacauuuaauaugguccaauugcuuuucuuuuuaacaugacaaacaauuuuaaaagagacuaaggaacaaacacuauugcgccgaaugccauaacacugaguuguacaaauugugauugaggagaugaaaaaguuuauacuuuuuaaaaaaaaaaaaaacaaaaaacaaaacuucaaauggaauaaauuauucaugaagccuuccuuguggugucucauucuguggaaaguacaagcuccuuacagcuuccccaugguuagcagcagggcucuuucugugucauuugcuuggggacggugguuuugaggcagggucuugcuauggagaccagguuggucuugaacucagugauuuccuugcuugugccuuccaaguucugggauuaaaggacugcaugcaccacuaaucucagcucugaauaauuuuuaaaagagaaugcugguucuccacacccaguauuggugauguguguguguuuacacacccaagcuccuuuuugucuuacaauuugguguuaauuauucagucaaaauaguuauguugaaauaauaauaguguuuuucuuugugucuuggguguguauguaugaucaccuaaucauguuugaaucauaaggaaaaaguuaaauauuaaaauaugaaucaugcauuaaaauagccgugcauuagucccguaggcagugguauaaaauguuuuguucagacuuaagcaaaaguuaugaucauuuaaaaacuuucucccaagaguuucaaaagcuuucauaaaugaugguguauggcauugaaauuuguaucucaaauuauuucuuauaauuuuccucugauucauuucuaccuuguuauuacuguucucuaugagccaugcaaauuaagcauuuuuacaaguaagaauauucauuguuuggacaacugcauacaucuuuucaauugugguuuacaguacucagagccaaucuuugggcacuguaacuuagaccucauugguagagcacuuuccuaacuacaaaacucuggccucagucuccagcaaugcaaacaaugucucaaguaacuguugggcgguuugcaaaggaaaugcuuuuuuucuuucaguaacuaugcauaagguguuuauacuuauuccuagugauaccaguuguuuggagagaucucucuuacucaccccuaggcaaacacaguuucucuauuggagcuaugugagccaugauuuugucauaagccaagacugaagucuaagaauggucguugguuccuuuuaugaguauuuucuuuugaaaacuuuccugucagagcuuuccauaugaauuucuuuaaaguaacgaauacagggaguuaaaagcaugugagaaauggcaaacauuuucaaggagcaggaaacucaauccuggacacugucuugaucuuuuggugucaguagcacacuguugauagccacacaugaauuuguuggauuugagaggugaacugaaagaauacuauuuuucucuucagacuguuaauaaauuaagaaaugguuggaguuauacuauguagucauugaaaauaauuugagaaauuuacaugaagaaaauccaauuuagaugaaacgaaacaguuugaauuggacucaaucuauuacguauaaauaacuuacaaaaguguugagaauuauggucauuuauuaguggaaaucacuuuauuaaucauguugaacgcaaaugccuaggcuuugcuuaacagaguauuacgggauuuguggccugucaacagcaaguugcagugcgucuucuggcucccuaucucccuacacacccauaggaagaacaagagcauguaacucagaucccagaugucuccuggucugcuuaugggggugugugauuguuuguuuguuuguuuguuuuguuuuguuuuuuuugagacaggguuuuucuguguagcagagccuugucuguccuggacuuguuuguagaccaggcuggccuccaaugcacagagguccaccugcuucccaaaugcugggauaaggcaugcaccacuaugccuggcgaacacucaaucuuagagaaaaaaaagaaacgaggcaggguuucucugugcagcccuggccuuccuggaaguuuaccuguaaagcaggcuggccucgaacuagacagcuuccugccucugaugugcugggauuaaaggcauacaccacuacugccagcuuuuuguuuguuuuuaacaauauaaagaagaaaauguuguuuuuggcucauggggaaaggauuuuuuaaagugucuaaaauguguauauuccugagcugcucacuauucuauuguuauucucauuuuuagucuauacuguaggagggugccgauccugguccagagacucaagaccucuuggguaugagugcaaacagaaauucugcaugaggaaaaaaagaagcggauuguuauguguguguggauguguucagguuaauacaguguguaugugugugugcguguguguaggcuagagaacuauguugaugguuguuucuaaggugcuguuuguacacaguuuuguuugaggcaugcucucuccugggaccuggugcuuacagcaauccucugauuuuuccgccuuucuucuuccucagugcugguaaauuguucaucaccaccccuggcucuuuaacgugaguccugggcuccaaucagguccucaugcuuguauggcaagcacuuugcugauugagccaucucuucagccaaaaacgagauuuuaaaaaaaaguacuccccuccuccccacccuccaauacuggcccagagaaacuuuauuaaagaauggccuuuugugagcagggcgugguggcgcacgccuuuaaucccagcacuggggaggcagaggcaggcggauuucugaguucaaggccaaccuggucuacaaagugaguuccaggacauccagggggcuacacagagaaacccugucuagacccccucccccccccacacacacaaagaaugaccuuuuguauagauaaaagccaaagacgaccuuauuuuguccugcccuacuacuauacagggguggaaaaaaggaaguuuacagcucucaaaacuuguaguguuucuagacuugaguucagaaugccuaacuauagaccuuggcucuuggauucuuuuguucugagaaagucuuuauagcaugaauuauccacaaaguccaucugguucuuauaguguucuuuguuucugccaucuguaagguucuauagaacauaagaaucucaucuuugaagccuuuugcuaguuguuuacaaggacauggagaugccagucuacaaucccagagaaggcaagaggaugacaguuucaguccagucugggcuauguagcaagacugucucaaaaaagacacaaaggaaaacaaguuaacaucuggggauuguuaguacuuaggaaacuaaguagggcauuggguuugaggccaggcuggaauaaauggcaagaccuuucuggaaaacaaaaucccaaauaauuguaauuauuuggcuguaaauuauuggucaguguauugauugucaaauguacucuuuugaccuaagcauaucaaguauuagguaaaacuacuuuauuuggguuggucguuaagaaacaauuauuuugagacauagucucaaucucuuguuacagaccaugcugaccuugaauucuccauaaauuuuccucagucucauaagugguaggauuauaagccugcacuaccaauaccuagcuugcaauaaacucuuuaccuggucuuucuccuccuggaguguuagucaccaaaucccuuuauaucuugauaucaggaagaaaaccaguaucaagccuuguuuccuucuguaacuucacaaaggguccucgguuuccuccuagccuguuuagcaucuaaguucauuuccacauauaccucagaugaaguucccuugucauacugccauuuauaacacccucugugcaucugcuacacugcuucccagcuuguacucugcaacuauuugucuccaccaaaaagcuccagaaagacacaaaacgggguuuauuuggguaaccauuguuacaggcagaauguagcacaugucaucuuuuacuaagauguugaacuauucuugaauacuuucaaccucuuauuauaacccaagacuuagcugaaauguggguuuuaccuauaaauaaaauucuaauauuguaguuacuuugaguuuucauuugcagagugcaaagcuuacaagaaagagauguuaaaggugucugaaagcacuuuuaaauaguuccuagcaaaacuagagacaaaauguagugccucucuagcuuucccuccuucauuccucuacccauucuggcaaaaagaucagccugaaguauuaucagauuuaagacaaagcaacauagagugaaaucagaggacacauuuagccuauguuuuccuugacucauguucugggugguggacagaaagaguccgggaaaucuuuggaaaaugcaaagaaacaaaagagucgaaacuggugcuuuccuacuuuuuaagauuuuaggcaaaacacucaucaaaucaaaucaaucuaaacaguuuuaauauguuacgaagucgguuccagaaauuagcagcaaaugagcuguuugggagcacugauaaacugacagguuauaggagcaaacaugcaugaagaaggguggggauuuuauuguuuuugaaacauucuugcuagagcuccagcuaucucugcccuccagguuucugagggaugagacgacaggcauauguguuaaccguuuuccauugugagaggugucuucuaagauccuuguauuucuucauuuuuuaaaaaaauauuuauuguauuuuauguagcugucuucagacacaccagaagagggcaucagaucccauuacugaugguugugagccaccaugugguugcugggaauugaacucaggacugcaagagcagucagugcucuuaaccucugagcuauuucucuagcccuaaagguucaaagaggucccaccgagauuugaacuuggauugcuggauucaaaguccagagugcuaaccauuacaccauggguccugcugcuacugcugcuucuuuuuuaaauuggauauuuuauuuauuuacauuucaaauguuauccccuuucccaguuuccccucugcaaccccccccccaucccuuuucccauuacucugcuucuaugugggugcuccccucuccacuuaccuacuccaggcucacugcccuagcauuccuuuacacuggggcaucacaccuucacaggaccaagagccuccccucccauugauaacagauaaggccacuucaccuccuucaguccuuccccuaacuccuccauugggcucccugcucacucugaugaauuggcugcuagauccuuguauuucugaaacauuguuacuguuucccaagaguacugaguaguucaaucuuuaauuucuugaaccaucacuuguagcacgugcuuucuucuuguuuauuccucugaggauagggagaggaaguaaaucagagucagccagccagucaaaaggaugcucacuuaauuugguaaagucuucucuugauuuaaacaaaauguaugaacaauguuucaccuaaucuaagccuucaauaauuaugacaccuuugugucccacuaaggggaaauuuuaccaaguaaaacaacacuacugauaagccugauucagagaugucaaaauuuaaaaagaaaugccaucacagaauuuauaaaguaucgucauaguugggcauaaaaugggcuucguacuacaguagucauuaaaagagauuguuucuucaguuuuguaugauaaucaaauuugagauaaucaaaguuguaacauaaacaaauagacuuauuccuacuuuaaagaacuauuuacuauuugugaagauaauauaauuaaacuuuugaacuacaagguauuugugaaagcugauuuuaccuucuuuaaggagucaaacugugaggacacaauuaaaacuccaaacaauuuuuuuuuucuuuuuuuuggauuuucaagauaggguuucucuguguaacccuggcaguccuggaacucuguagaccaggcuggcuugaacucagaaaucugccugccucugccucccaaguacugggaugaaaggccugugucaucacugcaggccuaaaacuccaaacuugauggcuguuuuuuuuuuuuguuuuguuuuguuuuuuucaguaggguggccaaauucuguacgauuacccaaauaguuuggcaagcauuguuuucaugauuugaaagacuucuaaguugauaagagugcgaccuccauacuuuugccuuaagaauucaagcugugcucacagugacugaaaggaaaaacgaagcaagggggacaaugagaaagggacauuuccgcacucacuucugagucauucaggcugggcucauuuacuguucuguuucuugaggugggcugugcgugcauggcccugaucugaaauaucaccuuguucuuaggugagcucuucuuauuaguccaucaaaccaaugccuugaguccucuuucucuuuuccugugaaaaggcuacucaggaaguuuaaauuguuuaaucucuuaguuuugauccuuccagcucuccccuuuuugugagacagucauuuugaaguucagccugugugugcugaaauuacaaauaaguucucuucucucucugucuuccugucucuuuugagacuggauccaugacccacagagauccugccugucacagagauccugccugugccccggaaguguugggauuaaaggcacaugccaccaaacccaaccaauaauuguaugcuuuguaauugugaaaucuauuucaauuacauuuuaaaaaaauaugcagaauuggacuugauggugcacaucuguaauuucaagaacuggaaagcugaagugguaggauccugagugcuaaggcuucacauauaacaagaccuauaacuccucacuauaucuccuuccaauaauaggaaauauaucaaguauuauguguauaagacauuuguuaccaucuacauuugaccacauuggguaucuauggcauaugauuauauaugauacauaauaguuacagaugauugcauauauuuugguucacaguacuaaagguauuacucugaaucaaaugggauaauuugagaaacacuguaucacaucucaguuuuucuguuuccuuugcugauucucuacccugaaagcugaguuuauuuucugagauuuucccucucugagagccuuagaaauauuuuaaaaauuuuuuguaagcuaagugguaguaguacagggcuuuuaucacagcacucugucauggacacacagaaaaaaacugucuugaagaaaaaaauuuaaaagaaaugaucagucaagcugggugguggaggcacacaccuuuagucccgcacuugggaggcagagagacguggagcucuuugaguucaaggguagucuggucuucugaguuuuaggauagccagggcuacacacacacacacacacacacacacacacacaaauccugucuugguugguaauucguugaaggaugcucaauuuuuuuuuuuuguuuuuaaauauucauuuauuuccuuuuucugaguuuagguguuuugccugcauauucuguguacaauaugucuucagugcccauagaggccagaagagaguuuuggaaauguaauuacagacuguuagcugccuugugaacucugguccucuggaagaucagcuagugcucuuaaccauuaagccaucucucuggcuccagaaauacuuuuuuuuuucuuuucuuucuagacaggguuucucuguguaacucuggcuuuccuggaacucacucuguagaacagguuggccuugaacucaggaaaucugccuaccucugccucccaagugcuggguugaaaggcgccacauuugcucagaaauauuuaauaagcaagccaagccaagccaagccaagccaagcaagcaaggaaacaagcaaacaaggaaaaacuauuguguguguguccugcagaggccagaagagggugucaaaccccuuggaguuuuggagccacaaguauagguacugggaacugaacucagguccucugaagagcagaauuuuuuuuuuuaaagauuucuuuauuauuauaucuaaguacauuguagcugucuucagacaccuagaagagggcaucagaucucauuauggaugguugugagccaccaugugguugcugggauuuaaacucaggaccuucggaagagcagucagugcucuuaaccgcugagccaucucuccagcccaaaagcugcauuuuaauaaaauaguucagaggcuugacagauggcacagcaugccagguguuggucgcugagccagaugacaugaauucaagucccaggacauacaugguggaaggagaaaaugagcuuccaugaguuauucuuuuuucucacaaguaaacacaugcacaaaugucacacacacacacacacacacacacacacacacacacacacacacacacaaacgcgcgcgcgcgcgcgcaaggucaugcaaaccuugggugaaccaggaacaacaaccacaacaaaaaacguaagcuggugaagauggcacaauccuauaauuccacaauuugaaaggcugaagcagaaguucagagcagccuggacuacauaguguggcgcugucuccagaacauuuauuaugagauaaauagacuugcaauuuuuaagauggugagacuuuaguuuugauuuucuuucacaagugccacauauaauauugagaagguuccacugaauucguuccuaaaauucacucuugaauaggauuuuuguaaccucgagacccgagaaagcuaccaaacauagagccucuaguaugagcccugggcagacagagggguugugucaaguaccagucauccuugucuacauaaugaacuccaggccaacaaggaccacauauaccuugucugaaaaacaaaaccaaccucgaaugcaagccggaagugguagcaugcgcuuauaauuuggguacacaccauaaaacuaaauaaugaaaaguuauuacacuuuggccuuaguguauagacuuaugauuaauuacuuuuuuuuuuuuuuuucgacacaugguuucucuguguagcccuggcuguccuggaacucacucuguagaccaagcuggccucgaacucagagauccgccugccucugccucccaagugcugggauuaaaggcgugcgccaccacugcccggcuucauuacuuuuaaaauuccccuacacacaggucuugggauucuagaacuuucuagaccgcaccggcagggguuuaaaggaggcugcaaucggguuccauuaggcaaauuucuguggaggaacagagcggacaacuuuugccauuuaauacauuauuguuauuuaaaugucgcgauaauugguucgggggucgggauuucgcucugaccguuuaggaacucaucugacaagguuccaagagaaaagcucuggaaaacaagaaaguguaacacuccacgcuuucggaagcggggagggcggugacggaggaaggggcgggccugcgcaugcgcagagcggcccuaagcuggcuuuucuuaucgccgccgacgucuucucagugcuguacgguggccggcgcgugccagaagcuugggaugaauggaggugcagggugcagguugaacuaagucucugcuuuccccucucuccugguugcuucucccuuuuuuuucccuuuccuuuuuacuuuuuuuuuuuuuuuugcaguguccccauucugauucucgcucugucgacggcacuguuggugccagcgucagaguucuuggugccugagucgacuccgggcauugccgggguuuggggaucuggauaaucaccuaggcccaacuucggaccgcgcucuccauuucugccucgucuggcucucggaggcggaauccgagugggucccuugaggcuggaggguugaucuuaagguaugaagcgucggcuucucgggcccaagugccgcuuugucugaaguccgccugacucuucgcagcccgggucacucgauucucauugcugccuggcagagaccccugaguccugucaccucugccuugagcuuacucuacuguuaaaagaccagcgcuuacuauugaaacagcagcauuucugccuacgauucuuuguccacagcucugcuagggaguaggucuuaagacugaguggucucuguuaacuguuccaugucaccucucuuuucugcuaccuuuugaaaauuuacucaaaaccacagugcccaagugagacucucuuuaacuccuucagcugacuguacauacacaucuaccucuauaacaauagggguacggaauagcguuguggcuuucagaaccaugccucugacauuacuuuuggcccgugagaugauuuaccaguguuuccauguaguugggagguagaaagagaagcccaacugauauuuauauuuaucugguaggcuuguaaaaugaaagagaucuggcugcagccguucauuuucucuccauauuucauggaacucauguaaugggcauaaugagggaagucuuggcuguguucaggguaggaggguucacugggacacaaaguauuagagcaaaugaucucuaaauugagaagaaacauuaaucugcaguuuuccuucuuaucuuccagaugucaguagaaacauagagacagaaaccugagcuuuaauugugccaacaacauugccaaugcaaggaccuacuaaguauuuaguauacuuuguuagauuuuaaagaagguugucauauaugugggaaguagauaccgauuuucauuuuguuguuuuggacuccuuaggaucgagagcgaugacgcccgaggguacaggccugcaguuugucagcccuuuugcuuuugaagcuaugcagaagguggauguuguccgccuggcguccuuaagugauccggaauuaagacuccucuugcccugccuggugaggauggcacuuugugcuccugcugaccagagccaaaguugggcacaggauaagaaacuuauacuucgccuccugucuggaguggaagcugucaacuccauuguugcacuguugucuguggacuuccacgcucuagaacaagaugccagcaaagaacagcagcuuagguaaaguucacuuguguguuaggacuugggaguuacuugauauuccagaggaggggguuguaaugaugcucaggucugucagagcucccccagcaaagggagaguaaugucugagaagcauuugacagaggucuuuucuaguuaaauuccuaagagcugcuuucuguguuauaaaauguugcucagagaagauuagcuacauauuaggucaguuacucugaguggggacugaggaggagaaagucuucuagaguggaagguuuuaugggaaugacugagcuuuuaaaauuacguugcuccccacucccccccccccagacuccaggcugguuuuguauccuuucaugucccuuguguaucugaaagcuauuguuacugaagucuguggcaauuacuaauuuacaguuucugagcucuugcaauauauagacaaacaguguuucggaggaauggaaaccauuuacaaugaguggauuauugcaggaaaggauugccuugccagugucuuaauguguuucccauguuuggacuucacuaggcauaaacuuggaggaggcaguggagagagcauccugguaucacagcuucagcaugggcugacacuagaguuugaacacagugauuccccucgucgauugcggcuugugcugagugaauuguuggcaauuaugaacaaggugcuuuaaaaaaaaccucccuuuucuuuuuucuuuuuuuuuuuuuugcauuuuuuuuucgagacaggguuucucuguguagcccuggcuguucuggaacucacucuguagaccaggcuggccucgaacucagaaauccgccugccucugccuccagagugcugggauuaaaggcauguaccaccacgcccaaaaacucccuuuucaucucacaauauccaugacuuaauauuuacaucuagaaaauaguaaaaagggcuggugagauggcucaguggguaagagcacccgacugcucuuccgaagguccagaguucaaaucccagcaaccacaugguggcucacaaccauccuuaaugcaaucugaugcccucuucuggaguaucugaggacagcuacaguguacuuacauauaaauaaauaaauaaauaaauaaaaaaaaaaaagaaaauaguaaaaaaauaucagcaagaaggcaggcagguuacauguucugcuaguauuucuguuugauuuguguucuuucaaagacugaagugauuuauuuuuuauuuuuagagauagaguuucucuguauaguucugacuuuccuauagcccagguuggccagauccaccugccucugcuauccaguacugggauuaaaggugugugccacuacacccaacuauucaguauuuuuuuuuuuuccagacaggguuucucuguguagcccuggcuguccuggaacucacucuguagaccaggcuggccucugccucccaagugcugggaugaaaggcgugugccaccacugccuggcaggauuuucuuuuuguguguguacggaauugauauaauuguuuuuaagaucaucaaaauaauuuuuacauuuuuauuuauuuuaugugcaugaauguuuugcuuguauauauaucuguguacucucugagugcccggagucugcagagcucagaagagagcacaggauaacuuggacuggagucuuugauugggagccaugauguuggugccaggacccaaaccuagauccucugcaagagggaggagugcucuuagccacugagccauguuuucucuccagcccccuaaacaucugucauuucacuuguagaaaugacuaaguuggauagcaccuuuuuguugggcuugacuuugaaucucuagaacaucuguacaugguguacaucuguaaucuagugggccaugguaaggugggagaccagagaauccuuggaagcuccaggccagguaccuuggugugcacaccaaacaacagaaagagggacccauuggguuagagagaugguuuaucaguuaacaguacuaauugucuuacagaggacuccggcauggcuuccagcccccaccugguggcuuacaaucauccaugacacaggcgaugcacagacaaaucaggguuuacaggaaacacaccagugugaaugaaggacacaaauacauguacacaauaacacacacacacacacacacacacacacacacacacacacacacaaagguaacuuaagucauggaccuuuggcuaaugguuaauugaaacuuucccacacuuaaauuuucccacaucucuuguaaauacauccuggaugugauaagagacauuuucuucuguggugauuuuaaugucuaacauggccuuacuaugugagaaauucuguuacauauuaccauaggaaauuuaaggaacauagagguuauugucuugauguuuuuuuuugucuuuaaguuucugcucccucccccuuugagaccuaucuuccuauuuucuucagaugacuucagacuucuaaucuuuucuuaucucaguuuucugugugcuaagauugcugggguguaccacuguuccaggcucaacguugucauuccuuguggguuuuuuguuuguuugcuuuuuuguuguuuuucccuuugugucuauugaucacuagagguaaaugaauucuuuuuuugucauacugcuuuaacaguuaaaagaguccuuuuauuuugguuuuugaauguagguaugaugguuguguuggcacauauguagaggucagagguuaccuucaugaguucuuucugugcuuccuuccacugugggaucugggagucacacucaguuuuucaggcuuguguggcaacguguuuuuaccugcugaggcaccuugcagaccaauauucgguuuuuuaaucaacaguuuauacauacaacauuucuuuuuuuuuuuguuuuuguuuuuguuuuuucgagacaggguuucucuguguagcucuggcuguccuggaacucacuuuguagaccaggcuggccuugaacuuagaaauccuccugccucugccucccgagugcugggauuaaaggcgugagccaccacgcucguaucauacaacauuucuauacuguuucuuagcuugccuuauccuuuaauuuuaaguaucucuaaaaauguagguuggaaucaauuccucuuaccaccucugucucugucccucucuucuuuuuuuuggaggggggacagaaucuuacuaggugccaggguggccuuuuaacuugagacuuuucuaccucagccucucaaaugcugagauuauacaguagccagcauggaguucugagacuacugcuacuguguguggauaauaaucaugguuaaccuguucagauucugauaggaucccacagacuuugccuccguguguuagccauauuauagguagugaguugaggcugguaugggacagcacaccuuccaucccagcaggagagaagcaaggacaagaugguguguuuuaugccaucguaggucaauagauugaaggcuagcuuggucuguguacugaguucagaccagccauagcuacauagugagacccccaucucaauggcagcauaaacccaugauuucugagcucaaaaagaaaacaauuacaguuuacuuaaacuuguucuuucuuccuuguuuccuucuucucccuaaggugucagagugcaauggagaguucuuuuucaagucuucugagcucuuugagagugcaguguacuuggaggaagcugcagauguccuuuguaucuuacaagcagguacuuuacggacugacugccaagauguagcucaguacagauacagugucucgggaagggucacugugugaccccucagccugcagagcugucugugucugggugugcacuggauguccugagacuggagguacaggcagcuauaagcugccugauggggaugcuggggcucaacaagagcaguauuaucucuccagcucaaauuugguauuuuaaagacuaucaaaacgggcuguggucccaaauuugggacauuaagacaggaguauugcgucaaaauccagaccaucuuggucuacagagcgagaugauaucuuaaauaacugugcuucucaccccaaaaaaacccuuaaaaaucuaaaaguuauuuacuagaaacaugucuuaaaauauuaaauuaaaggcuggagggaugggaagcuugggccucacagccucacagugccccccacgcgccccccacgugcccccccacgcgccccccacgcgcccccccacgcgccccccacgcgccucacgucuuuucagacaguucagauucugaaugacuagcguuagaucagagacgcagugacgucuacuuuuuguacaguuugccuuguuauagagauguuagcaguguacauuuaauuuaaugauuuauaacuuuaaugagcucauaaauguucauaauauguuagaucaaaaagcaaagggcagaggggaaaaauaaaaacuccguuuuaguuaauauuaaaacuacuaaugaggggauuaaacuagauauuaaauauacuuacuauuacaacaauauuaaauacauauauguauuauuagaacuaacauacauuuuucuuauguaccuuuuuugcuuuugcagauucuuuuuaauagguauauaugguaaaauaaaaacaagaaaauauagaaauguaaagauuuuaauuaaaaagcuuuuuagaccagcacuacucagggaaacaucugcuguauuccggguugugcuguccaguuggcagcccccccuccugccucccguggccuguggguuaacugaaguguagcuaaugugacugaggaacuaguacuuaagugaguugcauuuuggugaccucuuggaaaugucuggcuauggaaaagagaacccuguaggggucacgucucaauagauaguggcaguggcuuuuucucuuccagagcucccuucccugcuuccuauaguggacgucgcggaagccuugcugcguguuagaaauggagccugguucuugugucuccugguagccaauguuccugauaguuuuaacgaagguaaauauaauuuaagaaugaauuauuggaaagcuuggauuuugcauacuugggccuuuguuuuuuggacagucuugcuguguucucccagcuguccuugggauaaccugggagucuuuugucucugccuucugaguggggcugguguuaagaggugcauggcaccaugcuuagugcuaugcuuucccuccuucugggcaaggguaggacccagugccuaagcuacagcccagaccagucugucguuuaacugaaguguguagacacgcuauauuagccauuuaauacaauuauuguggugguuagguaugccauguuauuuuugucucuuuccuuuguaucauuuuuuaucauauauuugaguaauguguauuauaaguccagaugacauucuuacugcuuuuauuuuaaguaguuaauucuuuuuuccuuugauuuauuuccuuguuuaguuuguguguguuugcauaugggugugcauguggugcuaagcaucuugucuugcugagcuaugucaccagcaccuuuuucucauuuuuuuuaagcagggucucacuguguagccugguaaccuugaacuuuaaguuaucucccucuucucuguguuaguaucacugugugggcugccaugcccagcugauuuuaaguccuuucucagauguggggagaagcucuagcuguacacuuaguauuucugcugcucuccauugaauugccuuuguuucuuguaauguauaguuuauuuacauuuauuuuuauuuuguuuuuauuuauguguguuuaggauuggacccagagcuacuugcucugccagugaacuuugaaggguagaauucuuggcaacaauuucccccaggauuuugucaggaaaaaauguuuauucugauaaaaucuauuuuaaaaguaaaauagcuuuucuuuucaguccugaggauugagcacagagccuugcacuggucuggcaagcccucugccacuguuguuccucuauaucucuuuuaacgucuucauucugagacagggacucacaagauguccaggcuagacuugaacucacuuuguugcucaagcaggcuuugaacuugugaccuuuagacuugugagccucagcauuguuacuaggcugcacuaaucgcuguuuuguuuucucagcauuguuugcagagccucaucaguguuagccaggugcucuucugcugagcucagccuuaguuuguuguuguuuuccuugugacacugaaucccuauuuagcuccaguuugccuggauucugcuauguuguccaggcuggccuccaauuggagauucuccuccagcucccuagagcugugacuggagcuguguaucuuggccagcuugaguuacuuaguuguucacuaccuuuguccuuguggguuuauaguagcaggugggacuagguguuguccuccagguuguuauuugcgaaucccguugacuugguuucuauugcaauacuaucaaguucccagggucugccuucuacacuguuuaaguugcauaaaugguuaauuuucaagaaugaagaagugguuuauaacaccuuacuuaaaaaggcuuaacaaaacuuaaaauaauaggggcucuuaaaugauaguuuguaggggccugaucaaaaacggagaacggcaggaugaagaaagucucggagggaggcgcaggacagacgcccuacgcuuccuaugcagaaugaauccuucucaggcccugaagguccggggcaugguggugagugagucucuugucucuuuguaacagcacuuuuuauaguaggauuuuucucaagauuguuugagaauccuuuagaaacggggaacuuuauucauauccugaguaugcugccucccucuugggucuuagguuuugugagcucuuuuccucugaacuugaggugcauuaaauuuuaaaaugucccagaccuuuuccuuauuguauugaguuuaacuuauuuuucucucuguguuagguggaagaaugucacuugccaggccuuggaguagcuuugacauuggaucauacuaaaaccgaagcuugugaggauggagugagcgacuugguuugcuuuguuagugguuugcuucuuggaacaaaugcaaaagucaggacuugguuuggaaccuucauucgaaauggacaacaggugagagucacaugaucguagggacgacuccuuagaaggagcuuguuaccuaggccugguggcucauacaggagcuccugcucuuggaagacugaagcaggaggauuacuaugauugcaaggauuacuaugauuaaaagccauaggagucaggcaugguggcacacaccuucaucccaggacccugcaguaggagacaaguggaucucuaggaauuugaggccagccuggucuacauaucaacuuccaggccagccaaagcuacauagagagacugugucuaaaauuaccaaacaaaagccauggugggaaggaggaaacaaaagaaagaaaagguaucuuuagaccagugguugucagacuuaguuuuaggaaccuccugaaagcuauauguuuauauggcuuuugucuuuugauauuucccaauuagaaauuaaaaauuuagaaauacucaguuuauuaaaaauaaaaaacucaauuaaauauaaacagggagggagggagggagggagagagagagagagagagagagagagagagagagagagagagaugugugcaugugugugugugugugugugugugugugugugugucuacuuuugagcugucuugguauuuagucagggcuggcccucaauucuuccuuagacuugagcccaagccuccugauuacaaagaucauaggaaugucccaccaugcuuaguaaauauuacauuuuuaaaaaauacaaguguuuaaaaaaaccaaacuauugaaauaguaguacugcuuuacaguuuuuaagucucuucaaagucuaguuuagcagaagucuuuggagaauguacuguacccuagugagaaugggagggacaaggcaccgucucaauauugugacuagguauuuggacuuucugggccccugaaagaauuuggggaugcucuaguuuccuauguuaggguuuugagaacucuuaucaucaaaguaaguuauaaucuggguuuuucgagacaggguuucucuguauagcccuggcuguccuggaacucacucuguagaccaggcuggccucgaacucagaaauccaccugccucugccucccaagugcugggauuaaaggugugugccaccacugcccggucuauaaucuguaauuuaauauauguguguaugugguaaaauacauaucaaaguuugcauuuauucauuuuuuagauacaguucagaauauucacaguauagggcuggagacucaguagguaaaaugcuugcuauauaaacauaaggacuugacuuuagaaccauaguaaccauguaaaagcagagugugguagcaguugucuguacuuccuguguugggggagcugacacguauauggccuggaggcuuccuggucagcugguguagcugggaugucguguuucagguucagucuaaagacauaauguggggcagcugaaaggguagcccagcaguuaggagaacuuccugcuuuucuggaggacacaaguucuguucuuagcacccguagugggcagcucacagccgccuguaacucugcuuccagaggaucuggugcccucugcagccucccuuuccuacguccauauguacguacacacaggcaaauaaauaaaagauaaauacauauuuaaaaauauaaagugagaaguuggaagacacccaguauuuguuucuggguuguacauauagcuuguguguaugcauguacacacacacacacacacacacacacacagagaaaaggaaccuuggcaguguuaugcauauauagccauuaucuauuuuuaggauuuuguuuucuuuuuuuguggucagaguuuauacugguugguuaagcacucucucugaguucuagccccagugcucugcagacucugaacccacucaacuaccuguucauccuuuuuccuguaaacuggugaucagggcuuuagguuguucugugugaauucugggucccuuuguaaggaccucauaugagucacauuacaggauacuuguauguuauuuccguaacauaaagguuucaagguucauucuugcagcaugugucagaauuuucuuagccaggcauuguuacauauacuuuuaauacuaacuguagcuagaggcaggguuaugggcuagauacauaucacauucucugccagcuggacuacauccugaggccuccuccaccauauagaagcccccccaccccgccccgaaaggaauuuccuuccuuuuuaagguuaaauaauacuccauuguguguauauauucauuuuguuuuucuauuuaccuuuagauauauaucagauauuuuauuguacauaauaauaauuuagugaacaauaugaugcauuauguuuugugguccugggauugaauccagagccucucauacacugagcugcuaaaucucacuaaguugccaagauuguucuugaacuuggcuucuuucucuaaccugagcaguugagguuacaggugugucuugcaguagguuuguuuguuuuguguguguguguuuuguguguguguacgcaugugcgugugcaugugugugugauauaggcucuuucuuuguugccuuggcuguucuggagugugguagcccaggcugacccagucugagucugugcguugacugcaggcauggccuccauugccagcagucuuccccacucaacauggcuuuuuuuuuuuucucuucuuuacuuuuccauuuauuuauuuguuuguuuguauguuuauuuauuguuuguuuguaagcuugcuugcuuguuuuuugagacaggguuuuucucuuugguccuggcuguccugaaacucacucuguagaccagguuggccuauaaaucacagagaucaccuugccugugcccccccccccacccccugagugcugggauuaaaggugugcgccaccaucccccagcuccaccacuuugaacaccuuuuuagugcuucugaguagaauuugcuaguguagagugacuuuuaacaguucagguugaaagagggcagccuguguauggguuagaaacuaguuuugugccaagguaucacaucauucuacauuccagacuuauuuucuuuauaguccacugcuuugcuuuuuaaaaguaaagggaacgcacauguaucgugugacgggcauauggcugugugcugagcagucaguaugcucuuccuguucuccuagcccuuugugcaccacacauguuucuucuuggaauuuaacauugcuguucaggcauguuuauuauacuuuccuuaacagcagucuuaaaaauacuaagcaccgauuacaguuaucugccccauacguggcuacggaaaugucucucuggaguuuagcauuccguucuuguguaugaucuuucuuuguucauuggcuucuuaguaagcauugagugcuugccacuugucaggaacaguauuagacuugaagagugagugacgacuaaaguaucccugccuggagagcugggcuggggugcugccucugagguacagacucucagucauggugucucuaaaggcacguaauaccacuguuuauuuccuugucaagaaggaacuugggguucagagagguuaccugauguaccaugcagcgcguaauuagugggagaacuagagcuuaggacggagguuugcagguucuccaaacacgugcuugcuguugggcugccuuaggcauuggaaguacaguguaggugcugggaaucgaacccaaguccucugcaagagcaacugcucuuacuuaaccccugagccaucuuggaagucuuacuuugaauuuuuuaaacaaguuuuuauucuguaccccggcaguauuggaacuugccauguagacugccuggccuucagcagcuccccugccucugucuccagagugaugagauuuacaagaguggacuuccacacucagcccaagcacuuuuaauugcucuucacaaccuaauuaguacuaaguuagccuuaccucugcaaucagugcaaacuggggugaguagaggaauacauuuugagucuucuugacuuguuaaaauagaacugcaguuagaacaggcuccucauguugggucaacuguaagugcucaugugacaagauccauucagcuuccuuuuaaugcaguaaccgcuccaugcucucuuccuuugccgauuacgcuucuuacagagaaaacgggagaccagugguuccgugcuuuggcagaugagaaggcagcugcuucuggaguugaugggcauucuuccuacagugaggaguacccguauuguggaggaagccgauguggagauggaaccuaccgugucgguguacucggggcugaaggaagagcacgucgugaaagccagugcacucuuacgucuguacugugccuugaugggaauugcuggacucaaguacucaaucugauauuuccuucuuuaucuuuuucuucuugguucucaucucacagaagugaaccaaaggccuuuauuaagaggguucaggucuuaauuuuacuagcuuauaucaagauugaagguauuaaagccagcugucauuaaggaauauuuugaucuaauguggucugguuacaaauagaauuaugcaaauaucagagggacaagaguaguuucuaaguuuuuaaucccaguguauaaagguccugugauuuuaccacacuuaagaagauaccccugagugaccugugagcgauccacuccuguccugagccccaguugaaggaaacccuuuagacuugacaggaacacaagguuucuaaguuacuguaccaaauccuuuggaauaaugaccucagcugguaucugagcauuccuguguguaucuccccucaugugcuuuucaggucugacaguuuagguaagcaaaugcuggcccaucaguuugguucaaauuuaagucauuuacaauccauuaaccccauaauuguauaaagugcaaauugcugugaacucuuuaggacacauggcuacacauaaguaauaugugcucgucacgucuaggaccauugcuauuacuuccuuggaaguuuguugaucacagaacccugauuauugauuugguuuuugcacagacaacaaaguaauuccacuucccauucucugugguaaaucauaugccguguaaaaaggagacaacugaaaacggagaauugaccaauaaagaugaagggguuggggaugggguaaugacucagggguaagaaugcucacucuaggucuggagagaugacucagugguuaagagcacuggcuauucuuccagagguccugaguucaauuuccagcaaccaccugguagcucaccaccaucucuaaugaaauccgaugcccuauucuggugugucugaagacagcgacaguguacucacauacauaaaauaaaugaauaagucaccauguguacaugagaagcaagagauagagcuuguggucagcaggccuagugggggcagcuagcuucugcccgaggcaguaagacagagccccuugcucugccccugcaugcuuacccagacaugaacacccaugccuucgugugugcuacucaccugcagcccucacccagcacccagcauaccacaugccuaugcacgugcacacacacacacacacacaaaguaaguauaaggaguuggauguaguuuuguuacagugcgguuaaaaaguuugcaugugaaggguuaaaauguuggaacauuugauuguuuucuuacugaacuaaaaacaagcaaagaaacaaauuguguuuacccuuucagaccaacugaagaagaagcugagcaguugcugcagcugaugaccagccgaccuccugccacgccggccgggguucgcuuuguuucccucuccuucuguaugcugcuggccuucuccacacucgucagguaccgugcucuacaagucacuccgccuucccaaaugggcucuuaucuacuuaucuaauuguucauguacggacgagcguguaguguagguagcauguucgccuagaaggaguguuacuaccaauaaggguguauaaauagcauauuauuaaaaguuuaccacagaaacuggccaauauaagggaaucaguaucuacuaaugcgagccauuuuauuagucuuugucaauguuucuucugaacauuguuaaagacuaguaauucuuucucuacuuuuuuccuucuuuuaguucuugaguuguuuuacuaguacuuguaaaauuuuuuuuaaauuucuuuuucuuuuuuuuuuuuggagacaggauuucucuguauaguccuggcuguccuggaacucacuuuguagaccacgcuggccuugaacucagaaauccuccugccucugccucccgagugcugggauuaaaggcgugcaccaccaccccagcuuaaaaauuuuuuacuuguuuauuuauuucuuacuuguuuauuuuuuauuauuuguuuaguuagcacauuauuugauugugugaguguguguguguguguguguguguguguguguguguguguguauguacacgcguaugugcuauggugcauguguggaagucaaagaacaacuugcggaacucacuucuucuaccauaugggcuucaaggauugaacucugguuaucagguuuggcugcaguuuuguuuugaauuuucuugguguucuguguagcaauaauucaacuccaaacugcaaaacuaaaucuugcugguugugguguuucaugccucuaaucccaacccacaagagaccaaggcaagaggacugccauguguuugagucuagccuaagcugcaaaguaagaccuugucucaaaauaccaagaagaccacugacacacaaaacacaacaacaaagaaacaagaugcagcuaaaucuccucuggaucugcccugauucauuacacaguuuauugguuuaaucuuuuucagaaaucuugcccagagcaguguugucugcuccagucuuggcugggucccucuguaccugguauucuacagcuguauacaagacuaguuuuucauuuugaaucuuuagaaagcagucaugugggagguaaauucuucagagcaggggugcauuucugaaaaugccaacauucugacauuuggauaaugguuugauggcauguagaauucuaagcgggaaauaauuugaggauuuugaaaguguguccauuuccuugucuucuaacuucuugcuuuguugucauuguccaaagucauuccaguuccuugucccuuuguguggccucuucuaucacugugcagacauguaggcuuggcucuuucucacaugguuucagaaguuuuagauaauauuuggucucucuuuuuuuuuuucuucgagacagggcuuccauguauaucccuggcuguccuggaacucacuuuguagaccaggcuggccucgaacucagaaauaugccugccuuugccucccaaaugcugggauuaaaggcgugcgcaaccacugcccagcuucuuuuuguuguuuuguuuguuuauuugagacaaucuuucuggcuggccuggaauugacuguaguacccuugccgcagcccuccaaugcugggauuacauugcauuacacagccuugucauacccugccccaguucauauugaucuaucacuggagguguccaguggguccuuuccagcuggaaaccaaugcuucaguuguaggagauguucccacacugccgugcugcuagugucuuccccuggggucuccuugucucaguccuuuugugaaucuuucagagcaaccaaccacuggauuuucuuaucucagugcuuugcuccuucuuuuugaaaaccaccauaaaccauaacaacaaaugcacuguccacucgauguagcucaggguuccuugcguguuagccguuaucccgcuauggccgcagcccguuccauguguuuucaccucugcagacagacgcugugccucucgggcugucuguacugcagcuuaauucccaagagcucucuuuuuuguccuuuuauuccuuccuuuacuuaauuuuuuuguuguuguuauucaauuuuuguagaugaucuugucuggaacuuacuguauuguuaagauuguccuucaacuccuaguuuugcagcuuccaucucccauguuuuaagguagcucguuuguugacuuaguucugguacugaacuugcuuuguuacaguagcccuugcuucauugaaggcuacucauuuucccuaaggccuuuuguuaaggaguuuuuauugcauuuauuuuguguguacauguguauguauguggccaugcaugugcccugcacguguguagaguucugccaaugacuugugggagucaguucuucccucacacgggucccagguaucaaacucgggguuuuuuuuuguuuuguuuuuuuguuuuaaccuucugagccuuuucaccaaccuagaaauuucuuuuaaugaaauuauagugcuguucaggaaaguauaauguuaguaaaauuaaauauaaguauuaugugauaacuguaugcgucaggguuuuccgccaggcuuuuguaaccauuaccucuaguccucguuuucuugaggugccauguguguuugguaggaggacuacaggucagaaggauaaacuuagguuucagaucacacccucagaacugcagagaugggauucucacugggucuggcaggccucuaggcacccuccauuauagugcugucuugccuuaguggaaugacugaaaaauaauugagcacaauauuauauuagguauaggaauaaauggccuuuuagauuuucucagcuuagugagaaaagcacacuguucaguuguuuucuguuuucccugcggugagguggaagagagccgugacauuuuuacacaaguuaaagucagagugccuuuugaguuuuagauacaaugauuguucucaagaagucaguacugcugucgggucagugaggugacuuaguggguaaaggcacucacucuggccuuuagcaagccugauaacugaguuggauccccuggacuuacauggugaaggggagaacugauuccugccaguugaccucugaccucuacacacaugucaugcuauauacacucucacaaaauaaauaaguaaaugaaggaaaaagaaaaacuuagaaacuguuauuacuguuacauuuuuauaaccauuuaaaauauggugagcucauauucuuaguuuuuaugauuaguaauaauuucugacuaaaauuuaaaauucuuaaaauucuacccaagauauuuccauaaauuaaauuugaauuaaaagaugcauuaauuuguuagauuuuagaacuugguuucugaauuuuuagugcuuaaggaguuuuuuuuuuguuuuguuuuguuuuuguuuuuuuuuuuuuuuacucguuuuuguucuuuugaaacagggucuuaccauguagaccaggcuaguuuugaagucauagagaccugcuuuccucugucucucaccaaacgugaugcuuaugcuuuaacuuuagaucuuuaaaaucuuuccuauaggaaguaacugguuagcguucuuaauauaguucuuuuaacauuuuaaucccagagaccuuccuuuguuuuuccaaggaauaagagggaaugccacucucuucaauuuacaaauauauagaauugaggagguuuugacaguucagguugaugaaggcaaagucuccaucuuugaguucucaucuuguuuguaguuaguagucaaauucagcaaaccauuaauuugaguugguauuucaaaguagagaagaaaaaaaccuccuaggaaaaauaauuucagggcuggagagauggcucagggguaauaacaguucaugcucuugcagaggcccuggguucaguucccagcaccaacacaguggcucagaagcauccgaaacacuaguuccaggggaucugagggcagcaggcaugcacaugguacaaacaggcaauauucuuguacauaccaaauaagaauaaauaagucuuuaagaaugaggaaaagcugggugcuagugagauggcucagcugguaagagcaccgacugcccuuccgaagggccugaguucaaaucccagcaaccacaugguggcucacaaccaucgguaaugagaucugaugcccucuucuggugugucugaagacagcuacaguguacuuacaaauaacaauaaauagaucuuaaaaaaaaaaaaaaaaagaaugaggaaaagugucuuucagcguguugucgccacgcucuggugacguggugccauggugucucugcagcacgccggagcaggagcagcugauggugcuguggcucagcuggaugaucaaggaagaggcguacuuugagagguagggcaagcagccauuguuccucucaguugagaaagcuuuucuuacuuauuccuccuuggaacucauagcuuuucuucuguuuuaacaguacaucaggugucucugcuucuuuuggggagauguugcuauugguggccauguauuuccauagcaaccagcuuagugcuaucauugacuuagucugcuccacuuuggggaugaagguaauuguuaauuaucuuuuuuucugaaagaaacugugucuaugcuaguuauaguauauaacuauaauauaacuauauauacauauauacauaaagcuaguauaucuauaauguuauaguauaaaauaaauacauuguguucauuuaaguaguuuuaguuguuugcuaguuugaaauuuuacacaggaauuccuagaaaaauaggaauugcauuuauucaaauuuuguguauguaugggugucugugugggcauguguacauguguguagcugcccacagaagccagaagagggagugggagacccagcugccagagucuggguaaccugacaaggaugccguuucuccaggcuucucuuuaguuguugcuguuugagacaggcuggccugaaaucuaugcuggccucaaugguuuuuuguuuuuuguuuuuuaaaucuccuguguagauuuucuaauuuauucuaaaccuuagaugaauacuuauauaaauguaaacacagauagucacacagcucuauccucaaacacuuaguuuauuuaagauaaaacuguggccaaaguuacuuaauaagugagaauuugccaaguguuuaugaguucuaucauaguauuuuuuauagagauguuuccaguuucacuguucacauuaaugcaucagagcccuugguuucauaaagucuuaccaugccuugacaacuccauucuuuauaacuuuugguuuuuaacuuauuuauauacuuauuuaucgagacaagguaaccauagagaucugucagccucugccucugcuuccugagagcugggauuaaaggcgcauaccaccgugccuggccugcaaauuuggcgaagaauggucccucuuuuuuauauuuuacugauuauuaguaaaacuaguuauuccguucuuuuguuuguuuguuuuuguuuuguuucuuuuagaggagguuuuguuuuguagccuggaguggcucacacuuuuaugugauuccccugccuuuucacaggacugcugggcuguagaugugagucaucacacucagcuuuccagacuuuauucuggcucauuuguggcuuuaugcuuugcauugaaaucuuuuuuucucaguacuaaaguacaacaucgggcuucacuugugcuagccaagcacccuugcacuguauguacuucaggucugcaccgacuuuaaguugguccauuugaaguacaguugucuguguagagucauguguguaaaaugugugugugagcuauuuuuuuuuuuuuuuuuggucuccauuuauuggauaaaccuuuucuacucacuaacuuaagacgccaauaguuaguacaauuuauuaaguaauuuuaaaguauuuuuuuugauaagagguuucauuauauugcccagguugcuccugaucuccuggguucuagugacccaccagccucagccucccaagugcgcaugugugcacugcuuuuacuaaguaugcuuuauguugguucuacuucagugucuuaaugucaggcuugagaggucacuuaugagaggaaauuuaaguuuccaacauuaauauuguacaucauaccauuuuggguaauaaauucaugagaauaaacauacuucauacgguuuuacaugcuaccgaaauucucuuaacuguuuuagauugugauuaagccaagcuccuuaagcaggaugaagaccaucuucacacaggagaucuuuacagagcagguacuuccuucuguccuuagcuccucacuaaacuacuuagaagaauaaaguaagucuuuuuuuaucacuuucaauuuguagugguaauuuauuucaucuuuaaacuaucugugaauaauucaucuaccucauuacaaaacaguacguuuugaguugauagauucuugaaaacuuugaguggguccguaagaguguggcuguagauauugguaauguacucuguggguuaaugauuugaauugcucuugagaaaacagagcccuggguagcucuuuggguuguaaaguauuugcaguuacaguacagacuagccucugguuccuuacucuuuuguucacacuuacuuggcuucaguacccuugucucugaguaaauccaagaauauuuuucuuuuuuucuuuuucuuccuuccuuccuuccuuccuuccuuccuuccuuccuuccuuccuuccuuccuuccuuccuuucuuuuugucugucugucugucugucuuuuuuuuuuuuaaacaaaugaggaaccugagguuuaauauaguaugagggcuuucccacaaaacccguaggccgccauuuucaggaggaagcaccaaagcugggcccugugcuguaugucaucuggugggucugguccucugagggccucacaaguggccggacugcugcugcaacccacuccgacuggagacagucacugugcuaccacagauucagccccaaacaaaaucaaauaguuuucuuuuuagcaaaguuauccuaaaaguaaaaauucucaaauucauuugccaauucaaauauaaauauuuccuucugagacaaggucucuggcuggacuggaacuuaauaucuaguaaaccuguaaauucucugaacuuucugcaguccugucucagcaucuugagugcuggcccagcucauauaacuaguaggaaaaaaauuagcauccacagccacccuucaggacaaguaagaauguaaucuuuuauuuuauacauguaaaaauagauucgaaauguagacaagacuuaucuagacccaauuagcacaaauaauacauuuuauauuuguuagcacuucucauguguguuuguuuacuuauuuauuuuuauuguaguuuuuuugguggucaugguagaaacugaacaauaggccuuuguaugcuacacuacugcugucccacugaguuacacccuuuauguguguauguguaaaaauaaacagaaaauuagagaucuuuaccaauuccuagguauauacuccuuuuuuuuguuucuuuuucuuuuuuucuuuuuuaacuguacuggggauugaacucagggaucugcacaagcaucuuaacccugaguucuacuccuagccuuagcuguucaagaguuaagaaucucauucauccuuucuuguagcugagacaacagaugagugcuaccauaucuaauuuacuuaucacguagauaucauaaaagcuuucagguacaagucugcaacucuaacacuccggacaaagagacaggaggaguaggaguucagggucagccuuagcaguauagggccagccugauccacaugagaccuugucuuaaaacaaaacagaacaauuaaaacuuguaccagcugauucucauuguucauccucguggacugcauuuaaguguugauggucuauuugguagucuauaucuuuuuucaagcuaauuuugcauuuguuauguguuuuaaugcuguuguucuauuucagguugucacagcccaugcaguucgaguuccugucaccagcaacuugagugccaacauuacuggguuuuugcccauucauuguauuuaccaacuucucaggagucgaucguuuaccaagcacaaagugucaauaaaaguaugacuucauauuuagauuuuaagcuguaacucaggucucucccacuaguucuuaguuuguuuacuauaguucuuuccugugguuugugugugcauauauauauauauauauauauauauauauauauauauauacauauauauguauauauaugccagcacccacauggcagcucacaacuguguguaacucccagaucugacacccucacacagacauacauucaggcaaaacaacaaugaauguuaaaaaaaacaaaacccaacuucaauuuuuuaaaacaauuuuauaacuuguaauguuguaagcuaacuuacuagguaauaaguuacuacuauaaguagcuaguuacuaguuauuuauauaguuuauuauuucuaagaacugaacuugagguucagggcuggagagguggcucagugguuaagagcacuggcugcucuuccagaggauccagggguuccacccaacuucaaauuuuuaaagcaguauuauaacuuuuuuacaaaauguauaauauuauauuccauauaauagcaugcuuuuacauuuuuuguuugauacaaaauguaucaaacaaaugcaagcuggucuugaacuugaguuguagcugaggcucacagugaauucuugaucuucugcuuuucccauccuaagugcuaaggguaauaggugcgcacuaauauggcuggcccauucucuaaauuuuacuguugcuguuugcaaauuugucaccagcauagccagugccuaacuuauguuuucaguuuuuuaauauuugguuauaucaaaggguuaaaaggucucuuaaugagaaaucugaaauacagaagguaaguaaauguuuuuugaaccuguuauaaaagccuuuuuuacuuaaaaagagcaaugagcaguuuauaugugacauaucuuguuaggugcccuuuugacgcuuuuggcgauuuagugauauuaauuuuuagcuacguugcaucuuuugcuucuuuuugugcuuuuauugaguaagacaguuauggauuaagaguccagauacacaccuugaaguuuugcaugucuccucaccacuagguaagugguaucccauauuaguucuuuucuagucucuggagaaauaucccucugcugggaagucuuccaugacacacagagagcuuuagauagagacaguagggaagguucagaaacacaguaaacccagagccaggcugcucaccgucuuaggcguaucuuucaggagacaguguuuuugguuaaaugauagacugauuaggaaaagagguguaguauauuuuagcuccccaaacuacuggucaguaguacauugaucugaggaacauggcaaagcuauauguguucuacgguguugaucuuuuuuuuuuccaaucgccucaauuuuuuucuuguaggacuggauuuacagacagcuaugugaaacuuccacuccacuccacccucagcuccuuccucugauugauguguacauaaacuccauacucacuccugcgucuaagucuaacccugaagccacgaaccagccggucacugagcaggagauccugaaccuuuuccaggaggucaucgggguaaauaaaacaauaguccuuucaccugucacagcucggccucaguccgucuuuauuccuuagaagucuuauagguaauucugauuuccaaauaagauucauaugugcuaugcacacuugcacauaugcacacauaaaugagauuaaauuuuauuagcuuacuaauaaaaauuauauaauaauauuaguuccaaguaauuugacaaacagcacuuuuugaagauuuuauauauauauauauguauauauauauauguguguguaaaauuuaaauauauauauaauuuaaaaugauuaaauuauauguaucuauauauaucuguaaauauauaucuuaaauauauaguuuugagacagugucucacuuuguagccuggguagucgcaaacucaucauuuugcugagucagcuuccugaauacuggacuaacaggcuugccccaccgugcgcagcacaaggaguuguuuugaagccuccuguuaaaguuuaaugggugccuugaagauagguauuugcuaaaggccugugggauauuucaaccuguccaacguggugggugcucuuuaguuuccuggaaauugagaauacaccuggauucaauuauggaaaguuugauaaaaauuuuuuuccucauuuuguuagggaaaaauagcaguuuucacagacacaguuuaauguacaggauuuuuuuugugaauuguuuucuucauaguaauuucagauagaacuuugauuccugaaagucuuucagaagcagccuggugggaguacuacugagaaguagaagcugaagucuugugacauuuccccucaucugaaauugaggagaggauguuuccuuuugccugucaugcaugcccuucaagguucagugaagcuugaaguugucucagacugcagugaacccagcaguccugcucucggucuagcugggcugaugcagcagcacuggaugaucucucuuaugcgcuugcuguucaguguuuucaccguuuuuguaucaccucagggagacagcguccgccuuacccagcgcuucaguaucacagcgcagcuucuggugcucuacuauauccugucuuacgaggaagcucuccuggcgaacacaaagacgcuagguaagcggcacggggccgagccucuccaguaguaacuuccugauagugagugggucagagcccauccauggaaguccagugaauaggcagcagugagaugcuagggccuucagaugauuuguaucauaucaugggacugagguagucuuugguguuuacuuuagugaaucaaauuugagagagaggaaggcuaacuuagaggguuuggacaauggcauaaauuaguuuggacauuagauagguucucagcaauggaguauagaggauaucaaggagauagggguuguagauaccaaaggagauuucaaagaggacuuagugaggucugcugucugagcucuguuggaugaaccugaaugaggaaguaaaaugaggacuaguguucacccaagggcugcacauagcauguggagguuaguuugcuguagaaugguaggaugaagaccaaauguaaugaauucagaagggagcuggaggacccagugcuauagaccaugagaagagacugcuuuggggaguugccaagggaaagagaagugaugcgguaacugaagugaauaaggucaggaagcgacuugaaaauuauuugugugugugagugccuguguauguaaguacaccacagguacggugcccacugaucuucuggaauuaagagugcaagcagggggcuggcgagauggcucagcagguaagagcacugacugcucuuccaaagguccugaguucaaaucccagcaaccacaugguggcucacaaccacccacagugagaucugacgcccucuucuggugcaucugaagucagcuacagcauacuuauguauaauuauaaauaaaucuuaaaaaaaaaaaaaaaagagugcaagcaguugugagucacugaugugggugcuaaugcucucaaucaccucuccaucucucuagcccugaauuuuuaagaugaaaaagagacauguuauucucuugcuauugagagguguguccugcagagagggguuguugaagccagucucugcaguuacauccuugaugaauaggaagagaugagagagaagaccuuuuccugguaggaaacacccugguuaggcgguuuucucuggucuaguuuuugucuuccaaggguguaaagaacuucacgccauuguugagagguuuuugucaguagccaaaagauuauuugccccaaauauauucuuaccugugauauuauguguaaucucagcacuucacuuuugguuuuauucuuauaagaaacauuagcagccaccugcuagauauagaagcuaggacaggaacucugaaaucugagguagaaucacauauuagauugugauagcuguuaaacuacaucaguguauauucauuguuuauuuaaaaauacuuaugcacaugugcauguauauguauauugauucuaguuaaauccucauuuaaaaauauuuuagagauaaaaauuguacauauuuauauuauuuauagauuuaacuauccucaagaagaugcauaguaaauaaagaauuuccuguguacuuauuacuuaguugaaaugugaauauuccuuguauauuucaaauauuuguaccugaaacacugugcuauuagcugggcauagugcugcacacuuguaucaaaauuaccucaaagcaagcugcuuuucuaguauaaaaaguuucagauguacaauuuuuauuugauuuuuguuuuugaggcagagucucuuguagaggcuggucuugaacucucugcccagcugaauugugccugaacuccucauccucuugccucuaccucccaagugagugguucaaauacaggugugagcuuccaugucuggccacagucuuacuccucaguagcuacaaguacuggaggugcuuaacucacccuccagcuucaugucaccuaaaagaaagucucgccguucucuacucuguccuguuacauguaaaauaugcuucuuggucaccaacagaacaagauucauuguuucauugucugguacuugguaaacuggugcucagguaccaccaugcccacccagcgaggcaauuucaaguggcuaagauuauaguuguguauuuuauuuauuuauuuacucauucauucguaaaauuguuuaaugauauaguuuuauuuuauguacauugauguuuuaccugcaugugugucugugugagggugucagaucccucaaacuagagugagagacaguugugagcugccuuaugggugcuaggaauugaaccccaguccucuggaagaauagccaguucucuuaauagcugaaccauuucuccagcccuuuuuucucaccccaugguguucuguaauuuacauuaguaucauuaagcucuaagucuguguucaugacuucuuuagacuuccuaaauauauguggaaaaaucuccacugaguuuuuuuagugaauucuucuuugcacuaaaaccucccaugauuuuguuccaauuccaggcauuuccuaggucuugccuuauguuuuuccuuuauagucacuauaauuugguuguuaauuuuuaucuguuauacuuucauauaucaagugaauuaaaaguaccuucaaagugucuuuauucccauuuguuuugaaaguuaagauuugucucugauacucuuuuauuuuauacuuuuacugacagcuuccaugcagaggaaacccaaaucauauucuucuucuuuaauggaccaaauuccuaucaaguuucuuauucggcaggcucaaggacugcagcaggaguugggagguauucauuuuucauuugcuaaguuuuauugauaugauauauuuuacugcuuaugcuauaauuuguaguaaguauucauuguuauaaauguaaacaguugaagacuaaagaugcuuuuuguucccuugcugaauccauuaccucauuuccuacagaucacuacccccuagaaaacuccaguuuucaguuugacauucauuuuaauuuuaagucauuucuuuucauauaggaugacccuaauaugauggcugauauuugaguguugggguacagcuugguaguagagugccugccuggcaugugugaugcccuggguucauucccagcaccacacacgacacaugggugcccaccaguacauacuucuuauucccuucaucuuauuaggagcuuauuuggauauaacccuauugcaaacuucaguaugucaaguucaaaaugcauuuguggucaaguaugguggcuuagccuuuaaucacagcccuuggcaggcugaggcagucuggucuacauaguaaguuccaggacagccagaucuacauagugagacccugucucgaaaacagaacaaaacaaaacaaaagguaaaauuauuugccuccucuaagcaacagaauacugaagcucagcaaugcaaugcacuucagcguagugccuguuuucugucgugauuguauggcuggcucacucugaguugcccacugcugcugccuggcauaacaggagaguuucucauauugcuagccuuguacgauuuuagaguaaagccaacuguacuuccuuaacacuguaaaguuaagaacucaucagucuaacugucuaaagcugcagaccuagagaaugacaaguucauacgguugaaacuaguagaagcucacauaauauuuuaaaaagguggaugauauuauacacuaccuccuuuuucucauguuucucuuuucauugagauuugcacucagggcaguaugugaauuaagcuaguacuauaccacugacauaucuucagcccucugccucugcugagauaucagcccguguagaucuacuucauuauuugaaacuguuccauaauauuccaugauauucuaauauguauauaauagucugguuguaaauauugguaaauagaccugugagaguuuuagaaacuugauguuucuuaauagccaccuuucauguaacagcgugguuuuccugucuuucuuugcugugguugguuuggaauacgaacaugagccuucauuggacaugguagccagauagauagcuacauuuauuauagcuuuacauagucuguuucuuuaaaaaacaaacaaacaaacaauauuuggcaguaacauguuuuacugaaaagaguauaauauguagauuguuugcacuuuucugugucuguugguaguaguuuuaguuguacauauguuuagaaauuuaaaguucaguaacacuugauuauuacaaugccuuuuugaauguagaaacaucaguuuuaggcagucuugaugguuaggcaugguggcacacgaaaaucuuaguacuugagaaccuuuuuucucuucugaacuccuaaaagacugcuguguuaaacagcuuucacgaugagugucaaacaguggggugaaguagaggaaagccaagaaagauuagcgcaaggaguuuguuuuuaguuuuguuuuuagguuuuuugagacaggguuucucuguguaguccugguuguccuggaacaaacucuguagaccagccuggccucgaacucagaaaucugccugccucugccucccaaaugcugggaucaaaggcaugugccaccaccgcuuggcgcaaagagucauucuugacauacugugaaguaguuuucuuggggacuuuuauuuaaaaugcuacacagauuuuuuuuuucuuaaauuaaaaaaauuuuuuuugacuacuaauauuaaacuuaggccccuauacacauaaagcaaguccucugucauugaucuauccccucaguccuuguuuugagguaauaucucacuaaguuguccaggcuggcccugagcucaguguguagcugaagcaagauaggacuguacagcuucaaccuucugaaaagcuuggauucugcuccaggccuggcuagaacuucuuaaacuguggucuacacuugcagaagugggcguggcuagagcugggcauggcaucuagagccacaguugagcccuagcugggcauggcaucuucacuaugcauguacagcaaguuuccuuaacucccgaugcuagugggugggccagugaggugagaaacaccguuaguacacaccgcugcuccuuaugcuugcuggcugcuaaaaucaggaggggggagauacuguuuugagaacugagaguccaguuaacuuccuguuuuguuuuuuagggcugcauucagcuuuacuacgucuucuagcaacuaauuauccacaucuguguauuguggaugacuggaucugugaggaggagaucacagggacugaugcgcuguuaaggcgaaugcuccugacaaguaaugccaaaacccacucuccgaaacagcugcaggaagguacaguaaccgcucauuccccucccacuacugcuguacagaggggcugggcagacuggaauccuauacuguaacaagcaggugucuuuggcgguaaggauuucuaaccaucucuuugcuaugcugggaauuucguugacauguuuauagcaguuuuggauucuguguuauaucacuaagaagauuuagaaaauucacaaacugguuagaaauaaauacaguagaucaaggcaauguacuugcuauuaauggguaauguuccagauuaguguccccaaauacaaauagugugggcuacauguuaacauugcauuagcuguauuaaaaaguuucaguucacaagucuucugaauacaauuacacaaucaguguaaggauuguuguuguauaaucuuuacuuguguuugcagugacaauguaggccuuggcgccccacccaaacccaaccugaauuuuuguuguuguugcucuugaauucuuuagcuguuauuucuaagucuuuuucucuuuucccuuuggagcugcagacugaaucugggccuuuugugcguucugggccugugcucugcuacucagcucuacccccagcucuugaggucauugucuuuuuguuuucucuacacaacugaagaaauugugagccaguugucuuugacauguggauuuuggacccagauacaaagugacacgauguucuuuucagcuuuggcuaguuuucuccacauuccuuucagguucuguugguuuuccagggugacguacaugcaugacuaccuguuucccuugaaguauaguugguuggccaugaccggcuagguguagauauagauauaguguuguucaugauggcaacaaaaugaauuaguuuucccauuuguuauuuacuuuaugcauguuagcaggauguaauuagugacacucuaguagagagauaauucuagauauuuaauaacagcaaucugcuggaugcuaaucuucuguaauuggacaccuagaagaaaguaucaaggagccugaaacuuccaaauuaauaaacuacacaagcgguuacccccaaaaaugagguuagcuauugugucacuacuaggauuuuuaaaaugaacuuuaugaaauaacaucuguacuuucauggaguuucacuuauuuuuauuacauucuaauuuauuuguuuaguauauguuuguguggggucuugcacaugccauacugcacauguggaagucaggauaacaugagggagcugaucccauccuucaugugugugcagggauggaacucagcuugucaggcgucacuugccuugaccugcugggccaucaccugcugcuaacugggaaguuuucuaauggcuuuaauguuagcuucagugaaaaaguagcugugaguggaaggcuuucuugauuuguuucauuccuacuuuuaagaaagcagcauuuaucucuacuugguaaacauuauaggauuuaggaaugauugcaaaauguugucuuuagcauuuucagcugucccuguaagucacacacaagugaugcagauuauggaacacuugacucuacuuucugccagugaacuuauuccauaugcagaaguacuaacguccaauaugaaccagcugcugaauucugggguuccacggagaauucuucaaacugucaacaaguuauggaugguucuuaauacugugaugccaagaagguaaauucugucuacugcuuuauggaccagagaaaguguauagcuuugauaaugcacggggaacuuaguuguuagaaaaaugcucacaagaccagucuuauuaauggcuuugaguauguaacaauaaaauuccuuucugaagaugacuaaagauauuacauuggggugcaguguugcuuaucuuuaaucucaucaugaauuuaggaggaagaacaggcagagcuaagucugaggaaggcauggucuguuauaguaacuugucucaaaaaaugguuacauuuuaaagaaaaaaguauacuuuaagaaauaaaaacuauuagcaauuugagaacguguuugaagguauuuuccucuguguaguuauuuguaguuaacugauuuggaucaucaugucuuacaucacugcugugguuccaaauucuguugcacccugaaccauuuggacuggcuuuaaaacccugauucccaggcugcaaucuaugcaguuaaaccugagcggugcagcaggaucaaggcauacguuguaagaacagauuccucuggugcagcagaguuuggagaacaggguaugccuucacugugguuaucaguuggcuggcucacagauugugucaggccagucucgagaccagaacacuggucugacuuagcugagagcaugguuuaguaggucugggaacugcggaugguuguucuuucuaaauucaaggauuuuguugcuaugaauguuuguuuugguuuuucaagacaggcuuucucuguguggcccuggcuguccuggaacucacucucucuguagaccaggcuagucucuaacucagagaucugccugccucugccucucaugugcugggauuaaaggcgugugccaccacuaccuggccuaaauuuaaguuuuacuuuacaucaaauuaauaaauacacauaguaauacuucacacuuuucuauuuuagagucugcuuacccagaggaaaccauuauucagcuuaaaaaaauucuagcauuuacauuuuguuccuuauagcucaggaauaggcuuauaacaaguacggcuucuugauuuucuaauuuagacgugguuuguaaaguuuagcagccugaccggcuuccuuccugugaagcuuucccuuuauuuucuaauauaguuguaucauccagcuagagcaauagucaguguucaucuuaugauuaugcauuuacaguugaacggugcaguauuacaauauccuuugguuaccuuuucucucucuuucuugcuucuuuuucucugaguguggaggggaaucacacucaggcugugagcaugcuagucagguaugcugccccugaacuacacuucauaaacacgucuuucuuauacgcaagugccauuccucaaaguuggcauugcuauaguacuuaccuuguuuucauuuguuaaugcuaucaauaacuaauaaauaguucaucuuaaacuauuaagacuagguuuacuuaauaggaauuacaacagaaacuaaucuaacaguaacaugauuuuuauagggauaucucuuucagagcuuuucaucuuaacccuccccccucccaccaccccgacaugcaugguuguccuagaauuacuguugucucugcuuugcugggauuccaguuuucuuucuugguuucugcccacauagagcacauacuaacugcagcgcuuccugagaaaggcugaaaggggcuggcggaggcuccgguguuggggcuugcuuucuucucacaugugguugcugauuugcuuaagugugcuucauacauuugagaacaccauucugacuuggacuucccacuggcuguuagugaucugguguguugcugguucccagcccuuuguauguagauagccauugguuucuucacucauaaaaggcuuucccccuuuguguucuguguucuggaauuuaaugauguauuggguuuuuuuuuuuuuuuuuuuuuuuuuuuuuuuuuuugguguuuuugagacaggguuucucuguauagcccaggcuguccuggaacucacuuuguagaccaggcaugcgccaccauacccagcuuaaugauguguuuugaguggaacuuuuccucuuucauaguguuguguuucauaguguugguugauuuuuauuuauuuauuuauuuuaaauucuggugagcagugucuugauuuuuagaacuuuuucuuccuggaauaaauuaaauuaugugcauuuaaguguugauaugugcaugugaguaaaggugucugaagaggccagauacuggaucuugggggguuagaguuacaugugguugugagccaccuggcuuggguucugggaaaugaauuccuauccucuagaagaccaacauaugcucuuaaguucugaaccaucucuccaacacacacacaaaaccgcuuauggugguacauucuugugaucucaguucuugggaggggguggaggagaaaucggaaguccugucgucauccugugcuauauagugaguuugggcccagccugaaauacaugagagccuuuuucagaaacaaaaacaaaaagaaaccccaaaguuuauuuuuauaccugcuuugcuuuuuucucucucucuucuucuuuuaucuucaaaauaacauuuuuuuuuuuuuuuuagauacaaaggaccaaauaacuuagaugucagcucuaacauagcuauuaugaauguguuauuguuuccucacuaggcuguggguaaugacgguuaaugcacuccaaccuuccauaaaguuuauacgacaacaaaaauauacccagaaugauuugaugauagauccucucauugucuugaggugugaccgacggguucacagguaaauuauuuaauuucauuuguuuuaauagugcuguacuuuggagaaucaaaagaaauugaagaaaaucauuuuaauaucuuuuuuuuuuuuuuuuuuuaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccucauuuuaauaucuuauugcuguuaggaauauauagguaauauaauuuaugcagcuuuuuuucuagcuacauauauucauaaauuauagucaguguaauauuaguauguggauaaugaagucuggcuuuagagaaaaggaguucuuagcuuugguaaaaucaagaaaagaaaggaaugaccauuagcuaaucugcuagcucauuaaaaagguuuugcuucauuguguuuuauguugaaacaagguaucacuguauagcuaagggugaccuugaacuccuaauuuuccugcuucagccauuuuaguguugggauuacaguuguguccccauauacaucuugaaaaaaugauuuuaaaacacugauucauuugcaagccaucacauacuuuaaaacugugacccuuuugauacaacuugucauguuagcuucaugaauuccacacaugucucuaauuccuaguuaauuauuuugaaaugccuuuaacucaaaaggcagaauuuaauugucucaagacauuaacauuugaauuucaaauugucaugauaaauaacgaagguaaauaaguugaggugucgaccuuuaaugcucaccaucugcauggagaaagaagagagcugcaugaguaguguggucuugugcaggugaaugcugagcuaaaggaauugcuuuguuuuuauuugagaugggaucucacaauauagcucuggcuguccuggaacucacuguuuagaccaggcugucuucaaacuacagaaaaucacaaccagguaguguuacauaauggcacaugccuguaauuccagcacuuuguaagucuaagcagguauuucaggaguuuagggucauugucaccaacuauguaaaugugaggccagucuggacuagaaugaaucuauaaaaaaccaaaccaaaacaaaaaugggcuugugagauggcugaaugggcauaggugccugcugcugagacuaaugaucucaguuugacccucaugacacaaugguagaagugguacacauguacuccaacauauacacaaauacacauguguauaacguaaaugaauaaauguaaaaugucaacaagaauaaccuccaccagccaaaaggacaaccacuagagaucaaauaccauaaugauagagauuagagauacucaaggaacguucguugucuuugauuggucuuggcucuuuugagacauguuuacuaucuagccuuggcuggucuggagguugaguaguccaggauagccuugaacucaggauacuuuuccugugccucuggagggcuaagauuccagauguauaccugcauguccuacucugaugggaagauucugagaagaaucuuuggagcagaggguuaaauuuugagaauagugugcuuuuugacugagaaaauaaguuagacuauagagagccuugauuguuaggcaagauagaguaaaaugucugcuguguaaaccacagaccccaugugaaaaccagguguagcagcagaccuuaaacccauucugaugagggucggggaacgguggauuccuggcugucauuggccaaccaguguggcagauugaugaacugauucagugagucacauaaauauauaaggaggggaacgagcuugcauauauauuuaugcaacuggcaucuuacaguugauggcguucucaaagugauaaaaccuaggaaaaaaucaucuacauauaauuugcugagaucaagauuucauaggaaacagaaucaucagaauaaauauaguagcuaauauauguaaaccagcaguuuagucuagaaagcaggcauuucuuuuauucuaauuuuuaccuuuauuuguuauguauguguguguggagggguggugguaagcauaccaugacauauguaugaaggucagaugacaacuucaugaaauugcuucucucaugcuacauucaugugggucccaggucacagagcuuuuauggcaagugccuuuaccugcagagucaccucacugauuggaaauaaugcauuuguaaaacaaugaucuguguuaaaaaucuacuuaguagaugacuuugaauuuccucaggagauuuaguuuuccaagaaagcuguugaaguaugcuaucagaaucuaugggcuguuuuuguagcuuaaaccuuucacuugaaccgggugugguggcgcaugccuuuuaucccagcgcuugggaggcagaggcaggcggauuucugaguucaaggccagccagggcuacagagaaacccugucuggaaaaaccaaaaacaaacaaacaaaacaaaccuuucacuugagaaccuuuacuuauguuaagagguguacauucuuaacaauuagcuacauuuuaaauuugggcugugcuuacccaggccccuguggcugaaugcuuuaucuauagcuauacuguuguguauacuauauauuacauuauccauguauacuacacugugugcuucuuucuuagaugcuauuucuuagaucagauugguaaaaauagaauuuuaaccaaugcaauauacucauuuuuaagauuuuuauuuguuuuuuuuguuuccaaaacccccccaaucacuguucucuugcauagccagcaccuuggggccuauuugccucuuuucgggggguguagagucccuucuccuucuucuucaugggacagucucgcccaaugaccuuuuucuuucuuucuuucuuuuuuuuuuuuuccgagacaggguuucucuguguagcccuggcuguccuggaacucacuguguagaccaggcuggccucaaacucagaaauccaccugccucugccucccaagugcugggauuaaaggugugcgccaccagugccuggccauuuuaaaaauuuugauuccuguuuuuuuuuucugccaucuagaaggacucaaccaauuaccauucuauuacacuguuuuauguuguauaucuucuuguauauuucuguuuuauauuguacaagaaagugaagaauagauucccuuuuuauuuuauauuuauugguuauuguuauuguuuaucuuucagaaaaguuuuucuauuauuuuuuuuuuuuuuuauugauuuaaagaguucuucaucuauaacgugugugaagacugucacaggccaggugugguggcacaugccuguaaucucagcacucuggaggcugaggccgaggccgaggagucauccauugauugggcugugacucuuuguuuaaucaaguuagcauauagaugaaugcauuucauucugaagacucugcuuuaaacacacccaccccccccaaccccccacggaaaaguguuaucaguucuuccuacauauguuguaguuuuacauguuugggugccagagcuugaggcucaguguguccccucccuugagcuacagccauagcccuagggcuuugcuuuacauuuuuuuuuuuaaaucuucauaaaguugaaguuuacuuuuaccagguaaucuaaauucuaaugguuuuuaaaagauacuguacaccauacauaaugauaaugaggauuugccuagugguagcaauguguguggacuuagaucucaaaugagcuagcccuguguggauaacuuugggagcugagugaaggggucuguaagauucuuuacuaauauccauuuuucuuuguucuucugauacuuuucauauguacuaguaugcaaaaacaaugguauacagugagaacucucccucucacagcuguggcaaacccaaagcuuugcuggcugcuuuugaccaauuccaguucuguauccucuggaauuccuuacuguguccauauagccuuguucaucauugugcggcaugcauuucuaguucugguuguagcuaguuuuuauauuuauauucucucugauacauuuuuucuuuuuugucuaggugucccccacuaauggauguuacuuuacacaugcucaauggguaccuccuugccucuaaagcuuaccuuagugcccaucuaaaggaaacggcagagcaagauagaccuuccccgaauaauacaguaggcuugguuggacagacugaugccccagaagugaccagagaagaacugaaaaacgcauuacuggcugcucagguaaaauuugcuaaaguaaaguuucaucaaauggccuguuuguuuguaaauaaguagaugcugacauugugugcuccuuuuauucuagaaucuaaaauaaucuuaucuuugcuucugagugucagguagacccucauuaugaaaacuuaauaugaauaauauagauuuauauuuaucaaauuauaaaccuuuaaccagucuugucauacuucacuugauugacauauuauuggacaccuguguggcagauacuguacaaggacuagggacauggugguaaaggagauauaacuuuuaguuacuuguuuuuaaugaugaaauagaaaaauaaauuggauguuggagacagaccuuauagagaaaaauaaguaaauacaugacauuauaaagugucaggcugccuuccauauaggagcugcaaacaggucacgucucaaguccugcucuguaaagugaaacagagggaaauggagaggcaccugcuagaaucugagagggaggaagggauuuaggcucaagucggcuguaagugguaccguuaauauaaauguauguagugaccuauuaugcuggcuguuuucuuuauccuagcuagguccccaugaaagacacagagagaccaagauguauuuucaaacuuuaccucaauaucuguguagucaauuaucuguucuaaucuccuaaacuaaucuggcuaccccaugccaauauccucauaauacuggcauuuagggcccucuaugcuccagcugaacucuccuguugucuccuuucguccuugacuccuggcucagucuguauuccucuucucucuccccugcccucgauggcagaagucccgcccuguucuugcuucugucagccauugggugaucagcuuuuauugacaaggcagagaauaaaaugguaagaauuuacuugaaacaggagauuuuugacauaagaauauugugucugaaucgaaacaagauaggagagcagagaaaucagcauuugauuaacacaaguauaauuuuuuuguuguuuguuuuuuuugagacaggguuucucuguauaguccuggcuguccuggaacucacuuuguagaccaggcuggccuugaacucagaaauccgccugccucugccuccugagugcugggaauaaagguguguaccaccacgccuggcucaccacgauaauuuuuacguagugcacaaaaauauuaugccuacagucugcuuuggaggccauuggcuuugauuaccugucaaguagauauuuaugaacugaagucugcacuucugccuagugguauacaacccuucagaagaaugccagaugcuaauuuacaugcuguuuuuguuucuuuuguuuuuuucaagacaggguuuuucuguguagcccuagcuguccuggaauucauucuguagaccaggcuggccuugaacucagagauucacuugccucugccucccaggugcuggaauuaaaguuguauacccucaccuccuggcuacuugcuuauuuuuaucuuauguguguaggaauuguacauuuaugucugugcagcauuuguaugcaguggccuuagaagucagaagaggguauuagaaucccuggaacuggaguuagaggauacuuaguugugagcugccauaugagugcugggaauugaacuucuggaagagcagccguguugcuaacaacccagccaccucuagucuccugcauauguuuguuuguauggaaaaagugauuuguuuuguuuauuucagauacaucaggaguuuuuagccuuacaaugugagacccucugcauuguuaaccgcuuacuucugcucuaagaauuaccauauucaugguguugugccauucuguucauaugaaaaucgggauuucauuuucagaucagcuucuccaaggcuccuuacauguacuuuuuuaucugcuuguaggacagugcugcuguccagauucucuuagaaauuugcuugccgacugaagaggaaaaggcaaaaggugccaauucagacaucucccucaggaauacucaaggugucaccaccaucagcacuccaaguaaagaaacagaagaaggagaagacaauuugcucuguaaccuucgggaaguucagugccuuaucuguugccuguuacaccaaauguacauugcagaucccaacauugcuaaacuuguucacuuucagguaugcgcccaaaagaauguguuuggauuuguucuugaaggcucuauguauucaauuaauacaagccaugugaaaaugagaaaggaucauggucuuuugcaauauuuagaaaaaucuaaauuuucaguacugauaaaauauucaaauacuuuaucucuuuucuaauuugucaggaaaguucaauuacugacacauuuacauauauuugguguuuggagcagauucucuagaaaggaagugaagcuucacuuuccucucccucuguccuugacgucuccuuuuccuccugagacaggguuauccaugugaacuucugccucugacagucgcagggaucccgucuaugcacaucuguuuggauuucauaccggagcuuauugcccagccagaacuugaaaaacagguaaugcguauuuuaaaacuugaagaaaauuuugauuacuuuucaguguggcuauuagaggagauauuuuauaaauuuuaucauuuaaacuuuucaaaagauuuaacauguugauuuuguauuccagauauuugcuauacagcugcuuucucacuuguguauccaguaugcauuaccaaagucacuuaguguggcucgcuuagcugucaauguuauggggacuuugcuaacagguguguagccaaucaacaucaacaaaaguaucuaaucacacuuauuacauguauuuucugaacuuuaagacucagcagcucuuauugagacaagauuuuucucuguggucuuggcuguccuggaacucacuguguaaaucaggcugaccuugaacuuacagagauccuccugacuuugccucccaagugcugggauggcaugugcuacuaugguuagcuuauugguggguuuuuuuuuuuuuuuuucggggggugggggguuucaagacaggguuucucuguguagcucuguccuggaacucacucuguagaccaggcuggccucgaacucagaaauccgccugccucugccuccugagugcugggauuaaaggcguacgccaccaacugcccagcgcuuauugguguuuuaaugagucaguaugacaugguauauguuguucuuaucuuaaccuaugccauccuuugaguuacuuuucuuuuuuuaauuccauacuuacaaauaugauuuauaggauagaagaagcauagacaccuuuguuuugggaauguguauauaagaauuuaauaaauauuauauauuaguuauaauacuuuuucaauaaauaaugaaauuaugaaaauaauaucuguagaauuagaauacaaauuagaaauuacuaagugugcucaauuccagaaacaaaaauauuugaaaaugucuuaaauagcugggugguggugguggugguggugguggugguggugguggaggaugccuuuaaucucagcacugggaggcagaggaaaguggaugaggccagccuggcuacagaguuccaggauagccagggcuacacauagaaauacugucucaaaaaaaaaaaaaguaauaaauuaacauauacauuagguauuuccuuaaauucuauaaccuauuccacaacuuacccuguauuuuacccaccuucuaguucgaaaaguaaauguuauaaaagaaaacuacuuuaaaguuaugaguacguuccauccuuuagacaguuauguucuuucucuguguuccuucaauaguuuguuuguucauuuucuuucuauuguuuucaccucauguuacaguaaucuauagugguccaggguuccuguugcauuuaguccugguguuaccacuaacuguuaaugucaccuggaacaagcguuacuuuuuccucaggaccucagauucuugccuugcacgcgcuagacaagaacucuaugcuaaguacuucucuccuucccagccuuggaauuggaauaacguuauuuuuuuagaaacagggccucacuauguagaucaugcuguccucaaacucagagcucugcgugccucugccucuugguggcugagaucuuuuagaggcaugcacaaccacacugggccuuagaacaacuuuuagaacuucuuuaaaguuuucucaucugcacaaccggugugauccacuugugagaacugggugaaauaaugcaagcaguguacuuaucauaguacagggucauaauaaaaaugugggucuuggugaugacuaauuaguagaguacaggcuguuaaaauuagaguggacagcauccuauaaaacuucgucuuccaggggaacaccagggccaagaagugggaguggguggguaggggagcagggcguggggaggguauggggaacuuucaggauagcauuugaaauguaaauaaagaaaauaucuaauaaaauaaaaaaaauaugaggaccuuaaaaacaaagcaaaaaacuuaagucuuuuuuuuuuuguguaggaugccuguguugaauuuauauuugcaacuaaacaauuguguugcuuuucuucccaccaguucugacacaagcuaagcgguacucguuuuucaugccaacucuuccaaguuuggucuccuuuugucgagcauuuccuccacuguaugaggauauuaugucuuugcuaauucaaauaggacaagugugugccucugauguugccacucagacaagagacauugauccaaucauuacacguaagugcuacuucacuuuaauguuucaaacaagacuauauucauuucagaauaucuugccuuaauuauuuucucuccuuacuuuguaggucuucaacaaauaaaggagaaaccuaguggauggucucaaauuuguaaggauccaucuuacaaaaauggauccagggacacuggaagcauggauccugauguccagcucugucauuguauugaaagcacaauaauugaaauaauaaacaugaguguuaguggaauuuaaaaaaaguuuuaagugcagccacuugcuauacugaaucuggacuuuaugagaacucuaaacugaaugagaauagugagaucuuggaauugcugaagugacucaauucagcaugaggauaauuuagagcucucugagaauuauacuuguuugauuggcauaucuuuggaucugcucugaugguauguuuauauuguagcagcugaacuucuuuuccacuggagacacuuuaagaaacuugucacuagaaaaggauugguuccuguacuuagcauuugacgugaagaaagauugccaggccuuuaauuuaauugcuuaaaaaaaugagccuguggauaucccucauauuugugagcuuucaacaguuuucaacaaagagaggagaggaaggagaaagagggauguagggcaggaaccauuuagaaaaaauuaccauuuaaguacacagaaaucuuacagacuuguaaugcaaauaacaguauuacagguugaacuucuaauuuguuagagacaguaguaggauggcuuuaaaaaaaaaaaaaaaaaagcagguaaggcaggugugguggagcaugccuuaaaucccagccuagggagaaagggagaggcaggcagaccuuugaccaggccagccugguucacguagugaguuccaggaaagucagagcuacauaauggacccuguccagacuacuaaaugacugccuuggaauuacagaugaagauacaaagauuucacaaaucugcuucaauuuuucccaauauaugaagccauauguuuaaagagauacuugaauucuuugaaauuuuaagauacugauuguaguuacaguaacaucuuugugcaaagaagaaccugaaaguaaauuucauuuauucuuuuuaaaauuuauuuuuguaauacuguauuaucuaguucucagaggagcaaagauguaucaaauuaaaugaacuuuagagcaauaaaccccaauagugcucuugguucaucagcaggauuauaauucacauuuuacuuugaggagaucuuugaguaagaaaauacaguauuugaaccucaggaaaaauuauaauguggaaaaugcuguguugcugacuuuuucagcccucuguuaggagcuucacguuuaaggagaugcauucagauaaccauaaucauuuuuguaaaauuaaguaccuauauacaagguacuucuuugcucuuugagaaauaccucaaucauaugucacccuacucagagcggaccucugguuaaagaagguaguaagcuaaaaggaaaguuaucccuccccccacaaaggaacuuagcuucauccuuuccucucguacauagucacaucucauuuuucuuugucacuccugacccuaccucaugaagguguucuauuaaaacaaguuuauagcuguuuccaaucaugaaguacaucguaucaugcaugguggaauauauauaacuuuuuauuagaugcuuaauguucaauuaauuaauuuugaugugaagaguaaaagaauaugcuuuaaagauauaccacaagaauuuuccuauuuuuaaaugaggcaguucugaagucucuuaagauuaaauacaacugcucccguuuuguuuguaaaugagaccuuucuggaaguuuuucugugaauaguagaauccuuuaggaauucugaauuauuugaaguauguuuuguaaugaaauacaguacacauuuuguggaucaauuuucaaagacuagucauaaccuacuguguuaaaguaauaacauagccuguuuuucauccaauuuguugaugauguaaauaaaauauguaaauaauauuaguaaauguuaauauucauauaucuuaaguuaagguuauaagcuuugucacaaugugauuuuuuuuauucaagucaaaacagaugugugcaacuauuuuggauauugauuuauaaacauucauucuuuaacaaugaacuguagcuuuuauguuuuauuucacaacuguuaauguaaaauuaccaggagggaguuagaaucuaggacacccuaguucuggggcuuuaauauaucccuuucuuuaaggucacauaaaugaaaggaacccuagaaauuguaguuaccgaugguuaugagucccauaugggugcuaggaauguaaccuggguccuguacaagagaagcaagugcucuuaaccacugguccacccucuucagauccuggagucugcuuuuauaaaacaaauuucacaggacauauuuuuuucuuggaaacagcuuauuuuuaaaaaucauuuuacugaauaaucuauugaacugauaaauuagaacuuguaccccauuacuagacuaaagacuauaaauuuucaguguuacaacugaaacuugucaacugaggaauucacuuuuagauuaugcuuuuaggauaaauuaagggcauugagcuuacuaugucaaagguaauguauuuuauaauuacaaauuccaucauuuuaggaagcugcauaaccaaaagaaagcagggaaaacaaccagucuugcucucuaauuaacugaagaaaaguacuucacaguuuugccuuuuggaguuucuauuaguuggaucaagguuaggcuacaaacaacaacaauaauagaauaucuauuaaaacaaucuaauggccaagaaauuaauuugucaaggucgugguuaaaccccuuauaauugaggaaauuguacuucuuggcaaggaauaaaauguuauguaagguaggugaacucuaguauuagaucgaugugaucuggagagauuauccaucucagauucuauccaagaaagccuugaacaucaagaaauaacauacaaaguaccacaggaccuucucacuaauuuuagcauuguagugacaauucuggugcagucugcauuccucuuucuucccauacuguaaccauggagguuacuugcaugauagacaacaggaaaaagguuuccuuuucguugcaaauuagucuucuaguccuaggggacuagcuguguagguuaaaucauccauuuccaaaagggguacuguaagacccuuagagccuuacguccagggaggcccacucacagaaacagagacggagaucgaugcaacaagcaagagguuuaaugauccagcgcauuggggccauccugcaauuagggcagaggcuacccugaacauuucaagcaucuuuuauacaguucuugggggcagacuucagcaacaguaugaguugguuaaagcuuauuaguagucuguaucgaccuuucucagcauugguuguucuaaguggggugaggucuuuguuaucuucaaaggggaacugaauuaucugcaccuggcccacccugcucugcaguaaaggccuuccuguuuuucugggacauucugggaagaggaauuagucauaauccuucuguacccaaagucuuauuucuggcaagauccuccuucuagcagccauuuugugcuucuuaaacuuucacauuccccccuuuuucuuguauuucagucaugaaauuauagcucauucugacuuaacucuucauuuauuuauuauauguaaguacacuguagcugucuucagacacaccagaagagggagucagaucucauuacggaugauugugagccaccaugugguugcugggauuugaacucaggaccuuuggaagagcagucgggugcucuuaccugcugagccaucucaccagcccccugacuuaacucuugauacuguugucucagcauuauaaucugaacugugcuuauguguucucuaauaaaagcuagcaagcaauuuaaaaugcagggaacaaaaguuaaaagcaacaucaggauuagcaauggucccagaaggauagaaaucagggucgugaagccacggggaaagaguuaaaccaagauuaaaccaccccugguucuguuuucuuucucucuuucuuuucgccagccccuuucucacuuuggccaucgaaucuuuuaccacuccagaguggucuauguagaagcagcauucuucuuuuagggcugcacacagaucuuguuggaggaacaggagauccaagccucuccuauuuuggaggaccacuucugacagcaaggucagagacuccuggagcuuagagauggaguuuuccaucucuacaauaucagcaucuauggcagcccucagacuuugguaacucugggucugcaaggccagugcagaugaucccauagcagccccugccacucccagccccacccccaacaagacugaacuuuucccacacacagucccugcccaguuauagcugacaagguuaagucuggcgcucugcugcugccacugguauguuguggcaucagagugauuuuagcauuuuuauaaauaccaugccuucauaguaaggaggagcuacaucauaaacagagucaacaugauuuaguggcuucaggguuggugcuguugauaauucugaaagcuucuugaacuagaugaguuaaaugagauugcccaggcgauuaaagggaaacagucuccgugauccuuuuugaaggagccacaguaccacgagaauuggguggggguguuggccuggaacuagagggggguguuggccugggauuuaucucaucuggggccaagacuuuguuggggccuaaaggauuguagggggucucuauuuuuaaucugauagugaacaauaaucccucaucauaucuuuccuuauaaagccuaagaccccagguguauccuuuuguccauucuagagcucuuuucccugguucagugaaggugacacggaguggauggcaccagucgguacacucgucuaggucaaauccuccagguacguaagacucuagggaauaguuggcucuuacuuuaauauagucccagcucgaggagggcuuccaguagacuucaccugaagucucacaaccccagcucuugcagaagaagucagucuuaccuccgcauuuuggauugagggacugacuucgguggggcccggggcagacauagaagggguggauucgaagcaugcuucuaucccuuugguuagagcaaccaccccaugggucucuuggauguuuuucuacauacggaggggguguugaaggugcccucugaaugucagaguaccccuccaagucccauccaggaggugcuccuauagccaacuuacagaugucagggaaaaggucaggccaccagguagauggagugguaaccuuggauagacuccaaauagugucuccagccccugauaucaccugccacguuagguugcguggcugguggggaccaaggucugcagaauauaaggagaagaaacuaagauacaguaccaggggaagggcuugcaucuuuggacccuuugacgaucuucacuuucagaggguucuccguagccugggccuuccagacagggugguuuccuggaauucuggucucagcuaagggggcuggcuucacaugugaggcauguauccaggcagcaauuccauccacuuugacagccguuggaguaguuagcaguacuagauaggauccuuuccaauggggcucgagccucugggcacgauguugccucacguagaaugaaucuccaaccucgaacugaugcgaugucuuaggaguaucaggcucauaugcagcugccagcugugaucacacuucucucugcaccagcugcaggccuuuuaaccuggcauacaaaucauuguuacuaugacaagugggcccaaggaugucccccaggaaagucaggggagcaggaguuccauauaagauuucauaaggaaucagacuaaagugggaggggguauuccugacucuaaacagggccaagggaaggagcaccacccagucagcgccagucuccauggucaauuuugucaaggucucuuuuagaguucuguucauccucucuaccugcccuuagcuuugaggucuguaaauacagugaaguuuccaguugaccucuagguacuuggccacucgcuggcuuaccuuggcaacaaggcagggccauugucagaucugauuaccuuggauacuccaaaucggggaaaaaucucuuccauuaucuucuuuaccaccacugugguggucucuuguuuggaagggaaggcuucuauuuauccugagaaagugucuaugaaaacuagaagauauuuguagccauacuugccugguuuuaucucagugaaguccacuucccaguaggcucccagcuuaccuccccgaggucucuuacaggaaggagucagcuuugcuucugcaagcauuuaccuuuuggcagggcacacaaccgugaacuauuuuuucuaccagguguuucaguccuggaauauaauacguagaucuuaaggcaguuugaguuagcuugcuuaccucccagguggguccauugaugcauuugucuuaucauuguccgugcuuguuccuguggcagaaucuuuuuuuccugauggcauauuuccagaguucuuuuuccugaucaaagugcuuguugggauucuuugaaauaacugccagaucuucagcagaguaccagaacuugagucccgaugauccugggucucggaccaccaucacugagcugacucucaaggccacugcucuagccuucugauuugccagauuauuuccucuggcuacagggaagucacccuucugguggcccggacaguguaugauacugacuugcuggcuuaugcaggaucuuuaacaaggccagaaucucaguuuugugcuuaaucucuuuuccuccagagguuagcaguccuugaugcugauagauggauggcaccaugaacauguacuguggcaaaggcauaccugcugucuguauagauguuaaucuucuugucuuccccuaacucgagggccuugaugagggcaacgagcucaaccuuuugggcagagguuccuucaggcagaaccugugcucacacaauuuauuucccaucuacgauggcagcaccugcucucugccuuccucucuccagaaaacucuucccaucagagaaccaaguagccucagcaucugucaggggcugaucagacagaucuuuaugucagcugugugcuucggcaagcacuugcugacagccgugaauggggauucaaggucagggucuggaagcaggguggccagguuuaggcccauggaggaugcaaacaugauucugucagaguuaagcaacagagucugauaugagcauuggugagccacugguugggugguuggcgaaccaugcucuccagagcacauggagcagauaccaccaaguccuguccuauauauaguaaauuuguccaugucuuugaccaggauagcaaccaaggccacgaucgggaggcaugcaggccacccugccaccacugguuccaauuuuuuggacagauacgccauuggccuuuuccauggacccagugucugagucaagacccuuuuugcuaugccccuauuuuuucccacaaacaaguggaagggcuuggugacaucugggagacccaggcaggggcugucaugagggccaucuuaauggcaucaaaagcucgcuguuccuuuucuccccacaaaaaaggcuguuugcucuuggugaguggguauaacagagcugccaucacggcaaauccagguauccacaggcggcagaagcccucugugcccaagaacucucggacuuguuuuugguucgugggcggcggaauguggaauacaguuucuuuacuagccuccgacagccaccucuuucccuccuuaagcagauaccccagguaacuaaccuguugugugcagauuugggccuuagcugaggcacgguagcccaguucuccuaguucagugagaaggcguuucguuccuuccaggcauaguucuuugcuggaagcggccaacagaaggucaucuacacaguguaagagaguuaucuggggguuggcugccuggaacauggccagaucuugguagagagccucaaagguggugggggaggucuugaaacccuagggcaggugaguccaggugagcuggccugucauccccaagucuggguccuuccauucaaaggugaaguauuccugacuucugguggccagggcaggcagaagaaggcauccuugagguccaacacuguauaccaaguucuggagggaggcaaggaacucaacagguuguauggguuagggacugucagguggagaucaguuucucaauuguucacuuccuugagguccugggcaggucgauagucagggaggaguggggguguuccaggcagauugacauuuccacaggauccccaacuggaggaggcacaaaaugugaggucggauuccaucucgagccuccuuagauauaggauacugguggacuguuaucgggcugcauugggcuuuuaggucuaccuggacagguagcugauuuuuggccuuccucaucccugcaguuucugcccaugcccauguggguaauuuugcaaccaccaguccauaucuuuaaccucuuggcuccugucuucaaacaauugauauucauccucuaacuuccuggucaauaccuggaugggcucucuuugauggcccuugacuuguggucccccagggaggaaauggaucugugccccaucuuggugaggagaucucuccccaacaugggguaggggcauucaggaauaacaaugaauaagugggauaccgggcccaugccaagauccacuguuccuuggguaguccaugaguauuuguuucuuguagcccccugggcccaagacuucuuauuagaaauugguccaucaguuuguaauaggacuaaguguuaggccccuguguccacaagaaacuggguggguuucuccuccacuuuaaggauuacccuggguucggggaggggguccgaaccccgucuccccaaccacuguccucuuguauggccagcaccuuggggccuauuugccucuuuucggagguguagaguccccucuucuucuucuugggacagucucgcccaaugacuucuuuguuucuuuguuuguuucuuuguuuguuucuuuguuuguuucuuucuuucuuucuuucuuuuugguuuuuucgagacaggguuucucuguguaguccuggcuguccuggaacucacuuuguagaccaggcuggccuggaacucagaaaucugccugccucugccucccgagugcugggauuaaaggugggugccaccacgccuggcugaucuuuuucuuuacaguaggcauacugauccuuagccaggggcucucuucuguuggcagguacuaucuuacuagguuuucaauuuucucugacuacaguggccaagauccucuggagguuccuuuccuguuucuucucuccuuugaguucucuagcuuccuguuccuucugccuucucuccuccuucuuuucuucugacucuugguuaugauaagccuucucagcuacuugcacuaguuccuuuagagacuugucuuacaaucccucaaguuucugcaacuucuuccuaauaucucugcuagauuggucaauaaaggcaacaguaacuguugccuuaugcucuucacugcuaggaucauaguggguaaacuggcgaaaggccuccaugagucucucuaggaaggcagagggagacucauucagccccuguaccacuucccuuaccuuagucaaauugguggggcagugugcugacccuuugagaccugccaucagagccuggcgguggaccuucaggugcucccuaccuuuagggguguugaagucccaguucggucuggucaaugggaagccugcaucaauauucccuggcaggagggaagggcgcccaccugaccccgggacauguauccuagccucaaggauucgcugcuuuuccucugugguaaagagaaccugaagcaguugcugacuaucuucccaugugggcugaugggagaagugauucaauuaaguuaauuagaccuuguggauucucagaaaaugagggguuaugaguuuuccaguuauauaagucauuggaggaaaacggccaauacugaaaggcugaugaccuuguucauccggggaccauaggccgggaggggcagaauaugggcacccucaggaguugccuccacugucucugagucuccugagcaggucccucugaccuggggagggaggaggauggcgagucccccugauucuccaggcggaaugggcggggccaaaggcccugcagcuugagcugcaugaggagagagagagagagagagagagagagagagagagagagagagagagagagagaggauaaaggggagggagauaaagaagaagaucaguauccgugguggggagaacaucuuucuugggccuauccugaagggcgaagauuggcacagccauugguccugaagaggaaccgggcgaacacaaggagggggaucggugacuaaaucuucccacacuaugauauaugggaccugauuaggguggcucuucgagccagcaccaaaaaugcaccucuugacggacaauauaagaggcagugagaaagaacccucaggaggccauccaaucugaaaggugggccacucugacgagcaaaaaguaaaccauuuauuuuucuucacauuuacugagagauugugagcucuagucuuaaccucccuccaauguucuagaguaaaacucggagggguggaaggucagugucccauucuguccaaaaauaacgucagucccaguccacacacaaaaagaaaaacagaaaguaaaauaccaacgcgccccugccacgagcgccacagaagauacacugaauaacuugguaguggucucuuugccacugacccccagaugaagucgagcccucccggaucucgcggaucggauccgacuucccacucugagagucuggagcguccuccaggacucuucguuaccgcagcguuaaggucgcuucuggcaacccccggcagacaacuccuuugcaaaccgaaaccaaacugacuugcagccgacucaaaauagagggaacagacggaauagacgcgcggaauagacgcacgccaagggcggacacaaagagacacagccgcgguaccugcucgaacaauccuccggucuccugucacuggacccgccagcaggacgauucccggucaaugcaccaaauguaagacccgucuaacgcccauuuugugcuucuuaaagucucacaguacaagaauuuuuuuuuuuccuucaagcaaaugugcggaacuugucccagucuuuuucgcggggugggguuugggggaggggcggugcucgucu

SEQ ID NO: 6258 - RNA, 47973 nt, Mus musculus
gacgucuucucagugcuguacgguggccggcgcgugccagaagcuugggaugaauggaggugcagggugcagguugaacuaagucucugcuuuccccucucuccugguugcuucucccuuuuuuuucccuuuccuuuuuacuuuuuuuuuuuuuuuugcaguguccccauucugauucucgcucugucgacggcacuguuggugccagcgucagaguucuuggugccugagucgacuccgggcauugccgggguuuggggaucuggauaaucaccuaggcccaacuucggaccgcgcucuccauuucugccucgucuggcucucggaggcggaauccgagugggucccuugaggcuggaggguugaucuuaagguaugaagcgucggcuucucgggcccaagugccgcuuugucugaaguccgccugacucuucgcagcccgggucacucgauucucauugcugccuggcagagaccccugaguccugucaccucugccuugagcuuacucuacuguuaaaagaccagcgcuuacuauugaaacagcagcauuucugccuacgauucuuuguccacagcucugcuagggaguaggucuuaagacugaguggucucuguuaacuguuccaugucaccucucuuuucugcuaccuuuugaaaauuuacucaaaaccacagugcccaagugagacucucuuuaacuccuucagcugacuguacauacacaucuaccucuauaacaauagggguacggaauagcguuguggcuuucagaaccaugccucugacauuacuuuuggcccgugagaugauuuaccaguguuuccauguaguugggagguagaaagagaagcccaacugauauuuauauuuaucugguaggcuuguaaaaugaaagagaucuggcugcagccguucauuuucucuccauauuucauggaacucauguaaugggcauaaugagggaagucuuggcuguguucaggguaggaggguucacugggacacaaaguauuagagcaaaugaucucuaaauugagaagaaacauuaaucugcaguuuuccuucuuaucuuccagaugucaguagaaacauagagacagaaaccugagcuuuaauugugccaacaacauugccaaugcaaggaccuacuaaguauuuaguauacuuuguuagauuuuaaagaagguugucauauaugugggaaguagauaccgauuuucauuuuguuguuuuggacuccuuaggaucgagagcgaugacgcccgaggguacaggccugcaguuugucagcccuuuugcuuuugaagcuaugcagaagguggauguuguccgccuggcguccuuaagugauccggaauuaagacuccucuugcccugccuggugaggauggcacuuugugcuccugcugaccagagccaaaguugggcacaggauaagaaacuuauacuucgccuccugucuggaguggaagcugucaacuccauuguugcacuguugucuguggacuuccacgcucuagaacaagaugccagcaaagaacagcagcuuagguaaaguucacuuguguguuaggacuugggaguuacuugauauuccagaggaggggguuguaaugaugcucaggucugucagagcucccccagcaaagggagaguaaugucugagaagcauuugacagaggucuuuucuaguuaaauuccuaagagcugcuuucuguguuauaaaauguugcucagagaagauuagcuacauauuaggucaguuacucugaguggggacugaggaggagaaagucuucuagaguggaagguuuuaugggaaugacugagcuuuuaaaauuacguugcuccccacucccccccccccagacuccaggcugguuuuguauccuuucaugucccuuguguaucugaaagcuauuguuacugaagucuguggcaauuacuaauuuacaguuucugagcucuugcaauauauagacaaacaguguuucggaggaauggaaaccauuuacaaugaguggauuauugcaggaaaggauugccuugccagugucuuaauguguuucccauguuuggacuucacuaggcauaaacuuggaggaggcaguggagagagcauccugguaucacagcuucagcaugggcugacacuagaguuugaacacagugauuccccucgucgauugcggcuugugcugagugaauuguuggcaauuaugaacaaggugcuuuaaaaaaaaccucccuuuucuuuuuucuuuuuuuuuuuuuugcauuuuuuuuucgagacaggguuucucuguguagcccuggcuguucuggaacucacucuguagaccaggcuggccucgaacucagaaauccgccugccucugccuccagagugcugggauuaaaggcauguaccaccacgcccaaaaacucccuuuucaucucacaauauccaugacuuaauauuuacaucuagaaaauaguaaaaagggcuggugagauggcucaguggguaagagcacccgacugcucuuccgaagguccagaguucaaaucccagcaaccacaugguggcucacaaccauccuuaaugcaaucugaugcccucuucuggaguaucugaggacagcuacaguguacuuacauauaaauaaauaaauaaauaaauaaaaaaaaaaaagaaaauaguaaaaaaauaucagcaagaaggcaggcagguuacauguucugcuaguauuucuguuugauuuguguucuuucaaagacugaagugauuuauuuuuuauuuuuagagauagaguuucucuguauaguucugacuuuccuauagcccagguuggccagauccaccugccucugcuauccaguacugggauuaaaggugugugccacuacacccaacuauucaguauuuuuuuuuuuuccagacaggguuucucuguguagcccuggcuguccuggaacucacucuguagaccaggcuggccucugccucccaagugcugggaugaaaggcgugugccaccacugccuggcaggauuuucuuuuuguguguguacggaauugauauaauuguuuuuaagaucaucaaaauaauuuuuacauuuuuauuuauuuuaugugcaugaauguuuugcuuguauauauaucuguguacucucugagugcccggagucugcagagcucagaagagagcacaggauaacuuggacuggagucuuugauugggagccaugauguuggugccaggacccaaaccuagauccucugcaagagggaggagugcucuuagccacugagccauguuuucucuccagcccccuaaacaucugucauuucacuuguagaaaugacuaaguuggauagcaccuuuuuguugggcuugacuuugaaucucuagaacaucuguacaugguguacaucuguaaucuagugggccaugguaaggugggagaccagagaauccuuggaagcuccaggccagguaccuuggugugcacaccaaacaacagaaagagggacccauuggguuagagagaugguuuaucaguuaacaguacuaauugucuuacagaggacuccggcauggcuuccagcccccaccugguggcuuacaaucauccaugacacaggcgaugcacagacaaaucaggguuuacaggaaacacaccagugugaaugaaggacacaaauacauguacacaauaacacacacacacacacacacacacacacacacacacacacacacaaagguaacuuaagucauggaccuuuggcuaaugguuaauugaaacuuucccacacuuaaauuuucccacaucucuuguaaauacauccuggaugugauaagagacauuuucuucuguggugauuuuaaugucuaacauggccuuacuaugugagaaauucuguuacauauuaccauaggaaauuuaaggaacauagagguuauugucuugauguuuuuuuuugucuuuaaguuucugcucccucccccuuugagaccuaucuuccuauuuucuucagaugacuucagacuucuaaucuuuucuuaucucaguuuucugugugcuaagauugcugggguguaccacuguuccaggcucaacguugucauuccuuguggguuuuuuguuuguuugcuuuuuuguuguuuuucccuuugugucuauugaucacuagagguaaaugaauucuuuuuuugucauacugcuuuaacaguuaaaagaguccuuuuauuuugguuuuugaauguagguaugaugguuguguuggcacauauguagaggucagagguuaccuucaugaguucuuucugugcuuccuuccacugugggaucugggagucacacucaguuuuucaggcuuguguggcaacguguuuuuaccugcugaggcaccuugcagaccaauauucgguuuuuuaaucaacaguuuauacauacaacauuucuuuuuuuuuuuguuuuuguuuuuguuuuuucgagacaggguuucucuguguagcucuggcuguccuggaacucacuuuguagaccaggcuggccuugaacuuagaaauccuccugccucugccucccgagugcugggauuaaaggcgugagccaccacgcucguaucauacaacauuucuauacuguuucuuagcuugccuuauccuuuaauuuuaaguaucucuaaaaauguagguuggaaucaauuccucuuaccaccucugucucugucccucucuucuuuuuuuuggaggggggacagaaucuuacuaggugccaggguggccuuuuaacuugagacuuuucuaccucagccucucaaaugcugagauuauacaguagccagcauggaguucugagacuacugcuacuguguguggauaauaaucaugguuaaccuguucagauucugauaggaucccacagacuuugccuccguguguuagccauauuauagguagugaguugaggcugguaugggacagcacaccuuccaucccagcaggagagaagcaaggacaagaugguguguuuuaugccaucguaggucaauagauugaaggcuagcuuggucuguguacugaguucagaccagccauagcuacauagugagacccccaucucaauggcagcauaaacccaugauuucugagcucaaaaagaaaacaauuacaguuuacuuaaacuuguucuuucuuccuuguuuccuucuucucccuaaggugucagagugcaauggagaguucuuuuucaagucuucugagcucuuugagagugcaguguacuuggaggaagcugcagauguccuuuguaucuuacaagcagguacuuuacggacugacugccaagauguagcucaguacagauacagugucucgggaagggucacugugugaccccucagccugcagagcugucugugucugggugugcacuggauguccugagacuggagguacaggcagcuauaagcugccugauggggaugcuggggcucaacaagagcaguauuaucucuccagcucaaauuugguauuuuaaagacuaucaaaacgggcuguggucccaaauuugggacauuaagacaggaguauugcgucaaaauccagaccaucuuggucuacagagcgagaugauaucuuaaauaacugugcuucucaccccaaaaaaacccuuaaaaaucuaaaaguuauuuacuagaaacaugucuuaaaauauuaaauuaaaggcuggagggaugggaagcuugggccucacagccucacagugccccccacgcgccccccacgugcccccccacgcgccccccacgcgcccccccacgcgccccccacgcgccucacgucuuuucagacaguucagauucugaaugacuagcguuagaucagagacgcagugacgucuacuuuuuguacaguuugccuuguuauagagauguuagcaguguacauuuaauuuaaugauuuauaacuuuaaugagcucauaaauguucauaauauguuagaucaaaaagcaaagggcagaggggaaaaauaaaaacuccguuuuaguuaauauuaaaacuacuaaugaggggauuaaacuagauauuaaauauacuuacuauuacaacaauauuaaauacauauauguauuauuagaacuaacauacauuuuucuuauguaccuuuuuugcuuuugcagauucuuuuuaauagguauauaugguaaaauaaaaacaagaaaauauagaaauguaaagauuuuaauuaaaaagcuuuuuagaccagcacuacucagggaaacaucugcuguauuccggguugugcuguccaguuggcagcccccccuccugccucccguggccuguggguuaacugaaguguagcuaaugugacugaggaacuaguacuuaagugaguugcauuuuggugaccucuuggaaaugucuggcuauggaaaagagaacccuguaggggucacgucucaauagauaguggcaguggcuuuuucucuuccagagcucccuucccugcuuccuauaguggacgucgcggaagccuugcugcguguuagaaauggagccugguucuugugucuccugguagccaauguuccugauaguuuuaacgaagguaaauauaauuuaagaaugaauuauuggaaagcuuggauuuugcauacuugggccuuuguuuuuuggacagucuugcuguguucucccagcuguccuugggauaaccugggagucuuuugucucugccuucugaguggggcugguguuaagaggugcauggcaccaugcuuagugcuaugcuuucccuccuucugggcaaggguaggacccagugccuaagcuacagcccagaccagucugucguuuaacugaaguguguagacacgcuauauuagccauuuaauacaauuauuguggugguuagguaugccauguuauuuuugucucuuuccuuuguaucauuuuuuaucauauauuugaguaauguguauuauaaguccagaugacauucuuacugcuuuuauuuuaaguaguuaauucuuuuuuccuuugauuuauuuccuuguuuaguuuguguguguuugcauaugggugugcauguggugcuaagcaucuugucuugcugagcuaugucaccagcaccuuuuucucauuuuuuuuaagcagggucucacuguguagccugguaaccuugaacuuuaaguuaucucccucuucucuguguuaguaucacugugugggcugccaugcccagcugauuuuaaguccuuucucagauguggggagaagcucuagcuguacacuuaguauuucugcugcucuccauugaauugccuuuguuucuuguaauguauaguuuauuuacauuuauuuuuauuuuguuuuuauuuauguguguuuaggauuggacccagagcuacuugcucugccagugaacuuugaaggguagaauucuuggcaacaauuucccccaggauuuugucaggaaaaaauguuuauucugauaaaaucuauuuuaaaaguaaaauagcuuuucuuuucaguccugaggauugagcacagagccuugcacuggucuggcaagcccucugccacuguuguuccucuauaucucuuuuaacgucuucauucugagacagggacucacaagauguccaggcuagacuugaacucacuuuguugcucaagcaggcuuugaacuugugaccuuuagacuugugagccucagcauuguuacuaggcugcacuaaucgcuguuuuguuuucucagcauuguuugcagagccucaucaguguuagccaggugcucuucugcugagcucagccuuaguuuguuguuguuuuccuugugacacugaaucccuauuuagcuccaguuugccuggauucugcuauguuguccaggcuggccuccaauuggagauucuccuccagcucccuagagcugugacuggagcuguguaucuuggccagcuugaguuacuuaguuguucacuaccuuuguccuuguggguuuauaguagcaggugggacuagguguuguccuccagguuguuauuugcgaaucccguugacuugguuucuauugcaauacuaucaaguucccagggucugccuucuacacuguuuaaguugcauaaaugguuaauuuucaagaaugaagaagugguuuauaacaccuuacuuaaaaaggcuuaacaaaacuuaaaauaauaggggcucuuaaaugauaguuuguaggggccugaucaaaaacggagaacggcaggaugaagaaagucucggagggaggcgcaggacagacgcccuacgcuuccuaugcagaaugaauccuucucaggcccugaagguccggggcaugguggugagugagucucuugucucuuuguaacagcacuuuuuauaguaggauuuuucucaagauuguuugagaauccuuuagaaacggggaacuuuauucauauccugaguaugcugccucccucuugggucuuagguuuugugagcucuuuuccucugaacuugaggugcauuaaauuuuaaaaugucccagaccuuuuccuuauuguauugaguuuaacuuauuuuucucucuguguuagguggaagaaugucacuugccaggccuuggaguagcuuugacauuggaucauacuaaaaccgaagcuugugaggauggagugagcgacuugguuugcuuuguuagugguuugcuucuuggaacaaaugcaaaagucaggacuugguuuggaaccuucauucgaaauggacaacaggugagagucacaugaucguagggacgacuccuuagaaggagcuuguuaccuaggccugguggcucauacaggagcuccugcucuuggaagacugaagcaggaggauuacuaugauugcaaggauuacuaugauuaaaagccauaggagucaggcaugguggcacacaccuucaucccaggacccugcaguaggagacaaguggaucucuaggaauuugaggccagccuggucuacauaucaacuuccaggccagccaaagcuacauagagagacugugucuaaaauuaccaaacaaaagccauggugggaaggaggaaacaaaagaaagaaaagguaucuuuagaccagugguugucagacuuaguuuuaggaaccuccugaaagcuauauguuuauauggcuuuugucuuuugauauuucccaauuagaaauuaaaaauuuagaaauacucaguuuauuaaaaauaaaaaacucaauuaaauauaaacagggagggagggagggagggagagagagagagagagagagagagagagagagagagagagagaugugugcaugugugugugugugugugugugugugugugugugucuacuuuugagcugucuugguauuuagucagggcuggcccucaauucuuccuuagacuugagcccaagccuccugauuacaaagaucauaggaaugucccaccaugcuuaguaaauauuacauuuuuaaaaaauacaaguguuuaaaaaaaccaaacuauugaaauaguaguacugcuuuacaguuuuuaagucucuucaaagucuaguuuagcagaagucuuuggagaauguacuguacccuagugagaaugggagggacaaggcaccgucucaauauugugacuagguauuuggacuuucugggccccugaaagaauuuggggaugcucuaguuuccuauguuaggguuuugagaacucuuaucaucaaaguaaguuauaaucuggguuuuucgagacaggguuucucuguauagcccuggcuguccuggaacucacucuguagaccaggcuggccucgaacucagaaauccaccugccucugccucccaagugcugggauuaaaggugugugccaccacugcccggucuauaaucuguaauuuaauauauguguguaugugguaaaauacauaucaaaguuugcauuuauucauuuuuuagauacaguucagaauauucacaguauagggcuggagacucaguagguaaaaugcuugcuauauaaacauaaggacuugacuuuagaaccauaguaaccauguaaaagcagagugugguagcaguugucuguacuuccuguguugggggagcugacacguauauggccuggaggcuuccuggucagcugguguagcugggaugucguguuucagguucagucuaaagacauaauguggggcagcugaaaggguagcccagcaguuaggagaacuuccugcuuuucuggaggacacaaguucuguucuuagcacccguagugggcagcucacagccgccuguaacucugcuuccagaggaucuggugcccucugcagccucccuuuccuacguccauauguacguacacacaggcaaauaaauaaaagauaaauacauauuuaaaaauauaaagugagaaguuggaagacacccaguauuuguuucuggguuguacauauagcuuguguguaugcauguacacacacacacacacacacacacacacagagaaaaggaaccuuggcaguguuaugcauauauagccauuaucuauuuuuaggauuuuguuuucuuuuuuuguggucagaguuuauacugguugguuaagcacucucucugaguucuagccccagugcucugcagacucugaacccacucaacuaccuguucauccuuuuuccuguaaacuggugaucagggcuuuagguuguucugugugaauucugggucccuuuguaaggaccucauaugagucacauuacaggauacuuguauguuauuuccguaacauaaagguuucaagguucauucuugcagcaugugucagaauuuucuuagccaggcauuguuacauauacuuuuaauacuaacuguagcuagaggcaggguuaugggcuagauacauaucacauucucugccagcuggacuacauccugaggccuccuccaccauauagaagcccccccaccccgccccgaaaggaauuuccuuccuuuuuaagguuaaauaauacuccauuguguguauauauucauuuuguuuuucuauuuaccuuuagauauauaucagauauuuuauuguacauaauaauaauuuagugaacaauaugaugcauuauguuuugugguccugggauugaauccagagccucucauacacugagcugcuaaaucucacuaaguugccaagauuguucuugaacuuggcuucuuucucuaaccugagcaguugagguuacaggugugucuugcaguagguuuguuuguuuuguguguguguguuuuguguguguguacgcaugugcgugugcaugugugugugauauaggcucuuucuuuguugccuuggcuguucuggagugugguagcccaggcugacccagucugagucugugcguugacugcaggcauggccuccauugccagcagucuuccccacucaacauggcuuuuuuuuuuuucucuucuuuacuuuuccauuuauuuauuuguuuguuuguauguuuauuuauuguuuguuuguaagcuugcuugcuuguuuuuugagacaggguuuuucucuuugguccuggcuguccugaaacucacucuguagaccagguuggccuauaaaucacagagaucaccuugccugugcccccccccccacccccugagugcugggauuaaaggugugcgccaccaucccccagcuccaccacuuugaacaccuuuuuagugcuucugaguagaauuugcuaguguagagugacuuuuaacaguucagguugaaagagggcagccuguguauggguuagaaacuaguuuugugccaagguaucacaucauucuacauuccagacuuauuuucuuuauaguccacugcuuugcuuuuuaaaaguaaagggaacgcacauguaucgugugacgggcauauggcugugugcugagcagucaguaugcucuuccuguucuccuagcccuuugugcaccacacauguuucuucuuggaauuuaacauugcuguucaggcauguuuauuauacuuuccuuaacagcagucuuaaaaauacuaagcaccgauuacaguuaucugccccauacguggcuacggaaaugucucucuggaguuuagcauuccguucuuguguaugaucuuucuuuguucauuggcuucuuaguaagcauugagugcuugccacuugucaggaacaguauuagacuugaagagugagugacgacuaaaguaucccugccuggagagcugggcuggggugcugccucugagguacagacucucagucauggugucucuaaaggcacguaauaccacuguuuauuuccuugucaagaaggaacuugggguucagagagguuaccugauguaccaugcagcgcguaauuagugggagaacuagagcuuaggacggagguuugcagguucuccaaacacgugcuugcuguugggcugccuuaggcauuggaaguacaguguaggugcugggaaucgaacccaaguccucugcaagagcaacugcucuuacuuaaccccugagccaucuuggaagucuuacuuugaauuuuuuaaacaaguuuuuauucuguaccccggcaguauuggaacuugccauguagacugccuggccuucagcagcuccccugccucugucuccagagugaugagauuuacaagaguggacuuccacacucagcccaagcacuuuuaauugcucuucacaaccuaauuaguacuaaguuagccuuaccucugcaaucagugcaaacuggggugaguagaggaauacauuuugagucuucuugacuuguuaaaauagaacugcaguuagaacaggcuccucauguugggucaacuguaagugcucaugugacaagauccauucagcuuccuuuuaaugcaguaaccgcuccaugcucucuuccuuugccgauuacgcuucuuacagagaaaacgggagaccagugguuccgugcuuuggcagaugagaaggcagcugcuucuggaguugaugggcauucuuccuacagugaggaguacccguauuguggaggaagccgauguggagauggaaccuaccgugucgguguacucggggcugaaggaagagcacgucgugaaagccagugcacucuuacgucuguacugugccuugaugggaauugcuggacucaaguacucaaucugauauuuccuucuuuaucuuuuucuucuugguucucaucucacagaagugaaccaaaggccuuuauuaagaggguucaggucuuaauuuuacuagcuuauaucaagauugaagguauuaaagccagcugucauuaaggaauauuuugaucuaauguggucugguuacaaauagaauuaugcaaauaucagagggacaagaguaguuucuaaguuuuuaaucccaguguauaaagguccugugauuuuaccacacuuaagaagauaccccugagugaccugugagcgauccacuccuguccugagccccaguugaaggaaacccuuuagacuugacaggaacacaagguuucuaaguuacuguaccaaauccuuuggaauaaugaccucagcugguaucugagcauuccuguguguaucuccccucaugugcuuuucaggucugacaguuuagguaagcaaaugcuggcccaucaguuugguucaaauuuaagucauuuacaauccauuaaccccauaauuguauaaagugcaaauugcugugaacucuuuaggacacauggcuacacauaaguaauaugugcucgucacgucuaggaccauugcuauuacuuccuuggaaguuuguugaucacagaacccugauuauugauuugguuuuugcacagacaacaaaguaauuccacuucccauucucugugguaaaucauaugccguguaaaaaggagacaacugaaaacggagaauugaccaauaaagaugaagggguuggggaugggguaaugacucagggguaagaaugcucacucuaggucuggagagaugacucagugguuaagagcacuggcuauucuuccagagguccugaguucaauuuccagcaaccaccugguagcucaccaccaucucuaaugaaauccgaugcccuauucuggugugucugaagacagcgacaguguacucacauacauaaaauaaaugaauaagucaccauguguacaugagaagcaagagauagagcuuguggucagcaggccuagugggggcagcuagcuucugcccgaggcaguaagacagagccccuugcucugccccugcaugcuuacccagacaugaacacccaugccuucgugugugcuacucaccugcagcccucacccagcacccagcauaccacaugccuaugcacgugcacacacacacacacacacaaaguaaguauaaggaguuggauguaguuuuguuacagugcgguuaaaaaguuugcaugugaaggguuaaaauguuggaacauuugauuguuuucuuacugaacuaaaaacaagcaaagaaacaaauuguguuuacccuuucagaccaacugaagaagaagcugagcaguugcugcagcugaugaccagccgaccuccugccacgccggccgggguucgcuuuguuucccucuccuucuguaugcugcuggccuucuccacacucgucagguaccgugcucuacaagucacuccgccuucccaaaugggcucuuaucuacuuaucuaauuguucauguacggacgagcguguaguguagguagcauguucgccuagaaggaguguuacuaccaauaaggguguauaaauagcauauuauuaaaaguuuaccacagaaacuggccaauauaagggaaucaguaucuacuaaugcgagccauuuuauuagucuuugucaauguuucuucugaacauuguuaaagacuaguaauucuuucucuacuuuuuuccuucuuuuaguucuugaguuguuuuacuaguacuuguaaaauuuuuuuuaaauuucuuuuucuuuuuuuuuuuuggagacaggauuucucuguauaguccuggcuguccuggaacucacuuuguagaccacgcuggccuugaacucagaaauccuccugccucugccucccgagugcugggauuaaaggcgugcaccaccaccccagcuuaaaaauuuuuuacuuguuuauuuauuucuuacuuguuuauuuuuuauuauuuguuuaguuagcacauuauuugauugugugaguguguguguguguguguguguguguguguguguguguguguauguacacgcguaugugcuauggugcauguguggaagucaaagaacaacuugcggaacucacuucuucuaccauaugggcuucaaggauugaacucugguuaucagguuuggcugcaguuuuguuuugaauuuucuugguguucuguguagcaauaauucaacuccaaacugcaaaacuaaaucuugcugguugugguguuucaugccucuaaucccaacccacaagagaccaaggcaagaggacugccauguguuugagucuagccuaagcugcaaaguaagaccuugucucaaaauaccaagaagaccacugacacacaaaacacaacaacaaagaaacaagaugcagcuaaaucuccucuggaucugcccugauucauuacacaguuuauugguuuaaucuuuuucagaaaucuugcccagagcaguguugucugcuccagucuuggcugggucccucuguaccugguauucuacagcuguauacaagacuaguuuuucauuuugaaucuuuagaaagcagucaugugggagguaaauucuucagagcaggggugcauuucugaaaaugccaacauucugacauuuggauaaugguuugauggcauguagaauucuaagcgggaaauaauuugaggauuuugaaaguguguccauuuccuugucuucuaacuucuugcuuuguugucauuguccaaagucauuccaguuccuugucccuuuguguggccucuucuaucacugugcagacauguaggcuuggcucuuucucacaugguuucagaaguuuuagauaauauuuggucucucuuuuuuuuuuucuucgagacagggcuuccauguauaucccuggcuguccuggaacucacuuuguagaccaggcuggccucgaacucagaaauaugccugccuuugccucccaaaugcugggauuaaaggcgugcgcaaccacugcccagcuucuuuuuguuguuuuguuuguuuauuugagacaaucuuucuggcuggccuggaauugacuguaguacccuugccgcagcccuccaaugcugggauuacauugcauuacacagccuugucauacccugccccaguucauauugaucuaucacuggagguguccaguggguccuuuccagcuggaaaccaaugcuucaguuguaggagauguucccacacugccgugcugcuagugucuuccccuggggucuccuugucucaguccuuuugugaaucuuucagagcaaccaaccacuggauuuucuuaucucagugcuuugcuccuucuuuuugaaaaccaccauaaaccauaacaacaaaugcacuguccacucgauguagcucaggguuccuugcguguuagccguuaucccgcuauggccgcagcccguuccauguguuuucaccucugcagacagacgcugugccucucgggcugucuguacugcagcuuaauucccaagagcucucuuuuuuguccuuuuauuccuuccuuuacuuaauuuuuuuguuguuguuauucaauuuuuguagaugaucuugucuggaacuuacuguauuguuaagauuguccuucaacuccuaguuuugcagcuuccaucucccauguuuuaagguagcucguuuguugacuuaguucugguacugaacuugcuuuguuacaguagcccuugcuucauugaaggcuacucauuuucccuaaggccuuuuguuaaggaguuuuuauugcauuuauuuuguguguacauguguauguauguggccaugcaugugcccugcacguguguagaguucugccaaugacuugugggagucaguucuucccucacacgggucccagguaucaaacucgggguuuuuuuuuguuuuguuuuuuuguuuuaaccuucugagccuuuucaccaaccuagaaauuucuuuuaaugaaauuauagugcuguucaggaaaguauaauguuaguaaaauuaaauauaaguauuaugugauaacuguaugcgucaggguuuuccgccaggcuuuuguaaccauuaccucuaguccucguuuucuugaggugccauguguguuugguaggaggacuacaggucagaaggauaaacuuagguuucagaucacacccucagaacugcagagaugggauucucacugggucuggcaggccucuaggcacccuccauuauagugcugucuugccuuaguggaaugacugaaaaauaauugagcacaauauuauauuagguauaggaauaaauggccuuuuagauuuucucagcuuagugagaaaagcacacuguucaguuguuuucuguuuucccugcggugagguggaagagagccgugacauuuuuacacaaguuaaagucagagugccuuuugaguuuuagauacaaugauuguucucaagaagucaguacugcugucgggucagugaggugacuuaguggguaaaggcacucacucuggccuuuagcaagccugauaacugaguuggauccccuggacuuacauggugaaggggagaacugauuccugccaguugaccucugaccucuacacacaugucaugcuauauacacucucacaaaauaaauaaguaaaugaaggaaaaagaaaaacuuagaaacuguuauuacuguuacauuuuuauaaccauuuaaaauauggugagcucauauucuuaguuuuuaugauuaguaauaauuucugacuaaaauuuaaaauucuuaaaauucuacccaagauauuuccauaaauuaaauuugaauuaaaagaugcauuaauuuguuagauuuuagaacuugguuucugaauuuuuagugcuuaaggaguuuuuuuuuuguuuuguuuuguuuuuguuuuuuuuuuuuuuuacucguuuuuguucuuuugaaacagggucuuaccauguagaccaggcuaguuuugaagucauagagaccugcuuuccucugucucucaccaaacgugaugcuuaugcuuuaacuuuagaucuuuaaaaucuuuccuauaggaaguaacugguuagcguucuuaauauaguucuuuuaacauuuuaaucccagagaccuuccuuuguuuuuccaaggaauaagagggaaugccacucucuucaauuuacaaauauauagaauugaggagguuuugacaguucagguugaugaaggcaaagucuccaucuuugaguucucaucuuguuuguaguuaguagucaaauucagcaaaccauuaauuugaguugguauuucaaaguagagaagaaaaaaaccuccuaggaaaaauaauuucagggcuggagagauggcucagggguaauaacaguucaugcucuugcagaggcccuggguucaguucccagcaccaacacaguggcucagaagcauccgaaacacuaguuccaggggaucugagggcagcaggcaugcacaugguacaaacaggcaauauucuuguacauaccaaauaagaauaaauaagucuuuaagaaugaggaaaagcugggugcuagugagauggcucagcugguaagagcaccgacugcccuuccgaagggccugaguucaaaucccagcaaccacaugguggcucacaaccaucgguaaugagaucugaugcccucuucuggugugucugaagacagcuacaguguacuuacaaauaacaauaaauagaucuuaaaaaaaaaaaaaaaaagaaugaggaaaagugucuuucagcguguugucgccacgcucuggugacguggugccauggugucucugcagcacgccggagcaggagcagcugauggugcuguggcucagcuggaugaucaaggaagaggcguacuuugagagguagggcaagcagccauuguuccucucaguugagaaagcuuuucuuacuuauuccuccuuggaacucauagcuuuucuucuguuuuaacaguacaucaggugucucugcuucuuuuggggagauguugcuauugguggccauguauuuccauagcaaccagcuuagugcuaucauugacuuagucugcuccacuuuggggaugaagguaauuguuaauuaucuuuuuuucugaaagaaacugugucuaugcuaguuauaguauauaacuauaauauaacuauauauacauauauacauaaagcuaguauaucuauaauguuauaguauaaaauaaauacauuguguucauuuaaguaguuuuaguuguuugcuaguuugaaauuuuacacaggaauuccuagaaaaauaggaauugcauuuauucaaauuuuguguauguaugggugucugugugggcauguguacauguguguagcugcccacagaagccagaagagggagugggagacccagcugccagagucuggguaaccugacaaggaugccguuucuccaggcuucucuuuaguuguugcuguuugagacaggcuggccugaaaucuaugcuggccucaaugguuuuuuguuuuuuguuuuuuaaaucuccuguguagauuuucuaauuuauucuaaaccuuagaugaauacuuauauaaauguaaacacagauagucacacagcucuauccucaaacacuuaguuuauuuaagauaaaacuguggccaaaguuacuuaauaagugagaauuugccaaguguuuaugaguucuaucauaguauuuuuuauagagauguuuccaguuucacuguucacauuaaugcaucagagcccuugguuucauaaagucuuaccaugccuugacaacuccauucuuuauaacuuuugguuuuuaacuuauuuauauacuuauuuaucgagacaagguaaccauagagaucugucagccucugccucugcuuccugagagcugggauuaaaggcgcauaccaccgugccuggccugcaaauuuggcgaagaauggucccucuuuuuuauauuuuacugauuauuaguaaaacuaguuauuccguucuuuuguuuguuuguuuuuguuuuguuucuuuuagaggagguuuuguuuuguagccuggaguggcucacacuuuuaugugauuccccugccuuuucacaggacugcugggcuguagaugugagucaucacacucagcuuuccagacuuuauucuggcucauuuguggcuuuaugcuuugcauugaaaucuuuuuuucucaguacuaaaguacaacaucgggcuucacuugugcuagccaagcacccuugcacuguauguacuucaggucugcaccgacuuuaaguugguccauuugaaguacaguugucuguguagagucauguguguaaaaugugugugugagcuauuuuuuuuuuuuuuuuuggucuccauuuauuggauaaaccuuuucuacucacuaacuuaagacgccaauaguuaguacaauuuauuaaguaauuuuaaaguauuuuuuuugauaagagguuucauuauauugcccagguugcuccugaucuccuggguucuagugacccaccagccucagccucccaagugcgcaugugugcacugcuuuuacuaaguaugcuuuauguugguucuacuucagugucuuaaugucaggcuugagaggucacuuaugagaggaaauuuaaguuuccaacauuaauauuguacaucauaccauuuuggguaauaaauucaugagaauaaacauacuucauacgguuuuacaugcuaccgaaauucucuuaacuguuuuagauugugauuaagccaagcuccuuaagcaggaugaagaccaucuucacacaggagaucuuuacagagcagguacuuccuucuguccuuagcuccucacuaaacuacuuagaagaauaaaguaagucuuuuuuuaucacuuucaauuuguagugguaauuuauuucaucuuuaaacuaucugugaauaauucaucuaccucauuacaaaacaguacguuuugaguugauagauucuugaaaacuuugaguggguccguaagaguguggcuguagauauugguaauguacucuguggguuaaugauuugaauugcucuugagaaaacagagcccuggguagcucuuuggguuguaaaguauuugcaguuacaguacagacuagccucugguuccuuacucuuuuguucacacuuacuuggcuucaguacccuugucucugaguaaauccaagaauauuuuucuuuuuuucuuuuucuuccuuccuuccuuccuuccuuccuuccuuccuuccuuccuuccuuccuuccuuccuuccuuucuuuuugucugucugucugucugucuuuuuuuuuuuuaaacaaaugaggaaccugagguuuaauauaguaugagggcuuucccacaaaacccguaggccgccauuuucaggaggaagcaccaaagcugggcccugugcuguaugucaucuggugggucugguccucugagggccucacaaguggccggacugcugcugcaacccacuccgacuggagacagucacugugcuaccacagauucagccccaaacaaaaucaaauaguuuucuuuuuagcaaaguuauccuaaaaguaaaaauucucaaauucauuugccaauucaaauauaaauauuuccuucugagacaaggucucuggcuggacuggaacuuaauaucuaguaaaccuguaaauucucugaacuuucugcaguccugucucagcaucuugagugcuggcccagcucauauaacuaguaggaaaaaaauuagcauccacagccacccuucaggacaaguaagaauguaaucuuuuauuuuauacauguaaaaauagauucgaaauguagacaagacuuaucuagacccaauuagcacaaauaauacauuuuauauuuguuagcacuucucauguguguuuguuuacuuauuuauuuuuauuguaguuuuuuugguggucaugguagaaacugaacaauaggccuuuguaugcuacacuacugcugucccacugaguuacacccuuuauguguguauguguaaaaauaaacagaaaauuagagaucuuuaccaauuccuagguauauacuccuuuuuuuuguuucuuuuucuuuuuuucuuuuuuaacuguacuggggauugaacucagggaucugcacaagcaucuuaacccugaguucuacuccuagccuuagcuguucaagaguuaagaaucucauucauccuuucuuguagcugagacaacagaugagugcuaccauaucuaauuuacuuaucacguagauaucauaaaagcuuucagguacaagucugcaacucuaacacuccggacaaagagacaggaggaguaggaguucagggucagccuuagcaguauagggccagccugauccacaugagaccuugucuuaaaacaaaacagaacaauuaaaacuuguaccagcugauucucauuguucauccucguggacugcauuuaaguguugauggucuauuugguagucuauaucuuuuuucaagcuaauuuugcauuuguuauguguuuuaaugcuguuguucuauuucagguugucacagcccaugcaguucgaguuccugucaccagcaacuugagugccaacauuacuggguuuuugcccauucauuguauuuaccaacuucucaggagucgaucguuuaccaagcacaaagugucaauaaaaguaugacuucauauuuagauuuuaagcuguaacucaggucucucccacuaguucuuaguuuguuuacuauaguucuuuccugugguuugugugugcauauauauauauauauauauauauauauauauauauauauacauauauauguauauauaugccagcacccacauggcagcucacaacuguguguaacucccagaucugacacccucacacagacauacauucaggcaaaacaacaaugaauguuaaaaaaaacaaaacccaacuucaauuuuuuaaaacaauuuuauaacuuguaauguuguaagcuaacuuacuagguaauaaguuacuacuauaaguagcuaguuacuaguuauuuauauaguuuauuauuucuaagaacugaacuugagguucagggcuggagagguggcucagugguuaagagcacuggcugcucuuccagaggauccagggguuccacccaacuucaaauuuuuaaagcaguauuauaacuuuuuuacaaaauguauaauauuauauuccauauaauagcaugcuuuuacauuuuuuguuugauacaaaauguaucaaacaaaugcaagcuggucuugaacuugaguuguagcugaggcucacagugaauucuugaucuucugcuuuucccauccuaagugcuaaggguaauaggugcgcacuaauauggcuggcccauucucuaaauuuuacuguugcuguuugcaaauuugucaccagcauagccagugccuaacuuauguuuucaguuuuuuaauauuugguuauaucaaaggguuaaaaggucucuuaaugagaaaucugaaauacagaagguaaguaaauguuuuuugaaccuguuauaaaagccuuuuuuacuuaaaaagagcaaugagcaguuuauaugugacauaucuuguuaggugcccuuuugacgcuuuuggcgauuuagugauauuaauuuuuagcuacguugcaucuuuugcuucuuuuugugcuuuuauugaguaagacaguuauggauuaagaguccagauacacaccuugaaguuuugcaugucuccucaccacuagguaagugguaucccauauuaguucuuuucuagucucuggagaaauaucccucugcugggaagucuuccaugacacacagagagcuuuagauagagacaguagggaagguucagaaacacaguaaacccagagccaggcugcucaccgucuuaggcguaucuuucaggagacaguguuuuugguuaaaugauagacugauuaggaaaagagguguaguauauuuuagcuccccaaacuacuggucaguaguacauugaucugaggaacauggcaaagcuauauguguucuacgguguugaucuuuuuuuuuuccaaucgccucaauuuuuuucuuguaggacuggauuuacagacagcuaugugaaacuuccacuccacuccacccucagcuccuuccucugauugauguguacauaaacuccauacucacuccugcgucuaagucuaacccugaagccacgaaccagccggucacugagcaggagauccugaaccuuuuccaggaggucaucgggguaaauaaaacaauaguccuuucaccugucacagcucggccucaguccgucuuuauuccuuagaagucuuauagguaauucugauuuccaaauaagauucauaugugcuaugcacacuugcacauaugcacacauaaaugagauuaaauuuuauuagcuuacuaauaaaaauuauauaauaauauuaguuccaaguaauuugacaaacagcacuuuuugaagauuuuauauauauauauauguauauauauauauguguguguaaaauuuaaauauauauauaauuuaaaaugauuaaauuauauguaucuauauauaucuguaaauauauaucuuaaauauauaguuuugagacagugucucacuuuguagccuggguagucgcaaacucaucauuuugcugagucagcuuccugaauacuggacuaacaggcuugccccaccgugcgcagcacaaggaguuguuuugaagccuccuguuaaaguuuaaugggugccuugaagauagguauuugcuaaaggccugugggauauuucaaccuguccaacguggugggugcucuuuaguuuccuggaaauugagaauacaccuggauucaauuauggaaaguuugauaaaaauuuuuuuccucauuuuguuagggaaaaauagcaguuuucacagacacaguuuaauguacaggauuuuuuuugugaauuguuuucuucauaguaauuucagauagaacuuugauuccugaaagucuuucagaagcagccuggugggaguacuacugagaaguagaagcugaagucuugugacauuuccccucaucugaaauugaggagaggauguuuccuuuugccugucaugcaugcccuucaagguucagugaagcuugaaguugucucagacugcagugaacccagcaguccugcucucggucuagcugggcugaugcagcagcacuggaugaucucucuuaugcgcuugcuguucaguguuuucaccguuuuuguaucaccucagggagacagcguccgccuuacccagcgcuucaguaucacagcgcagcuucuggugcucuacuauauccugucuuacgaggaagcucuccuggcgaacacaaagacgcuagguaagcggcacggggccgagccucuccaguaguaacuuccugauagugagugggucagagcccauccauggaaguccagugaauaggcagcagugagaugcuagggccuucagaugauuuguaucauaucaugggacugagguagucuuugguguuuacuuuagugaaucaaauuugagagagaggaaggcuaacuuagaggguuuggacaauggcauaaauuaguuuggacauuagauagguucucagcaauggaguauagaggauaucaaggagauagggguuguagauaccaaaggagauuucaaagaggacuuagugaggucugcugucugagcucuguuggaugaaccugaaugaggaaguaaaaugaggacuaguguucacccaagggcugcacauagcauguggagguuaguuugcuguagaaugguaggaugaagaccaaauguaaugaauucagaagggagcuggaggacccagugcuauagaccaugagaagagacugcuuuggggaguugccaagggaaagagaagugaugcgguaacugaagugaauaaggucaggaagcgacuugaaaauuauuugugugugugagugccuguguauguaaguacaccacagguacggugcccacugaucuucuggaauuaagagugcaagcagggggcuggcgagauggcucagcagguaagagcacugacugcucuuccaaagguccugaguucaaaucccagcaaccacaugguggcucacaaccacccacagugagaucugacgcccucuucuggugcaucugaagucagcuacagcauacuuauguauaauuauaaauaaaucuuaaaaaaaaaaaaaaaagagugcaagcaguugugagucacugaugugggugcuaaugcucucaaucaccucuccaucucucuagcccugaauuuuuaagaugaaaaagagacauguuauucucuugcuauugagagguguguccugcagagagggguuguugaagccagucucugcaguuacauccuugaugaauaggaagagaugagagagaagaccuuuuccugguaggaaacacccugguuaggcgguuuucucuggucuaguuuuugucuuccaaggguguaaagaacuucacgccauuguugagagguuuuugucaguagccaaaagauuauuugccccaaauauauucuuaccugugauauuauguguaaucucagcacuucacuuuugguuuuauucuuauaagaaacauuagcagccaccugcuagauauagaagcuaggacaggaacucugaaaucugagguagaaucacauauuagauugugauagcuguuaaacuacaucaguguauauucauuguuuauuuaaaaauacuuaugcacaugugcauguauauguauauugauucuaguuaaauccucauuuaaaaauauuuuagagauaaaaauuguacauauuuauauuauuuauagauuuaacuauccucaagaagaugcauaguaaauaaagaauuuccuguguacuuauuacuuaguugaaaugugaauauuccuuguauauuucaaauauuuguaccugaaacacugugcuauuagcugggcauagugcugcacacuuguaucaaaauuaccucaaagcaagcugcuuuucuaguauaaaaaguuucagauguacaauuuuuauuugauuuuuguuuuugaggcagagucucuuguagaggcuggucuugaacucucugcccagcugaauugugccugaacuccucauccucuugccucuaccucccaagugagugguucaaauacaggugugagcuuccaugucuggccacagucuuacuccucaguagcuacaaguacuggaggugcuuaacucacccuccagcuucaugucaccuaaaagaaagucucgccguucucuacucuguccuguuacauguaaaauaugcuucuuggucaccaacagaacaagauucauuguuucauugucugguacuugguaaacuggugcucagguaccaccaugcccacccagcgaggcaauuucaaguggcuaagauuauaguuguguauuuuauuuauuuauuuacucauucauucguaaaauuguuuaaugauauaguuuuauuuuauguacauugauguuuuaccugcaugugugucugugugagggugucagaucccucaaacuagagugagagacaguugugagcugccuuaugggugcuaggaauugaaccccaguccucuggaagaauagccaguucucuuaauagcugaaccauuucuccagcccuuuuuucucaccccaugguguucuguaauuuacauuaguaucauuaagcucuaagucuguguucaugacuucuuuagacuuccuaaauauauguggaaaaaucuccacugaguuuuuuuagugaauucuucuuugcacuaaaaccucccaugauuuuguuccaauuccaggcauuuccuaggucuugccuuauguuuuuccuuuauagucacuauaauuugguuguuaauuuuuaucuguuauacuuucauauaucaagugaauuaaaaguaccuucaaagugucuuuauucccauuuguuuugaaaguuaagauuugucucugauacucuuuuauuuuauacuuuuacugacagcuuccaugcagaggaaacccaaaucauauucuucuucuuuaauggaccaaauuccuaucaaguuucuuauucggcaggcucaaggacugcagcaggaguugggagguauucauuuuucauuugcuaaguuuuauugauaugauauauuuuacugcuuaugcuauaauuuguaguaaguauucauuguuauaaauguaaacaguugaagacuaaagaugcuuuuuguucccuugcugaauccauuaccucauuuccuacagaucacuacccccuagaaaacuccaguuuucaguuugacauucauuuuaauuuuaagucauuucuuuucauauaggaugacccuaauaugauggcugauauuugaguguugggguacagcuugguaguagagugccugccuggcaugugugaugcccuggguucauucccagcaccacacacgacacaugggugcccaccaguacauacuucuuauucccuucaucuuauuaggagcuuauuuggauauaacccuauugcaaacuucaguaugucaaguucaaaaugcauuuguggucaaguaugguggcuuagccuuuaaucacagcccuuggcaggcugaggcagucuggucuacauaguaaguuccaggacagccagaucuacauagugagacccugucucgaaaacagaacaaaacaaaacaaaagguaaaauuauuugccuccucuaagcaacagaauacugaagcucagcaaugcaaugcacuucagcguagugccuguuuucugucgugauuguauggcuggcucacucugaguugcccacugcugcugccuggcauaacaggagaguuucucauauugcuagccuuguacgauuuuagaguaaagccaacuguacuuccuuaacacuguaaaguuaagaacucaucagucuaacugucuaaagcugcagaccuagagaaugacaaguucauacgguugaaacuaguagaagcucacauaauauuuuaaaaagguggaugauauuauacacuaccuccuuuuucucauguuucucuuuucauugagauuugcacucagggcaguaugugaauuaagcuaguacuauaccacugacauaucuucagcccucugccucugcugagauaucagcccguguagaucuacuucauuauuugaaacuguuccauaauauuccaugauauucuaauauguauauaauagucugguuguaaauauugguaaauagaccugugagaguuuuagaaacuugauguuucuuaauagccaccuuucauguaacagcgugguuuuccugucuuucuuugcugugguugguuuggaauacgaacaugagccuucauuggacaugguagccagauagauagcuacauuuauuauagcuuuacauagucuguuucuuuaaaaaacaaacaaacaaacaauauuuggcaguaacauguuuuacugaaaagaguauaauauguagauuguuugcacuuuucugugucuguugguaguaguuuuaguuguacauauguuuagaaauuuaaaguucaguaacacuugauuauuacaaugccuuuuugaauguagaaacaucaguuuuaggcagucuugaugguuaggcaugguggcacacgaaaaucuuaguacuugagaaccuuuuuucucuucugaacuccuaaaagacugcuguguuaaacagcuuucacgaugagugucaaacaguggggugaaguagaggaaagccaagaaagauuagcgcaaggaguuuguuuuuaguuuuguuuuuagguuuuuugagacaggguuucucuguguaguccugguuguccuggaacaaacucuguagaccagccuggccucgaacucagaaaucugccugccucugccucccaaaugcugggaucaaaggcaugugccaccaccgcuuggcgcaaagagucauucuugacauacugugaaguaguuuucuuggggacuuuuauuuaaaaugcuacacagauuuuuuuuuucuuaaauuaaaaaaauuuuuuuugacuacuaauauuaaacuuaggccccuauacacauaaagcaaguccucugucauugaucuauccccucaguccuuguuuugagguaauaucucacuaaguuguccaggcuggcccugagcucaguguguagcugaagcaagauaggacuguacagcuucaaccuucugaaaagcuuggauucugcuccaggccuggcuagaacuucuuaaacuguggucuacacuugcagaagugggcguggcuagagcugggcauggcaucuagagccacaguugagcccuagcugggcauggcaucuucacuaugcauguacagcaaguuuccuuaacucccgaugcuagugggugggccagugaggugagaaacaccguuaguacacaccgcugcuccuuaugcuugcuggcugcuaaaaucaggaggggggagauacuguuuugagaacugagaguccaguuaacuuccuguuuuguuuuuuagggcugcauucagcuuuacuacgucuucuagcaacuaauuauccacaucuguguauuguggaugacuggaucugugaggaggagaucacagggacugaugcgcuguuaaggcgaaugcuccugacaaguaaugccaaaacccacucuccgaaacagcugcaggaagguacaguaaccgcucauuccccucccacuacugcuguacagaggggcugggcagacuggaauccuauacuguaacaagcaggugucuuuggcgguaaggauuucuaaccaucucuuugcuaugcugggaauuucguugacauguuuauagcaguuuuggauucuguguuauaucacuaagaagauuuagaaaauucacaaacugguuagaaauaaauacaguagaucaaggcaauguacuugcuauuaauggguaauguuccagauuaguguccccaaauacaaauagugugggcuacauguuaacauugcauuagcuguauuaaaaaguuucaguucacaagucuucugaauacaauuacacaaucaguguaaggauuguuguuguauaaucuuuacuuguguuugcagugacaauguaggccuuggcgccccacccaaacccaaccugaauuuuuguuguuguugcucuugaauucuuuagcuguuauuucuaagucuuuuucucuuuucccuuuggagcugcagacugaaucugggccuuuugugcguucugggccugugcucugcuacucagcucuacccccagcucuugaggucauugucuuuuuguuuucucuacacaacugaagaaauugugagccaguugucuuugacauguggauuuuggacccagauacaaagugacacgauguucuuuucagcuuuggcuaguuuucuccacauuccuuucagguucuguugguuuuccagggugacguacaugcaugacuaccuguuucccuugaaguauaguugguuggccaugaccggcuagguguagauauagauauaguguuguucaugauggcaacaaaaugaauuaguuuucccauuuguuauuuacuuuaugcauguuagcaggauguaauuagugacacucuaguagagagauaauucuagauauuuaauaacagcaaucugcuggaugcuaaucuucuguaauuggacaccuagaagaaaguaucaaggagccugaaacuuccaaauuaauaaacuacacaagcgguuacccccaaaaaugagguuagcuauugugucacuacuaggauuuuuaaaaugaacuuuaugaaauaacaucuguacuuucauggaguuucacuuauuuuuauuacauucuaauuuauuuguuuaguauauguuuguguggggucuugcacaugccauacugcacauguggaagucaggauaacaugagggagcugaucccauccuucaugugugugcagggauggaacucagcuugucaggcgucacuugccuugaccugcugggccaucaccugcugcuaacugggaaguuuucuaauggcuuuaauguuagcuucagugaaaaaguagcugugaguggaaggcuuucuugauuuguuucauuccuacuuuuaagaaagcagcauuuaucucuacuugguaaacauuauaggauuuaggaaugauugcaaaauguugucuuuagcauuuucagcugucccuguaagucacacacaagugaugcagauuauggaacacuugacucuacuuucugccagugaacuuauuccauaugcagaaguacuaacguccaauaugaaccagcugcugaauucugggguuccacggagaauucuucaaacugucaacaaguuauggaugguucuuaauacugugaugccaagaagguaaauucugucuacugcuuuauggaccagagaaaguguauagcuuugauaaugcacggggaacuuaguuguuagaaaaaugcucacaagaccagucuuauuaauggcuuugaguauguaacaauaaaauuccuuucugaagaugacuaaagauauuacauuggggugcaguguugcuuaucuuuaaucucaucaugaauuuaggaggaagaacaggcagagcuaagucugaggaaggcauggucuguuauaguaacuugucucaaaaaaugguuacauuuuaaagaaaaaaguauacuuuaagaaauaaaaacuauuagcaauuugagaacguguuugaagguauuuuccucuguguaguuauuuguaguuaacugauuuggaucaucaugucuuacaucacugcugugguuccaaauucuguugcacccugaaccauuuggacuggcuuuaaaacccugauucccaggcugcaaucuaugcaguuaaaccugagcggugcagcaggaucaaggcauacguuguaagaacagauuccucuggugcagcagaguuuggagaacaggguaugccuucacugugguuaucaguuggcuggcucacagauugugucaggccagucucgagaccagaacacuggucugacuuagcugagagcaugguuuaguaggucugggaacugcggaugguuguucuuucuaaauucaaggauuuuguugcuaugaauguuuguuuugguuuuucaagacaggcuuucucuguguggcccuggcuguccuggaacucacucucucuguagaccaggcuagucucuaacucagagaucugccugccucugccucucaugugcugggauuaaaggcgugugccaccacuaccuggccuaaauuuaaguuuuacuuuacaucaaauuaauaaauacacauaguaauacuucacacuuuucuauuuuagagucugcuuacccagaggaaaccauuauucagcuuaaaaaaauucuagcauuuacauuuuguuccuuauagcucaggaauaggcuuauaacaaguacggcuucuugauuuucuaauuuagacgugguuuguaaaguuuagcagccugaccggcuuccuuccugugaagcuuucccuuuauuuucuaauauaguuguaucauccagcuagagcaauagucaguguucaucuuaugauuaugcauuuacaguugaacggugcaguauuacaauauccuuugguuaccuuuucucucucuuucuugcuucuuuuucucugaguguggaggggaaucacacucaggcugugagcaugcuagucagguaugcugccccugaacuacacuucauaaacacgucuuucuuauacgcaagugccauuccucaaaguuggcauugcuauaguacuuaccuuguuuucauuuguuaaugcuaucaauaacuaauaaauaguucaucuuaaacuauuaagacuagguuuacuuaauaggaauuacaacagaaacuaaucuaacaguaacaugauuuuuauagggauaucucuuucagagcuuuucaucuuaacccuccccccucccaccaccccgacaugcaugguuguccuagaauuacuguugucucugcuuugcugggauuccaguuuucuuucuugguuucugcccacauagagcacauacuaacugcagcgcuuccugagaaaggcugaaaggggcuggcggaggcuccgguguuggggcuugcuuucuucucacaugugguugcugauuugcuuaagugugcuucauacauuugagaacaccauucugacuuggacuucccacuggcuguuagugaucugguguguugcugguucccagcccuuuguauguagauagccauugguuucuucacucauaaaaggcuuucccccuuuguguucuguguucuggaauuuaaugauguauuggguuuuuuuuuuuuuuuuuuuuuuuuuuuuuuuuuuugguguuuuugagacaggguuucucuguauagcccaggcuguccuggaacucacuuuguagaccaggcaugcgccaccauacccagcuuaaugauguguuuugaguggaacuuuuccucuuucauaguguuguguuucauaguguugguugauuuuuauuuauuuauuuauuuuaaauucuggugagcagugucuugauuuuuagaacuuuuucuuccuggaauaaauuaaauuaugugcauuuaaguguugauaugugcaugugaguaaaggugucugaagaggccagauacuggaucuugggggguuagaguuacaugugguugugagccaccuggcuuggguucugggaaaugaauuccuauccucuagaagaccaacauaugcucuuaaguucugaaccaucucuccaacacacacacaaaaccgcuuauggugguacauucuugugaucucaguucuugggaggggguggaggagaaaucggaaguccugucgucauccugugcuauauagugaguuugggcccagccugaaauacaugagagccuuuuucagaaacaaaaacaaaaagaaaccccaaaguuuauuuuuauaccugcuuugcuuuuuucucucucucuucuucuuuuaucuucaaaauaacauuuuuuuuuuuuuuuuagauacaaaggaccaaauaacuuagaugucagcucuaacauagcuauuaugaauguguuauuguuuccucacuaggcuguggguaaugacgguuaaugcacuccaaccuuccauaaaguuuauacgacaacaaaaauauacccagaaugauuugaugauagauccucucauugucuugaggugugaccgacggguucacagguaaauuauuuaauuucauuuguuuuaauagugcuguacuuuggagaaucaaaagaaauugaagaaaaucauuuuaauaucuuuuuuuuuuuuuuuuuuuaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccucauuuuaauaucuuauugcuguuaggaauauauagguaauauaauuuaugcagcuuuuuuucuagcuacauauauucauaaauuauagucaguguaauauuaguauguggauaaugaagucuggcuuuagagaaaaggaguucuuagcuuugguaaaaucaagaaaagaaaggaaugaccauuagcuaaucugcuagcucauuaaaaagguuuugcuucauuguguuuuauguugaaacaagguaucacuguauagcuaagggugaccuugaacuccuaauuuuccugcuucagccauuuuaguguugggauuacaguuguguccccauauacaucuugaaaaaaugauuuuaaaacacugauucauuugcaagccaucacauacuuuaaaacugugacccuuuugauacaacuugucauguuagcuucaugaauuccacacaugucucuaauuccuaguuaauuauuuugaaaugccuuuaacucaaaaggcagaauuuaauugucucaagacauuaacauuugaauuucaaauugucaugauaaauaacgaagguaaauaaguugaggugucgaccuuuaaugcucaccaucugcauggagaaagaagagagcugcaugaguaguguggucuugugcaggugaaugcugagcuaaaggaauugcuuuguuuuuauuugagaugggaucucacaauauagcucuggcuguccuggaacucacuguuuagaccaggcugucuucaaacuacagaaaaucacaaccagguaguguuacauaauggcacaugccuguaauuccagcacuuuguaagucuaagcagguauuucaggaguuuagggucauugucaccaacuauguaaaugugaggccagucuggacuagaaugaaucuauaaaaaaccaaaccaaaacaaaaaugggcuugugagauggcugaaugggcauaggugccugcugcugagacuaaugaucucaguuugacccucaugacacaaugguagaagugguacacauguacuccaacauauacacaaauacacauguguauaacguaaaugaauaaauguaaaaugucaacaagaauaaccuccaccagccaaaaggacaaccacuagagaucaaauaccauaaugauagagauuagagauacucaaggaacguucguugucuuugauuggucuuggcucuuuugagacauguuuacuaucuagccuuggcuggucuggagguugaguaguccaggauagccuugaacucaggauacuuuuccugugccucuggagggcuaagauuccagauguauaccugcauguccuacucugaugggaagauucugagaagaaucuuuggagcagaggguuaaauuuugagaauagugugcuuuuugacugagaaaauaaguuagacuauagagagccuugauuguuaggcaagauagaguaaaaugucugcuguguaaaccacagaccccaugugaaaaccagguguagcagcagaccuuaaacccauucugaugagggucggggaacgguggauuccuggcugucauuggccaaccaguguggcagauugaugaacugauucagugagucacauaaauauauaaggaggggaacgagcuugcauauauauuuaugcaacuggcaucuuacaguugauggcguucucaaagugauaaaaccuaggaaaaaaucaucuacauauaauuugcugagaucaagauuucauaggaaacagaaucaucagaauaaauauaguagcuaauauauguaaaccagcaguuuagucuagaaagcaggcauuucuuuuauucuaauuuuuaccuuuauuuguuauguauguguguguggagggguggugguaagcauaccaugacauauguaugaaggucagaugacaacuucaugaaauugcuucucucaugcuacauucaugugggucccaggucacagagcuuuuauggcaagugccuuuaccugcagagucaccucacugauuggaaauaaugcauuuguaaaacaaugaucuguguuaaaaaucuacuuaguagaugacuuugaauuuccucaggagauuuaguuuuccaagaaagcuguugaaguaugcuaucagaaucuaugggcuguuuuuguagcuuaaaccuuucacuugaaccgggugugguggcgcaugccuuuuaucccagcgcuugggaggcagaggcaggcggauuucugaguucaaggccagccagggcuacagagaaacccugucuggaaaaaccaaaaacaaacaaacaaaacaaaccuuucacuugagaaccuuuacuuauguuaagagguguacauucuuaacaauuagcuacauuuuaaauuugggcugugcuuacccaggccccuguggcugaaugcuuuaucuauagcuauacuguuguguauacuauauauuacauuauccauguauacuacacugugugcuucuuucuuagaugcuauuucuuagaucagauugguaaaaauagaauuuuaaccaaugcaauauacucauuuuuaagauuuuuauuuguuuuuuuuguuuccaaaacccccccaaucacuguucucuugcauagccagcaccuuggggccuauuugccucuuuucgggggguguagagucccuucuccuucuucuucaugggacagucucgcccaaugaccuuuuucuuucuuucuuucuuuuuuuuuuuuuccgagacaggguuucucuguguagcccuggcuguccuggaacucacuguguagaccaggcuggccucaaacucagaaauccaccugccucugccucccaagugcugggauuaaaggugugcgccaccagugccuggccauuuuaaaaauuuugauuccuguuuuuuuuuucugccaucuagaaggacucaaccaauuaccauucuauuacacuguuuuauguuguauaucuucuuguauauuucuguuuuauauuguacaagaaagugaagaauagauucccuuuuuauuuuauauuuauugguuauuguuauuguuuaucuuucagaaaaguuuuucuauuauuuuuuuuuuuuuuuauugauuuaaagaguucuucaucuauaacgugugugaagacugucacaggccaggugugguggcacaugccuguaaucucagcacucuggaggcugaggccgaggccgaggagucauccauugauugggcugugacucuuuguuuaaucaaguuagcauauagaugaaugcauuucauucugaagacucugcuuuaaacacacccaccccccccaaccccccacggaaaaguguuaucaguucuuccuacauauguuguaguuuuacauguuugggugccagagcuugaggcucaguguguccccucccuugagcuacagccauagcccuagggcuuugcuuuacauuuuuuuuuuuaaaucuucauaaaguugaaguuuacuuuuaccagguaaucuaaauucuaaugguuuuuaaaagauacuguacaccauacauaaugauaaugaggauuugccuagugguagcaauguguguggacuuagaucucaaaugagcuagcccuguguggauaacuuugggagcugagugaaggggucuguaagauucuuuacuaauauccauuuuucuuuguucuucugauacuuuucauauguacuaguaugcaaaaacaaugguauacagugagaacucucccucucacagcuguggcaaacccaaagcuuugcuggcugcuuuugaccaauuccaguucuguauccucuggaauuccuuacuguguccauauagccuuguucaucauugugcggcaugcauuucuaguucugguuguagcuaguuuuuauauuuauauucucucugauacauuuuuucuuuuuugucuaggugucccccacuaauggauguuacuuuacacaugcucaauggguaccuccuugccucuaaagcuuaccuuagugcccaucuaaaggaaacggcagagcaagauagaccuuccccgaauaauacaguaggcuugguuggacagacugaugccccagaagugaccagagaagaacugaaaaacgcauuacuggcugcucagguaaaauuugcuaaaguaaaguuucaucaaauggccuguuuguuuguaaauaaguagaugcugacauugugugcuccuuuuauucuagaaucuaaaauaaucuuaucuuugcuucugagugucagguagacccucauuaugaaaacuuaauaugaauaauauagauuuauauuuaucaaauuauaaaccuuuaaccagucuugucauacuucacuugauugacauauuauuggacaccuguguggcagauacuguacaaggacuagggacauggugguaaaggagauauaacuuuuaguuacuuguuuuuaaugaugaaauagaaaaauaaauuggauguuggagacagaccuuauagagaaaaauaaguaaauacaugacauuauaaagugucaggcugccuuccauauaggagcugcaaacaggucacgucucaaguccugcucuguaaagugaaacagagggaaauggagaggcaccugcuagaaucugagagggaggaagggauuuaggcucaagucggcuguaagugguaccguuaauauaaauguauguagugaccuauuaugcuggcuguuuucuuuauccuagcuagguccccaugaaagacacagagagaccaagauguauuuucaaacuuuaccucaauaucuguguagucaauuaucuguucuaaucuccuaaacuaaucuggcuaccccaugccaauauccucauaauacuggcauuuagggcccucuaugcuccagcugaacucuccuguugucuccuuucguccuugacuccuggcucagucuguauuccucuucucucuccccugcccucgauggcagaagucccgcccuguucuugcuucugucagccauugggugaucagcuuuuauugacaaggcagagaauaaaaugguaagaauuuacuugaaacaggagauuuuugacauaagaauauugugucugaaucgaaacaagauaggagagcagagaaaucagcauuugauuaacacaaguauaauuuuuuuguuguuuguuuuuuuugagacaggguuucucuguauaguccuggcuguccuggaacucacuuuguagaccaggcuggccuugaacucagaaauccgccugccucugccuccugagugcugggaauaaagguguguaccaccacgccuggcucaccacgauaauuuuuacguagugcacaaaaauauuaugccuacagucugcuuuggaggccauuggcuuugauuaccugucaaguagauauuuaugaacugaagucugcacuucugccuagugguauacaacccuucagaagaaugccagaugcuaauuuacaugcuguuuuuguuucuuuuguuuuuuucaagacaggguuuuucuguguagcccuagcuguccuggaauucauucuguagaccaggcuggccuugaacucagagauucacuugccucugccucccaggugcuggaauuaaaguuguauacccucaccuccuggcuacuugcuuauuuuuaucuuauguguguaggaauuguacauuuaugucugugcagcauuuguaugcaguggccuuagaagucagaagaggguauuagaaucccuggaacuggaguuagaggauacuuaguugugagcugccauaugagugcugggaauugaacuucuggaagagcagccguguugcuaacaacccagccaccucuagucuccugcauauguuuguuuguauggaaaaagugauuuguuuuguuuauuucagauacaucaggaguuuuuagccuuacaaugugagacccucugcauuguuaaccgcuuacuucugcucuaagaauuaccauauucaugguguugugccauucuguucauaugaaaaucgggauuucauuuucagaucagcuucuccaaggcuccuuacauguacuuuuuuaucugcuuguaggacagugcugcuguccagauucucuuagaaauuugcuugccgacugaagaggaaaaggcaaaaggugccaauucagacaucucccucaggaauacucaaggugucaccaccaucagcacuccaaguaaagaaacagaagaaggagaagacaauuugcucuguaaccuucgggaaguucagugccuuaucuguugccuguuacaccaaauguacauugcagaucccaacauugcuaaacuuguucacuuucagguaugcgcccaaaagaauguguuuggauuuguucuugaaggcucuauguauucaauuaauacaagccaugugaaaaugagaaaggaucauggucuuuugcaauauuuagaaaaaucuaaauuuucaguacugauaaaauauucaaauacuuuaucucuuuucuaauuugucaggaaaguucaauuacugacacauuuacauauauuugguguuuggagcagauucucuagaaaggaagugaagcuucacuuuccucucccucuguccuugacgucuccuuuuccuccugagacaggguuauccaugugaacuucugccucugacagucgcagggaucccgucuaugcacaucuguuuggauuucauaccggagcuuauugcccagccagaacuugaaaaacagguaaugcguauuuuaaaacuugaagaaaauuuugauuacuuuucaguguggcuauuagaggagauauuuuauaaauuuuaucauuuaaacuuuucaaaagauuuaacauguugauuuuguauuccagauauuugcuauacagcugcuuucucacuuguguauccaguaugcauuaccaaagucacuuaguguggcucgcuuagcugucaauguuauggggacuuugcuaacagguguguagccaaucaacaucaacaaaaguaucuaaucacacuuauuacauguauuuucugaacuuuaagacucagcagcucuuauugagacaagauuuuucucuguggucuuggcuguccuggaacucacuguguaaaucaggcugaccuugaacuuacagagauccuccugacuuugccucccaagugcugggauggcaugugcuacuaugguuagcuuauugguggguuuuuuuuuuuuuuuuucggggggugggggguuucaagacaggguuucucuguguagcucuguccuggaacucacucuguagaccaggcuggccucgaacucagaaauccgccugccucugccuccugagugcugggauuaaaggcguacgccaccaacugcccagcgcuuauugguguuuuaaugagucaguaugacaugguauauguuguucuuaucuuaaccuaugccauccuuugaguuacuuuucuuuuuuuaauuccauacuuacaaauaugauuuauaggauagaagaagcauagacaccuuuguuuugggaauguguauauaagaauuuaauaaauauuauauauuaguuauaauacuuuuucaauaaauaaugaaauuaugaaaauaauaucuguagaauuagaauacaaauuagaaauuacuaagugugcucaauuccagaaacaaaaauauuugaaaaugucuuaaauagcugggugguggugguggugguggugguggugguggugguggaggaugccuuuaaucucagcacugggaggcagaggaaaguggaugaggccagccuggcuacagaguuccaggauagccagggcuacacauagaaauacugucucaaaaaaaaaaaaaguaauaaauuaacauauacauuagguauuuccuuaaauucuauaaccuauuccacaacuuacccuguauuuuacccaccuucuaguucgaaaaguaaauguuauaaaagaaaacuacuuuaaaguuaugaguacguuccauccuuuagacaguuauguucuuucucuguguuccuucaauaguuuguuuguucauuuucuuucuauuguuuucaccucauguuacaguaaucuauagugguccaggguuccuguugcauuuaguccugguguuaccacuaacuguuaaugucaccuggaacaagcguuacuuuuuccucaggaccucagauucuugccuugcacgcgcuagacaagaacucuaugcuaaguacuucucuccuucccagccuuggaauuggaauaacguuauuuuuuuagaaacagggccucacuauguagaucaugcuguccucaaacucagagcucugcgugccucugccucuugguggcugagaucuuuuagaggcaugcacaaccacacugggccuuagaacaacuuuuagaacuucuuuaaaguuuucucaucugcacaaccggugugauccacuugugagaacugggugaaauaaugcaagcaguguacuuaucauaguacagggucauaauaaaaaugugggucuuggugaugacuaauuaguagaguacaggcuguuaaaauuagaguggacagcauccuauaaaacuucgucuuccaggggaacaccagggccaagaagugggaguggguggguaggggagcagggcguggggaggguauggggaacuuucaggauagcauuugaaauguaaauaaagaaaauaucuaauaaaauaaaaaaaauaugaggaccuuaaaaacaaagcaaaaaacuuaagucuuuuuuuuuuuguguaggaugccuguguugaauuuauauuugcaacuaaacaauuguguugcuuuucuucccaccaguucugacacaagcuaagcgguacucguuuuucaugccaacucuuccaaguuuggucuccuuuugucgagcauuuccuccacuguaugaggauauuaugucuuugcuaauucaaauaggacaagugugugccucugauguugccacucagacaagagacauugauccaaucauuacacguaagugcuacuucacuuuaauguuucaaacaagacuauauucauuucagaauaucuugccuuaauuauuuucucuccuuacuuuguaggucuucaacaaauaaaggagaaaccuaguggauggucucaaauuuguaaggauccaucuuacaaaaauggauccagggacacuggaagcauggauccugauguccagcucugucauuguauugaaagcacaauaauugaaauaauaaacaugaguguuaguggaauuuaaaaaaaguuuuaagugcagccacuugcuauacugaaucuggacuuuaugagaacucuaaacugaaugagaauagugagaucuuggaauugcugaagugacucaauucagcaugaggauaauuuagagcucucugagaauuauacuuguuugauuggcauaucuuuggaucugcucugaugguauguuuauauuguagcagcugaacuucuuuuccacuggagacacuuuaagaaacuugucacuagaaaaggauugguuccuguacuuagcauuugacgugaagaaagauugccaggccuuuaauuuaauugcuuaaaaaaaugagccuguggauaucccucauauuugugagcuuucaacaguuuucaacaaagagaggagaggaaggagaaagagggauguagggcaggaaccauuuagaaaaaauuaccauuuaaguacacagaaaucuuacagacuuguaaugcaaauaacaguauuacagguugaacuucuaauuuguuagagacaguaguaggauggcuuuaaaaaaaaaaaaaaaaaagcagguaaggcaggugugguggagcaugccuuaaaucccagccuagggagaaagggagaggcaggcagaccuuugaccaggccagccugguucacguagugaguuccaggaaagucagagcuacauaauggacccuguccagacuacuaaaugacugccuuggaauuacagaugaagauacaaagauuucacaaaucugcuucaauuuuucccaauauaugaagccauauguuuaaagagauacuugaauucuuugaaauuuuaagauacugauuguaguuacaguaacaucuuugugcaaagaagaaccugaaaguaaauuucauuuauucuuuuuaaaauuuauuuuuguaauacuguauuaucuaguucucagaggagcaaagauguaucaaauuaaaugaacuuuagagcaauaaaccccaauagugcucuugguucaucagcaggauuauaauucacauuuuacuuugaggagaucuuugaguaagaaaauacaguauuugaaccucaggaaaaauuauaauguggaaaaugcuguguugcugacuuuuucagcccucuguuaggagcuucacguuuaaggagaugcauucagauaaccauaaucauuuuuguaaaauuaaguaccuauauacaagguacuucuuugcucuuugagaaauaccucaaucauaugucacccuacucagagcggaccucugguuaaagaagguaguaagcuaaaaggaaaguuaucccuccccccacaaaggaacuuagcuucauccuuuccucucguacauagucacaucucauuuuucuuugucacuccugacccuaccucaugaagguguucuauuaaaacaaguuuauagcuguuuccaaucaugaaguacaucguaucaugcaugguggaauauauauaacuuuuuauuagaugcuuaauguucaauuaauuaauuuugaugugaagaguaaaagaauaugcuuuaaagauauaccacaagaauuuuccuauuuuuaaaugaggcaguucugaagucucuuaagauuaaauacaacugcucccguuuuguuuguaaaugagaccuuucuggaaguuuuucugugaauaguagaauccuuuaggaauucugaauuauuugaaguauguuuuguaaugaaauacaguacacauuuuguggaucaauuuucaaagacuagucauaaccuacuguguuaaaguaauaacauagccuguuuuucauccaauuuguugaugauguaaauaaaauauguaaauaauauuaguaaauguuaauauucauauaucuuaaguuaagguuauaagcuuugucacaaugugauuuuuuuuauucaagucaaaacagaugugugcaacuauuuuggauauugauuuauaaacauucauucuuuaacaaugaacuguagcuuuuauguuuuauuucacaacuguuaauguaaaauuaccaggagggaguuagaaucuaggacacccuaguucuggggcuuuaauauaucccuuucuuuaaggucacauaaaugaaaggaacccuagaaauuguaguuaccgaugguuaugagucccauaugggugcuaggaauguaaccuggguccuguacaagagaagcaagugcucuuaaccacugguccacccucuucagauccuggagucugcuuuuauaaaacaaauuucacaggacauauuuuuuucuuggaaacagcuuauuuuuaaaaaucauuuuacugaauaaucuauugaacugauaaauuagaacuuguaccccauuacuagacuaaagacuauaaauuuucaguguuacaacugaaacuugucaacugaggaauucacuuuuagauuaugcuuuuaggauaaauuaagggcauugagcuuacuaugucaaagguaauguauuuuauaauuacaaauuccaucauuuuaggaagcugcauaaccaaaagaaagcagggaaaacaaccagucuugcucucuaauuaacugaagaaaaguacuucacaguuuugccuuuuggaguuucuauuaguuggaucaagguuaggcuacaaacaacaacaauaauagaauaucuauuaaaacaaucuaauggccaagaaauuaauuugucaaggucgugguuaaaccccuuauaauugaggaaauuguacuucuuggcaaggaauaaaauguuauguaagguaggugaacucuaguauuagaucgaugugaucuggagagauuauccaucucagauucuauccaagaaagccuugaacaucaagaaauaacauacaaaguaccacaggaccuucucacuaauuuuagcauuguagugacaauucuggugcagucugcauuccucuuucuucccauacuguaaccauggagguuacuugcaugauagacaacaggaaaaagguuuccuuuucguugcaaauuagucuucuaguccuaggggacuagcuguguagguuaaaucauccauuuccaaaagggguacugu

SEQ ID NO: 6259 - RNA, 92586 nt, Mus musculus
ggucccuguggccgccauuaaagcgaagggaaaacccgugaauucggauuaaagggggaaaaacaccgcccgcugggcccacaaaaugggggagacuacggcguccaggcggugaggcggcaggagagcagacguuaggcaggcuuggcccagggacaacacgaggacacagccggagaauggacugagcccacagacgccgccaccaccuccgccgcugaggagacucugggcuuaaggacaucgccgcugccgggccgggggcccggggugcucugccgguccucgcccuucccgccccuccgcgggcguccccgggccgcggagaacccucccgggcuucugggcucggcccgcucggacucgggcucugacuauuuaucguguaccugauuguuauuauuauuuuuuuguuuuucguuuuuuuuucucuuuucuucuuuuaaaucuuuuuuuauuuuucugguggaagggacagacaucccuuccccuccucuccggagagggacgcgcguccgcgggcuccgcagucccggcggccggccgagcgcggcgcggcccucccgccugcggccucggccccgggcggcugggugccuccgggcggcgggggccgcggcggcgccggggggcggcggggagggcgggcggcccggcggccuccuccccaccgccccccgcccuccccggugucuguguuucucucucuggucggaggcggcgguaauggcggaugguggguuguggcgccggcggcggcugcugugagggacgaugaguuccuccuucgugucgaacggggccagccuggaagauugucacuguaaccucuucugccuggugagugcgggggccgcgggcggugggggagggggccgcgccgugcgcccuugggccgugggggagggggucugggucgcauccagaugccggugucccccggcuaggccccgccggagucggccuccuccgaggcucugcggccgccccgggaggcagcguccgcucaccuaccgaccggggcucugcugggaagaggcuugucuuuccccccacccccucggucuuucuccuccuccugucuuguuuuggacucuuuuccccauccuagucuuuuccuuaacuugggcugcuuaucugcccggauaguaauauuuucuugugugcuucuugcuuccccgccuccccgccccccgccccuuguaucgaacaguguaucccuuuuccacacuuuccacgauugccccugcucgacugccuuuaagcucgcuuuucccuuguaagugggcuucucuuaaacaggacccccccaaaaacuuacguauuaaaacccucuucguuuuguaaguuaaacuaauacagggguaguguccuuaugggugacuucagaucuuuguguaaaaacagugugugccgguucauauguuuucuuuuuaaacuuugaaaacauuuugccauuuugacaauuucuagccaucuugcuuuuauuagaacauuauguuuuugugagaguggaggggcaaguggaggagguacugugguuucgcacuaaacguucuauauuugucuguuuugcuuacguuuuaagaauguuuugagcuggcuguuccuuuuauugaacugaaaagucuggggcagcuggaauuagggauguucuaguacguguauguaggucggcccaaaucggauaacacucaagaguuaagacuuuugucaaaaguaccaacuguugcaaauaucuaguccugaauuaaacgauagccgagcuuccugaaugacuaaguuagagugacuuuuuucauuuuucgugugcucugagaaauauuaagucuaucauagguaagugaauuaaguggguggagcauaacuaguuggcaagcauaaacugccagucauguaucagcaguuucauuuuuggcaccuuaugcuuucugucacuaaguuagaauaaggaauuacugaauuuccuuuguugaaucucuuucacgaugugguaaauggggaucuucagcacacuuacgucuuacagauuagacugguuuucuugacauguccauuaaucagcaucucgucacauguaguaagauguacagcagguuuaacguuucugucuuccccaacuggaucuauuuuuggcacuuuggguuuuuuuuuuuuuuuuuuuuuuugaagcuagauuagcacaaaucugacagcucuuuggaagugguucuuuccuuggagcugugugcuuguggagaauuaacaggcuuuuuuuuuuuuuccuuaagaaaaaaaaaauucagaugguuuucguauuagagccaugacuucuuacaaaccuggaaugagagucuuuacuuuccaguucaccaaggaucaaaugugacugacagagaggacuguaggacagaggaggaggcuagacuuacugugcaggcuuagcaucauugucucauuggucagcucuggauauguugcauuuauuguagacuugcuacucagugacaucuuugauaauuuauguaacaguuuuguguucuuuuccuuaagcucuuguugguugaaacauuagaauucuuugcugugguguuuuugguuuguuugguuguuuauuuuggucauaucuuuagguacuuaagcaugcauuaaaaauagugauguuuuaaugaaaucaaggacuuuauagugaauauauauuuuauauauaaauauauaaauaguauacuuauauuauuauacuuaauaacaaauauuuauuacuuagagugaaugaacaauaauauagauauuuugcuuucuuuuccuucaggccgacuugacaggaauuaaguggaaaagauauguauggcaaggcccaacuuccgccccuauucuguuuccggugacagaagaagaccccauuuugagcaguuuuagucgaugccuuaaggcagauguacuugguguuuggcggcgagaucaaagaccuggaagaagagaauuguggauauuuuggugggguaaagaucccaauuuugcugaccuuauucaccaugacuuaucaggugaaagcacuuuauccuuuuuaacugugccuuagcaauguuguacacuuucccaaugugcuucugcugugguggacggccuugucagccuggaucuguaagaggguugccaugcucuguuucaccaucuuuguuuugguuuccuuaaguuaccuguguagauuccaggagacuugaacucugacugaguuucuuccucuaccucccggcuucuuucuguaauuucucacaggcaguuuguaucuagggaaagcauuuucauuaaccugagaaaaauggaaucuggaagcauguuauuuuuacaguuauauaauagucuugaagccaaguguaacucaccuuugagucuaguuugcuguguucuuuuuugucugaccccgugggcaggccuagaaauguaacuuuguuuggcauagauuuucaaaaguauaguuguauuuuaauauuauuuaugauuauguauuaacucggggaggcauaugcuguuuuugggggguggggggugggagggucuuuagacccugcuucgucaaaggguauauuaguaaggacaagggccaucucauuaacuuuuaaaggacaaaggucauuaucugaaagguuguacagaaacgguuuauuaugagcacaucaauauuucuuuuuuuuuuauuuucuugacuuuuagggccaaauauacuuuagaaagaaacuauagcccuuuaugaaaauuacugguuauguuuauuuuaaacucaguguaaguguaucuuugacuagauacucucggagggaaccaaguucuaguuugauaagaguuuugacagcuaaauugaaaauuuuuaaggucuuuaaaauuuucugugugagcagggaguguagguguggguguagauaugugugccaccauguuguguagaggucagaggacaacguuuuuggaguccugcuucuuccaucuuggugagacaggguuuuacugauuguuuugcccuuaggaagcuuauuucgggccaccuggcccucuuuguuucugacugcuccuaucucugcuccccuucuugguguaggggugcuggaauuacagaugcaccacaucuaguuuuuuuguguggguucuggaaaucgaacugagacugacuaguguuuuuacucuauccccgagccaucucuccugcuccuuaggucuuuugaaaaaaagcuuucuuguaugaaaguuaguuuucugugguuuaugguuuugaacuguaggaucuguuuuauuuuguaugaaauauaauccagaaaucauguagccuuacuuaaauaaauaccuuaaguuuacucacaggguuuagucuucuugauaaaguuggcacagcaucugaauacacuuuuuuauuugagacggagucuguguugccuugaauucaaagcccccuucaagcucagccucaguccugguugguauuacagcugugugcuacucuguacagccuugaacaaaccuuuccauggaacacauuuuaugcccuuugaacucguauuccuucugguuccugcuggaauuagagaugugugccaucagacuaggcuccagauagcucuaucuugaacuaauacuuucuaaggucaacauuuguuuaagaaugcgccuuuuauauauuuuuaagucaccuuuuguuuuuaaugaauucuucagcauuuugagaguggugcaguuguuuuaugauagagcauucuggcuuuccugaaauguuacugaagaaccuaguucuuaguucuaaauauuauaauguguuugugauuuugcuuguuuugagacaguguuacacauaguccauuagggcuuugaaguccugauuuuccugccuccacuucucaaugcuaggaucaaaggugugugcuacuacacuugacuuauacaguuuuagauaguaaagagaugaguguauaucuguaaaugcauacuguguugucugaguguguaucaguagccuucgugccuuuuagcaaggugugcuuucugcuucaugcacuaaaugcuaagcauacagcuuccuuuuccuuucauugacuuaggugagaguuauuuuaaacauugaaaugauucaugaagucaccucaguuaaaguguuuguagguuguuuguuuguuuacuuucuuuuaagugcuaaguauugaaucuugggccauguguauauauuaaccaagugcucuacuguugaccuuuaucccuggcucauuguuaaaauguugauagacuguuuagacacuguuguuaaauugaaauguuuaagcaaacacagucaguguuaaaacuauaauggugcucagaguguuuggcuagccugaguaagguccuggcuuugaacucccaauaccacaagaaauuauaugaauaccuuaagucuaugagaguuuagucuucuugguaaaguuggcacagcaucugaauacacuuuauuauuugagacggagucuugugguguuccuugaauucaaagccccccucaagcucagccucagugcugguugguauuacagcugugugcuacucuauacagccuugaacaaaccuuuccauggaacacauuuuguguaaucaaagauaaguuuaaauacauaguguuuaguuuuaccauagugauucuaauguuuugaagguuaaaagucuauuaaaauagaauaugagcuguuuaauaacaauguauguuguuaaaacacuuuguguagcuuuuuucuucuggauuugaggucaucagaaguguguucuuaagcaaagcuugguuagaguuuaaaguuucuccuuccuucuccuuuagcauaauuuuaaaaugacaauaccugcacucuaauacagauacugauccuugaauauaaucaaaauuuuguugcugucagagucugcugacugcuauugaauagcuaaauauuuuuaucaaaguggaagugacccaaagagugagcacacacacuguugaguagcaugugagcauguccacugucucaaagcuagcccugaacucuugguuuacaaagucagugguauuuauauaauguuuuagcuucuuuuuaaccuguuguuuacuuuagaauguuacuuagaucagacuaucuuaaagaauaauaaggucuuuucagauggaguauauuuaucuugcccuuuuuuuuuuuuuuuuuuuuuuuuuuuuuugcuccagggacaccgucugccucccuuuugggguaauuagugcgccucugugcucuagcuaacccccuuuucauuucuucccaucuguggcacucgguucccuucuuuuaagcucccuugagaagagagcagcuggacaguagggguggcaucagcugcaugaggcaguccugagcuccaaguggagguguagcagugaggaaagaggaccaggaaggacccagguggugacuaagcagcuaguuaauuuggcuugggccugcucuucucagucagugucccucuguuugguucaacaccuacuacuucuuguuacugacauguuugugauuauggaaauauugcccuccuuauaggggguaggaggagaagguaggcaaucauuuuuguaaagauuagaauucucuguuuguuuuuuucccacugauguguucaauaacaaaaccacagaguagccccuuuaucuacucugucucaucuacagcuguuuuuaagaauaauuuucuuugagguaauuuuagauuuauauaaaucuugguaggauagaguagagagugccugugcaucucuuacuuaacuuuuuuuuauucuuaauaucuaugucagaaugauggacuuucuaaaacucauaaaucaguauuguuauacuaaaauaccuaaucacuuggauuucuuuauuuucaccuaguucuguuguuuuuaggagcuggccugggcugccaaaugauauuuaccugcccucuuauuuuuugcucuucugggcuuugacaguuucucggggaaccucccugcuccuuuuugaugauuuugacaguucuaagagucuggugucuagucagguuucgcagugcauguuaaauuuaaccuucucuucugccucacaccauuuaacacauuucuggguuacuauuaaguuuagcuaauguauagacagaaaacauagacugaguaaauuguauucuacacuuugaauuuuugcuuauuuuguaucaguaguacuugaugcuguuucacaaagugauuugggaaggucuggugauuuuuggauaaggauuugugcucauugguauuagcuuaaguauaacauuccagaaagacauuuguuaaagagaaaaaucccuugaauuucaaagccaaauauaugaguuuuuauuguauuuauaggagaauggauaggugaaucuguguugguuuauucugguuacagguuuuugaguuguuuaguagugugugaaugacagauguaaaguugguggugggaaaaucuuagcucacuggcuccugucaauuucuccagugggugugauugauugacucuuuuaaauguacuguuaguuaguucgcuguuuuaaaaagcaagauuguuuuaauuuugcuuggugugucuuggagcaugucuguguauuuuuacucuguauccuaagauuucaaaauuuuauugcagccacugguuuuuauucuuaaaaacaaaacuauucauucucccaagauuguugucuuaaaaaaaaaucauaagguagauucugaugagacuuuggauuccuugaaguaaaaaguaugcugaaucaaggcuaaaauauguguucuuuuuuugugguuuuggaggucucuauauaggaguuuagcaccacauccagauacuuucauuauaguauaguuuuguagugcauauugcuuagcugggucauuauuccagauuuaauuuuggaugcuuuuaucagaggacaucaauuauaguggacuuuaaccuuaacgggcagcuuuuagcagaguugauagacacaaaagcagcaaccuaagacaugcugaagaauuauuucuaucuuuguuuuuuaaacuucauaaauugugucccauuuccuuggcuaaucuuaugagugaugacuguguguaugcucuguaguauccuuuuuugaguaagaaaguguuauuguuuagaucgucaugucagauguaacagucaccucaguaagcuguuuuaaauaaaucuucaaguuuugacccuaagugaaugaugugauagcuauuauuuguuagauagauauuuguugauuuaaugaguuaugaaugagaaauaauuauuaagagagacgcugauuuagacauguugauuuuuuuucaagaaaucuguacuauuuucuuuuccuaacaugcuaauuuuugugucauuccuuauccauuggcauauguugcaucuuagcuguuuagcaaaauuauugggaaaagaugccuuuuuaaaaaucggcugaucaccauggagacauuuaaagaggucauuuuugaggaaaauguugaauauugguuguuaucaacuuuuuugcuuuugauacuaauuuuuuucuaauucauaguuauuuugaugaccuaugacacauccuuuggcacuccuauaaucuguguucuuagugaaacauacagcuuuagcauuugaacuuuuauguuguugcauucuacagcuaaaugugcaaaauuuuuugaguaucacuggugguuaagauuucuaauaccaauaguaauggaaaaguacuaaaaacagaauagaaacuuuguuuucucuggggauuaaagauacgagaggggggggaaacauuuauuuaaaugcauuaagcagacuuuuuuccauuagccucugguuaaguucuaaagugccugcuaaagcuuccauguguucccaccuccuuucuuuccuuguuacagugcugguguugauucaaggagcuuuuaauuaguguaagauaaaagauacacaguacuugucuuaggugguugguucugccguucacuguuuauaucugugaguacaguauguagaaaguacuuuuuguuuuuacaacaucagggaauuagaaacuggauucaguacacuuuuuguuucuaggugacacucuucccaaaacagaaccuaaauuucuuuagacuuuucauuggguauuuuauuaggaauuaguauuucauuagcaaugaaaaauggaauaguuauuuagucacuuaccauguacaugaagguguagaucaggguuguuuuuuuuuuuuuuuuuuuuuuuuuuuuuuuuuuuuuuuuuuuuuuuuugccuuggguggguccuguuuguacuaaugaaaauuaugagcuucugggacaagagccuccugaaagcauuaaguucaugcuaagguucucuagauaaaaguuaaagcaaugagacaaguccuuaaaaauuaauccugcuuucuaaaaagugugugugugugugugugugugugauacaugugcacuacacauauguggagaucagaagacaacuuuguggaguuguuucuccuaaucuuaugcaaguucugaggaucaaacuuaggucaucaggcugucagcaagcacuuuuacccucugaacuaucuugcuggccuugguuagcuaaaccacauuugguauucuuagcuuagauuuagucgaaauagauuuuaaaaaauaaagacuuuuuuuaugacauguaaaaauguauaaacaacuguaaguuuugcuuuucuaaagauuuuuguuuuuaaaugcaaagcaguucauaauuugcugaacaguuuuuaaaauauaaacaacauucauauauuuauuuuugugauuguguaugucuguggcuauacaagugcagugcacacacauggaguucagagaacaucugugggagucuguucuuuccucuaccaaguagguccugggauucaaacccaggugguuaagcuugcugagccauuauuauugguucaaaauaggcuuuuagugaauuggaacuuugugcuuaacacucuuguuuuaaacuguaugaagagguaaauuauucauaaguuuuaaaugaauuuauuuugaauuaaucuagaauaauuaauuuaaaugaauaacaguuuguagcuuagauauguauagaaguaacuguguaucuuaugucuucuuaaaacuuagcaguaguuauaaugcaaagaucagagccauuguguuuagaagguagggaguuuugaagguaacaaaggacauugaacagguggggaauugggagcaguuccuggcauauuucuuuuggaauuaugaacacauguauuucuauuacuguugucauguaauuugagauacacgcuuuaaugaagcuauuugacuuugaaaucagaaguccuuauuaagccaaaagauggguucuuauuuccucuuagcugcucgcacauaugcuugugaucuagaccuuaaauaagugaggucacuaugagccagcuccuuuucucucaggauaucuuuauaauaagaggagacccauaagcaucugagcuguaagugaaguagauaaggaucucuaacauaacugaaugggaaguuuuccuacuuaaaauuacuuuauucuagccugcgaguauuacugauuuccuuuguuuuucuguagaggaacaauauuaguugcuuugaaaggucugacaaugauuugggaaagaacacuugaaagaagaacauacaaucuguguuaaccuuuguaguggcagcuuccaaugcaguucaagcccacggucgcuaugguuucuaguuaauguuuacccugaccauuugcuguaauacauucugaauauaaacugagugccacucuuaauacagcucuguuuuuauucaaaagcucauaguaaauguuauuuuucuagguucagcauguaaguuugugaacugagaaauacuuguccuuucauuuuguuuuguuugaaaauuaaaugagaacaagacaugguggcacaggucuguaaccucagcacuugagaggcucgagaggcggagauagaaagaucuugaguucaaggcuagccuucuagagcaagcuccugucucaagaagaaaauaggugauggugcauaagucggaaauguuuagagcugggagugguagcucacacauacaaucccaguacuaaguacugagacaagaggauugcugagaguucaaggccaaccucgucuauguaguuagcuccaguccaggacaacuggguuaaaaagagaggcaaaggaaaggucauauauauaaagauacaguauauuagaagauuccuaauuauauuugggcuaacaaaauaaaauguaaguugcugaugugguaccuaucauuauuugguacccuugcugaauguuuuguuacagauaaaagaguaaauuauguucucugaacuaugucuagacuuacuagugauugauuucugcccccuacucccuaccccgaaacuuaacuuagagugauuaauagauuuagugggaaauuugaggcuauguaguuagugaagagcaauacuucuucugacugauacacguuuuuauauuuccuccuauacugaauaaucaugugagucauugaaaugagaucuguuugauaauuaacacguugcuugguagacuugguggcagcagcuuccuuuauacucaucacuuaguuuuguaguugagucauagauuagaaugcugauugucaugaaauauuuugaguuuaauuauuaacugauagacuuucugccccuccuccuucagguuaaaugauuagaagaauuaggacaaaguaacaagugagccaguuuagaaacaggcaucauauaguaugcuuaauauuuuccagguuauccaaaucaauacccuuuuuuaaaauacagaaaauaagacuuuauguuuaugauaccauugcuaucuuuuauauuguggaaaauaauuuuuaggcaguuuuguagagcucuuagguauugucaaucuugcaggauaucuuugaaaccugauguuuugauguuuaaagauguauuaaagaacaguaaguauaguggugcguguuuguuaucccagcacucagaagguagaggcaagguugcugucaaguuccaggccauucaggucuaaauagugagacucucaaaaacagacaaacaaacaaacagaaagccaccuccacacccccacacacaguucaagagaucaaaagauugcagcucugcauucugagguaaaggagagagcuauggauauagacauugaucugucacauauuuaguuuucccggagaagauguagucucacuaacuuacuuucuacuugauuuuuuuuucuuuagaagaggaagauggaguaugggagaauggccuuuccuaugaaugccguacuuugcuuuucaaagcaguucacaaucuguuggagcgauguuugaugaaccgaaacuuuguacgaauuggcaagugguuugugaagccauaugagaaagaugaaaaaccuauaaauaaaagguaagcugucuuauuuuccucuuuugauaguugauguuuguuaauuuuaugagauuaauaguuaauauauuuuacaaaacauauucagaaguuaauguuggcagaguacuauagguauuucugucccucucccuuuauucauguaagaaguuucuugcaaugggaaugagcuguauauauguuuuugagaggggguuguuuuuugaguagugucucaccuguggaccugacuggcuuggaacuugauuuguagacuaggcugaccuugaacuccugaugucugauuguguuuuguguaggguugaccuauuuaauuuuuaaagauuuauuuuuguuuugcauguauguguaaaugucuugaauguauguauagcaugugagugccugaugucugaggaggccagaagaggguuuuguauccuuuagaacuggagauagacaugguuguaagcugccaggugggaggugggaauggaacccagguccucugcaagaauagcuaguguucuuaacugcugagccaucuccagccccuaaauuccccaaucuuaaguggcuuuaacuaaaguaaauugguguucugcauaagauguguuuaauuuuagagaaguuaauuuucuugagcuuuaaauuagauuuaugacacagaaaaauaaaaaaguugcagauagagguacauagauuuuuagggcaagcaucucucuuucucuuucucucuuucucuuucucuuucucuuucucuuucucuuucucuuucucuuucucuuucucuuucucuuucucuuucucuuucucuuucucuuucucuuucucuuuuucucucucuccucgucuacugcuuaguguagccuuagguauccuggaacucauuguguagcucaggcuggccucuugcucacagagacucaccugccucugucucccaagugcuggaguuaaaguagugugauaccacugccugaccagauuuguuuuuaauggaaaaaauauguuuuuaguuuuuuaagauaauuguaucauuuuuccuucucuuuucccucucuagcuucuccuaccuuuauucucucuuugaauuuauggacuguuuuucuuuaguuguuguuguguauguaaaacucugggcaugguuuggagugggucuauuaccacagcacugcggggagguggagcuaggaggaucccuagcacuugcuggcugccagccuagcuuuagauuuggucucaggggcuaagauggagagugguggauacacacacacacacacacacacacacacacacacacacacacccucgcugucugugucucugucuagauugccuuucuugugucuuccugucuccccaucucuuuugugguaauagagaucaaauacaugccaggccagugcucuccccacugaguuguauuucuaguauuuaguuguauuuuuauuuugaggcuaccuuucaaaguugcccaaguuggcuucagacuuguaaucuuccugugucagccucuggaguaguugggauuguggcguacugcaugguaaguccagggagauauucauuuucuaauauucuggacauagaccuaguuaauuugucuacuaguuacuaaggacugaaagacaagaaguggagucaccuucuagugcauugaggaaagguauaaagaaccuuucaauuuaugaguaguuagccauggaaucaaauuagucuuuagauaauuguauaaaagaacaucuaauauuuuaucuuaaauaguugagggguuguucugcaguacauggguuuugugcuagucacuagguuugccaguaagauuauaggaaaauuggaugguauaagaaccagugacuugcgaugcuugauuguauauccaaauaagacugucuugagaagaguauuaugaguuuguauuuuguuaaacauuuugucauguugaaucucuuauagccauuuugcugauugggcaguuaaguuuguauauuuggcaagauuuuuuguuuuuucuuuugagccaauucucauuguguuguccauugauuccuggugcaguugaucuuccugccuugccuuucuccuaguugguauuauagauaggcucuacuguacuggcuaacauuuuuuuauccauucaugcccccccccccaaccuaccccuguguguauaugguaugcuuguauuauagcaugagugguuucaugugccugucugugaaggucaguggaugucuuuuagaaguugguuaucuucuguuaugugguuccugggaacagaacuuauugucagauuugguggcaaguaucuuuauccauuuagccagucuccccagccccucacuuagcaaguuucaaaugugucuaggaagauauacaggguagaauuacauuggucuacaacucuuuuuuugagacaacugauaccuuacagaguauauugacauaggagauuuugcuaaguagcagaugauacuauauacaauauuauaaaauuuguagcucagacuggccuggaauaacuguagccuagacuaaucuagaacuugaggugcucuuuaugccucaguguucagaauauugggcuuacgggcaggauuuaccacaucuggcuaauauucaauuuuaauauauaccauaaucuuauccuauacauucaguuauagauauguaacuuuuuuuugaaaacaauauugcuaauuuuguuaguagucuuugacauuuuuauucuauauauauuaguuaucuuuagccucaauuuuaaaaggcaauguauuuuacaaaaccuauacaugugagcaugcauauacauguaagcaugcauauauacacacacagagacagcuauaaauacaggauaaaaaaauucaugguagauauaacaaaaaagagauaggaucaagaaugugguucagcguguucuuguguccugggaaagaaccugauccacaaagauuaagauguucuugguuuuuguuuuguggggaagaggagaggaauaccucaagcauuugugauauauugucguaauuagaauauuaaagcugagcaugguggcacaugucugucuguaauuccagcacuucagagacugaagcugcaaguucaagaucaauccagacuacauagucuuagcgcaccacaacugccccuuaccccucaaaaagaaagaaaaggaaagaacauuaggguggaauauugaaauaaugaugcuuuuuuccccuugaagguguuuuacgucuguacuguuuacuguaauagccacuagcuugcugcuauuuaaauucaauacauugaaauuaagauaaaaaauuacuucuucaguuucauaagcuacacuuauuuuauauaauggcuguuguuuaguauaauaauguuucagagauggggcauuucuaucauuguaggaacuucuuuuggaugauguugccuuuauaacuaacagugcuuuuaguguuuuauacaagcaguuggucaaguguuuuauuuuuuuaaucaguaggcagaagaauauucuuauaugcuuuaaauuccauaauaaaacuguuuauuccuacaugguggcuucugcauuaucuccugaucuccaaaauuaacuaaaaguaagcaccaugauauguaaaucucuccuggaaaggaacugggagcaguuaguagguuuaggaugaucuuuguuccuuggcuaucuuacuaccucugaacaggugaaggugguaagaggcauugcuaugcguuguucuuguuuguucagaggggaucaugcuuauguagccuagccuggccuugaccugggccuguaggcaugcauuacuaugucuccuuuacaaguauguuucuuuucuuugugucucuuuaguagcauaaagaaauaggaugaacuugagccacaugcauaguguaaaauuucuguuacaguguuuuguuuuuuuuccagacggggauucucuguguagcccuggcuguccuggaacucacuuuguagaccaggcuggcuucgaacucagaaauccacuugccucugccuccugagugcugggauuaaaggcacgugccaccacgcccagcucuguuacacuguuaacugagcuuggugauguguuugacaggugugugugugugugugcgcacacgugcugaguaaaauaaacccaaaucaggugaaacuaauuuuaagaauauuuuagccaggugugguggugcacgccuuuaaucccagcacuugggaggcagaggcagguggauuucugaguucgaagccagccuagccuggucuacaaagugaguuccaggacagccagagaaacccugucucgaaaaaacaaaacacaaccaacaaacaaacaaacaaaaaagaauauuuuacuuaguuugguacacuugaaauacuuuuuagaguguaagucuauuaccucugagauaguuuacauuuuuuguaugugaggccuuugaaaucuaguguguauuuucuccucagagcacaucaugauuuggauuggccauaguccaaaugaucauaaugacacggugauuguuuaacagcuagauucuagggcuuuaaacuuagcuuguuaauguuaguugcuuauugcuuauuggugaucucuuccuggaacagauuuuguucuaaguugugugugguagagucccaaagguuccugugccaaagcauccacuguugcccaguuaggcucguuacuucagacuguccauuuucccuuucuguagguuuucuaaacugaucuguucuuacugaguuugaucuugcagggugguauaauagcuauaccuugauguguuuuguuaguucauaaaucauuaggauuuguauagcuuuuaacauuuucaucuuuccaggacuauuuugagaagaauuaaauccuaagaaugacuuucacccuuuucacuuuuuuuuccuuacugcuauuuucuacuacaguucuuaguauugacucaaacaaucuuuuuucaugauuguuuuuagaugcuaaugagacuuuuuuuuuucugaaaugagggagaaaguaagggggcauugccuaaguaggacugauaaggcacuguucagaguuaagaguuuaccauaaaugacugcagaucuuaaaacaaucuaucuagcuuuauacauaaugaaauguaaagcacauagcaguucagcgacuccuucccacaguacuacacaggacuaaggguuggaguugauuacugggacaugaaauacaagagaacuucuaagcccuauuaggcagauguauauuucauacacuuacaucuuuuuaaagaguaguagugaguaguaaaagcagagaauagcgaaaguauuaaagauuucaaacuuuauagaguaauuguuuucuaaagauuuuuuacuauauaauguucaguaacguguucauuaaauguguagaaauaauagaagauucagugauaacaugcuuugggauuuuaaaauagauacuuuguucauggagauauauuaagaauguuggacauugcugauuaacgguagcuugcaauguuguauggaaacaaccuagagaauguccaaagauuauugauauuagggcuggugcuguagguaguggagaacuugccuaagcacgaagcccugaguucagucuguagcaccucccugcauuugggagauggaggcaggaggaccaggaguuuaugguugauuacauggugaguuugaggucagccuguuuugcaugugcuccuguaaucaaucaaucaaucaaucaaauuauugcuggugcugaugucuuaaccugagccuguuacauuggugaaccuuaauguauaaauuugaaaguuauuagcugggcauagugaacguggcuuucccagcccccuaggaagcagaggaaggugaauuucugugaguuugaggccagccuggucuacagggagaguuccaccacagccagagcuauagagugagagucugccucaaaaccaaaaccaagaaauaaacuauaaauaaauaaauaaauuggaaaaauaaaauuaaaaaauagaaaacuauugaauucauggaauaaaauuaaucugggaauuuaagauaacuagguuuaaaauauuauaaaaacacguguaacaaaauuaaucauuuuugccuuuuuuccaguauuucagugguauuaaggaaauugacauggugguacaauugacaucuucuacccuuuggucccuuuguuuuuauuuuuuucccucaagguuuguuuucuuguuuucuuucuuucuuucuuuccuuccuuccucucccucucccucucccucucccucucccucuuccuuccuuccuuccuuuuauuagauauauuuauuuuauuuauaugagcacacuguagcuauuuucaggcacaccagaagagggcauuggaucccauuacagaugguugugaacuaccaugugguugcugggaauugaacucaggacaucuggaagaccaagcagccagugcucuuaaccccugagccaucuaucgccuaacuuuuuuguuuuuuaaugaguguuuuaagcaccucauauaagugaaaguauauauuuguuauuuuguaucugacuuauuucacuuggcauaccuucaaguuuuauccacauuguagcaugugggagguuuucuuuuuuuuuccuuuaagacuaaacaauaacucauuguucauguaguguauuguguacuugcucauugacuggcaucugagucacuucucauuuugacuguuuguuguaaacacuagugugcuuuccuuaggucccuguuugucauucuugugguuacacacucagaagucaaauugcugcauuuuaugauaauuuuaauuuaauuaucugaaaaauugccauacuguuucucacuguggcuacaguguuugacauuuucauuggcaauauuagaguuucaguuucacugcauccuuaacaaugcuuguuauuuacugguuguuuguuaaguaaccauuuuuguuggugugaagugguaucuucuguuucugauguguaguuccuuaauuacuauggcuauugagcauaguuucuuauuggcugcuuauauauugucucuggaaaaauacccaacucugucaaauuuuaauuguuaggauuaguauguuuugcuuuuugugagucaguacuuugauuuugugacguauacauguguguuuguguauguguagaauuaguagauuaaucuuggagaucaaaaccaggguucauaugugcuagacuacugcuguacuacugggccgcaucccuagcuguaagcuuuugauuuuaaaauaggucauagcuuggugugguggcgcaugccuugaaugccaacacuagggaggcagagguaggcagaucucucugaguugaagcccagucugguuuacauaaugaguuccaaggcagcaaggacuacauagacccuguuucaaaaauaaaaacaauuacaacaacaaaaccaagucauagaacccucuuugggccucaaauucucuaccagcaaaauggaagauuguuauuucuauagcuuccuaacacaugcugagaacagaucauuugcuccauagcacuccacacacaggcaugugcaugcauuuauggaggcacacaucuguuauccugugaucuugguacuucggaagucaaagcagaagaucucaacuuugaggccagccuacaggacaaguucagugcuagucugagcuacauacauuaugagaccuugcuccaaagcaaguaagcaagcaagcaagcaagcaaacagaaaccuuguuacuagaagagcugacuuucauguuuugcuuuuuugagaucacugugugccaggcugccuuuuauuccucugcuuccuucucccuaaguacugcaaugucuagcccuaauggagcuaacucuuugaacuugaguaugucuucuucaucaucaucaucuucuucuucuucuuccuccuauuuuagaaaauaaucuuuuagggggccuaugagguaaaggcacuuggccaccaagcucgaugaccugaguuugauccccagaaugcaugugguagaaggaaaaacugacagacaccuacaaguuguccucucacuuccacaaguaugccauggcauguucauagaacauauacacauacauauaaaacaaauaaaacucugaaauauagcugaggaucguuucugugacauaguuguugaggauuuaccucugauuuuggccucauugauaaauaguguaaacaucuuagaaaacaaacaguagucuuuaaaguaucuaacaguauaaguccuuggcuugucauuguaguuaaagacauuuguuuacuuuccccuagugcuaauuguaggugccucaugggaguauacuauaaaugauaacauuucucucugaaagaagccauucugaguuuaguauguaagugcuaaccuacaggucucuguacuguaauauucuugacuagaauauugcuuucaauauaagaaucuuaaaaauaugaguccuauuuuagaucacuucucccuaauaucauacacaagcuugguuuauaaaucauauuguauggaaguaugaagaguauauuggggucauuugcuagcaguaugggaaggacgguuuuccuugcugggacuaagaaccgcucauacacaggguauuguuaauaggcaguaggaaguaggcacagugcugcaugacuuuagaauauuagcuuugcauggggauuccuugguagcuaguuuauuacuuuauaucagaaagcuaguguuuuuuucuaauuuaaaaguuaaauggggccgggagugguggcgcacgccuuuaaucccagcacuugagaggcagaugcaggcggauuucugaguucgaggccagccuggucuacaaagugaguuccaggacagccagggcuauacagagaaacccugucucgaaaaaccaaucaaucaaucaaucaaucaaucaauaaauaaauaacacacaacuggggacccccaaaccaaaaaacaacaaaaguuaaacagggacagagagauggcucaacaguuaaagguacuugccaucaagccuaaugauugaguuucgucuuagagacuaauguggaagaggagaacuuacaucuccuaguuguccucugaucccuauaagcacauauacaccacacacaaauaaaauaagauuuaauuuuaaaguuuacauuaaauaaaguguaauuuaaaaagagaauuaaggcugggcagugguggcacaugccuuugaucucagcacuugggaggcagaggcaggcggauuucugaguucaaggccagccuggucuacagagugaguuccaagacagccagggcuacacagagaaacccugucucgaaaaacaaaaagaaagagagagagagagagagagggagagagagagagagagagaguguuaaauggccaaaugcucauugcauauagguuguuagggaauuugagagguuggccuucaugcuuccuuuuuguuuuguauugagaagugggacacgugucccacauuaagaacuguuucacccuuggugacacgauuagagccucuuuaguuuauguugaagauuccugacuuuggcuguguggacacacaugagcacaugugcuaguacacaugcacucacacacacagucuuacuggaaaguuaccaaguaaaggguuuuuuguuuuuguuuuuguuuuuguuuuucgagacaggguuucucuguguagcccuggcuguccuggaacucacuuuguagaccaggcuggccucgaacucagaaauccuccugccucugccucccaaguggugggauuaaaggcgugcagccaccacugccuggccaccaaguacaguuuuuauaaaggaaacggaggaggugaggaaugagaaccaauaaugaaaauuuacacuuauauuaaauuuagaauucuuuuccagguauuuauaaauuggcagggaauuaaaggaauuuugaguugauuaggguguggagacaagugugugguaaauaaaggaggauuuguggguuaaguaucaugguuuacaagguuuggcaaggaucagauucuaaagguauuaaugugcuaugcuaaugcuuuuggauuuaguccugaacauuuuagggagccagugaugauuuuaggcuuuccaguuacaugaucaugauuagauuuuagggagauccccagcagcacugugaagcaaggagauaauguaggagauucugauaacgucucccuaaaagacagaguuggauguaguaguacacccugcaaucccaacacuuaggcuaaguaagacaaaagguuccagaauuugagccagccuugguuacauagcaauucuaggccacucugggaugcauaguaaaacauaaagaacaaaaaaguauacuuaucagguaauaacacccccaaaagacauguaggucuauaaauuacaaauauguagaguuaaaucuguaggaauugguagaaacagggaaugauggaacaaagaaaaauuuaagauuguauuauauuuaugguuuagaguauuauauggagcauagauuugaaaauagacuugaaugguuaguuauaaauaaguucagauaccgacuuuauucuauaguauuuaguuuguaucagugcaccagauugcuaugugucaaagacuuacagcaaacacaguauagaggaaagauaaauuuuucuuucacuaauggucaccuucugggccagcuaugagaaauacguaauaauacgauggugguguguccuuuagcaaaaacaccccuugccccccccccaaagagcaauuagaaacaguauagauguauagauuuguuagugaaguacguacuuagaagauuauuugaacagagucccaaagaaggugauuuuagaggguuuaagaagaagacaaacacugaggguacgaaggcaguccugauuaaggaaacuggaagacuggacccacagaggugguaugggagaacugaugacucuugaagggagguggauggcugucaccaugggauaugggaacaaccuggggaucagauccaggcucugcucucuuuuuaggaaugaaaauuccauuuucaguacagaguucuucauguuaaggcauucuuguaacauccuauacuuguuuuuugucucauagcaccuaacaucacuaaguucaugccuuaguacagugcuuaacagaaaauauuaguuggaugaaggaauaacauuugcacucacuuagaagguucauauguacugcauaugggugugaaugcagcacuguuuaguguagagcuguauuaagagucugugugugugugcgcgcguguacuuaauuauuuuuaaacaucguuuggggauaggcuugugcucaguauguucuugauagcacagguaccucacuauugcuaggacacuggauagcagcagugcuggauaacuucaauaaaauugagugcuuuagaugagcacuagcaauggauguuuuggaggugaacagcugucagagcuauuaaauuucuuuacauaucuuggcuuaaugacuaagguuauacuccuuuaucauaguaucuguauauaaucuucauaauuccucagcuaaaaccuauuccaauaaaguaagcauuguaaucagaggaaaacaaguuuaacuguuaauccuggagagauugccgagugguuaagagcacuaacugcuuuuccagaagacccggggucaauuccuauaccaucuggcagcucgcagcugucuguaacucugguuccaggggaaucagaugcccacuuuuggccucugagagcacugcauacaugugauacacagacacauauguaggcaaaauauauacauaaaauaaaauaaaauaaauaaaucuuuuaaaaacuuguuuaaauguuguaucuuggaucagauccuuaaucagaaaaaaaaaaaaaaaaaaaaaaaaagcuuaagugguuaauccagauaaugacucguucaggucagugccuuagaaauagaguguggcuucugaaaacuacuaauagauuggggaccuccuauagugucucuuuauuuuuuaauacauuuuuaauuauucugauauguaugugauuacauguacaaaaacuaagcugagcauggaggcacaucaguauaaucacaguacuugggaggcagaaagcagagauuugggaguuuggggcaaguccagacuauuaagaccuauuucaaaaauggcagcaauaaucacaaaacauaagcacagcaaacuugcuagguaagaaagauguagugaucaagaacuaauuaguagaauucacaauuucagaaaaguugaaaaaauuguaauauaaauagaaccuaaugguauuauaaaacuuauucccaguucaaauaccucaaucccauuucuauaagaugucugguuuuauuuuuuugcuucuuguuuaguucucauaauuaaugccauagcuccagagaaucuuauaauucuaggccucaguuuauaaauuucagacauuguuuauuguuaauugauaaagacaagauuaauuugaugucagcugcuuuggcuuuguauuguguuuauuagugaaacaucuagacuagucaagugcaauagugaggaaggaauaagagaacaaaguugacccuugugacccaugugaguaguugaugcaguaacccacccucacaccagcuucugucagguacuuuagugacuuccauaacacuuucagguucaguuucuucuuuuggcuuuagacauguugacuccuacuaucugauggaauucucaguucuauuacuuucuacuuuaaaaaaaaaauugguuuuuaaggcaggguuucucuguguagcgcuggcuguccuagaacucacuccauaaaccuggccuugaucucacagagauagguucuacugccuuuugacugcuggggucacaggugugugccaccauuggcuuuuccguuuuauuacgauuuucuacugauuuuaggucucuauauaacuuuuacuauaauuuaauuucuuuaugccuuuuccugaaaaauauuaaauagggcuaguguguguauauauaguauguguauguauuauauauugguuuggaguugauuaauggucauuuaaggaacuggcuuuaagauggaugcuuaaggcagaugugugggaaaagauuauuaguguauacugccccaaucccuuuucucccucuagauuuucuuacccuuuaauuucagaauauaucugcuguccuugagaauguauuuucuagguucugacaaaaugaauaggccaucucuccuaccuagcucaugugccucagcccugagaguuuauuuucuaauuugcuuucuugacuuauuucuguggucauguaauaauugcauaugguauaccuaacuuauuuuaacugguuucuuaaagcuauuugcauuaugaauaguguugugaauacuuuaucuuugcugguaauggauacuuucucucccccuacagauaauaaagacuucugagcuaauguauucauuuuugugguuuaacuucuuaauaaagcaaagcauguugaguugguaauauaauucauuuaguagagugcuuggcuuucaugcaugagaccucauguucccaggauccagaaucagauaaacaaggcauuggucacacaugcuugcaaucccagcacucaggagguggaguuaggaugaucagaaauucaaggccauccuugacuauauagugacuuucagaauagccugagauauauggacuucugucucaaaauaaaaugaaacauuaaaaacaaagaaaaugauuuuauucuauuuuuuugcuauuaaucaucacuaaacuauaacuuuuucuucuuuauuagugaacacuuguccugcucuuucaccuuuuucuugcauggagacagcaauguuuguaccaguguggaaauuaaccaacaucaaccuguauaccuucucagugaagagcaugucacccuugcucaacagucuaauagcccauuucaagguagauuauuuuauugccauaggcauuugauuucuuauucucauuucaguauuggagauuaaaacuuucauguuagcaacuauauuaguaagacaacaaaauuaguaccauuagugaaauuauuuaaaauucguaugaaugggaauuuucacauuucuguguuuucuccugauagcauauuacauuauggauauguuagucauuucaaggcuuuguguguaagcuguguuuagcauagcuacccaggggaacuuuuaaugucauuuauaucaugaauuguugaccucaagagaaguuguuuuauaagguugcugauugcuuuuuaaguacuggaaguaucuucuuuaauuuuaaauguaguguguguuuuaaaauuuauguggcaguacuucauaaauauuuagauuuauuuaucuacauuuucuucaaguugcuuagagucagaauaaauugaauaauagguaaauauucccaguucauuuugaaauaugauuauauuuugauuuugugguaggcauauuuuaagcaauuuucaaaaucuuagcguuauauuuuauauuaaaauguauaauaaauuuacuuucuuggagugaugauaauagauuuccuuuuuuauuagucuuacaucauuauaacacuguuuaugauuuuauuugcuguaaaucuuuacuuacuggauaucugcuuugguuucuaguuaucuuaaguccauuuggacuaaauggcacucucacgggacaggcuuucaagaugucugauucagcuacgaaaaaauuaauuggugaauggaaacaguucuauccuauuucaugugguuugaaggagaugucugaggagaaacaggacgauauggauugggaagacgauucuuuggcugcgguggaaguucuuguugguauggauucugauacuagucugaaggggguccuguguguuuagauuuuacuaaauaacaaaccgcucucuuggcauucaguaccaaacaguuauuucuugcuuauuuccucugcacaucacacaagggcuacagcuuggcugugaugacugucugcauguucuuccuguacaguccagguuaagaagcaccuagggucugggacacaguguuccuaggaaaacaagggaaugacagggaucacgccugaugaugaaagugcauuaaaguuucugcugagaugaaaaugagcuaaaggaaugguacauuugcucccagugaauuagacaagacugguuaccuguccaagccagaguuacugggacagaggaacaugcuuuguuguccacauguuauagaagggaacaagauuaauugugaaacaguuauuauuugggggcuagaaaaauugacagccuguauuauguauagugcuugaauauuuaauaaaacuuucaguaacagaaaauauuccuaaauaacuucuggcauugguguguucuccauaagucaguucuuuccagauuagcuucaguucauaugucauguuccaggugcagccaggaaggagaucugcuucugaguauauuaauuacauagcagagacaagaagaaaagaggcugcaccgaucccucugagcauaauucacuuguuaagauguggcauacagucaagccugauaguguauaaagacauggaaggcauggacaauguauaauucagcagauaauuggaauuaguaucugugauacuguaguuaaagcaaucuaauacaaaugucucauguaaggguuacccuaugggaguuuuggaguuuuuauuaggguuugcccuguaacccagguuggccuuggacucaacacucaaccuguucaaccuccugaguccugggguugcagauguauaucacuaugcauggcuuuuuuaaaaguugaaacuguucucauucauuuucaguaaauucaugaucuauuauuggaauaguuaugacagaaacaguacagaugauuacuagacuuuaaagacaagaugguccaugaucuuaaguguccacauuaccuuuauuauguuuauaaauuaaaauuuauaauacagugcacauugaucaacuguacauacauagauuuuuaaaacucaucauuacaguagaaaaucuauagcuuauugaauuaaaguacuuaauauacaagucugaggaugugauuuuuggauuucaaaaucugcauggaacccaaauacaguauuguauuuaucuaauuccagcacuccuauggcaggaugggaggcugagauaggaguagaccugcaagcucacagacuaguuaguuagcauggcauauacaguagccuggagaacuuguccuaaacuagguggaaaguguacacugacaccugaguuuauccucugcaccauagcacguguauagcuaugcucagagacggauacaaugauauuuuuauuuacauaaauauaacauuaggguaauuuuuacugcagugcuuuuuaaugaaaguaauucaauuucugccacagugguagcugauuuguguuuuuuucccuuguuuuuguccauuuuguuuucagcggguguccgaaugaucuacccagcaugcuuugugcuagucccucagucagacauuccugcuccuagcucugugggagcuucucacuguucagcuucuugcuuggguauccaucaagugccugcuuccacaagagauccugcuaugucuucaguuacucucacuccaccuacaucuccugaggaaguccaaacagguauuaauuacacuagcugcuucaucaaucagcucuggcuacaaaucuguucuuuugaguacaucagcacuuagcaauuuuuauuuugaaauuguuaaaauuuacuagaaaacugaaaguauaauguaaaaaacucaucuaaauuuauacuuaacuuuucauguucuguguauguauccauugucuucucugaacuguuagagaaaaagcugcagacuuggcaccuuaugauuccuacauauucauugcauuuucagaauuaagaccauucucauacagauguacauaauacaaauacaugugcacucccacacacauuuuguguauauguguuugcccaugaugcugguaauuaaacccaggaccuuauauaucucuuauucaagauaccuuguauaucuuugcucucugcauuuaaagaaaaaaaaauuuugaccucagaaugucacuagaauuacaaaauagagcaaagauucgaggaguuaacaaaaacuccaacuuguuacuuucaguuuguuuuuaccuuucuauagccucugguuuuguguuuguuuucaguugauccucaguccgcacagaagugggucaaauuuucuucaguauccgauggcuucagcacugacaguacuagccaucauggugggaaaauacccagaaaauuagcaaaucaugugguggauagagucuggcaagaauguaauaugaacagauuacagaacaaguauguaucuuuauuucuauuugcccaucuaucuacccacccacccaccuauccauccaucggucuauuugucuaucuuucacuguguaacuuuggcuauccuggcacucaguauauagccgaggcuggucuaucaaauucacaaaugcuuguccucccaagugcugagauuaaacggauguaccaccauguucaguuguauauuuauuuugauauuuaaaacuugcaugcugcuuaauaguauggaauaaaaacagaaaaauuaaauuuuaaaaauuaaagauuaagcugggugguaguggcacaugcauuuaaucccagcaaucaggcagcagagacagaggcauucucaucuucuuuguguuugaugccagccugguuuacaaacugaguccaggacagccagggcuacacagaaacccugucuugaagaaaaaccaaaaaauaaaaauaaauaaauaaauaaaacuuaaagcugaaauucaguuuuaauagaaauauacuaaggaauuuguaacucacacuucacuucaggaggaaguauucugcuacauccagcggccugugugaggaagagacugccgauaaaauaggaugcugggacuuuguugaagccacacaaagaacaagcugcaguuguuugagguaaguuuauuucuaauuggugaugcuuauauguaugcauauaauaauaauaauauuuguuuuggguauuaugcaaauauguuaggauuuuuuuccccaaggagaaaauugagaaaagauagccaacaauuucaagcugauuagagaaguacagagaauuuauggcuuauuuuuuucuuuauuuuuuucagaugugggcuauguaucaacuauagauauacuuuuggugguuguuuugaggcucuuaacuacugcucuggcugacuuugaacuugagauuuucuugucuuagcaucuagaguacuaggaucacaguucuggccaccauccuugggucauacaucucuggaggaacacauuccuuacuugcguuaugucugagaaaucuucccugggauuuuuauagaagaaauaauuuucauaauuuuuaaaauaguaaauacauuguugaguuucguguagcagguuguuguucuugggcaacuaucagugaguuacuaaaauaagaucaagaauuacugaucuuacaggagacuugaccaaaauaucagcuuucuaauuaacugcauuucugaagguuugguagcagaaugguuugacuugggauucuuugggcaauugaacugauuucauauuuugagaccuuuugauaaaauuugauuguaaggcuuuugucaaguuuauuacuuuuuggcguauuaaagguagauuauaugcuuuuaccaccacauaauaauaguggcuuugguaucuguuacuguacuuugugauuggauauguaccuaucccuguuuucccaugaaaaucaucuaaaggaauggagucccuccaaguuguggccaagguuguagguuuuuuuguuuuuguuuuggcuuuuauacauuaacuggguuuacuugaauauauugacagacucuuaaguguugugguauguuucuauguagauuuaaguuuuuacuuaguuuuuuugggggguugagccaucuaauuuuugaaaggcaacacuguugaaaacuuguaucuguugguagauuagaauaaguauaugauacauuaacuaauauuuaacagauuaaacuaguuaacuacaauuguucuugaacauaauuuaagaacagaauugacaacuuuuguuuacuugguuaaauguaguucacucccuguuuuguuguauggccuaugagcugaaaaugaaagggccuaacuugguggcacaggccuuuaaucccaggggaggcagaggcaggcaggucuacaaagcaaguugcaggauagcaagggcuguuauacagagaaacuuugucuugaaaaaaacaacugaaaaaaagaaacaaguauuucauuaaguuuaugguguuuuaucuguguguaugcacaucuugugccuguauuggucugggaggugaaaggaguauguaggauccucugggacuagagucagagacaccugugaggcacuguguugguguggggaucaaaccuggguucucuagaagagcaacccccgcuuauaaccagugaaguauuguucuagcuuuuggauuuuuuagagaguuugaaaaaguuaaaaaaaguauuuugugauacaugaguuaugacaugcaaauuuuaguguauauaaauaaaaauuuauuggaacauauccauaucucauuuucauacugucugugaugcauucacuuggcaauggcagacagaauugacuaguuauguaucacuguauguggguauacauuuugggaaauucuggauccuuaggcaaugagaccacuggggugugcgugcgugcgugugugugugugugugugugugaugugaugugauguguuguguguguguguguuuguauacacacgaacagcugcaacucuuacugucuagucucauagaaaagagguuucuuugucuauguagagauuuuuauugggcagcuuuuuucguuuauaaugugcuuuuguuuuaguucucuugaaauaauggauuucaguaauuuuauuugaagugauuuuagaggaagacgcuaaggaaugacauuaacauuucaauucuuggccuuaagacaaaaguuugcucuucgaaaguuacuuacuuucacauuuuaaagaaauuccuccuagguuuauagagauuuucauauacuaaauuaguaaaugugauuuuccauguauuucuauaguuuaguguauuaugauauauauguaugugauuuauuccucauagauuagaaagccaguauuauuucugggauauuuuauauuuguugugcugguggauugguggauuggcacacacacaucuauugauauuuaauuuaggacaacagcuuuccuagacucagaaugcaugaaugaacaagccucuugcugaaaccuauacucuaguggaagugauaauuugcuuacaaaaauucaguucucuuucuaaaaaauuuaagagugauauguacaagucagaaaauaggauaaugugacuuuuaaacucuugugacuugaauuuacucauuucauacucagaaauuugaggcaucauauuuuacauauaaaggguuuucuugugcuuguacugaucugaaaacugucuucagaauuguuauuaucaaggagaaaauuuuuuaauugcaucuuuuuguugguaagggggauuaguaagaguaauaggaaaaacucugaaagagaucacuuugucauaccaugaaggugacacauccuuuaggaagacuuacccacuuguuuuuaguauggaauuauuguuagaauaauucucuguaaagacgccuuacauuuuggaaaggucuauauagaacaauaggacggggacuuuaaugucaacaauuuaaagagcuacuucuaguaauauuuguaaguccuaauuaguaguuucuuucuuucuuuuuuuuucaaagauucauuuauuuauuuuauguauaugcguacauuguaguuaucuucagacacaccagaagaaggcauuggaucacauugcagaugguugugaaccaccaugugguugcugggaauuaaacucaggaccuuuggaagaacaaucagugcucuuaaccauugagccaucucuccagccuguaguuucuuauucacauaacaaaguaaagaaauacggcuguuuacuguuccuguuucauauacauaaaguauagccauguauuucacuucgucaauggagauccuguucucccuacccccacccccgucccccauguccuccaagguuuucucuauguaguuccugucuuggaaugcucuguagaccaagcuggcccugaaagcuggcccugaacuuggacgccugccuccugaguacuggaauuaaaggcaugugccaccacaccccgcuuggauaucacuauuauugccuuguaggaaguagauucucaaaauuuaugucaguucucauuuauacuuaagcguuacuacugcuagagcuuaaggaugugacucauugguagaauauuugccuggcauggagaagagaugguuugaucuccagcuccuagagaaacaauaaaugaacuccaaagugguuuuauuuaugugagccuaacuuuagauacauuuuaaaguacuacuuaauaaaaaaauaauucacuuuagauacauuuuaaaccacugcuucauuagaaaaaaaucaggaaaccuaauauacaucuacaugaacaaaguauuuuuuuuaaaaguuagauuaauuaauuuauguguugugaguguuuugccugcauguguguuuguaccaugcauguaccugguaccaguagaggucagaagaggguaucugguaucacugaaacuggaauuccaaacuaggagugcccuaugagcacuugaaaauugaaccuugguccuuugcaaggacauuaagugaucuuaaugaauuacuaagcuuuauuaauuauuuccauaaacuuuuuuugaaagauaaauuauuuagauucuauuuugauugaauuuuuuauuuuuugggaugugugugagauagggucucuguguagcccuggcucuccuggagcuuguuucacacaccaggcuggccuugaauucacagagauccacugaccucugccuccucucaagcccugggauuaaaggugcccaucaccaugcccuaagucaguguaguguagaagcuaaagcuacuuuaauaaaacugauuccauuaaugauuggaaugauguuuuacauaauaggauuuuauaucaucaaguauucgucauuuggaagacagugguuggcugaguuaugcaaauuuaaauguuggaauauuuuguuauauuuaauaauaaaaaauguauuuaugucaccaguggccuaauguaacuuuccaaauuuuuaaauguuacucaaaagcucaaauuuaucaguuguucuuaauuaaaauggcaaacucgcuguguuuuaaaagaaccuuauuaagcaauuuuaucaaauaaugaaaaaauggauaauuaugguuuaucaaagauuauuuuccuauuuugcaugugacaagauuuuguuaaauggccacagguuagucuagaucucaugaagcugguggcuggccucaugcugaugguuauucugccauauucuccaaguucuggguugugguauucagugccaccauagucaacucagugauuuguuuuucaaauaaaaguguuauuccaugaagaaaaaaacagcuaguuuagcuuugaccucaaguaacaauguaaguaauuuuccucaaagcaaucauuaaccuuaauuguguagcagagaggcugcauauggacccauuucuucauacagaaaauggaaagcaguccaaguauauaaagccgcugaaguuuaauaaaaugugauccuccccucgguuuuuguaggaaaaaaaaaagagaaaaacugaguuuaaaguaaaauuggcuuuaaacauauccuaaauugauagagugcauaucuagcauacuguaccagcucuggguucaaaccucuguacaucauaaaacucagaaaacacaaaucaagaaaugccuguguaucugguagcgaagacaagcgcucucaccgcuagcacauuugguacuguucaagggucugacugcugcuggucuuguuccaucacugugucaguauaaugggaaaggcaauaauguucugcuaugaaaaucauuuuaacugggugugaugccacauauuuauaaugucaccaggcaagaaauccugucucaaaaaaucuuuuaaauuaaaaguuuuaaucucuacaacaggcaaguauuugaguaacuaagagaugaaugauacugucauuauuuuuaugcuaaauuauucuauuguuucuuuuggaggugucuguguuacuuuuaccuaucuuuaucuucucuuaauuaggcugccauagagguuuggcauucuauguuuguucuugaguccuaugguacaguaguauaugcuguuaauuacugaacccuauuuuucagcaucuaggucauguucuuggagccacauacaaggcauuuuuaaaaaaaauuauuuauuuuuauuuuaugcacauugguauucugccugcauguauaucuguguaaggguguugguuucccuggaacuggaauuacagauaguugcucuuaaccacugagccaucucuccagcacaauacaggacauuuuuauuauuguaguagaaacuugucuuagagucagcauuuuuggcaagaguacuucauagacgaugguuuuguaauaugccacaugagaagagacauggggucugguuacccuucuucuaagaauguuuaauauuuuuaacuaguuguaguggcccaugccuuuaaccccaguacuuggaggccacccugguguacagacaguuccaggacugacagccauggcugcauagagacccuaucucaaaaaaaaaaaaaguuuaacuuugacuacaaguugauacuuugaccuuugcacugaaguuucuaucaacuacaaauacaguuuuguucucuugagaucuuugauuucuuuuuuuuucuaaaagauuuauuuuuauuauuuuuaauuaugugucuugaguguaugugcccauuaguguggguaccugaggagggcggaggccuaggauucccuggagcuagaagaguuccaggcaauucugagcuaccuaauaaaggugaaggaggucucaaccacugagccaucucuccagccuaagaucuuuuauuucuuuucuugccuugcuguguuggauaacuuuuuauuuaaauauuaagcaauagugcauauuacuugguuauuaguaauaguuccuuuguuuucucauuuacucuguuaauguaaagaauaauacugauuuauuuucauuucuuuucuauugccauaccuuaaauuuuuagcuaggauaaaccccauuugcuuuaugaugaauguuuuauacuuugcuggguugacuuguuccuaauuauguuaauuuuuugcuucugugaaugaugugcacuucuguucuugaagaauauuggucuaugauuuucguacauugucuuugauuuugcuguuuggguaauggugaauuugguuuuucuguguccuucggauauuggucauguuuccuuugauaguauccagugagaugucccagaccuugugugaaagaacuauucagaguguucuuuaucagaaacuucuguggaaauaaaacugguugccauuuuuaaaaaccguuuugauuuauuacacuuguguauugggggugggcaugcacacgcagcagugagaauguggagaucugaagacagccuguaggaauugauucuugccuucccuguggcuuuucagaauugacucaagugguuagccugugcuaauguucuguuguagauuugauuuagcuaacaaggcucccagaauuaaagaaaauauacuacugaauuuaaaauuucauauucaacucuuuaugaaguaauuucuuuguguaaaaagaaauuugaaaauacauauauaucuuagcccuaacaaaauuauuagauuuuaagauaugguuuaaguccuucaguucagaaauccuucauggaugaagaacagguuguuuuaagcauuucuuuuccuuuucuaguuaagugauuucuccugcagugccaaauacugggagaaccuagguagacccaucugucagucaauucuagcaccuuuuagacuaaucaguuacuauaguauuguaauuaaugacuaagcuugggcaagccauucuuaauaguuacuaagucugaaaaaccagguauauuuacaaaugaagaaauuucaaauuuccuuauacuuuuuaucuuaacuagauucaucgagaagccaagauaguaagaugauguaaguuagcuagcuauuugaucccagagcuauuaagugaaugugaguugauuuaaaauucuuuuagaagacaauaugugcaugaguguuuugucugcauauauguauguguaccauauguaugccuggugccugaagagguuagaagaagguuccuuggaacuguaguuaaauaugguugugaguuaccacaugagugcugugaauugaaccagaguccuuugcaagagccagugcuccuuaaccaucacaccaucucuccuguucugcacaugggcuuuaugaauuguucuguacaagcgauuuguaaauucaaaucaucauauuuuuagaguugcauaugaaaaaccaaugaccuuacugucucaaaaucuuacuuuauauauuuugucuaauaguuguauauuaacauaaauaaccuaaauuuuuuuuuuuuaacuuuucaggcauaaaagucucaagacaagaaauacugggcaacaaggacaggcaccaucuuuagggcagcaacagcaaguacuuccuaagcacaagaccaaugagaagcaagacaagagugagaagccacagaagcgccccuugacucccuuucaccaucguguaucaguuagugaugagauuggcauggacacagauucagccagccaaagacuugugaucucugcugcagauagucaagugagguuuucaaacauccgaacuaaugauguagcaaagacuccucagaugcauggcacugaacuggcaaauucaccucagccucccccacuuaguccucauccuugugaugugguugaugaaggagugacuaaaacaccuucaacuccgcagagucaacauuuuuaucaaaugccaacaccggaucccuugguuccuaccaaaccaauggaagauaggauagacaguuugucccagucuuucccaccuccauuucaggaagcuguagaaccuaccguguauguugguacagcaguaagcuuggaagaagaugaagcuaauguagccuggaaguauuacaaagucccaaagaaaaaagauguagaauuuuuaccaccucaacuuccaaaugauaaauucaaggaugauccaguuggaccuuuuggacaggaaaguguaacaucaguuacagaguauguauuuuuuguuuuuaauagucacuacuaucaagaguaaaaagugauguaaguucuuaaugcugggaugcuaggcuugguuauaggauaggauuuauaaaaacagauauucuugguauuugaauaauuucuuuaaucucugaagaaaccuuuuuauuauuaaacauuuagccacaaaaauguagagaaaauaaugugucaaaacuucagugucugucaccuaacuaaggggguugccuaugacaggauccaucuauucuucuaguucuucuuucacuggccugaauuuagcacuuauuucuacacaugccuuaagacauacuuaguuaauuuguagaauugcuuuguugaucuucuguuauuaguggaucugcuauaguaugucuacuuuuagaugguuuuucuuagcaacaaauuagguagcagugaauuggggaggguggauacacauuugcuuguauagaauuucuuuaggaagcacuugugaaagaggaauugucacaucuugagauguauccuuuuucaaugaaagguuuuagagccaguuugcucuucaaacaacuggccuacaguuuguaccaucauaagccaguagaccaugaaaauacuguugguuuucauuuuuaucagaccuuggcagaagacuauuuuaacugcaugaagaauggcaaggcauuauuuugaugcauguuuguagauuucuaguaauauuaaacaucauuuaaaauuuucguugaacgauuaguguucuucaucugugaauuaccugccuaaacuugaagguuucccuuucuuacuuuauucuucccauauuuuugguccuaguccuguacuacuaaauguaauauagauagcucucuauaucuaguuugccaacuuuguucacuuaauauguggcaaacuuuuggcagaauguggcuuucuuuuggguuuuccuuuccuuuauauauugcuuggaauacaaucuuagccuacccaauaaggccuuuuuauuuuuaauguguaaauuuuucuaauaguguaaaucaaccagcaaaacaccuuuauagacaauuuuuuugggggggggggguugguuuuucgagacagguuuucucuguauagcccuggcuguccuggaacucacuuuguagaccaggcuggcuggccucaaacucagaaauccaccugccucugccuuccaaaugcugggauuaaaggcaugcgccacuaccacccggccuuuauagacaauuuauuaugaguauggauauuuugccugcauauuugugugugacucugaugacaucagagcccagaggaggcuguugcaucuccugaaguugcagacaguugugagccaccaugugugugaugcuggggauugaacuccugugcucugaaagagcagcuaguguuuuuaaccauuggcaucccacuguuagucuuuuuuuuuuuuuuuuaauuuauuuauuuauuauauguaaguacacuguagcuguccucagacacuccagaagaaggagucagaucucauuacagaugguugugagccaccaugugguugcugggauuugaacuccugaccuucggaagaacagucaggugcucuuacccacugagccaucucaccagcccccacuguuagucuuaaugucacaugauguauuagauuuuauuaguugcuuaagauuguauacauccucccuuuuuuguguguguguuuccuguaguccugggcauccaguucaguucugggugaaugccaggcaaguagucuuguuacugagcaauacucccaagugcuugguggcuuuuguuuuaguuuugcuuugugugcauggaacauuucagccuacagcacaugcaugccuacuacccucagaaaccuuuggaaccuaagguugugaaccucuauguggguacuggcaguugacuacuguugcucuguaacccugggaagugggagcagcuccuagagcuggauucacagucaggaaagaaugguucauuucuuccuuguggucuugggugcucuauagagucagagaaacuuaucuaguaacaaacuguagaagcaguaccuggaaguguagucuuuuuaagacguuaaguacaaaggaauguguuuccuuaugccauuugcauaccauuaugucaucauccuuugucaguagcuccucaccacagccuuucucugugcuguccaucucugacugguucccuuucuuuggauaguagccuuucauuguuuuuguuuuuuaagucauguauuucauuacucuuuuuuaaucuuuucuucccuuaagaucucuuucucaccucaugaucuuuuuaugaccuucaugaccuacacacacauacacauauaccuguguauauguuuacacacacacacacucacacacacacacacacacacacauuccauauguaagaaaaauagcucauccccuuucugagucuggcuuauuuugccuaacauaaugauuucuaguucuacccauuuuucugcaaaugucauuucauuuucuuuaaugggugcauaaaauuucauuauguuuguaccauacuuuauucauugauggauguguaagcugccaucauucgcuggcuuuuguuuaauaaugagucugcuauaaacacacuugggugaguaucuugauggaucauauauggucgaucucuacuuuuaguuuuuuugaagaaacuuuaugagauuuccaucaugcuuauacuagaagcaaggaaguguuuguuuccccauauccuugccagcguuuguugucccuccccacaguuuuuggauagccauucugacuagggugagauaggaucuugaauuugcauuccugaacugcuaagcaacauucacccuaucuucuacuugcuuucugauuuagccacaauaucuucuuuugccucugccucccgagugcugggcuuaaaggcgugcaccacuacgcccggcuaauaucuucuuuaaaaaacaaaaacaaaagaaaggccaggcucaugccuuaugguuuuucagauuacauuagagaagcagagaaccauuuacuuuuuaaucauuuaguguugcuugagaguuguuggaaaguuuucugauuauucuguccaagcuauggucugucuucauucugccaaaucacugccucucuuauauaguguuuuuuaaaauugguugguuacauuuuuaugucugaaauuaugcguuuauuaguggaggcuguuccuuguuaaaauguaagcucuacaagggcaagugcucuuguuuacugcucuacuucucuuaacacaagaacauacaugguauacaggcaggcuuacaccuagaguaguccugugcauauuguagagaucccacagauguuuggaugaauuggaugacaguauggcuagacacuuuacuauucuacaacuuuuuuuucuuuccagguucgauuuucuuacuuacuguagaaauguagugauaugaauauuuuuacauuagaaaacuuuaggaaugaguuuuuaugggcacauuauguucuuaaguucuaagaauucuggccauagcuuuaaacacauguauugguugcuuaagcuuauaacguuuaaucucagacucuguuaaaacaauuacuucacauuuuccucauugaauacaaaugagaagaagcguagaguagagucacagcgugcccaguagacugguacugugucauggcucugugaguuuaggacagaacagauuucugcuucugccuacuucuggccucccaugccccucugucauagaaaagggaaagacaaacaaucaaacuugaauaaaauguuugcuguuaguuuuauuuaagcaaauuuaauuuuuuauuuuguggaauuguaugucuuuuuuuguuguuguuauaccagauaggaaacuauauucugucagaauucuuuaguacuaagccuuauuguuguagcacaaugauagaugucacauaaaguuacauaacagguuuuguuucucuguuaucucagaagcauuuaugaaauauaauaguuucguacuugguagguuagaaauaagagcaaggggcuggagagaucgcucagugguuaagagcacugacugcucuucugaaaauccugaguuaaaaucccagcaaccacaugguggcucacaaccaucuguaaugagaucugaugcccucuucugguacaucugaagacagcuacaguguacuucgauauaauaauaaauaaaucuuuaaaaaaaagaaaaaagaaauaagagcaagagauugguguuuguugccuugugguucccuccuuuucccuggaaucacuggaauggcaggaauucucaggugacacuggucaguguccacuuuuaguugucagagcucaagguguguuccugacaucugguagguugauauuagugaugcuacuaaguggcuuuuaaguguacgugguaguaucccacaacaaaaaaauuacgccgcacaaagaaagggcuguguuaucuuaaugugucuuaaaagauccuuuauuauaaaaagcuugcaaauagaaagccacauaccaaaguuacaaugggcuuuaaagucuguauaacuuaaugaacuuaauauaguuaaaauuagcguaaaauauauuugauaauguggcuuuuaaagaaauuugaccccuaaaacuauuagcaaauuaaaugggccaaauguauguaauaauuagguucuuuagaguuguacuauuugguugggcaguggugggacauaccuuuaaucccagcauucuggaggcagaggcacaugaaucacacacaaaucucugaauaugaggccagcagagugaguucuaggacagccgcuucauaaugaaauccugucuuggaaaaacaaaacaaaaaacgaggagcggggaguguuuguguguguguguuugagagagagagagugugugagugagagagagugagaguuaguuguacuauuuuaguuccccaaaccacuugugaaauaauugacuuggucauugauguccccccuuccccuuuuccccuuucccccuuccuucucucauuuauuuauuuauuuauuuauuuauuuauuuauuuauuuauuuauuuuugagacaggguuucuuuauguagcugguguuccuggaacucacucuguagaccaggcuggccucaaauucagagauccaccugccucugccucucaagugcugguauuaaagguguacuccucuaccaccuugcaguuuugacauguuuuuaaacagcuuaaggcugcaaauuauuugccuuuacuagggaauuaggaacaagaagaaugggaagaaauauggacauuauagaugaaguuguuucucuaaauagaagugccuugaaacaacugauaacauuuaaaaaguaaggucuuugugaauaguuaagcucuggcuaaauaaugacauccuuauaaaagaaggggaaauauguauauagugauagaagagagucuauagauacauuauaaacuuuagaucuucgguauaugguauguguaugcauacaugaucuuuggucauuaauuagaugauauaagcaguaccuguuuuccuggagagggaucagcauacucuugaucuguccuucuguccuuaugacuuuauagcuaugugaauauaagacauggacacuguaaaaauaugucuuuagaaaugugaaauaccagcaauuuguacauauguuaauaaacaggugaggcauagaugguacagggaaggaaugcauuagaagaauuauuuucauuaugaguguugccuuuuguaggucuguaccuucaaggauaauugucaguuugagaaacuuaaaauuuguguuuccauugguguaaagaaaugauguuuacuguugaugcuucaauguggcacuaugccccguaggugggcggauacaccagagccauggaugagcucaguuggaaggaagggugcuuucuugguggugugcuugaagcuaggucucucugagacugcaguugcaggugauugugagcuuccugugggugcugaggaucaaacccauaaccugugggaagcaggcuuacgcugcagugcuuuuaacagcugaaucaguacuugagccccaguauucuacaguuuuaguaguuuuggcugcuucacuaguacagaauaauauaguuaauuauuucuccguaaaacugcauucuuaaacuuucaugcauaguacuuugugagagcuuuuucaugagcuaugcugaauuaugauuccuuuucuaaucuguuguuguuuuguuuuguuuuuuugggggggggaaagagguucgaggcaggguuucucuguagcucuggcuguccuggaacucacucuguagaccaggcuguccucgaacucagaaaucgccucccgagugcugggauuaaagguguucuccaccacugcccggcauaauuuacuaggagaaagggaaaguuggggauauauagcaguauagcauaucccauaugcaagguguauacaucugugaugaauaucuuuaucuuuuuccuggucauuuucaauuuguuaguuaugauugaaacuguuuuagaauagagacuaaugacuuuuuaaauuguguagguuauuuaguuugugguuuuuuuuuuugagacaaggaaagucuugguacuuuugaaccugccugccucuugccuuuuuuugccucuuguuuccugagugcuaguauuauguguaugcucuaccaccucuggccuagagauuuaaaaguuaaagauagcccuugugcagugcacauuuuuuauuccaguaaucucuuuaauucaaguuuaaacacagccuggucuacauugcaaguuccagaacauagagggacccugggcuacauagagggacccuggcucaaaacaaacuaacaaacccaaaaauuuaaagauagaaaaauucaugccaagaaacaugguuguuuugauauuuuaaaaagggauuuagcauguuucaauguaauauguagaugccuaaaaacaaucuauuuuuauuuagaugguguuucuaaacccugagcaaagacagcuugcuugagccuagcucuucacauuuucuucuacaguuaggauacauuaggauuuuaaaauuauagucaucagaagaauccuuguguuauaguaaaucuaccagauauuuauuguauguauauaguuauaaaaugcauuauuugaucuccgaaaauaguaguuuugauuguuucauagaaagaagccugugaugaaauaaacuuguuuucaugucacuguacucaagccuuuuaagaauucuguuugcuauuuuaaugcaauaaaauuauacuuuugacagcucaaggaauauuucugaauauggagaugguacgagggcuaguaccauuuaaagaaagugggaggauuuugagcuauucaguucuucuguuuuuaacauuuccuccuuaguuuaucuccuauaauuguuaaugcauauugucaaaccuuuucuggaagaauucuuuugaauaaacacuuaaaguuuuaugugaguacauaucaagagagugugcuguuaucuuagugagaggaaggagaugcaauuaaugaaaacuauacaggcaauuuauuuccuaguuugggcuuuucaaugcuuccugucauuauuguaccugaacuuacaguuuguauuuaguuuuguaucuaauugaaauuaccuuuguaguuaguaauuuaauuuggcucuaugugaaaguuccuuuugggaaaggacagguauuauuuauauuuagaaaaucuucuguguacuguauauuuggauagagacaugauaauuuguuugaaucuggcacuuuaaaaauuuuacuuuuacuaagauuuuaauauagaauguauaauguuauuuuacaucaacuuuauugugacuugcuauuaaugaguacauuugaaauuuuugcauaugccaacgucuccaagaucacuugaauaaaacaagaaaacauugucuuuuggcaguggacuugguuuacucuucuuuacucauagcagagcucugugcaguauguucacuccuuuuaaugauguuacugcacaacaguuuaauaauuauguauuuaaauaauguggcagucuuuuugcuucugucaaaggauggcuugguaagaaagagaagauuuguuaacucucacugugccauucagucuaagugcaggguauuuuguuauccuuuaccgucuggguagguauuagaagacgaauaguuuagcacuuaaguuuuaauuuuuaucuuugccacuaaaugaccuuggcgcacaaacuauuuguuguuacauaauucuaaucacuuagugaccacccuuuauauccauuauagaaaguuauuuuuacuaaaaaggggcauaacaaauuaaauacuguuaaaaauauucauauuagcauauucaacaguuuuuagcaaaguuauucaaggucgaaugugaugaaguagaguuacuuuucagauacaaauguucaucuguuuauagaaagaacuaucuuaaugaguaauuaguauauuucauugacaguugugccacaaguguguuuuuaugaaacuguagacuuggaauguuagauuuggggauuugucuaguaucuuuagaauaguaguaauugcuugagcaucugauaaaacauucaggaaacacuggcuuuuauuuugauagacucuguuucacuccauagggaaccgaguggaggcagugcuagguauuaauaauagauugaaguuugaggccauucauacaacuuacagucugggcaguaacuuccugcuccaaacucuacauaagucuuguuuaaguguugagaggagauggugaguggcaucagucugugguuuuccuucgguguuuguugaggguguauguauuuaagaugagaccucacucucuagcucagucugaccagagggcugggaucacccgugugaucuuggcggcucagugcuuucuaauguagaagagugguuuacuucacaguacaagauacuaaugcuaauuagcuuaguuucgugcuuuguuuauaucucauuuauucuacauuaguaacgacugaccuuguguuuuagcauuucuucaguauuagagaugauucagugaaccaagacaagaccuccgccuuuguggggcuucuauucuaaugagaguuugaaagaguaacguauauaauauuuuggaagauaacugcccucggaggguuugacuacagugcaggguaagacaguuuuaaauagguagucauaaggugcagagaaguuggcauuuaaacaaagcacuggaggaaguaaaggagauggguagacaaacauugcaagcaaaaggaagagucaggugguguguguccuugugaggcacaucaaggaagccccuggaaacagagaggcuauggagaagcaucaggugaaguuggagaggagagaagagugagauugugggagauuuggcuuggguauuacagacuuuggugcuguauucaaguagguuuugcaggauguugaaaauguucugacuagaagccuggcugccuuguucugacagguugacaacuugagauuuguaaacccgagagaaaaggaauuuuaaaguuuuaacguacuuuauucaccgaaguuaugauuuuguauucacauucuggucuagcauauaaacagugaauauugcaguucagaaguauggguccugaggcuucacagagcuugcccagggucuucuuguggcuccucccaucguuuagcuuuaaaaucugaggccuagauuucuuugauauauuagcuuccucuuguuuauaacuugaauuucucugcuguccuuucugugguuuugugugccuuuguuguuuucuuagaguauaagugggagcauacuuuuuuuuaaaucacuguuuccaaccaggagacugguaauauacaaauuaaucuuccagaguagcaggaagaaaacugaguuacuuuuugaccuguugcuuuuauuuuguuuuguugaccucauuauuaauagcaauaauguuauuuucauaaaguagaaacaaggccuuaaaauuugaagcuuaaaauguaucuauucuuugcaauaagaaaaggagaguuauuuuccuuguacagauuuuaugagaguaucuugucuuugaagauucuucucaguaccagcuuuggacaagucaccgugcuugagaacaugagaacagggcacaugauuaaaaggcagcuuguucugguggaaggacaauauguggagacuuggguuuuaguuucauuuuucuguuguuaaaauugagguuauaauaaaucauauuaccucaguuucauuuguaaaauuagagauuauaggguaaauacuaugaguaauucuaaaaacgacacuuaaaguuguuuuagaauuuucaagugcuuguuuggauaacaaauacuaauuuucuaacuguguuuucuaugcagguuaauggugcaguguaagaagccuuuaaaaguuucugaugaaauaguccagcaauaucaaauuaaaaaucaguaucuuucagcaauagcaucugauacagaacaagaaccuaaaauugauccauaugcauuuguugaaggagaugaggaauucauuuuuacugauaaaaaagauagacaaaauagcgagagagaagcugggaagaaacacaaggugaguaggagagauucuguccugucaguguacacacugccguguacugcacauuggaugucacccucagcacugcuugcuuugcuuuuagugguuuugguuauugaaccugggcacucugucacugaacugugugcccagccccacucauuucuucuucuucuucuucuuuuuuuuuuuuuuuuuuuuuuuaagauuuauuuauuuuauuuaugaguccacuguagcugucuucagacauaccagaagagggcaucugaucccauuacagaugguugugagccaccauguggaugcugggaauugaacucaggacuucuggaagaagagccugugcucguaaccuccacucuacccaacucacccauuuauucuuuuagaauagaaagauugaucauauguauguagauauguuuaugugacgaugaguaaaucaguugugugacacacuuugacuuaguuucugaugacggaguuguauuuuaauaguggaugaauaguauauuaacuuuggucagaauuagaacauuuaacugcacugucuuggugcuagguuuaauaaaaugugggauauuuuugaguaugugauuuagcaagauuacuuucuucuuaaaagcaaaaacuuuauaaaguauggguaaugaaacuaucaucuagggcuaggcuagugagaugacugagugaguaaaaacaccuacugccuagccugaucccugcgccuuacgugauggagggagacaucuccuuuaaguuguucuuugagcuucauacucaugguguggcauagauacacacgcacacacacacacacacacacuguaauuaagauuaugcauaugauuaaaguuuuaauauuaggcaauaaauaacuuaagaauuuggcaguaaaucuaaaauauaagcauugaaaacuaaauguauuaaaugauccaguguuuacuacaaagcaguucauuucacagaguuguaucuagcuguacuauaugccaguuacuuagucuuaucuuuuuuuaaauaugaaaccaguacugucugggaaggguauauccacaauuuaaacucaacacagacucgggaaaucuauacuaugucaaaaguuccaguuuacaccaucagcuaugauuucuguggcagauuccuuagcaucccugugaauuaaaugauugauuuguaaggugagaccgcugauuguuuacuuuaagaauuagugauagcuaaauguaauggcauacauguuuaguccuagcacucaagaggcugaggcacaucucccugaaucugagacuagccuggucuacaugacauguuccuggccaggcagagaucccgucucaaaacaaaaaccccaagugaaccaaacuaaacaauagaaagaguaacaagccccauauaguggugugugcuuucuagucuaguguaugagagacugaggcaggaacaugacaaauaugagggcaagcuugauacauuaaaccuuguuuuauacgcaacuuccugacuccaaagcaacacaggaauuggugguaaugcauuuagaacauuuauaagaauguuugacacauagcuacucaagaauugauagguuuuuauuguugguaaaauauauagcacugcccaaucuauaacacuguuucagguggaagaugggacaucugcugucacaguguuaucacacgaagaagaugcuaugucauuauuuagucccucuaaacaagguaaaacuucuuucuaaucauucauuccagugaugauuugauuaugugauuuaggaaaagcaccuauugcuuaaaagucaaagcuuuaugaaggaugggcaaugaaaauacucaucuggggcuggugagauggcucuuuggguaaagacacguacugccuaaccucaugugacacuguuggauuuuuaaauaauccuuuuugcacaguauauuucaugguaugguuagauuuauuguuuaucuuguauuugaagaagcaaguucagaugauagcauuuucuuagaaauugagauguauauuuacugauuuuuggcuaagacuaaguauuauugagcaugguggugcaugucuuuaaucccagcacucuggagacagaggaaggcagaucucuugaguucaagcuauccugguguacagagugaguucaggacacccagagcuacauagagaaaacccugucuugaaaacccaaaccaacaaagaagaagaucaaguguaaauuguuggaauguuuuccuuuuuuuuuuuuuuuuuuuuuuuaauagcuagaaauaggucuguguagugagauaagagccuaagguuuucugaucugaaaacucaauauuuaggacuuugggguagaugaucuuuuauuuuaaguuucuuuucuuguaguccgaccugaucucauuccugagcucuugagcaccugagccccugggauuacagguguguguaccuggucugcagagcucaguuuuuaaaugaagcuuagaaaacuuucugauucuucucauggcuugaauguaucagagaacuuuuucuuuucuucuacuuuuuguuguuguucuuuuagcuuuguuuuucauuuuuuggugaugugaccgcguacagccuuugcuggcuucuauguaacacacgaucugguagcggcugcacugcauugaaugucuuuucucaugccucugcuucccaaguacugggauuguaccaugugcuccauacccaaccaaggauucuuuucugaugcuauuaguucagcuucuuguuuuguuuugcuuuuuuuauuuguuuuuuuggaagcaguuucucuguguaacccuggcuggccuugaacucagagaucugccuccugggauuaaaggcgugugcuaccacugcuuugcagucgagcauauuuauauguucagacuguagagcuauaguagucaagaguccuuugaaaguaucugugugaagaagguaucuaauuuuaaaaauugauagauagauaaacaugauauagcauauguauauauauuuaugaugcauaguuuguugcuuucuguggauauuuuagugugcuaaucaagcuauuuaauacguaucauuucauauaaguacuuuuuuuggaauaaaaacacgaagauugguuuuuuuuguuauuaccagacauuaagcauacuauaaacguuaguauguaucauuuacauuaagcuuuugaauaggcacaguuuaucuuuugguauguguuuuugaaggcaauauuuuguuuuaauauuuugagaauaaagaaaugaaaauaaggaaaaaauuauguaaagaaggagcagguagucuuucauaaggcagcuuaguggcucuaaguauuggugggugacaucuuagauucuuugaugaaggggucuuuaucaaauuucuaguggcauguugcacagagaugaaguaaaaaaaaaaaaaauccuggacuuuguauugaggcucaaaagaauuugguacugaguaaacucaccaaggugcugagccaggauuuugguauauggcuguagucacagcacucaggaguugacagaggaguucaugagucugagauuaguuggugcacacaguaagugucuuacuaccccucuccucaauaaaaaguugauuuucagccaugugauggcacacaccuuuaaucuuucgcagcaucugggaagcagaggcaggcucuugaguucaaagucagccuggucuacagagugagucucaggacagcuggggccacacaaagaauccuuguccccucccccauugguuuauuauauuguuugacuucaaaauauacucuacagcuaauaguaguauagcacuggcauuaaggaaaaaggucaaaggcauaggccaguaaaacaggggaggggcuagacguaaaguaaacauguaaugauaguauaguauguuuuacuacauguaucccauauaaauuagccaaaucgggguauuuuguacuuaguuuauuaggagccuuaaagccccucuuaccuaguuuuuuuuuuuuuuaauuauuauaucauuauaggucaaaauucugaaguacaaucacuccucuaugcuauaagcaauagaaccuauuccuucuauccaauucuauuuugguaucuauuuuguauccucuauuuucucuccucuauucuucucaaccacuaagaguuauacacacacacacacacacacacacacacacacauacacacacacacacacacacacacacaauaacggaaaaaaacauaccaagccuuuagacaaguagugauacuccauuauuaucuauaaauauuucuuuuuuuuaacagauacuuaacauguauucaucauacauaauuagcuugauauucugugauucuaucaucuuuauuacgauauuuacaugcagccuuauuugcuuaaauaaaucccaucuguuucaaaaugaaaaaggccuggauagauggcuuagcuuuuaaauuguuugccggacaagcaugacagugcaaguugggaucuucaguagccacauaaaugucaggcaagugugauggagccugccugaaauucuagcaucggagaagaggagcuagggaguucccagagaaagcuggauagcuggacucauugaaucagugcgcucuagguucaaaggagagaccauacuuaauguauaaguuaggaagcaacuaaggcagaugccccaugucaaccucuggcuuccacauuaugcauauaaugugcgcagguaccugugaaucugcauauauucaaucacaucacauaacacacacaaaaaaggaaaaguauguguuuuuaaguaucauucuaauggcauuuguauuuuuaugaccuuuucuacagagcuuaacuaugguguagauuauguaacuuuuggagcuuccucgggaagcuuuauuuaugagaaaagaauuucagauuuuaaauuagugacuagaauaaucguguugcauaguuguugugaacauuagguuuucucucuuguuuaguuaaacagaauacuacuuggcuaauaguugaguuuucaguuuauuuuuuucugauugucacauguagaugcuccacgcccuacaaaucaugcccguccuccaucaaccaguuugauuuaugacucagauuuggcugugucuuacacugaccuugauaaccucuucaauucugaugaagaugaauuaacaguaaguauccuacuaaugauuaggauuaaguuaaauuucauugauuucauaacaguuugaguuuuggaagugauuuaugacuuuauuacuauguuuuagcucugaacaguaggaaauauuuuauaauaaaacacauuugauugauuuuuacucucauguuaaagucaccuugacaugguuuccuguaaaucuugauguggguauguuugaaagauagaugaucaaguuucauaguucuaccauguaauuuuuuuuucuucagucuuuagaaugauuuuucuguucuuugauccuguaguuugagaggugacucuggaauugaauuagagaauguuuaaguaauuaacauuaggacuuuauaccuuaccaauuucauaaaaaugcuaguucuuagccgggcgugguggugcacaccuuuaaucccagcacucgggaggcagaggcagguggauuucugaguuugaagccagccuggucuacaaagugaguuccaggacagccagggcuacacagagaaacccugucucaaaaaaccaaaaaaccaaaaaugcuaguuuuucucaaauuauuugaccuuacuucuguuacuacgagacauagucuugaaaaugguaaaggagaaaccagaaaauacuacuucaucguucacaccuguuuucagagaaaguugaagauaaaaguaaacacuuuagggcuggcaagauggcucaguggguaagagcacugacugcucuucugaggguccugaauucaaaucccagcaaccacauaguggcucacaaccauccuuaaugagaucugaugcccucuucuggugugucuaaagacagcuacaguguauaauacuguauacguauaauaaauaaauaaauaaaucuuuuuuuuaaaaaguaaacacuuuaaaugauuuccuagaaugucagucgucuagcaguuaauugggugcuacagugucaugaaagggaguccuuucccaucuacuuaaaaguaguuuaggaccugacuggcauauuugguguuuguugucuuauauaauauauccugugaggauaucuauugcacauguuugaacauaugaaaucuauuacagauauugguaagucagauauagcucuaugugaacauucacucuuuacccuccaguguaguguguacuagggcacgcuucacuaggaaaagaacuuugaauaugguccauauagacagaucuugucucuacuaacacccagacagcagcuguggcuuuuuggagguaaaaaauuugucaugugugugcuuuacuuacaaaguguucaacauaagacguggaacaaacguuccuucuaaaaacauugguaagagcuggauaugguugcacaugccuuuaaaccccggucuugggauaggaggccaaaguguugggaguucaaacucagcuuugucuacauaaaaacaagaagccuacuuagguuauauaaggcuuuaccuaucucaaaaaacaaacaauccaauccaccaaaaaauguugguggugagagaugcuaaaacuugguuuguuaggaaguuucccugaacuuaugcucaguauuagaucuguaaaaauauuuuugcuagaauaacuuuauuaaaccaaggugaaaauuaaagaauuaagaggaguuauuaauuauuuaggaaaucuuaauaucuuuuaaauuaagggacagauucuuugaauaucuuuugcuaaaaaaagaauuguguuaauuuuaccuuucuugccuuuuacuuguuuauugcuuauuuuccugaggaugcccuuuucucuguuaaucccaagacuuaccaaugcacuccagugauggaucuaccuguaaacugucuaguaugauauuuagcucugucguagacucagaaaaccacuuuugaugaccaguacuuaauccuuuaacuuacauauaagcgaauaauacugugugaucacuuuggguuucacauuaauauguuuuuccccccauagccuggaucuaaaaagucagcaaguggaucagaugauaaagccagcuccaaagaaucaaagacaggaaaucuggauccguuguccugcauaaguaagcaucccaaaucugagcuccagcuuggcuuaaaaacuuaacuccuuucaaaacuccuucacuguaaacagacucaccucuuuuaguuuguuaacauggguguuguacuacacacaggcacugcagaccuccacaaaauguaccccacgccacccucacuggaacagcacauuaugggcuucucuccaaugaauaugaauaacaaagaauacgguaguguggacacagcacccggagggacuguccuggaaggaaauagcucuaguguaggaacgcaguucagaaucgaggucgaggaaggauucuguagcccuaaaccgucugaaauuaaaguaaguauuuucuagaaaagucauuuccucccuguguuuucuuauaggauuaauugcuguguuuaagaauuuuuucacaguugauuuuaguguuauggcuaauaaauaugaggagggaauugugggaccacuauguaaaaugcauucaagaauaaaaacagauaauauuuauacuuuuguccauuuaaagaacaggcuagagaagauagucgcuuugauucuguuucuuuguuuuugucccuggaauauaaggcacugaaaguccccguucuuuauauuguaggauuuuucuuaugucuauaagcccgaaaauugucaaguucuaguaggauguuccauguuugcaccuuuaaaaacucuaccaagccauugucugccuccuaucaaauugccagaagaguguguuuaccggcagagcuggacuguuggaaaauuggacuugcuuccuucaggcccuucaaugccauucaucaaggagggguaugauugaugauguuauuauaauacugauugcuuguguggggugugugugcgcgagcgugugugugagcgugugugugagugcccguguguguuagagggcggcacuggagacucugcaugaguacgagccacauguguugccguuuacucacuugagacaugguuucucauuggaucugaaacuugguguuuuguugaagcagacugaccagcagcuuccuggaauaugccugucuuugccucccaagugcuggauuauagcuuguuuaguuagucaugcucagcuuuaucacaugggaucugagaaucugaacucaugucuucagcuuacacagcaagcacuuuuacccauugagccauuucugcagcucagcuuuuguuuuucuugaaguagcugguaugcuggaaauagaacauugguuuuggaaauccuaaguaaauaaauuuaaaaugauucuuguuuaucauaaugauaauagagauggauuaacucuuugagaccauagaccagaaaccauagaccauuuuugauuuucaagguaccuuuucuuuuagccuuugauucugaauuguccucuuuuuuauacugccauuuuacaauuacuucacaucauaacagauaaaguuuugcauuuuauuaccagucacauuuuuauaauuacuauggccaacugggcaguggugguacauaguggcacucaggaagcagagguagaugaucaaguuuaaggacagucuugucuauagauugaguuccagugcagccagggugugcuacacagagaaacccugucucagaaaaucgaaaacaaaaacaaaccaaaaaaucaaagcaaaacauucacuauuaccacuuucuaacacaaacaucccaaaagucagaauuuauuuuuugcuaucaguagcaauuagagucaaugaaguauggauauuuguagcauuagaaauuuauagauaguaaauaugguuguccagauguggaugcuucaugaauuuuuuuaagucuuuguguauccuuacaugacuucaugugcacuacauauguguaggugcccacagagaccagaggacaucaagacaccuuggaacuggaguuaauaggcagauaugagcuuccugauauggguccugggaaccaaaccucugaaccuauggccccccaaaaugcagcaaauauuuuaaacucccaagccauaguucuagucacugcuucauuuuauaaucuugaaucugguugcuuauuauuuuugauucuaguuagcucacaagaaucuuuauagugcucacaguaaaccugaaauaagucuuauuucucccuguaaucuuguaaugauuaccauauagaaauguccaguguugcuuggaaguguauggaggaugcuguuuuguguuccauauauuaauguguucuuuuaugcauuuguuccucuuuuuacccuggugacaacagugauggcaguaauuuggaucaggacuauggccccgccuacacaccgcaaacccaugcuucuuuugggaugccuccgagcagcgcaccuccuaguaaugguggugcaggaauucuuccuuccccauccaccccuagguuuccaacuccaaggacuccaaggacuccaaggaccccucguggggcuggugggccugcuagugcucaagguucagucaaguaugagaauucagacuuguauucaccagcuuccaccccaucuacaugccgaccccucaauucuguugaaccugcaacuguuccuuccaucccugaagcgcacagucuuuauguaaaccucauccuuucagaaucaguaaugaauuuguuuaaagacuguaauuuugauaguugcuguauuugugucugcaauaugaauaucaagggugccgauguuggaguuuacauuccagacccaacccaagaagcacaguaucggugcaccuguggcuucagugcugucaugaaccgaaaauuuggaaauaauucaggauuauuucuugaagaugaacuugacaucauaggacguaacacagacugugggaaagaagcagaaaaacguuuugaagcucucagggcuuccucuguggagaauguuaauggaggccugaaggaaucugaaaaggugccugaugaauuaauauuacugcuacaagaucaaugcacuaauuuauuuucacccuuuggagcagcagaccaagauccuuuucccaaaguggguauaaguagcaauugggugcguguugaggagcgggacuguuguagugacugcugccucgccuuagaacaugggcgucaguucauggauaauaugucaggagggaaaguugaugaagcacuugucagaagcucaugcuuacauccgugggccaagcaaaaugguaaguuugugaauuugacuuuggcuuuuuuuuuaucccucggggggggggggggccgugaguaacuuaccaguaggucacauaggaauacuaaaguuuggacuuaacccucaguuaaagacagcuacauguuggguguggugucucaugccuuuaaucucagcagaggcaggcagaccucugugcguuggaagucagccuugucuacauauggaguuucaggauagccaagaccaguaugagacccugucucagaaaaacaaauaagacuguuaccuaaugugagacuuagcuguuuagaugaguuucagcaauuaaaacguuauuguaaucuuuaacuauguacugacauagaaauguaaacggcauguugcauguuagcaaggagaaaaugagugauuguuucucaugcagccaucuaauuugucuuuugagguagcugcacugcucucgagcugugcccgggcucucaguagcugcuuacagagcaccucguucaugcucagcgcuguucaugcucacuccugagcagacacagccgcuuuugguuuugaauuuuuauucgauuguuuucuuuguuuuuccuuauguguguggguacgugauugcauguguauuuggaguuuagauacauagaaggauagccuucugugucauuccucaaaagccaucaaccuugugggccccacuccuuguguauaucagguuuuucauucacagggcacugacuggcuagguuagaaucccuuguccuuuugagccuaugauuuaguggaggagacaguuaaauaacaacaacaacaacagaaaauauauacuugcauuacauaccaguuacgaguacguggaagagaaagcagggcaaaagagcauguuugcaugggaggauccuuaugugcuauuuuagaaauauggucagacauguuaggggggagaacauuuauagaaaggccuacuugaagugggaaaagugagccagaguaguuaacugggggaagaauguuaguagacaauguaguuccaaguccuugaggacauagcucucgguaaauuuuagaaacauaaguaguguuaaguauguugagugauggucauacugauacacggugaaguguaagaggugucccaaacacuuauuuaauuugugugugagcacuuccauguuugggugcacaugugugcuuuggaaaauguguugaggucagaggccacuuugagggaguuggcucuuucuucauauccucuugguuuaaggcuugaacucggguugcaaggcuuggcaacagguacuuuuacccugguucuggguguggguuuuuaggcuaugccuuuagcauuuauuugaaaugccuugggaaugguucuuaaucggaaaguaacaccacugucuuuuuagcuuuaaaaaaaaaaucccugggaugggaagugagggaagaugagagaagcagcaguaauuuugaguagagaauagucauuuagugaagguggcagcuuggagaagacuggaagccauagaacuaguggcaguaggcucuagauuagauggagacguagaccuacagagugugcugauccacuuaagaaaagaugaaguguuaagccugguuugugccaaugcugguacuacugcagagaaagaaaauaggaggguugcaggcacacauuuggagguuaaaauucagaauucagguuguauguggguuaucaguauuaaauacuauggaaagccagguguguuguacaucuguaauaccagcacugggaaauuguaggaaaaaaucagaaauugaagaugaucuuuggcuacauaguaaguucguggccacccuggaauauaugaggcccuuucuuuucaaaggccggagcuggaugggcaguuuuggggaaaagaaggucaggaaggagucugagaaggaagaaggagcaaggaagugauugcucuuguaugagaauauuugaaggagagugauuauauguauaauaaugccuucauaaagguacaaugugacaagaccacuggaugugaccucaugaagguaguaauuagagaccuagauaaucaguucuggucaaccugauuagagugagugugaggaaaugagaaacaaacuugaaauuugggagacauugguauaaauagaguuuuauguuagguuuaacauauaguacuugugugugugcacacacacacacaucuguucauggaaagugauucuuucuagaucaaaaaauuuaaacugacaguaauuucauauaauugaguaagugugguauuuugcuauguaaauauaugauagcuuaucuaucacuuuuuuuguagugacacuuaaaaucuuuuagcagcuuuaaaauauacaauacaauaauauuaguugugcucaucauguuacuguguagaccgcuagaacauaaucuuccuaccuaacuggaaacucacucccucucuccagucuaaccuucuuccgugggaagaauuaccaugaaacaaaaggugcuguuguaggagcaaagacauuaaguaagugaggggaaauagaauacauuccaaguagagguguauauagaccuauauauaggaacauguccaucgaaacaagaagaaaagauggcauuucuuuggacaagaaaagugaaagugaccauucuuagugauuucuuuuguaguugugggugagagcaguaggagauagugacagggucauuugauacugaugucuuaauucacauacuagcagcaucacacaguaccacuuuguuagaaaugcacauuugcagauucucccaugaucuucuaaagauuuauuuauuuuuauuauauauaaguacacuguagcugucuucagacacuccagaagagggagucagaucucauuacggaugguugugagccaccaugugguugcugggauuugaacuucggaccuucggaagagcagucgggugcucuuacccacugagccaucucaccagcccucccaugaucuucuaaagcaaacucuggagauaagaaucaguuuugucacucauuacuaaugugucuuugaaaaaguaauauauuaucuuuauuucuuuaucugcauuguuggcgggggaguuuggggggagggaggguugaacccauguguaaaaguaacuuuuauuccccugauguaauuguaguuucugaagcuuccugccucugucugcuaaccuaggccaaguccuagagacuuccagucuccauacaaucuuauuuaggccuagaguguuuucagccucugagacuuacugcugaauaagcucacccuuucuaguucuuucugagcucugacuggcugguucaacucagcuguucuggcucaaacuccucuccaagcugauagagucaaucugacuucucugaauugcucugcuuggcuuuaaacuaacauuggcaauauguucuuaucuucugguuccuuuuuguucuuggacuuguucugucuucaucggugucuagucuguucugucuucaaccugucucuguaaaacucuccugguaaaaucgccucuuuucucucucucuuugaacugcucccucaaguagcuuccuuuccucucuucuugugagaguugagcauauccuauugucagaucauucucugauucaucacuuuuucugccacucaauuagucauugcuuucaaauauaugucuacaaucuaacuuuaccuuuauuaauaauguauacuaaguauuuguauguauuccaaccagagcagccagccauauugcuggauuaaaaucccucuacacuaggaucuuguguaugcuaggccaguaguuuauaacugaacuauauccccaacucacuuuauuuuacuaaugaaauaaagcuaguauuugacuugauuagaauuguaaagauuuaaugaguucauucauguaagcauaauagaucuuauguaggcuuuguauuugguauuuuugggaacuauggagguagucuacauuuuaauuguucucagccacuaagauaacuaaaauuauaaucagaaguaaaagauaauccaaauucuuauugauagaaaauuccuauuauuaauuacuauaagacaauauuaacaagcccugaaaaaauuaugugaauuugaucauauauaauagaugaauuauagauuaauuauagcaaugauaguuugagggugaggucagaauaauucuaaagacuauaguaacauguaugcuuuucuuuuucuuuuuucuuuuuuacauugugcuuucuguguguucagauaugcacacacacaugccauguuacauguugaauucagaggacacuugcaggaauugcuuaucuuucauucagugaagucuuuaggcuuagcugcaggcaccuuuacccaaugaaacaucucaccaccccaguuaaagccauuacuuuaaugcaguucugaaauaagcaaaaguaaauguguuguucauuugcacauaaaacucaggguucugguuauuucuugagacuuacacauguauagaaaggagcaaggaauagaacaaaaggaggcacuuaguagacugggaggaaguguaauaccucuuggacauggugguguauauuuuaaaucccaacacucaggaggcagagacagguggaucucugaguuucaagauagcuaguacuuuauagugagauucugucucaacaaaaacggguuuuuuggcaaugagauaauaacucauaauuauuuucaucaugauauuaaaaguaauuugugaaauaaaacaagaggaccacucaugggcucauuauuauuuaugacaauaucaagauucauuuaauucauuauacuacagggaagagccaguuaaaguaaagcacucauugagugccuggcauauggcccuccaguguuacuccaacagcagcagagagcaccagggugcucuguauuaguaguuuauugggauuaccucuuugccagacaaauacucaaguucuacuuggugcacacuuauacucugauuaaaguauaacacuguugaguauauauagcuccagaauuaggaccuacuguauggauuagggccuguggauugugccaucugccuuggauaccuuucucccucauacuuaacuugggcuccuucuugucuccuuuaucucuuguuagagguuauggucugcauuuuucauauuauuugcuuauuuccuucuuauacaugcaauauaauuuauugguuggucccuuaucccuuaaguacaccucaugcaaguucugagaauaguugaauaugaauauucauucaaauuaaucuaagucuaugaaauugguugagaauguaucucuguggcagagcaauugacugacauguccuggguuuaauccuuauuacuuuagaagaggaaaaaagaaaaucuauaagauaguuuauauauucaaguggcaacuuacuauucaagauaaaaaguugcucuuaauugucccaauuucacuguccuagcaccuccugaucacagaagaaaaacuuuuauaaacauaccauaugauucaucuauauaaaauauacagucaaaaauuuaguauuuauaguuguaaccauuuguacaaacaauuuuggaacauuugugccacucuaaaaguaauaacucauucuuaguauuuauuugcuauuuuuccccauccuuuucuuguagcuguaagcaacuauuaucuaguuaucuucccuaaaaaguuuuuuuauuuuauguuuauugguguuuugcccucacauaugucugugugcggguggugaguccucuggaccuggaguuacaggaguuaucagcugcugggacuagaaccuggguucucuggaaaagcagccagugcucuuaauuugugagccaugucuuuagcccgauuuuuucccccuuccguucagauuguuuuaagaguucuuuuuuuuuuuuuugguuuugguuuugguuuugguuuuucgagacaggguuucucuguguagccuuggcuguccuggcacucauuuuuguagaccaggcuggccucgaacucagaaauccgccugccucugccucccgagugcugggauuaaaggcgugcgccaccaagcccggcuguuuuaagaguucuuaagcauauacuuuaaugacauagaauuccauugucauauagugguauaccuuuuucaaaaucuucaaauuguucauuugaauugaacgcacuuuggcuucugugaauauguguguaugauuuuauguaugucuuuguuuccgucauacuuagauuucuugggucauggaacuaauauuuuucaaagcaucugcacuacuuuaaauucuaacauuagauguuucacuuucuccaaacccacaccaguacuugcaaucuauuuuuuauugaagacauccuagugguuaugaagugguuucuugcgguuuggcuuugaauuccccuaaugauuaaugauguucggugucuuuucauagacaccauuugugcaucuuaggggagaugcuucauaagguccuuugcuuuacuggggagugggacugagagaguugcguguggagaggaagcagcucauccugcagccccgccuggggcuugugagcuuucagcuucaccaguucaucugacuuuuuguguuuuuuuuuuaaacuuguguuucauucuuauuuuuuaaauuauugaucuguaagaauuuuuaugagcugugggugaaaauacuuuauugguuugugguuugaaaauauuuucacagccaggcauugguggugcaugccuucagucccagcacuugggaggcagaggcagguggaucucgcucuguagaucaggcugucuucgaacucagaaaucucuucugccucugccugcccaccagcccucccuucccuuuuucucucaaucaaucucuaucugucugaauucagggauuauagauauguaccacuacaucugacuucugaaaggucuuauauaguuuucuguguaugcagauauuuagguuuuuuuuuuuuaaugaacaguuaagauaccucagauauauuucuuuuuaacucuaaaguuugugucacccaaaagcaaugaccacuuacuuuuuuuaaugauuguagaugcgagcgugcaguguucacaggauauacuucggaugcuccuuucucuucagccaguucuucaagaugcuauucagaaaaaaagaacagugaggccuugggguguucaagguccucucacauggcaacaauuucauaaaauggcuggccgaggcucuuaugguaaguuguguauuguacuagauaaugacugauuuauaucuguucucagauaugugcucaacuugaauaaguacauuaguucuuaaauauuuuaggggacuaugacccaguucugauucuagcccaccuuuuuacauuugcagcauuuaguuuuccuggguucuuuaauuucccaucagcacgaguagcugcacuaucuguacaugguugacacucaguaucaguuuaucugaaggaagggugaugaguuuuguaaaacccccaaauaacuucaguucuaaauugaaugagaugaaagauugcggccaaauaauagaggccaauacuuuuuuuaaaacauaagauuuuucacauaaaaaguuuggacaaaaauagaaacaaaagcaguaggugugugcucccuggaaggaggagacucucacuuaguaggaguguguugacugugcuccccuggaagguggagggagacucuuaggugguugagauacuguuucugcaguaguguaucugggugauagcugguuguguuuguauaguguugggauugaaccagagccucacacgcaguaggcaaccaaaucgcacuccagcucuggaauaauagcuguuagcauuaaaaguucucugugguuucagaaugcauuguacacuguaguagacuucuuguauuuuucucuuuuuuauuaauaacuuaaugauuuaaauaaaucaauuaucauauaaauugauaaucuaugaaaaguucaaguuauugauacuuuuuaguauaaacuucacauuuuucucaaaaccagaacagauuuauuucugcaccuaauucugaaaauuauuucuguauguauuuuaccaacauauuaucuauagauguaaaaguauuuccaucauuauccaucaucccacccauacuccaucauuccaacuauuuucagugauuuguuuaugcuugccuuaaaucauauguguaguuuaaaauuuauauugcugaauuauacucagcaguaucaauauaaacucaaucagaaauauuuacuaucccagacuuugcaguagauuaucaggcugagaguggguuuccuggguucagauuccuacagugacuucuuuuauguugcuggauaaguuguuuaccuuuuuuauuccucuuucuuauguuuaaaaugaguuuaaaaacagugucugccaauauaugguguuugugaaaauuaguauagacaguaccuagcauguaguauagacaguaccuagcauguaguauagucaguaccuagcauguagagcugcaguuauuuucuaguauucagguuacuuucuuuuacaagaucaaacaccuuuuuuugggucuuuacucauuuuaaaauaagguaauuugucucuuuuuccuaauaauauauugucguaagaacauuuaaccugugguaaacauuuaacauuuaccccuuuaauucaguuuuaaguaaaaaaaaaauuaguauuguugauuucuguauaauguauaguauaucugaugauaaucucauagauuuauaaguccuuuuuuuauaguaaauaaaguaacuccaucauaacaaucacaaauuuguuaacuauuaaauuaaaucaauucaugacaggugugguacccgugccuguaauuugagcucuuuuacaggcugaggaaaggagaauuguuacaaguuuacgaccagacugggcuguagaacaggaacccuucucaaguaaaauagcaguaaauauuuuaaagugaccacuuaaggauauuuuuaauucugaaaauaugucauugcuugcuuuucauguuucugucuuuaauauuuuccuuauuaauuuuggaaauaaagaggaugacgugaauuggcuuccuccugauugccuucuuuauuacucaggaacugaugaaucuccggaaccacugccgauucccacguuuuuguuggguuaugauuacgauuuucuggugcuuucuccauuugcucucccuuacugggagaaacuuaugcuggaacccuauggaucucaaagagauauagccuauguuguacucuguccagagaaugaagcuuuguuaaauggagccagaagcuuuuuuagagaucucacugcaauauaugagguaaguguuuuguaauuuauacuuuuauguuuaaaguguacugggagauucuaugggcugaugaagaaugcugauguugacaguagucuuaguaauggauuauauucuugcuacauuuuuugcuagucuuuguuagguauauguuccaugggucacaguggaaaauauaguauuagagggauauaccaagggcauaaauguguuccauuuaaaguaaccuuugguauguugggugugguggugcacaccuguaaaucauauguauuuggguagcugaaacaggagacucgcuagaacuaugucuuggaaaaaauguauuaccaggggugguuguauauguuuguaaucccaacauuugagagggagaggcaggaggaucagaaauucauccuucagcaauauaacaaguuugaggcuggcuuggguuaccugagacccuuuguccagaaaaagaaaaaagaaaaagaaaagcagcuggaaauuucuaaaggaaaauaaccaugucuucauaguuacccaugcuuucaacucaguuguuaguuauaagugagaagguuuguuuuaaaugggucaaguucugcuuggauuuuauaaucuguauccaaauaguaugguaaauucacugauucugccuuuucuauauauauuuuaguccugucgauuaggccaacacagaccuauuucucgauuguugacggaugggaucaugaaagugggagcuacugcaucaaagaaacuuucagaaaaguuuguaacagaaugguuuucucaggcagcugaugguaacaaugaagcauuuuccaaauugaagcuguaugcacaagucugcagauaugauuuagguauuaaauuuguauucauccuacaagagcaaugugagcaguauggguugguucaccaucuaaguuuguaaauaaaaucuuugugucauguggccaucuccauguuuucaaacacugucucugccugcuuuuguccugcaaagucagaacugaauagauguggcaaagacugugguuucagacuuaaguaugcacugucugacuguccauagaaagucugcuagcucuguauaugggaaugcuaucaaguagucauuauugguuccaaaauauucucugcugcuucuguggagucugauguuuccugccauugaucccagcauuccggaggcagagucaggaucucugugaguuugaggccaguguggccucaagacaacagggcuacacacauaguaagacccugucuuuaaaaacauuuuuuuuugauuuguuaauaacuuacauacaaauauuuucuaaguaaccuucugcaacaccaaaaaaagucuuauuguagcuaauccuauggcuguuauuuaaaucuuuuuguuauacucuuaaauaucagugaacuucuuuuacacuuaauccaaagagaugcaauaccaaauuacugaaccuaauuagacauuucugaaaauugaaccucaugauaauaucccuccauuuuguauuuuaguuagcuaucaaucuagacaguauuucuucaacuugugauuuaacaauaguuguagugguuugaugaaaaauugcuacauacuuauacacauuuguugauguauucuaauuuuuucuuacacuuauuacuugugucgggauauaugccacugugaaccaguggaaaucaggacuacuuggcaagguugguuuucucuuuccgccuugugguuucugggggucaacuuaaucaccgagcuaucuuguuagcuuuuguuuacauuuaauuuugccuaagaaauagaauuuucuuacauuucauacugacuauuuaaaauuugaaugaaaauauggguuuauuuuuauaauuaauuuaaaacauuuuuucuuuuuuuuaaaguuucugggagggaguaggaaguuaguucgugcugcacuguuaguauaaagcaguuaagggaagauaaucgccauaaaagugucagcuacauuguuauuucuauagaagaauaaaaauaagucagugaaaucaagaauuaaauacccguuuuuguucuuuagguccauaucuugcuucucagccguuggacagcucucugcucucccagccaaauuuaguugccccuccaaaucagucuuugguuacugcaccucagaugacaaauacuggaaacgcuaaugcuccaucugccaccuuagcaucugcggcaaguagcacuaugacaaugacuucagguguucccauaucuacuucaguugccacagcuaauucaacuuugaccacaacuucaucuucaucaucuuccagucugaguaguggaguaucaucaaauaaacugccuucguuuccacccuuuggcaguaugaacacuagugguacaggauccaugucugcacaagcaaguacgguucagaguggccagcuaggaggacagcagucgucaucucugcaggcagcaggaauaucaggggagucagcuucucuucccacucagccacauccugaugugucugaaagguaccguuaaauauuaggauacuugggguugaaagauaguuaaguaguauguagcauauguguuuagcaugcuugaagccuuauguacaaugaaugaauaaguauaaaaaaauuaaguuuguggaaauacagaaucuaucgacucuuuaucuaaguaaacagugaccuuacuguggaauuuaguuuaaucaugguaauuauuuuacguaugaaguuauaauaaagauuguuuuuaaauuuuucaucauagaaucacaggguugguguuuagaucuuaaaaauuauucaacuccagauaguccuaugauugagucuggcugugucauaagcagauguaauuguuuaugcauauuacacaacugguugcaaaaucucugugugccugccucugugugcguguguggggugugcguguguauaucugcgugcaugugcuagagucucacuggagcuggcacgugcgaggcaugcagccuuucacugugcuacguacgcuucagcucugcuugggaggcuuuagacucugaaucccagcucuguccuugacucacuuugugauaaggagaaggucuaacauuguuagcauugcauccauaucuguaguauggaagcaguucuacacgcugcacagcaauugugcuaaugguaauggaucucauuguuuuuauauaaaaguccuggggaaauucccuuaucagacagucugaugcucauuguuucucugcuuccuagaaugcaguuguuuacaaauucacgcucauaaauaugagguaaaaguagacuauuaucugaacagaaaaaccuggcuucugucuggacuagcucuguuucuaggcaggcugcugagcaugaccaguuacugagaugccugucagagagaccuuuagucucuuacuguuaagcugcuugagaauucuuucuuuuaaaugcacaaagccucuuauuugaagggauuucauauggugugaaguguaaguauccugauuaucagagagguuuucugaugccuugccccaauaaaagagggauguaaggauucacuuuggugcuguaccaggcagacauaauacaacauuguucucuuucuacuucaauuuuuagcacaauggaucgugauaaaguggggauucccacagauggugauucacaugcaauuaccuacccuccugcaauuguuguuuauauaaucgauccuuuuacauaugaaaauaaagacgagagcacuaacucuucuaauguauggacuuuggggcuccuucgaugcuucuuggaaaugguccaaacucuuccuccucauaucaagagcacuguuucugugcagguaaggauuucuucauguuucagaguuucacaguuguuuuucucuguucaaaauaauuuuguuaaaagacagguuauauugauuucacuuaaauauuauaauaggaguuuuaagagaguuuauaaaagauaaacuuuauaguucugggggcuaauuagauggcuuagcagugaagugcuugcugcucuuccagaggauccaggauuaguucuuuccacucauaucugguggcucauagcugucuguaauaucagcaacuuucuguggguacuguuauauacauggaauacccacauagagacagacacaugaaaucuuuaaaaaccuugauugucauucuacaaucaugagaaauacaauuauauuggcuguaggugguguguuucuaacuaauuccaugaagcugaggcaguaggaucagaaguugcaggcuagcaucaguacauaguuccagacuagccugggcuauguaauaagauguuuguuaaccuccuaacaccaccuccuccuccaacccccaagauuauauugaguagauugcuucuccuguguuacuuguaagcacaguuauaaaguauagccuaaauaggaaaauaaugccuguauucuauguguuaauuuuaauugagacagguucacaguaaaaguagaaaguuaaagaaauuuugauuucuuuaauuuguagacuauaauaggccccggagaacuauauuuaauuaguauaacugcuauguauagaaauuuuaaaagauuucuagguaguucuuuaguucaggacauacauauauauacacauauauauauauauauauauacacacacacacuguguuacagaggcaggcaggugagagggcucagugguuaagagcacucaccugcuuuucaggacucguauucaguugcuagcacucauaaggcaucugauagccauccauaacucugguccuaaaggaucccagugcucuugcuaggcuucacagggaauaauguauaaguguauguauguauaugcaggcagaacacucgugcauauaccauacaaauuaaaaacacugugugauagaaaccaguaucuuuccauuagauguugcucacguuuaucugaggaauuucucuuacuguugcaaguugcucuguuaauguuuguaaugcucaccuuucuuuguagauuguuccuugucaguaccuguuacaaccugugaaacacgacgacagacagaucuacucccagcauuuaaaaucuuuggcuuuuucgguguuuacccagugucggagaccacuuccaacaucaaccaauguaaaaacacugacuggguuugguccaggcuuagcuauggaaacugcucuuaaaaguccugauguaagugcuauguuucauaugaacgaagcuaucauggugacuuacauuuucaaauuuuauauauaacuaaauggcuggucacuggcaguaugcuccuuuaauaccagcacucugggaggcagagacaaacaaaucucugaguuugaggccaaucuggucuacagagcaaguucaggacagccaggguuacauagagaaacccugucuccaaaaaccaaaccaaaccaaaauuuuguuuuagucuaauuucuaguuauaauuggguaaauaguaaauauuuuccuaagauugcauaauucuauaguacuuucauguuuuauuuuacagagaccagaguguauucgacuuuauacaccaccuuuuauucuggcuccggugaaggacaaacaaacagagcuaggagagaccuuuggagaagcuggacagaaauacaauguucuuuuugugggcuacuguuuaucacaugaucaaagguggauucuugcaucuugcacagaucuauauggagaacuccuagaaacauguaucauuaacaucgauguuccaaauagguacuuauuuccuuaaacaugcuuaucccaauuuagaauguuauuagauguccacaaacauacuguuucauaguaaauaaguaaccauuugaaguuuauauauauuaugauauuaauuguugagguucuggguauacuuuuuaucuacauuuuauaguuacugcuuauaauguauaauugagauaauuaaaaaaaaauuggacaggcacaugucuuuuaaucucagcucuugaaagguggaaacaagugacucucugaguuggaggccagucaggacuacauaguaagauaaucucucaaaaacaaacgcuucuucuccuugcuaaucuguuacacagagaaaaaagauuaagguccuuaacuuuuauguuguaaugcuugugacaauaauuuuggauaaagaguuugaaacuuuagggccuggcaguuaagaguuauuuguucaucuuccuagagggcuggacuuguuucuugacauacacaucugguggcuuauaacuccuguuaacucuggcuuccauagguacuugcacucauguccacauuuaccccucuucccaguacauauaguuaagaaauaauaugaaucaaauacaguuuuuuaaacauuaacuuagaaagcucuucuacucauaaaaguggaucuuguaagaugaggguggaagagugcacuuuuaauuucaguauuuuggaggccuaggcaggcagaucacugaguuagccagggcuauuuaaaaaagaacaaaaacccaaaacauaaauacauauuuaacugcuuauagcauaaauucuacaauagugaucuaucuaccuaccuaccuaaccuaccuaucugucugggagaauacaggcauuauuuuccuauuuaggcucuacuuuauaacuguuuacaaaguaacacaggagaagcaaucuacuucauauaaccuuggcaggggagggucagcaaccaaccucccucccucccuuucucucuuuuuauugaaaggcugggucaguauaacugcccuggcuaucuuagaacucccuuuguagaccagacgggccuugaacucauagaguuuugucagucacuaccucugcucagauuaaagacaugcaccaccacuccuggagguguuuuuaaaaauauaauuuuuuuguuuguuuuuuguuuuuugagacaggguuuuuuuauguagccuuggauguccuggaaugugcuauguagaccaggcuagccuugaacucacagggauccaccugccucugccucucaagugcuggauuaaagguguacacugucaauaccuggcucaaaacuaauuuucuuuaaauacauuuuugagugagauaguugcauuagucaugagauaauuuggaaauaguaugcuucucugugaaggaagagaacagauaccaccacugucaggcuuagguuaccauuuuauuuccuuacucaaaagguagaaauggggguaggagagacagcauuuagaauuauuggcuauucuuguagaggauugcauuccauucccagcacccacauuguggcucacaaucuguuauaacuguaguuucaaggaaucuagucuuuucuucugcugucugggcaccagguacacccacgguacacauacauacauguaagcaaaacacguauaaaauaaaguaaauccuuccaacaaaguagaaacagaaacaaagauuaagaauuauauugguaagccaggcagugguggugugcgccuuuaauuccaucacuugggaggcagaggcagguggauuucugaguucgaggccagccuggucuacaaagugaguuccaggacagccagggcuauacagagaaacccugucucgaaaaaccaaaaccaaaaccaaaaccagaaaacaacaaagaauuauauugguaggcaagguuaaucaguggguaaagaugcuugccucuaagccuaacaacauaaauuaccccauuacccacaugaugaagagagccaacucccaaaaguuauccucugaucuuuguccccaugccauggaauguauaucccuacacaaaauaaauuaaaauguaauaauaauaguuauuauaagauauaauuaggccuguuuucaauuaccaccccuuccugguuucuaacaguuuauaugauauugugaaaaucaggcagcugagcaauagcuuauugaucugcagugucuguagaguaguugucucugcuucaucgguguguuacuaugaaaugaauguuguguguacaccaccuaggcuguuuauuugugggguuuuuuuuuuuuugguuuuucgagacaggguuucucagcauagcccuggcuguccuggaacucacuuuguagaccaggcuggccucgaacucacaaauccgccuuaggcuguauauuuguaacagaguacaugcuagcaaauguuagcuguuguuucucauuuggaaagugguuguguuacaagcuugccuaccuaaugaagcaaccuguaucagaaaacaugcaacaauguuauuaggugugagaaaugugguuuguguuggacauucucucccuucuaagguauggagauugcuuuagugcaaaucguuggccagaauuggacaacaagucauguuuucaguucuuccccauggcacugcucaggaagcagcuuucaguagugaugguugcugauaguuuguaaagcuugaaguguacucaacuuuauaaaacaaaagcuuuggguagaauagacaggauuuaugguaaauuuaggcuuuucguagguaaacuuugaaaaaaaauucuauuaggcuaaguguauaucaaacuauauuuuaaaaaguucuuuaugcauguuugugaaagucaaaggacaaccuucacuguuacuuuucagaagcuuuccuccucuuuaacggucucuaguguggacuuuggaagcacaggccgacuggguaguaaggccagggguugagcucugugucucugucugcaucuccagguugagauuaaagcuacacauuuguucucuuaggugcugggaagguaacucagguccuaaugcuugcaaggaaagcaugcuaacuaauuaacuguuucuucaggucacgaacaacaaaacaauccauaaacuucagcccgaauaugacaucauacaucuaugcuuccugcaacuaaagcuaaaacauuaggguggaugauuugaauuuaggaauucaaaaccggcuugcacaaaacauaaagagaugccauaucauaaacuuaggacuuugagugguaaaucuuugggauuuauuuuuguaaagguuugaggcauuaaaauuaagcaaaggacaaggaauuggaaguguaugccuaucauccacaagcucugccgcgucuguaaaacagaauaaaguaaaguggaugaaccaguuggucacacauuugauuucauaugugaauuucaucaugugaauuuuugaaauacuuacaaccauuucauucaauagggcccgucggaaaaaggguucugcuagaagauuuggucuacagaaacugugggaguggugcuugggacuuguucagaugagcucuuuaccauggagaguugugauuggucgccugggaaggauuggacauggagaguugaaagguggauuaugcuuuuaucuguuuuucuuuuuuaacuuuguuuuauguugauguauauuugguucagagcacauuaaauaacgugaauaaaaugcuaaaaggcucaguacuuccuagaggauguggguuugcugucuagugcucaccuagugccucacaacugucuauaacucaaacuucaccggauuugaugcccucuucuagccucuacaagcccuguacacgggugguguacagguauacaugcaggcaaaauacucguacauaugaaaauaaggcuucaaaugcuagaauugucaguaaaaguuuuuguuuuaaacaaggaaccauauauauauauauauauauauauauauauauauauauauauauauauauaauacaacagguauaacuaguaucuauuauguauuauacaaguauauguaacaauuuuauaaauauauaaucauauauaauuauauaauacauuuuauacauauacacagacauauacacugacuucauucugaaaguaagccaucaggcauaagaguuuuaacuuauuuaugaugaccucuauauuagaagaaauacacuaauuuaaaagcuguuaucuauuucucuuucaucgucagucucauaacagagcaguaacuuuaaguacuguccuucccuauugauauccacagauuggaguuguuugcugagucgucgaaacuugcaaucucuaagcaaaaggcucaaagacauguguaggauguguggcauaucugcugcagacucuccaaguauccuuagugcuuguuugguugcaauggaaccccaagguucuuuuguuaucaugccagguuaguuauguucaguguaugucagauuuaauuaucauuguacgcguuuaacuuaacuguuacauaaaauucugcacuuacaaaaaaggaaaaugcauuucucuuuagauucugugucaacugguucuguuuuuggaagaaguaccacucuaaauaugcagacgccucagcuaaauaccccacaagauacauccuguacucauauacuuguguucccuacuucugcuucugugcaaguagcuucagcuacuuacaccacugaaaauuuggauuuagcuuucaaucccaacaaugguaaguuaauugaaccuuaaauuuuuaaucuaauuugcuuugaaaucauggucuuucuauacagcccuguuuggccuaguacuugcccagguguggucuugagcuauaucccuagccauucuuuauauaucuguuugcuauaauacggcuuuauaucaucuacuagaauauaaauguaauuuagugaaccuuuuagguuguguuuaguagaagaggaaaaaaaauaguacucauuguuacuugaaacuguuuuuuuuuuaaaaaauuaggucuucacggauccacauauauuuuaauaauaauaauaauaauaauaauaauaauaauaaugauaauaaucauuuuguuuuucaaggcaggguuucuuugugugucccuggcuguccuggaacucacucuuuagaccaggcuggccucaaacucggagauccuccugucucugccucccacaugcugggauuaagguugugugucaccagcaccuggcauaugucaucauuuuguucuuuuauuauguaauaacuugaguguuuugcuuuuuuagagaacagugcccuuuaaaacauguuugcauuccuugcuaucuuugcuuuuuacugguugcuuuuauaacauuauuaacgcaguggcuuaagaaagcaggaguuuguuccauuguaaugcucucaaagucauucucgugaggcaggguuucuuacugaucccucucaguuagccucucaguuagccuguuuccuugccuuugccagcuccuagaggccacuguagguuuugaccuuuggccuuucucuccauuuugaaugacagcaguacuuccuuuguaggccacucuucucuuuccuucauauuaguacauauuaguacuucauauuaguacuucauauuaguacuucauauuagagcugggguuaacucagugguauaaugcuuaccuguuguuuguauggcccuugggucaaucugugggaccacauuuaagaaaaaagaaaaugacuucuaugauuauagggcccauuggaaagugcagcauaaucuccauauaggucucuuuagauugaccgcaaucgcaaaacucuuucuguggcuaguggcacaauacuugcgcaugauugaugcucaggaaauacuagucucauuaacucauuuugcuuuaagauauuuuuugguugauuuuguuuuugaggcagggucucacuauguagcacugacuagccuggagcucacaauaauccuucccccuuugccucugagugcugagauuaagagcaugugccaacaugcccugacuguuguaaagcccaggcugacuuaccuagagcuuacuuugcagguuggccuuacucauaacaauccugaucacccagccuucuaugucguaggacuaugggcaugagcaaucaucccuugccugucucauuuugguuaaaauuuauuuuaguacuuuaaugucaauaaucacaguauacagaaaauagaauauuaauuucuuuucccuguacagauggagcagacggaauggguaucuuugauuuauuagacacaggagaugaucuugauccugauaucauuaauauccuuccugcaucuccaacugcaucuccuguacauucuccaggcucucauuacccccauggaggugaugcuggcaagguaauuuuguuaaaaaaaaaaaacguuucaguguauggaaaugccaucugucaauccauucauccaucaauccauccagggauuaguauaugaaauuaaaaacuuucccuuugaaauuagcaagaggugaauaucaguugagcucauguacucuuauuuagucauuaaaacuuuuguugugcaaugaucuuccugcuucuaccucagaaguguugcggucucaggcauguguuguccguggccuuuuuccuguguguuuuuuguguuuuuuuuuguuuuguuuuuuuguuuuuuuuuugaguuggagucuuuguauacagcuugggguggcuccuaacuugagagccuccugugugcugggauuccaccaaugucugguucuucaaaauucuugcuuuuuuuuuaaacauuagaaguaccacuaauuuuaugaucaaaacacauuauaugaaauucucaaagaacugauaaaaacguugggggagaagcuguuucuccugucuuaucacaguagaaggguuuauggugcuugagguacugauguaaugaauauuuuuauuaugcauuuuauuuuucuuuuaucuguuuucuuaaaguaaaugcugagaaauuuguuggccaauucaaagggaaugaauaaaagucugugguauuauaaugucuuccaaaacacuguugaaauuaauggcauuuuauagauagugcuaugggaacagagaauggaaucugccuuuugaauuggggcaaggaauuaguugaauaaguauuaggacauaaguggcagcuauauugaaccauuuguauuuuguacucaguucaaccugaggcauacucauuuugucucacaguuuuuguaacacacugcuuuuaugauauuacuacauuuaguuauuaggcuuggaauuaaauuuaaaugucacauauguuagacagguaugcucccgugaaccuagauccucagcccucuuuuuuucuuuugagauggucuagcugagaguuguccagacuaaccuugaacguuguagccuacacgggccuuuaacuucuuuuuauccuccugcuuuagcucugaguaguagauauuauuggccugucaccagguuagauguaguacuaauugagacucuuaaguaaauaaccauuuaauuuuuaguauuuuaugugguuuauugagauaguaauaugaaauuauuaauuguuguaagcauuuguauuuauauuuguugucuagagauguauuaaaugaacuaauaauacucuugucuuuuuaagggucaggguacugaucggcuacuuucaacagaaucgcaugaugaaguaacuaauauucuucaacaaccauuggcccuuggauacuuuguaucaacugccaaagcggguccauuaccugacugguucuggucagcaugcccucaagcacaauaucaaugcccccuuuuucuuaagguauuaguauuucugugccaauuccuaacgaauccuaguagauaguuuuuaguucuaauaauuacuaaaguagcauuuuaaaguuuuauagcucauuugaauuccaaguucguuuaugcuuuguuguguauauuucuguaaauggugucauaaagagaauuacuuaauaugaaacacauaauuauaaaaaauuuauaugaagauugacuguuauucuuaaggcuccuggaacuuuugguuuuaaguuguauuuucauuguaguacagaagcugagagccuagaaacacugcccugucucuuuguguucuuaucuuccaucuaaauauauuguaacuuuggaaacucauucaucuaaagucauaacuuuguaguagacaucaagauuaaagccugagucuuuguuauuugaauggacucauacuaaacuccuauuuuauuauuuugaagauuaaaaaauuuagcaacuuuguaauucuugguuuuaguuuaauuuaccuacucuaaaaaguuuccuuuguauaaauuacuuuugaguaggaugagugugauagcucaugcuuuuaaucccagcauccaggaaccagaggcagcaagauuucuguaagcuugaggcuauucugguauacauagagaguuccaggccagccagggauacguagugagacuucugucauagaaaaaagcauauaaacaacuaguugaguagguugggcauggugacuugggaggcauaagcaagaaguuuacccaggaguugaaggccagcuugguuuacaaugaguucugagugagccagugggacagagcuagaccuucucaaaacauaagcugcugagcggguuuuaggaagugagaaucuuagaccuauagauacuuauuuuuuuaaccuucauuuuauagucuaaauuaucagauggugaaguaaaaugagucaugaaagcccugugugauuauuguuaaaguugcuacuaccaguacaaaauaauaaaugaagaccugacucucacuauguagaaaccacuguaagugggcucuucauguuucaggucagaugguaacacuuuaauuucuugagauuauauuuucuauuuuuuugauacccuggauauauaucccauucugugaaagcuacuugcgauuaaacaaugggcuucugucgcacacuuauaaagacuauuaacugucguuaauaaucugaguaauuuuccccuucucuuaaugugaauuaacuaugcuaggcaagugcucugagcucucccugcccuugaauugccuauuaauaaaaauuauaguuuauccugugacuuuuauucuucucugagauauucauuggucuguuguaaaucucauuuacaugaacaucuucucaaggggcuuucugcagaauaguaggauggaaucuccacuaagcagaguuccuugguccuuugggaagugcugcccacuuacagucacagaaccuguauguacacuaaaguucuuauaauagcaguaaauaacuuugcuuacccagcauuuuccaaauuuaguauaauaccuauuuguaguucaugaccuuaguguuucagggcacacuuuuguuaguaaacacuuuuaugaaaaguccaagggacuauccagauuguuuucuacucaauauuuauuuacagagaggauaguguaaagugagcauucacccucagauacaguguaacacgauuaggacuccugaaccccagguaaggcaugacuuaacguaacuuuguucaccuuuuauuuuuuucauguaucccauuuuaguucuguacuguagucaauaaaaccacaucauauauuucuuuuuuacuugagaaaucaguggguuuuagaugguuaaaaauaauuuuuauuauaagaauuaaaccagcauucauuuacuuuguagugguuggccaagugagacuuacuuaagauucauaaauccagaauuuauaaacaguucaaacauaaguauuguuggcuauauuuuuguauguacuuuauaugagcucauacauauaugcagucaugauggagaaugcauauggguauaaagaagcaccuuuaaagaguguagaaaacuugguugaaggauugucugcgaugagcacccccacuguagcaugacauuaauacuacuauacgacuuacauacuagaugauuaauuuuacuuaauugaaaugugaaaaauaguaccacauuucuucugcucauugcuaucuguaaaugugcgugcugucguuuauaugccucugauaauuaauguauugcacaaggagucaugugugcauuguauugauuguuaaguguucauccagaggcaauuuuguuaaauuuccagcuuugcaaaaauaaauaaauaaauaaaauaaaugugcaggauuacuccuuugacauuuuauuuuauuuuauucauuuauuuuuauagcacuuaggucccaagugugacuguguggucucaauuuuguucaacccagggacaggguacacuucaggccuauggguucaguguuuccuuaaucauuugcuuuauagacuugggcagauuauauuuagaagauaauuguaaagcuuguuuuuaaggauugcuauacgauuuuuaaaaguaaggcuaaaguaaaaauuguagagagacacgauguaaguuuuacaccuuaaaguuuccaucaaaaccaugaauuuuuuauaguugcucccacagauaacacugucauaagaucaguuucaucaggauaauacauuaggagaacacagugaaaugaaauguugcuuucccucuguggcugacugcgucccucccuuccuuuguaggccucuuugcaccuccacgugccuucagugcaaucugacgagcugcuucacagcaaacacucccacccacuggacucaaaucagacuucagauguccucagguauagcucccaugaugcuaaggguucucuguuucaacuuggguaaaagagaaugguuauuaugagauauauuuauucuuuuggguaagaguucacagcguuuuauuuuugaaucauugggugauuccccaccccaccccccacccccguucaugauauagacaaagcauagugccugugcuggcuugguaaauugcucuaccucugagcuaaacuccauuuaaaaccccauuuaguuauuauuucuuaaaaacaauuuuauucuuuuuauguccauauauauaugggucuuuugucugcauacauguccauugcaccauauauacaugcagugccacuggaagccagaaggcaucagauacccuggaacuggaguucuaggcuguuagcaggcauguagguacugggaauugaauucuggaucucuggaaaaguaguacuuuaagcaugagucaucucuccagccccaaccucguuaaauuauugagaaugaauaccuuucuaaaaugaauacguuuuugaguuuuuuucuccccaccucauucauucaaaaagcggucuuauguaucuuaggcuagcuuuaaacuuccuauguggugagaucuauuccuuauauguuacucuuucauugcguauuuuuugagacagggucucacuguauuccuuugggcugccuggagacaggcuuuccuugugcuuaacagagcuugauccacuucugucacugcgcacacgugcuuuuuuauuuuuucuuuugagaggguucugauuauccuggacucagaauaggccuuggacagagauccaccagccucgucucuucggugccaggaugaaaggcuugugcugccaugucuggcucugcugcucuucuuaagaaaaugacuguguuugguggucagagcuauguuugggaagguuagacaggagaaucauuacaaguugaaacuagcccaucuuaaaacaaauaaaacaaaaagcaaacaaauagaacaaaacaacaaauaaagugacuuuggcuaggcaugaugccauucaggaggccaaagcagaaggcuuucugugaguuugaggcuaacaugugcuacaguaugaaauucuuagcaaagaggguuucugugguugugguauugaugucaucucauuguuuaggcagcaaagggugucucucucucucucucucucucucucucucucucucucucucucucucucuuucucucucuuucucucucucucucucacacacacacacacacacacacacacaccucuuugagucuugaaaguacuauccaaguguauauugaaugagauggauugacacaguuuauucgcuuucagguuuguuuuggaacaguacaaugcacucucauggcuaaccugugacccugcaguccaggacagacgcucaugucucccaguucauuuuguggugcugaaucaguuauauaacuucaucaugaauaugcugugauccucguuugauggaauuacgcaaggaaagaacgggaagaaaggauauuuugcugcaagauuaaguuacaguucucaguggaagucauuugugauggggucuaauucuuauuacuucaacaaauauuguuuugacuuggggggcggggcuauaacccuauuuuucauugacuuuacugagcucuuuaggaugaugacugauuauucaaaacguauuauaacacuuucguagcaaaaauuaaccuuuuuuuuccagucacaguauuugugaaaaguaaugagccauaguacccauuaauguuaaagaauauuaaagcauggagaggaacaugaggaacaaugaauuccaacauauggcuuuagaacaucaggauguucuuguauuggauauaguaucuaguauucaaaaaugccugcaucucuuauuuauuguaaguuuuuaaauguauaaauugucuuauauuucuuaaccucuuuuauaaaaauuuuccuagaagguuuauacugccuucuugcuuuaaagcaauuggucuaaaauauauguaaucgucuuaauuaaaacguugcaguaggguugcuuuuagaguauuauuuuuuuguaagggggugggguggacaguaaauuuguauugucucaauguacaguuuaacagggauagaggggaaauaauguccaugccauuguguguggaagauuuacagcuaagcuguaguugcagaguacauguacaguaaugaaguucacuguguuuauaaacugaaaagguaccgggucuuacagcauuuuauauaucacaccuuuacagaauaacaugauggcaauauacauacgugauauuguuagguggaauaacuuagaauaaaaugagaauucuugaguuauauuuuguacuaugguuuagggcuaugacuaauauuucaggccauuuccagugaaagaaacuuaguuuuacaagaaaacauuugcuacugaaugcuuacacuaaucuugguguuuaauguuacaugcuuaaauucuuuucaguuuucacaguggcacauuuaggcauggggauaguacuaauuaugaaauuuccugcaggaucuguucuaagguugaaauuuagcccagcucuaggcauuuuacaaauuauuuuaagaacagucacucuugauuguuuuacuuuuuauuuuuaaauuaaagauugggaaugcgugugagaguaugcauaagcauggcaggaagagaggggggagagagaaagagagagagagugagaaagaaagagagagugagaguguguguguauaugugugugugugugcaaucaaacugugguguaaauagauccucagugaauucugguauucagacucuguuccacuagugaaugaaccauuuucuaaacguuucccuuugacuuuuuuauuuauugaauuuucuugguuuggagauggcagucccaaacaccagagucuguacuuuucuaugacacagcucaaauuaaaguagggcacaugccaaggagguucucaccucccuaaagaagggacuugaauuuuagggacuuuaauucacccuuuccuucaauccagcuuucccccuucuuguuugcacaugccaagauaacugcuuuuaugcaggcuuuaccccugaaaaacuccuuucuacagugcugcucacgagagcccagccagucucaugccugcauugcugacuugaacucacagucgccaagucuaccuaucuuucuuggaagcagucuuucaaaauuccuacuuguauauucauccauuguugacaaggacaaaaucaguuguauuuacaaaacucuuaacucgguauuuuuuuuuuaaacugaauccuguuuuguaaauaauauacauuuaauguugcuuagcauaaaaaauacuuucuuacaguaaucuucuuuaaauuggguauaugaaaacauuaccaacucuuguuuuucuauaaagaaauacaguuaauaacaagguuucaaauuauuccuuuaacauuaauagaacaauccaaauguugagcauauuuugauauuaaacuaaagaucacgucucuguuuuuaaauuaugcuaacaccaccacagauuauguugacguauuuucuucuguauuuucuuggugggacuugagauuugaggaaaaaagaugcuuauuuggaauuucuauuaagaacuauccuuguuauuuucuuagcucaauaauuacucaagaaaaauaaaagauuauaaucucaguuuaaaauuacuaaugugugacaaccauaccucaguuugaaauagauuuaacaagauuauucccugacauuuucuuccauguagccauaagcagggacccagcauacaauucuucuuaccuaggaaucaggaacuagucccaaauauacaggauugagucaugguuugcuuuuuuuuuuuuuccuuuccuuuuuuucuccccuuuacacaucagauuuugcucaaauaggagguaacuaaauagccauuagaagaagaagugaagccuuucaugcaggaugauagaucuaacuuaucaauguacugucacaguacauuaaucguuuuauuugaguagguaaacaaauuugcacacuuuuccccagugaauucccaacaccuugacuuccucauuucagugcuaauaaccuguuuugugugcaguuaauccauucugaagcaggugaaaggucaguauuuuagcauuuuaaaagaugaguuauauaaugucugcuuccagccagucugcaacaucuagccauaccuuucuuaugcaagccauucaguuaucaggacugugaauuaacacuguaugaauacauuucuguacaccuuauuguuuggccagagggccaccaaguguacuuauauguaauccuuaaauuuuaaacuagcuugugauuuuuaaauauuucuaaacuuuucuuaaaccacuaaaauuaagcucuuacuacuuagucaacuauccucagcuguauucgucuucaauugucaguauggcacagaucacuguauuaaaaugcucuuucgucuucauauuuaccuucugaggucauuuuuuaacuuaauguguuacuacaaagauuugcagaucuuuaaucaagcacuauguuaauacuguaauaucaaaauacuaugucgaauuauuucagauguucagauugaauaggguaaaagaaagucuuuaaaugcuaucgcauccuagacccucuucccaccuacuauggcauugcauauuagucuguugagacauucauuguugcuugacugacauuuuggucuggguuuucuuuuaauauuuuauuuuaauuaaaauuaggaaaaaauguguucaacaauuuuuuuuuugucccaucuucuccaaaucagugggaaaagcuuaccuuuugguauaucuuaguguuuucaugggcccagaacugugguuuaaauuuuuauauguauucucauucucauauucacucauacucacucuuuuucucucucucccucucucucccucucucccccccccuucucuuuuguggaguauaaauuaaaaaaacuggauuugggaccuacaauacuccucagguugagauauucuugaaguuuuaaaauagcuuuaguuuuuaaaguaaacuggauuuguggaccuuaaaguuacugaguuuaaacuacaaauuguaacaucauuacugaacauguccgcaucaacccucugagaauaacuuggucacuuuaugaaggggcguuuuuaaguuguuuagcagugacauuuaauaugguccaauugcuuuucuuuuuaacaugacaaacaauuuuaaaagagacuaaggaacaaacacuauugcgccgaaugccauaacacugaguuguacaaauugugauugaggagaugaaaaaguuuauacuuuuuaaaaaaaaaaaaaacaaaaaacaaaacuucaaauggaauaaauuauucaugaagccuuccuuguggugucucauucuguggaaaguacaagcuccuuacagcuuccccaugguuagcagcagggcucuuucugugucauuugcuuggggacggugguuuugaggcagggucuugcuauggagaccagguuggucuugaacucagugauuuccuugcuugugccuuccaaguucugggauuaaaggacugcaugcaccacuaaucucagcucugaauaauuuuuaaaagagaaugcugguucuccacacccaguauuggugauguguguguguuuacacacccaagcuccuuuuugucuuacaauuugguguuaauuauucagucaaaauaguuauguugaaauaauaauaguguuuuucuuugugucuuggguguguauguaugaucaccuaaucauguuugaaucauaaggaaaaaguuaaauauuaaaauaugaaucaugcauuaaaauagccgugcauuagucccguaggcagugguauaaaauguuuuguucagacuuaagcaaaaguuaugaucauuuaaaaacuuucucccaagaguuucaaaagcuuucauaaaugaugguguauggcauugaaauuuguaucucaaauuauuucuuauaauuuuccucugauucauuucuaccuuguuauuacuguucucuaugagccaugcaaauuaagcauuuuuacaaguaagaauauucauuguuuggacaacugcauacaucuuuucaauugugguuuacaguacucagagccaaucuuugggcacuguaacuuagaccucauugguagagcacuuuccuaacuacaaaacucuggccucagucuccagcaaugcaaacaaugucucaaguaacuguugggcgguuugcaaaggaaaugcuuuuuuucuuucaguaacuaugcauaagguguuuauacuuauuccuagugauaccaguuguuuggagagaucucucuuacucaccccuaggcaaacacaguuucucuauuggagcuaugugagccaugauuuugucauaagccaagacugaagucuaagaauggucguugguuccuuuuaugaguauuuucuuuugaaaacuuuccugucagagcuuuccauaugaauuucuuuaaaguaacgaauacagggaguuaaaagcaugugagaaauggcaaacauuuucaaggagcaggaaacucaauccuggacacugucuugaucuuuuggugucaguagcacacuguugauagccacacaugaauuuguuggauuugagaggugaacugaaagaauacuauuuuucucuucagacuguuaauaaauuaagaaaugguuggaguua

SEQ ID NO: 6260 - RNA, 19353 nt, Mus musculus
uuuuuuuuuuuuuuuuuuuuuuuuuugguuuuuuucgagacaggguuucucuguauagcucuggcuguccuggaacucacuuuguagaccaggcuggccucgaacucagaaaucugccugccucugccucccgagugcugggauuaaaggcgugcgccaccacgcccggcuggaaaacauuuuuuuuuaagccuagaagaauauagcuuaagaaaugcauguaaguuacacaaauaaaaaguucugucauaucugccuaauauaggcauaacaucuacucacaccaaguauccucuuuaugcauuuaucaacauguuauauaugcugcauaguauauguauaauacauguaauacagacuuguuccuuccugacagaaauauacacacaucuauguaccuaccaaguuaugucaaguguacccgcauauguuacacauacauuuuuuuaaaaagggugguaguagaaagcagagaaaaaaugaggaggcuuccauuaccuaugggcaacauggucucccuggugaaguaacuucuaagaaaaaggaaaaagcuagcuuugcaaacaaacaaaaaaaaaguaccaaguauugcaggcagaacagcagccaggacaacgaacgccccuggggaggggagcaugcuuuuuggaaauaagaagucagaguucuuggaaugugguaaauaaggaaaauggccagcaaauugggaaaguauuuuaagugcaauaggaagucauuuuuaagugggagaguaaaaugaguuaacaguauaugucauuaagggcuuaaaggucaaguguagagguaaagaggccaguuuggacacacuagcuauuagccuaggggaaagaugguugaagcucugccuuugagacaguccacaugaaaauaaaauaaggucacauuacccuucccuuuaaacaugagaaauacuucuuguuaagaugaucauugagacaaaugaaugauagcucuuccuugucuuaaagcccagucaaauucucuccuggggauuucuggggacgaggugcuucagccagcacggcaaauccucagaccccuguggaauacccaauggaaacaagugggauagagcagauggaugugacagugagcggggaagcaucagcgccacuuccaauccgacaacccaacuccgggccguacaaaaaacaagcuuuuccuaugaucuccaaacggccagagcaccugcggaugaaucuaugaugaaacaaugcuuuuauuaaugcaaaaucaaaaaggaaacaaauccgggaaggggaugugugagcauccugcaauauaaaaacaagaauaaaauggcagucucaaagagucagugucauuaccuggaaugcuuucgauggaggaaaaaauaaacauggauuuuaaaaaaucaaucaaaaauggugcaaaaaaaaaaauaaacccacaaaaaacucaagcaaaauaguauuguggaauccacagacacaucagcugacugguuccuauccuagcaacaucucggcguucgcaaggguucucaugcugauggcugcaaacugacaguauuaaggguaggauguugcuucggaaucaccguugaaaucugaugaugucaaauaaggguuauccuaauaggcaaaguuugagauugccuguaauacuugcaacuaaggacaaauuagcaugcaagcuuugucaaacuuuuuccagcaacacagaaucaaagacaaaagaaacuuuaucgauugauguuuuacgugcaaacaaccugaaucuuuuuuuuauauaaauauauauuuuucaaauagauuuuugauucagcucauuaugaaaaacaucccaaacuuuaaaaugcgaaguuauugguuggugugaagaaagccagcuucugucuucucuugaugaaauaaaaugcaaaugaucauuguuaaccacagcuguggcuugucugagggccugggguggaccugggguguuuuuuuaaucuuuuuguuuuaguaaccuagcugcaauacuugucuguaauacuaggggggaaaagucuguuuaaucauuuuuacuugcaguacugcuguguguuuggcguaacugcaagccuugggacaggcagaaguuguaugaucuacauugcauccuuguccugggccugcacuacacuggaaacaguaucaccaccuguucuuauaccaguauuugagucaagccuuggucgaggagggacagaagagaaucaggcuaaagugcauaaagagggcaguaagcgggggagauagaccugcaggggagaggguguugccacgggcgucucucucgacucuuuacagcacauuggugugguucuagguuuacuuuguacuguuaugcuguuuaccuuccuuaacaauuuucuuuuuugagaaucuaaaaaagaaaaaaaugguguuuuuuuccccuccugcacuggggcuacauuuuucacuuauaaaaauauuugauggccuuuugaugaaugucuuccauaacgaauaagaaaaccuaguggcuuaauuuaggaaacauguuaacaagacacuguuuuugaaauuguaacaaagucaacauaagugauuuacagguacaaagaauaaaaauaaagguaacuuuaccuuucuuaaauacuuccugccuuaaggagcauuuccaugacuagcuggugaaaggguuuaauaucugcagagcuuuauaaaauauacugcagugcauacuggucuagguagauggucacacagugaguccugucacgccacucuguuggucuuuuuugucuugguaauaguugcagcccuuggguuucuuuaugcagaugcucuugcuguguuccucaaaggauccaagccauaaaauucuuuaugcaugucacagucaggauugacccagaccuugcuuauucaaauuguaauugaagugagaugggaagaaauguuaacagugagcaaaaauagaaccuugagaggcuggagagaugacucagcaguuaagaacucuggcuacuuuuccagagguccugaguucaaucccagcacccacaugauagcuuacaucuauaaacuguagucucguuggaucaaauguucucuuacaugcacaugugcagacaaaacauccacauacauaaaaaucuuaaaaaaaaaaaacaaaaaaaaaaaaccagagccauggcagaugacuggaaauacugcccuucaauuguggcagcaaacguccaucuggacagagaauuucuuuuuuuaucauuuaaauggucauuccugauucucuugacuguagcagcauuuugagaacuucauaauuguagcaguaaauuaggagcugcaguaaugauuaagaauguucuucauucuuugagaguuugugguaucuuaaaaaauagaaccccucaaaaaaccuauggcaaugcauuauaggaaucauuucagacugcaaauggcuugugcuacucugauaucuguuucuaaauguguuuacuaacuauagcguugacugccuggccaaauuccaauaaaacuuuuacacuaaaugauuccuccuuagcccuaguugcuaguaauaugugcacugugaccaccccauaaacuguuaauaaacuguucauagaauuacugccagcaauaguggcaaauaucgcaacguuuuuguguagaacgcauuaauuguacaccuucugucgacuuccaucuacacaaauauauagcuuuucuaucacaacauuaagugaaauugaugcuguggcaaguuuauugagaaacuuucauaaauggauaucccuacuaugacugugaaaacaugucaggugucacaugagugucacagacagaaagcacaugccuaugcaauauggccuacucuguauuuauuuguaaaaacugaagcauaauuuaaaguguauaucaauacuacucugaguuucuaagagagguguucaugcuuguaccagguaagugaauaaaaaaaaagauuaagugcuuuuucuuucauuacuugauuauuuucuuuaaaaucagcuauuacaggauauuuuuuuauuuucuacauucuguuuuuuaauuaauauguacucacugaacugaaauuuacuaaauuuguuuuauaagguuuguaguguuacagaauaacuaaacugggauuuauaaaccagcugugauuaacaauguauuaauuauuugaacuugaaccagaccauuaggaaaauuauguuauuuguuccccuuguaugcucuuaacuuaaagaauuuucccacauaccguuuuugagauaguuugagauuugaggauaggaugcaugugagagacuccauaaauucaacauucuguacuauagcugacaacuauaaacaaaauguaucuuagcauuaauaucuugagccuugaacaucauauuuaauacaggaccauuuuagaaauauucaguuaguuguauauuuccuagguuacaagggcuagaucuaagauuauucucaugagaaauguugaauuuaugagaaauggauuuugaggcuuugaaaaugaaaauggcuaguaucucaaagaugucaguauccauacaucuaugguuucaucccaggagcagacauuagcuagcuggacaaacaguugugacaauauuugucacauaggggccuaugguuuguugcucaacaauauaguacuuuucucaugugacucaacacuauagcacaaguauuauuucccuggauucucugaaggagcaucuaaaagacggguuucugacaguguuugcucuuuaaacuauguuuucuccuaccccaaguuggcuuugcaucuauuaaauaaguucuucagcugccuuacuaggaguucuacgagggcaacaucuuuucugcauuucaccuuguauuuaguuuacuguguuaagauauuugauuucagauugaaugaauguaaauagaaauuaaaugcaaauuugaaugaacauaaaauagaagugauuuuuuauuacuugagagaaaaaaauuuuaguauauuuacuauagcauacauaacagauguacaauuuuuucauuaacguguuagauauguucauguuaccauauuuaauaaacuacuuuuguauaaaagauaacaguuauaaaacuuucucccgagacauuggagcuauuuaaauauauaacaaaucuuaguggucauuuuauguauuaaguguuacagauucuuguuauuuuuaauauacuugaauuguuugcuuuuaaaaauauucaugaaacaagcuauguggaaucuaguuucacauaaaaauagugggaauaauuucuuauauuaauaaucaacaauuugccuaaguacaccucauagcuagcuuugauaauguaauguucauguucaaaauaauuguacaaaaaauuagcaaauaugucagauagcuucacaggagcaaugcugugccuuucgagggcaugguuuugguuucuaguacucacauaauagugguucaucauaacuaucacaaaauaaaucugaaaaacaaagaaaucacccaucuugccacaugcgguggugccugccuucagucccuucccaguccucaggagacagaggcaagcagaucucuguguuuguagcuagccuggccuauaaagcaaguuccaggacagcguaggcugcacagaaacccaaucucgaaaaaaaugaaaaacaaaaguaucucuagcaaggaguuauagucucaauccuggugguugguagcaucuccccccggccccaauccccuuaccuccccucucucuuuggacauuuauuuuuauguauauagguguuuugccuguaugugucugcaucaugugugcauugcucaagaaagccagaagagggcaucagacuccccuggaacuggagaugguuguucgcugcggugugggaacacccacaggccucuggagcaacagugcucuucacugcugagccauugcucuaugcccuagcagcauuucucagugcugggacagcaacuguuuagagaggaugaucuaaauccacaaaaucaauccucuuccuuugaggugaaagcaaagggcaaaagcaagagaaauguuucaguuuauuacugauaaugaguaccacaaccuuacuacauuuucugguuuuuguuuagagacaagaucucuuuauauagcccuagguggucuggaacaagacaggguuucucucuauagcccugccuguccuggaacuugcucuggagacuagaugggcaucaaacucagauucacccgcuucugccuuuaauugcugggguuaaaauauuugcuaugaguuacuucccuuuuccuaauuuuaagugauagccuugugaaaaaauccacccaccucagucuucuacaaacucccuuuguuauuuaaucauauuaaaaaaacaaguugccuggagaaacugugauaaguguuaagagggaugaauguaauaguuuuaaacaggaagucauuucagcugacuuucacagugaaauuuuaaucacaaaucacuuucucuccuucaucccuuguauaucuaacaacuaagcuucaccacaaagccaggaaggugauuuaauauacuuagcagugauucucauuaggcaagguguguguguguguauaauagacucuauguguguguggacacauacaauauacacaaauauagagugaauacucauuuaaaacaaaaagugaugugguguuuaucugguugaggguaucacagucuuccuguaccucugucaaucuagguagcagcuguacagacaugauuucacccaugacacuuggucacuauccuuauuaagccauguacugguuuagucugucuuuaaaguuuaacuuuagucagguggugguggugguggugguagcacacgacuuuaaucccagcauucagcauaaacucugguccuggaacugcagcacauguucuaaucugcuaaagccaucucuagaacccagcuuagucugucuuacacggcuaauuuguuuuugucucaacuucuccuuguuacugaugauaaaugcgaagaagccuucgcaguagcagcccuuuagucaugguaaagauuucagauucuucagaggaaacacaaggaaagguaaagugcgccauuaccuuuucuucuugcagaaaucagcuggagaugacuaauguucuggcuuccccugagugaaaguugcuguuuucucccuuucuccucgauguggaauucagccaggacacagugcgcacuaagcaggcacuccaccacagccuugggugcaagcuuucauaucucaacagguggugauuguaaaacuugugagcuacauccccagcccacauucaaaucacuuucauuguuauuucaagcuauuacaugguacuacacaaaacacaagacagcuaguggcaaggaguacauaacagguccaccaggugaaugaaucuaaaucauuuauucucacugauuacuagucauauuauagagcauaauacaguauuaaaauauaucauccucaguaaaucuucacuuagaaaaugugauuguuauagguaaaauauagcauuuagaacuuucauuuaaaaauacaaucuuaugaaaaauuuaagcauuuuuagaaugggaauuauaaaaaucuguaaauuguuucagauacuauauaucuuaaaauacuaugcaaaaucuuuauucugaaaaccugucaggaaacaguaccugaaccccuuuaaaauggcuaguucuauuucuaauugcuauuuugguauuauugauaagaaaucacauuuccaauuuaacacugcaauuauuugucaaauaaguggaauaaauguugcauauuuauuaaggugaaugaauauauaguuuaaaaaugcagggcucuugcacuuaaacuucugagaaacugaacuauaaacaugucucgugauacccuaaagccuuuuucuacugcuggagaucaauuauaccuuuaucaauaguuaccaaaccagauaaaauuagugucuugaggccuuaauaguuggaacaacuuaguacaucuggaggugagaugaaguggccccaucuuuccauuuguuuauacauucugaaaucacaguucugcacaguggacauguuuucucucuguuaaaccauaaggugauacauucuucacagaauauaugcuguaaggggaugaagaagcagaucuuacacagugcauucuaggucacauacuuuaaaguuauaaaggauuuagcaguuucaaaugagaaaaugacucuuuuaauagcugagccaauacuaguguuuugauucuacuuaacuauuuucccgggugcugcuuuuuaaaaccugcuuaaugguaacuuacuggcaguuacuaugaaaauauggcaaggagccuuacacauuuaugaacaacugcuaguugagcaaggcuaguauccaguuagaaauagagccuauuugccaacugcuuuaguaucuuaaguaguugaccaaauuacccccucccuuuucuuaugcuccacugcacaaaaaucaucagaagggacauaauuuaggcagucuaccauaucccuuccauccugaacuuucacugcuauauaacaaacauaaaugugauuuuaacaaaucuguaaaaugcuauauauaauuuguuuagaaaucuuaccugacaaaagagaagaacuggcuucugaaauuccgcuugacauauuguacaaauaccauccauaucugaacacugucucuugcuggcaggcacuccauaacucuauaaagacaaauucuguuaaaaguggaggguuugguuuugaaaucugaucugggauaugguucagugguagcacauguuugaggcccaggguucaaucccuagaacuauuucaauaaaaaauaaacagauuguagagauugauuuagcagcccagacauuaaacauucuaagaugggauucauucuaaaguccuaagaauaguuugaacucuaagaucuugacuuuuuuacuaaagucaacaggguuugcucauuauccauacacaauaguuacgaacagucaaagcuuucugaagcauugaaaucaugaagggggagguggugagaaacacccgagggcuucauaagcagguccuaguuaugaugggcuacaaaagcugucaugaaaguccuauaagugaggauuuacccuauggucacuuccacuuuguucauaggguugacagauauauguauaugcacucagggugcuuauuuuaguuuuuuuuuuucuuguguguuagguauugaaccuaggggcucacacgcauguuaggcaagcacucucaaguuacaccaacagcccacagggcugaggcuugaggcuauuucagcacuagccuuacuaaauucaaccaagugaaaugcuuauaacugcaaaugaauuaacuuaaagcuaaacucugaauuuuuuuuucuuuuucuaauuuuuuauuagguauuuuccucauuuucauuuccaaugcuaucccaaaagucucccauaccucccccccuaauccccuacccacccacucccucuuuuuggcucugguguuccccuguacuggggcauauaaaguuugcaaguccaaugggccucucuuucaagugauagccgacuaaacucugaauuuuauuguaucuuuuuaauguucucuuuguuuuaacaggaaauuuuuuuuuuuuuuuuguaugugugcucuucuggaacuugauuuguagaccaggcuggccuuaacucgcagagaucuaucugccucugccucccaaaugcugggauuaaagucagaugcccacacccaccuagcauuugcuuuuauaucauuauaucauuaaugaucuuuaaaaacaaaaaaagaugggucccccauucuugcucucuucuucucuugcucccccucucaacccauuccuuucccccuuuuucuuucauggucggccucuacucuauucccuucucucuuucuuucuuuccuacccccucaacuccccucccaugcccuaaauaaacuauucuauacuuuaaauuacuuuuuuuuuuuuuuuuuuugcuagacuuccuugaaguguucaggcuggcccuuaaccuuuaauucugagaugagaaacuccuccauucccuccccuaccucuccuaaaaccuaacagccuguuaugaacugagaacuguuauugcuguugguagaaugcuugccuagaaaacuuaauuuucaaauacagaauugaguaugaggaaauuucuuuuaguacaaaaauugcaagggacaugauuuuuacugaguuguccucaaacuaaaaucauacuuaaaaguguuuucauaaaagugaaauaggcuauguuaauaaaaauauacaaagcaaguaucaguggauuaaaaaaggaaaacaaaaguccaugacaagguuuuuaaaguguguuuguaaauccuaaaagauguccaauggauuugcuuuugugcuuccuuuuacaggauauccaaaugucuaucacugagcccagauccaaacugacacagggaaugcaaggacaagagacaguccaguacagagucacugaagcagcuggugggcagugggauuuaagaaacugcugguggaauucaaacuucuaagucauuacagccccaagugccaaaauauuagaaaauaaucucgaaguagaagaggaagagcuuaugaaugucuauuuguaacacuacuagagaaaauagggcgaaacaagguagaaguauuucccuuaacugacaaaaguacuuaccggucguguaaaaaauacucguaagaccugucugaaaguucucaaguguccaaaaaaguccaaaagcuaaaagaggaagagacaauuuauuaauucaaacccucuauaugcuaaaccuaaagaccaaagguaaaauucaauucccaccuaaccuaguguucauuauaugccauacuagucguccauuaugaauuuauuucaagcuuaauagugcauagaucugagccaccucuuacccuacagcuacaguuuaagacaaaccuaugucaaagacacugcagcaggcuagcagauaagaguacuggcugcaccgggccuuuaaucccagcacucgggaggcagaggcaggcggauuucugaguucgaggccagccuggucuacagagugaguuccaggacaacuauacagagaaaaaagcacuggcugcaguuccauuccauuccuagcacguggacacugugcucaugugacauacaagcauaauuacagggaaaacacauacacacaguugcaacaaagaaggaggggcgggggagguaucagcuucauuuaauucaaauacccuuggcauuuagacuugaaaguauuggggguggggggcguauaccuuugauccuggcacucugguggcagaggcaagcagaucucagaguuagaggacagccuggucuacaguaagauccagggcuacauagagaaaccauguuucagaaaacaaguuucauuggucuauguaacaauaacaaguuccaggacagccagagcuacauaagugagauccugaaucaacaacccaacacacacacaacaggggcgcacacacacacucacuugagcucucuuucucucucagaaaguuuaauaaagugcuaaguugaaaggaucaggcauaaagugaagagaagaagcuaguccucugguuugagaccuguguauuacaagugguacugugagguuagugucuuuucuacuuaaucucccuuggauagcacguguauguucaucuuugcuacuccucaacaaagacugagcuuagcuugguggcagguauuuaggaggccaaggcacccugggcaacacaaggaaccuauguaguccccuacccccagaccauuagguuccuucuacucuuucuugaucacugucuuuauugagguggucuuccugguugccaaugcuggcaaacucaugaucuuccugccucucuagcugggauuacagguauauguauauagaaauauacagguauauuucuacauuucuaaauagguaagaggcugucauuacuuucaauuagugauaugaagauaaauuuugaggcagcuuaguaguaauguaaagccaggaauuaguauagcagucacuuugccaaaauuaguguuacuuacuuuuaguaugagguagaguaaagccagcaauaucccaagacuccauguaguuacauuaccaaacuccccguagcuuauaagguaccgaaaccaaacugguauaggaacaaaaauucgguaauacugacacaauucuucuaaaagcauguaccaauaucccuaaaaaaaggaagggaaaagaaauaaauucagcuaaccaagguauuaaacacauagcauagacacuauuggaaggagaacaucauaaguauauaaugcacuaaucacaauaacuaaauuauauuucagaacuaugauuaacacaaaucugacuugacuaucacauaccauugucauuacauggcuuggcuugguguugggccagugaaaugacccaguggguauggauaauggccuuaguucacuucuuuuuuuuauguuaguuacauauuguuuuuauucaggcuugucaauuaagaaauacaaaccaagcaacuguucguugcuucuacagguccaaucuuuccuucagaagcugcucacuacagcucugaaguaguguaguacaggcagcaagagauuuggguggagcaacaacucaucugaaauccagaguuaaguauuuacuuccuuuggugccuuguacagaaaggcacuguuaagauguuacaaaauagaaaaugcccacagcaaauaguucuaguggcaacuuacuaucagcaaguuacagugguggcgaugauucucuucauuuuauucuuaguucacuuucuagaacccaugugguggagagguacacacaaaauaauaaaugugaaagaaaugucuuaauuuguaaguuggguaugaugacucacauuugggaggcuaugguagcagaauugcuaugaguuccugagcagcucagucacuaagccacuggcuaacugcuuacauagucauuuaucaguugucagugcuucagagagaagcacaaguacaaauuuagaauugucugauguaugaugugaagacugaguuuucaauuauuuugaaggaaauaucauucugauuuuggccaauucauuaauauuuucaguugaaguacuugagcaagugguugcccggcaaaaguaauaaaaauuagguuauuuagguguggagagagcucugcaguuagagaacuucuugcucuuccagaggaccugagcuagguucccaacagccacauagcaguguauaaacugcagacccaggggaucugaugcccucuucuggccucuaaacugagagacauguaaaugaagacuggcuagcauucagggguuuugcuaacaucauuccaauaagcauuaguuaguuuuuuaccuuugauuuaaaaggcaugaugaaagaaggcaccaauaaaaucaggcauuuuaaacccaugaaaaagaauuucagaaugaagucuguaauuccaacaauccaaagaacuucccagaagcucaacuguucgaguguaggauuuaagaaaauuaagcuaccaagagaaaaacauaagcauuuauuaaagcaacacagaaacauaauguauugguaaagguuuuaaguuugcugcaguauuuuacauauuucaugagcguucagagcgcuagcauugaacuauaccccuagccuguucaguuuccaggcaucuaacaauacauuccuacaauagcuuuaagucagagaugucaccuccuuuuauguccaggcugggccuccuucuccaccuaaacuuccuuacucugguugguuuuguacaauuccaugagccccuuuuguuucgcauguucuuucaccuaggcugaccucacuggguuuacaggcuaugcccagcaagucuuguaacuuuuaaguaucaaacauauauucugauaauaccaaauuuaaaaugcuguguuucuguguggugaaggacaguaugugcacgucugagugcggaugccugugaagucagcagagggcauccgaccccuggaccuggagucuccucuggaaaguagcaggugcucuugaccauggcucugucuucccaggccacaggucauuccugucucacacccacucuaccucccaggccuucuaauuaucuaagcuaaaacgucagaauaucuggcauguacaugcauguuaacauguguuuuacugauucauuuuagaaacaaaaguuugguaauaaccaccuaauguuacuaaauaaacacagauuaaaacuggugaguggcacauuaccuguauuuccagcacucaagaggcugaggcaggaggaaugcaaguuggcacccuggacuacacagugagauccuaucucaaaaacaaaaagcaaaaaaacugauucaacagaaauccacuuaucaaaaaguacuuauugagcacaugcuaugugccaugguauuggggauacaaaccugccacaccuguuaaucaugaacgacaaguggauuaaaaucauuuacuuaaaauaagauacuuauaacugcaagguagaaauuaaauauuaaagaaauuaaagaucaccacaaggugaucuuauugacuagaagcuuaauuucucuuaauaaauuagugaauaaacaucuaauaaacacuaaucucacaaaaaaaggaaaauugaacccuacuaagcauuacaugcaaauccauaggauaaaugauaaacaacagacauauacuaggaucucugauuaccuguaaugaagugacugagaaugaaaaguguaauauaagaggacggaggaaccugccaggaacaccaguaaccaagcacagcggagcuuugaugaccguuccugaaaaagacacaauucuguaauuuacuguguuauguuaggccggaauuuuaauuaauaauaaauagcauuuucaucugaugaucaauguauuaacuuagcagguagucuguauguuauuaagaauaaaaacauucuauguugcucauucccacaaccacuguuuuuguuaauacuuaauuaacaaaacauaacucugagcaaaauuuuaaaaugcaagccgggcacaguggcgcacaccuuugaucccagcacuggggaggcagagccaggcagagaugucuugugaguuugaggccagccuggucuauacaguguuccaagacaggcagggcuguguagagagacccuguuucaaaccaucaaccccauaaaaaaaaauuaaaaaaauacaagaccuaggagucucagagcccaaucuccauaaugacauuaggggaccuggccaaaguaaucuuuaccucugcagcucuuuuuuuucucuuccacaaaacagaaauuuaaaaaauuuuaaauuuaaaaauuuaaauauaaaaauuuaaaucaguuccuaaauauacaguaauuuugaccuuuaaaauucaaguuuuuacuacuaguuuaauugaaaguuuuacaguugagcccuaauccauaaccugaacaacuguuuugaguacuaacaugauacccaaaaguggaaacuucuuuuuuuuuuuuuuaaagauuuauuuauuguuauaaauaaguauacuguagcugucuucagacacaccagaagagggagucaaaucucauuaugggugguugugagccaccaugugguggcuggaauuugaacucaggaccuuuggaagagcagucagugcucuuacccacuaagccaucucgcuagcccggaaaccucuacacaugacuucaccacuaagucaaaacacuggcacacugaaaauacuauauaagaaugcuucgggcuggagagauggcucaaugguuaaaggcacugacugcucuuccagagguccugaguucaaaucccagcaaccacaugguggcucacaaccaucuguaaugagaucugaugcccucuucuggugugucugaagacaacuacaaugugcuuauauauaauaaaucuuaaaaaaaaaaaaaaaaagaaugccucugggcuauguggguaaggcagacagaaaacaacuuaaagacaccucauuauauauggauaaaauuuccaauguuaaagaagucaaucugguacuaauauuuuuguucucuaaagagagggucucacucuguagcacaaggaggccugguacucacuguaauauuccagacugguucugaauucaugacaaucuuccugccucagcagccccagugcugggauuauaagcacauaccacuaugcccagaauuaaccugugcuaguuuugaauaugcacuaaaauuuuuguuaauaugcuauacuauaaauucccagauacaaccccucuucuggugaaauuucauagauucuuggaacuuuuucuaaugauucagaugauuaaaacuuuucacauuacuagaaaaacuucuugagauuauucuuuuuaaauaagagacaucugccauucgugacagggcaugccuuuaaacccagcacucaggaggcaggcguagcucuugagucugaggccagccuggucuacacagugaguuccaagccaaccagaaagucauagugaaauccuguaucaaacacccacguaaaacaccagggccaauguagucagugcuugcuuuuauuuccugccagucucaugcagcaucaaucagcuuuuaaaaugauauuauacuacucuguauaauuaacucauaaaguacaaagguccuugccaaacuagaucacacaguguggucuaagucucuuaacccuccugucuagguuuguuuuguuuccuuuuuuuaggaaccaaacaacuuaaguaagguuaguuguuugguuccuaaaaauugcuuaguuacgcauuaggacagggaacuuaagccgggugugguagcgcaugccuuuaaucccggcacuuggaaggcagaggcagaggcagaggcaggcggauuucugaguucgaggccagccugguuuacaaagugaguuccaggacagccagggcuacacagagaaacccugucucgaaaaaccaaaaaaaaaaaaaaggacaggguacuuauuuagaaaauaaaacaaagcaugugguggccaucacaauguauccuguuguuuccuacuccucuggaaaguaacuuauauuucucucaaaguuaucucuaauucuguagagagaaagaguuaaugauuuaguugcuugucauacuuacucuuagaaaaaccugauuuacaaugcuuuuguuugcauacauaaaaguuguuagcagcccaauuccaagagaaauuccuguuagaaaauaaguucuaguuaauugaaagaaaagaaaaaaaaccaacaagauuauauauacugauauaauuuuuaaaagcuagcaaccaaaauauguuaaaauuauuaauaaaaugggaaacuuaauucagcaguuuuauuuccuaccuguuauaugcugcauaacaaguuuaauacccagaauuaaaauauaaggaagacuuuuuugcaaccacuugaagagauagcggaauucugagaaggagccacuuccauguuccccagacucuguagcaaagucaucagguggucuugcuucacugugggaguaacuccggaaacgaccaugcacacauccaugggcacaaguacagacgccugaccugggauuucuagagcuuggauuuucagaauauucuuuugguccggaguuuauuuggauauguacauccccagggugaagggaaccuucuguugaucuugaaugaccacacggggaggcugcagcaucuucaugugcagugcccggaggaucaugcaguugguuacagcuggcuugcauggcccuugaguauuuucucucuaaaaugucuuugcuucaggacucuuucuccuuaaaaguaaaaucaaagagcagaaagcauucuaaguuaaucacaagcagugcaucgguucauuagguguccuuuguucacuaaaggggcaguugacagucacagacaaguuucagguccuucaaucuuugcaacugucaaagcucugcugcccugccccacuccaaccucgaaguccaacuuggcaaaccaagaguuuugaaccaggggcuacuuaaaguacaaagcacugcagaugucuugauuuuucaaaugugccaaaagacaucagcaaagagucaaaggggugcccagcagauaccacagugaauagcagcacuaaugcugaauaaguuggcucauguacucugaggcagaguccacaucaggaaguuugcuaagggugggugagauggcuggguaagucaagaccuuuaauuugaguuaaauccccuaaacucauaugguggaagcaaugaacugacucccacaaguccucugacacacacacuaaauaaauacaauagauuuuuuuuuacagauucauuaauguuuagaaggaaaaaaaucagugccuuaauuaagcaucaacaaagauaauaaacacuucauuuuaugcugaaacagcuuccacaaagcuaauaagguuuucaguaauuaauggugccaccgagaauauugcuucuccuuccaaaagaauguuagucaaaugccuuugaaagaggacccuuagggggagucaucacguaauugcuaagugaugcuuuagucuaaauaaggaguuagccucccgaauaaaaaugccaccaucggcuugguuaggggugucagaagagaggcugugggcagggcaagaucccuacgugauccaguguggaucucggaccagggugccagaaucgugcugucgcccgacgaaacgcagagcccaccgccgggccucucccguuucccccgcgauggagcuagcugcggcggaggcuggcuggcugaaaccgugcaguuacugugugacguuucgaagaggcucggaagccacagcggcucuaucgccucacucucugaagagcgacuugggacaggacaguuugugucucugcuauuaaaaaagaaacacaaaaccugcccuccuucauacauaaacaagaaaaggggaaagggagaaagaaaagucaacgccaacucuuccggaauccgcgaggacagaguucuccacccacguccgagcuucggcucuucuccccggaaacccuccgccucacccccuuccccaggccugaccucucaugaccaggagcgggcggccucggcagccacaauaccaacagcccgacacgcggccgcaagcccuucucgccaagccuucagccucggacgccaccagcagcgcucggccuggccccgcggcggcgcgcgcgcucccuagacgucgucacgcgcggcccgccuucgccgggccacgcccucgcccaguggaagaag

SEQ ID NO: 6261 - RNA, 2846 nt, Mus musculus
uuuucaauaaggagucauagucuauacauaguuucggugcucucuuucuuacuauacacagguauccccucauaccuucugguccucuguucuguagaauuccucagauuagaauaaguguuuuuaauuucuugaauuuuauguguauggaguauuuugcugcauauauaugcuaugcaguagauuuugugugugcgcacgcaugcacacgcgugcgaacacacuugcccgccuuguacuugugaaggucagaagagggcaucagauccccuggaauuggaguuaugaaugguuaugagccacuacauggaugcugggaacuuaaccgaagucuuuuggaagagcggcaagugcucuuaauggcuaauccauuuuuccaucccugcauuccuuacauuuuaauuuuugcucauuuuauccccacugcaucauuuauuauguuaucucuuuccaaauuaaggaacuugggauacagauggacuucuugaugcuauaugcuuugacaaggaagcuuaucuuacaguauaguuguauuccuuuagagcaguuaguagucauuaaugaaucccuguaugucaaugguucuuaaccagggaccaaagucuagaaguauuuugguuguguugcaggagggcucugcuccuaguaccuacagcguaagugccaguacauggcaggcagcucucuacuuugaagaauuaucaagcccaggggcuagagagaugguucugcaguaaaaacuagcacacuugagcuuucagagaaucuaaguucaauucccagcacuaacauggugucuuauagcugucuguagcuccagguccaguggauccuacacuuucuggcuucugugggcaccaggcaugcauguaguguaagcaaacacagagacacauaaaauaaaaaaauuaaaagaauuaaaauuaucaaguuccauaaggucaauagugcugcugugagaauccuaguuguguucuccuuaccuuguucauucuucauuagccacaaguuuuccauaaagcagacaucaguuguuugguuauccaaaguauaguugauaccaggaauguaggcuaaauguaugauuuuuuuaauauucuucaaaauaaugaaauaguuccuuaguaucuucuaaaauuaaauaaugaauuauaagauuuuuuaaaagauuuauuucuuuauauauauaguguuuuuucuguguguauaccugcaggacagaagagggcaccagaucucauuauaggucguugugagucaccaugugguugcugggaauugagugcccucaaccucugaaucaucucucuagccugaauuauauaguuuuuuauacuauauaauuauauagugaauuauauaguguuauuuugaacucagucuuaauauuucaagcuguucuaacauuuuccugauuuuccuuuuuucuuaacuuccccccgccccccacacacacacagagcacaagcuggccuuaagcucacaauuuagccaagaauagccuugauccucuugccgcuacuuccuaagugcugggauuauaggcauguaucaccauguucagcauaggucauauuuuuuaauugauaucucuuuccucuauuugguucacgagucagacuagacacaucaugaaagggaagaaauuaaaggaaucugguggguagaacuuagaugauacuauucuauaacaagaaaauguacucagagcaaaccacuacuuuaaaacucuuagacaugaaguaaugcacaagaagacucucaggccagggagaauuugauguugguguguuaauaccaggugauugcacaugcccaggcaagugcuugacacugagaguaaacaaaguuuacauccuagguggcuaacuccggcaucuuaucucugugucucauuugaacucuucuuccauaguuauccuuaucuagacuuacuguagauauacaacagccguugagcacauuauuaucucuaggaauuuauugagugacuagaugcacuaaaggguuaugaaggaaaacugauacucaguuuuaagaagaaugguaacuaucuacugaaauuuauguuaauucauauauaaaauuugaagauguaggcuuugguucacugguagaacauuugcuugccuagcaagggugaagcucuggguuugaacucagguaccacauauauacaaaaggaugaugcuguggagcuagagagaaucacagcacccacaugcuggcucacaaccaucuguaacugcaguucuaggggaauccaacaucuucugaccucuguggguaccaggcacaaauaugugcauggaaauacaugcagucaaaacaccugcacauaaaauaaacauuaaaaaaaaaaagacaaugauguaaauguacuguugacucucuuucuaccugcauuuuuuuuucuuuugucuguggcugcuaaaauuauucucauguuuuauuacaguuaaacccugugcaaagaauauagggcuuguggcaccuuugauugauaggaauaauauagacuguucaccauuuucuaaccauuguucuuaugaagcaaucugaagaggaugugagucaguuugauucaaaguuuacacgucagacaccuguugacagcccugaugacuccacucucagugaaagugccaaccaggucuuucugguaagugaaagaacuuaggucuccaugcagcuguaggaaaccucagguugaugcagugagaaguuuaugugggaagcuugaaugacuuugcuuuuaagccauuucuuugauaacuuacugguaucuacaaauugauuuucauaaucuuaacauucuguuuuagaaauuacagugagaauguuug

SEQ ID NO: 6262 - RNA, 500 nt, Mus musculus
gagucaaacuccgagcuucaguccugccacagaacccuuccaccaggccagaaagcaguuauaaaguccaaaucaggcucucguggugaaaagccuuugagcccagcacuugagaggcagaggccagccuggucuacagagugaacuccagggcaucugucuugaaaaaaagcucaaauucagaaaaagacucugacuggccccuugaucucagccccggggaaucugaggcagcacaaacaguauugaaacugaaaccuuaucucaagaaagggggagggccgagaggaaaagagcguacuauauaagaccgagaaaaacuagauacggccagcaugauggcuuacuggaugaaggagcucgcugccaagcccgaccgucugaucgucugagcucaaucccugggauugugcauggugggaggacagaguccacaacuacagauugcccuugguccuucucauacaccgugcacauacacuuguuaaauaaauguuuua

SEQ ID NO: 6263 - RNA, 2177 nt, Mus musculus
uaauaauaguaauaaaaaauagccaugcaagguagcccaucccuuuaagcccagacagaauucugugacuucaaggacagccggguuuacaugaagugaguuacaggcuagccagggcuagccagggcuaccgaguaagacccucauucaacagaagcagcagcagcagcaccagcaacaaaagaugcccaaaaacaccccaaaacaaaaacaaaaacaaacaagcaacucaaacagaaaaauaagaaaagguugagucuuccuccuguggucuaggcugacauagcucauucuaacuacuuuccauagagugaagaacaagaaacaacauuccgacuucagagcuuaauuacuaacugguucaaaugcucucucuugccacaggcaagccugacucugaggucaaacaucaaguuaacuguuguuaggagacagcgaagaagagcauggaacauucuguaacuggugaaaagucccuguuccagccaagcccaucccccagcccucgaguucaaugacugaguuauggaaacuucuccugugugguaaaacuggggacuuugucuuccaaucagacccuggcaagcugacaacaagccaauguucugcauauggcuuauugcaagucacaggcuuaauguuauuuucugggaauucuuagccucuauuuggugagaauuccggaacaugucauuuuauaauuacaauuuuuaucauuugguucuguacuuuaagaaauauucacaggucucacguauuucuuacaauguaagucuacaaugaauuaaaaaucagguuuaugucaucacaguaauagggaacaagacguuaacacugccuuucaagcucucagguuugcuggugcuuuggcucugacuuucccucugacguacucagagaguacaaaccaaugcacaagcaacaucuuuaaaaacaacagaauucugucccugcccaccugcuaagaaacacaccauaaauuagaaagcuauuuucuauauucuaaucuuucagaauuuguaagugguccacuauaucugauuauuuauagaguauaacuuagaucuaucuacugauuuagauaauaaggacauuuucccuuaaaccuauugacauuagcaacuacuuucuagaauugcccuagaaauaaagcuguuaauuaugauuggggaauaggcauuauugaacuuagggugucauguuuagcuaggcuguuccauacuuauauuaagaauagcaguccacuggggcuggagaggcggcucagugguuaagaguacuggcuguucuuccagagaaucugagcugagcuucucgcacacaggcaaaugaccaucuguaacuccagcuccaaggacucugacaccuuccagucuccacugucacuuaaacacaugugguauuuacucacaaagauauacacacauacacguaaguaaaaauaucaaggucagccugguguauauugugaauucuaggcagccacaaugcauaguugagagaaaguuacaaaagaaaagaaaagaaaagaaaagaaaggaaggaaggaaggaaggaaggaaagaguuuaagaucauucugaguugaaccagacaaaccugagcuacaugaacccaugcauucaggauuuaggguuauauuuauuauuuuuguuacagugcuaaauauccccuguaaacacucuaccacagagcuacagcuacagccauauugguaauuuucauuuugaacacuuauauuuuaaaacaucuaggcaggccucguuaauccuagcauuugggagacaaaggcagguggaucucugugaguuugaggucagccuggucuacagagcuaguucaaggaaagucaaggcuacacaaagaaacccugucucaaaaaaauaagaaguaaauaaauuaaaaaaaaaaacaaaacaacccaaagccagagaacauuuccuauuugagcuaggcauggagguacuugcuuuuaauauuagcagguguagagguaugcugaucucggugagcuugaagacagccagaguuaugaauagagaugcugucucaaaagacaaaacaaagcaacaaugucuuguuucaaaguguaggaaaacaaauuuugucaugauuggugagagacugugauuauaauuuaauuacugacaaaauacuaaaaacucuuuugguaucuga

SEQ ID NO: 6264 - RNA, 8583 nt, Mus musculus
ccuccaaaagagaaacguucccccacccccacccccuccuuucggccaccgggagguuccucgcgggauuucgguucggcuuucucgguucgggcucugugggugugacaagaagaaggaugacugcgcuucguaguuucugauccggaacuaguuuuucaggaaacccggaaggaguagguggcgcgcgcgaagcguguuccuuguucuggcuuggagaccugcgaggugagcgagacgagcuccagguaagucucgacuccuucuaggacggugcagaggaguguaguucuuaauggcucuacugaaaagcaucuuaucaucuuaccccacggucggccucccccuagcuacuucauaaauugucuuccgccccguggcugcugccugccuugccuacucugcaaaccuuuggaagaagccaagauagaacccagaauuuuagucgcuggcaacaccuccucuuagagguggcauugauacgcuacccuagcgugaaaaaaauggagaacaggccucacacuauacauuuuaaauauccgucuucgaauuguugagcccagcuuggaaaaggaaaagaauucuaaagauggauucaaaaguauuuuuauuuauugguauugcggugcaugcacguugugcauggugagcaaagcgcucuacucugaagcuauuguuaaucucauggauucgaaguggaagaccacugacccaaaucauggccagauuaauuaaagcaaacuuuuuauuauuauuauucguuuacacggacuauuucucccaaaaggcaguguucaagagaucagcacuggacauggggaaaauaaggauuuuuauaguucaggaguauugguuuccaaaugggggauuuggcauauaaacaguguuaauagcagcggaaagugaacauaaguuggucauaacaacccucugaaguaagacaugguugcaagguggucaguaauagccuuuggaaacaaaggcauaguugccguuuccaggaaaaggcagaucaagaauauuuagccauauguugcucugugacacuaaucucuaccacauuggacagcauagggacagacagaagggccaacuauguacguguguguaauauuauccauauuuccaggcaaauagguaguuuugcuuaggagacugcaaacugugagaaaggucaggugagcaguggguggaaguugaguuaaauaacucagaggaagguuuaaaguuuuaaaagucagcagggaguggugcacaaaacucaagaaugaaacacaaaaagaaagaacugugguagcaaugacagccugucugguucuuuagcaguuuggauagaauaguauauuacccauccuguaauagacgcuauguagagacguuaacuuuccccaaaucugauuugcuuauuuuacaaccuagaaauugugaggacuccuaauucuaccuggcaggcagcuaucaaacauuuguuguauuuaacuucucuuggucuuagguucucuguucccccaucuuuuguuuuggauuuugaaugcuuucuucauuaaaaugggcagacaauguuuacuuugaaaagauuaugaaaagggagcuagguuucaggauacauagcuagaaucccagcuacugggaaggcugaggcaaaaggaccauggcaagagcagcccaggcaaccuuagcaaggugcaguguaaacagaggcagggaugaggcucagagaguccuugccuaacaugcaggaggcgcaagagcaguaguucucaaccuguggguugugaccccuucauauggggucauauaucaaauauucuguguaucagauauuuauauuauguuuccuagcauacaauguagcaaaauuauaguuaugagguaaaaugagauaauuuucuaguugggggucacuauaaaaugaggaauucuauaagagguuacagcauuaggaagguugagaaccacuauagagucuaccccaagcaugcagagagggagagaagagggucagugagcugccuccucaccaggugaagacaagccuacaaccucaaguuaaucccuggggcccacauagugaaagaagagaacacauuuccaaggaaguguccugaccuccacacauucuuaucuguauuguaugcaccuaugcuacacacacacacauacacacacacacacacacacacacacacacacacacacacacacacgcacauagacucaccauagcuuucaaacauucccuugccaguuccuuucuaucuugguguccuuuuuuauccaucagagaggccuguuauuccuagacuuggaguggauccuucuugggaaaucuguacggucguacauuuagaauauggcuucccaggccuaaauccaucacaguucuguuagacuucuuuauucaccuuaauagcuauuccaaaccuuuguuauauuuucauaucugauguuucauuuuucuuuaagaaaauaagaggcaucaguuuuuaguuucugcuucaaacacuaaagauauauucuggcuaagugcauuuucuuuauauacacauuucggugucucuuucucucugauuuuccuagccaaucuaauaggaaagucaggcuuuuaucuacucauugggauuuauuucagcacucuggaaggucuaugcuucuaaccaagucuaauccagacaaccaucauuuguugcuucuuuuuuucauuguuacugucuuuagaacuccagcacaccaaccauguggcugguaucccugagaaaauauuuaugcuuuaaauaauccuacauccagaucagugucuuugcauuauaaaaugaccucucauuuugggagcuaauacuuacaucauauaacccuaugaauaaucaaagcacauauacagacucuaacacacuuguaauuacuaauucacuuggauuuaaauagauagcugaaccaucuaaaguuucuacuauaaacuuuguccugguuuugaacuauauaguucaugugccuaccugaucuauaaaugaguuuuaugguauuuaucuguauagugacuaagaacuguaauuaaagauuugguagaguauuugucugacaugcaugaaugcaggguuugauuccuagcacaagugccugggaaguggaggcaggaagauaagcaguuugguaagcuuuggcuuccuggggaguucaaagcuaagcuggccuauguuagacccacuuucaaaagccaccuuaacaauaaacaaucaaacaaagcagagucagcuguggugggacaugccuguagcuccaaugccagggaggcccggggcucaggcaaaggaauuauaauaugaaguuagccugguuuacauaaugaaauccuguaucauaaagaaaaaagcccuggacucaagcuaucauugcuugacucaaguacuauaggaauacaaucuaguggaggauuaaugcucuacccaauacacuugugugucaauaaguuuuaguuguuucagcagcuuugugccaggcuugugauuccagcuacuugagaaagagagguagaaagaugacugguucauagugagaccuuguuucaaaauaaaagguaaaaagaagucugggcauacagcuuggugguagaacacucguuuagccugggugagguccuggaucaacccccauugccucuacagaauuuacuucugucaugggaaguucccugugcugggcagaagccccucagcuugcugggaucccaucgugacucaacuguuggcacuuuaguugccuggaaacagacaaggauauauuaacccaacaacaugccagcaguaugaggcaggagacauacacagaaacgaggucagcuugggcuauagagugaaaccaucucauaaaacaaagaacaaagcaaaauaaaacaaaaaaaaucagaauagucuaauuuaaaaguaugaauaucuccaagcaguaguggugcacaccuuugaucccagcacacaggaggcagaggcagguggaucucugugaauuugaugucagccuggucugcagagcuaguuccaggacaccgagggcuacaaagacaaaccuuaucuugaaaaaauauuuuuaaaaaaaucuacauuugauagugugaaugucgugguaugugaauuuuuuugguuuauuuguuuuuguuuuucugacaggguuucucaguguggcccuggcuguccuggaacucacucuguagaccaggcuggccucgaacucaggaaucugcucaacugcugggauuaaugguguguaucacugccaccacccagcuaugaaauguuuuuaagaaauaguuuguacugcuaugcuauucucaagugaaaaucuuugguaauuuauaaucuauuauauuugccauauauuaacaugucuuuaugaguaauaaaagggaaauuuuugauaaaauaugaguuuccagccuggcggugguggugcacgccuuuaaucccagcacuugggaggcagaggcagguggauuucugaguucaaagccagccuggucuacaaagugaguuccagggcagccaggguuacacagagaaacccugucucgaaaaacuaaaaaaaaaaaaaaaaaaaaaaaaugaguuuucaucaguuccacuuagauugugcaugcuuaguucccagggugucacuuaagcgcuguaaaaauggucacuucaugcauacaaaugcuuggacacuacacuacacuacacuacacuacacuacaggaagaaacugaugacaaacaggaauccaagccaggcuuguugcucauucuuguaaucccagcauuggaagauugaggccagaggacuguaaauucaaggccugucuggauugcagggcacuguagaguagagcccuguagagggagggaaggagagaaaugccugcaggauaguuacacuucuaggaaaaaaaaaaaaaaaaaaacaaaaaccugaauuuaagagcccuacuucaaauacuuuuguucagauauaacaugaaguuguguuaagaccuuggauaaguuucuuauccauguuaauuuuaauuucuaaugcugcaacuuugcuuacagcaucgauucguggccuaguguaccuuccacagguuuacugugauaaugagaaccacacuguacugucuccauugaggaccacuguguuaugaagacacagaucugaacugcuuuccagaaaggagcagaauguuauuucuuauugcuuuggauauuuuaggcauguuguccaagccaucauuuccuuuacuccacacaauuuaagacugaauaguauaguggguugguuuuguuguuguuuaaagauuuauuuauuuauguaugugaauacacuguagcugucuucagacacagcagcagaggucaucagaucccauuacagaugguugugagccaccaugugguuguugggauuugaacucagggcucuuaacugcugagccaucucuccagcccuauagugggguuuuuaaacaaauuuugcugacuguugaaaaugaacaaaacuauuucaugugggucuuugaaucaacuaguacuuggggauggauggaaacaggguccaugcauaaaauccugcaugacuuaguuugguucuaaaauacugcuugcugcuuguggguaacuuaucugaauagugugaaacuucaguucuagauaauaccuuuuuucuuuucucuuaagaugcucuccaaguucuugacuauggaguauuugguucauccugguacacucagcuuggcugcuggaguugcuuguggcaugugccugggcuggggccuccggagccaccuugggauguucccccagaacucaacaagugaggcaaauagagacacagagacuggaacugaagcaagcaucuugggagagaguggggaauacaaaaugauucuugugguucgaacugaccuuaaaauggggaaagggaagguugcugcccaguguucucaugcugccgugucugccuacaagcagacucaaaggagaagcccucaagugcucaaagagugggaguacuguggccagcccaaagugguggucaaagcuccagaugaagacacccucauucaauuacucacccaugcaaaaaccuugggacugacuguaaguuuaauccaagaugcuggacguacucagauugaaccagguucucgaacuguccugggaauugggccaggaccaguagaacuaauugaugaaguuacuggccaccuaaaacuuuacuagauaagcuuuugcuugauggagauucuguccgaagacuauggagccugucaguaacaauaaaugcuuaauucuugucccacuuuaaagucuguucccauguuccucuaucauguacuagaccauuaauaucuugagcuuaaaauacuauugaagggguagagagauuccucagugauuaagggcacuuguuccucuugcaaaggaugcugguucaguuucuaguaucuggaucucaguuuacaagcauccagauccaguuccagggaauccaacacccucucaaccacaagguauacacaguauacauauauacacgcaggcaaguccucaaacauccaaagaguacauaaagaaaaaggaagucucaagaauaaaaauacauucucuaaaugcuccuguggagugauagggucucaaacagauuggaagugagacagugccuguaaugacgcugggugagaaggaggcugcguuucccagguacaguuaggccccuguguguugauuacucuuuucucaaaccaugcuguuguccuuugccuuuuugaggaucugguucaagaaaucauauuguaauuuuuuucugcugcuacuuuuugaauggcuguuaaccucuuuuuauuauuaacagaucauugcauagacucacugcaauuuugauuuagauauuaacuagcuggacuuuuugagguggucucauacuguagcucaggcuaaucuuuaacuuguggaaauccuccugccuugaccucccaccugggagggauggaaguuaugaaccaucauacccagcuacucucuaaauucauuucuauuucaaaguugaaauuuuaugaucuauguagcauuuuguuguuuauuucuccagauccaccugggcuaagguauuucacagcuguucuaauucauaaacugaaaauuccucuacuuuaacagugagaccugugaguuugugaagugauaaggauuuacaaaguguaaaugugagaauuuaugggaacuaaaggacuguaacuguacccagccaguuucuccuagaaauuucaggaccuaaauaauuuuauuauuuuagggcacuuuuucuccccguaucccugagccuggaacucacuauggaacaggcugaucuaaacucagagguccuccuaccucugccucccagugcugggauuaaaaacaugcacuagcaugccugccuacauaaagcuuucuugacaguuugcuagaauucauuuuucuugauaguucuaaaagauugacagugauuuccaaguuccuuauauccuuuaaaacuauaaaugauguuaaggaaaguaagaccguaaguaggaacuaagcagaaugaugaagacaacuguaggcagucuccaaguuaaagugcuuagugcauuuuuauccuacggaagcauaaaugguacaggaccaaucgcaacacugaaugaugccacaguagcaacaguuucuagacagaauguuuauacaugagucaagugaugcaaccacauguaacugaguagaacucaaucuuaaauacaugguuaugacucagguaauuuaugaggcuugcugcagacaaaugguuccacacuaaaagacuagauucccagcugggguggcugauucaaugaccuguaacaagcugggccuuacaaggacauaguaaaacuuguuaauucuggugacaagucacgguauuuuucugguucaccugcucuugguauauacuucauaggacuuucagaguaguucucagagcauacucugcagagcacaagaguuugcuaccuaccuguuuucacuagcuuaaaugaaagggauucccgguucuaguguguuccugcugaugguccacaugaacaaggaaccaucagauuccucagcccacauucacaauaaagucucacuuggccugaugaagcaguuaaaaagagcaguauuuuuuuuuccccagcguagguaggggaagggcuuugggaacugaaagcugggcaauaagaagucuuuagggaaguccuccuugguagguggcccaugcuccuguagauggccccacaugcuuucaaacagugucagcauugauugaacucagugcacuguuaugaaagagaucaaccugagagggagaugcguaaggguuggggugcuaggcucauauaguacacuguauacuuguaugaaaauuucagcaaauaaaaaaugauuaaaaacauuuuuuacucaugacuauuuguguucauaucuuugucuaaagggcuguugucuaguuugugagcucagcuaacuucauagaacauuuuuacugaaacaagaggcuggagagauggcucugcaauuaaaaucuuacacaaaaucca

SEQ ID NO: 6265 - RNA, 63402 nt, Mus musculus
aagggagaaaccggagccuggggaaagugaugagucuagaaaaaguagucccucgguuccucuguuuccccgcagccgcaucagcgaagagcgcuccgcgcacugcgucccugaaucccuacgcccgaccgcggcgcggcgucuguggaaggcuacauaaggcggacggcgugaggagacugggcggaguucugccucgggauccuuccgcagggcucagccguuuccggagucugcgcugcucccgguuccgccauugcggcucucccggccccuggagccuccgcccccgacccaagcucucucgucugccugccaguucccugcguccccggagaguaucccucugagcccagccuccccuccccuuccccgucuccuccucucccuuggagagcccgggcaggcacugcccugcagccccagugacaggaggagaccauacuccccgacagcgccauggcccagauucugcccauucgcuuucaggagcaucuccagguacgugugagucggggcugcugagggacuuuucgagggucgugggaaggaagaagcuagcggccuggcccgaaagggaucgagagaaggggaguggggggugucgguauuuggcauagguggaggaaggacagugucuuaaaagcuuaaaggguuaaaugauaugagacuaggauggaaaugacgaaucggagugcaaagggcggcgaggccaggccuuacgucugacgaccucuuauucugcuuccuggauugcaagaacugcgcauaccagaccccccuucccauuuuacucaguucauucauuuggguaggggcuaggugggggagcuucucgcgcguuucucccagagcaagauuucucguuaacccugagcgacgcggggcugucaccuucccuuggucuauucccauuucuacaucgagucugcacccaggaauuguguggcggguggguuggggaggagcugcauccucccucugcagcucaccacugagaaaggcaccuugggguuaggguagcaguggcucguggcuugccuucccugaaucuauaaggaaccgaaggucacacucacugaaggaacagaaagaagauagaggggcggcaaggggcggugucagucucggugccuggggucaaggucccaaggggaacgcgcauauuuuuccuuucuugguuucuucagaggguuaguguagcucuuaggcucacuuugauucuugcagguagggagaguuauuuagagguuauuuauggccuuuuggaauuuagcagguaguugugggauuacggcaggaguaugucucacaggacugcguggaauucaucagagccggguuuaagugcauaccugcucugugucaguaccuaacaaguugaucuguaacuggcuccuuuuuaauagucuggggcguccccccuccgccccccacugcaccuuauccuggagucaauacaccauugucuaaccuggcaaccugccagcaguuggccuaggcaggugacuguuggagggcuucgcugaauuacgcuucuucugaacugcugauuuuccugguucacuugucccgacucuuugacaucauaauuuauucauauuaauuuacuuucccucaaguauccccauaaagaaaucugcuuucagcugcaucuucugaagggcuaauuucaugagggggaggugcagugauccaguucaaauauugguaacuuauugagugcuuuaucauugaaggcaaucugauuuacuuuucuucauugauauacauaaaagauguuugauaauaaagaggguuaacuaaaauuuagcaccaaguaaaauaauuaaauauuucuuuauagacuuuaccguguugcuaacauuaacgaauuauuuuacuuuaggacuucuuugcccauuaaaugacuugaauacauuuucuucagucaucacuaguuuucaaauaauucaucugauuuuggcaauaagaucucuauuuuguaaaggucugaaaaaugucaagugacaaugcugacagagaaguuaauuuuuguucucaauucaagcuugaguuuccucuguuaagaauauaaaguguuaggaaagcacuguucuggauguuaguggacagugggcucuucaggcugaguuaagagggaggcagccuguguacacuaacaacagaaaaaaaucuagcuuuaauuaauugcuugcuuuaauuaauuugaccaugauuuggguugcuguuuuuucuucucccaucuuugggauuaacacuuggccacacugaaguuaccagaaauagcuuucugcaaauauguguauaaaccuuacacaaaagaagcaaagacaacugcugaugacaugaccguugcuggugauuugaguaauaguuuuucauuucuauuaaacucaagaccagaauuguugaauggucuuacagacuggaauccaaacuugucacuaauuaaaaacagauuuaaugcagguguggcaugugaguagcaauuucugcaaauauuugaaacuguuuuccaaaauuuaaagauuuugaauauuuauaaaauagcuuuacagauacacuugaagaucucggaugcuuauuuucuggaggaccucauuacacuuuaggcuuuggcugguaggaucccacucuaguagauagagucaggugugccgaaaggauaauguaucuucugaucucagacuuuuauucccucucuuuuaacaaacaaacauacaguguaaggauuauuccaguugucaucuuaagucuuugauugcccagccucugccauucugcuuagaaaacaacuuucuaaagcauuuaggagaacugggaaguaaggaguguagaguucacuugugaaaguuaacagcaaacucuaaauuaauuuauuuuaaacuuuuuaugagaauguugcaaauaaaaaauugcuauuuauuuucauaucccuuugugcauuuguuuagaugaagaucugucaucaaggcuuggaacuauaucacauaauuuugauauuuuaugugaugaaggaauuuuuguugaguugcagauucugaacaaauucuaggcugcagaacucagaaaguucagugccagccagcaaaacccugucucaaaggacaaaacaacaaaaccccacugccugcaauuuucaguuccuggcauauuaagcauuuugcaauugacacauuuuguugagcauuuggauacuuuuaauuuucauuuacaaaucuuuccaccccguucuucucucuuugauccauaaacacagacaugcaauguguugcugaguugaauaguaggauucuuaagaagguuuugguuucaaagagaaagcaguaauagaugcuuaggaagacuagaagagcaugccaccuggaaguagacucuaaucuaccguggaaauaguuuaaaugaagaccgauucccuccccccccaccccccccagaauuuucuuaaagguuaguuuacucagcuuuaaggaguuuggccaauuuuaaugaaaauacuugugcccuguuugggauuauacuuuaagguaugcaaaacuaugguuuucacuuuaaagucuugggaacuuggguagugugcuguugggacaguuguuucugauaagugagggcuagagagugaggaggagagcaguccaacuucuguugugugcuguguccucacucagcccuugguccugucucacauuaacaguggaagacuaaggcuggaggccguacucaggggccauagucagaaugggguuuggaucgccucuucuguuuuuaagacagagucuuaacuauaucgcacugucuggucugaaacuuacuauguauaacaggauggcuuugaacugagaucugcuugccucuggcuccagcgugcuggaauuauugcauauuccaucacaccugaccauaaaucauauuuuaaagacagugucuugcuaauguugcccagaguggauucagauucaaaauccucuugcuucucagccucuugagugccgggguucuaggccugcaucaucaugcccugcugcagugauugccuuuaagagaugcuacaagggaccagagaggugcucugugcuuaagagcgacuguuaacucuuccugagcaccuggguuugguucccaucacauacagacaacuccucaucuccuguaacuccaguuccaggggcucuucaguccuccaaggauaccaggcacacauguagcacacauagguauaugcaggcaaaauucucauguacauaaaauaaauaaaucuaauuaaaaagagagagagagagagagcaagaggguuggagagauggcucacugguuaagaauacugacugcucuuccagagguccuggguucaguucucagcaaacacauaguggcuuacaaucucuguaaugggauccaaugcccucugaagacagcuacagugugcucauagacauaaaauaaauaauuccuuuuuuuaaaaauagaacaagaaacuacacagauuuccuacuauuuucuuuccuguuggacuuuggccuagagaagagauuuuccucuuguuuaaaguaugauuagugaugugauacagugaacaaaggaagucuuggggcuggcucagugagacaaguucugacuaucagaaacaugugauggucauaaguaacagggaaaauauaggugcaguucauguuuuauuuaacacauuauacccaagauacuauuuuagauauauucaguauaaaauuagcuaguugaaauucuauucaaaauggccauuuuguauucagacaucuugaucuagaccuuuucuucaugggaaguacuugguauguauuuaaagauuauaugcuuuauuguaagaagaccaaauuugcauggcugaauuauuuacuuacgcuuuucuguuuuguuuuaucuugguuuaauuucuauuuuuugagacagggucuuaacuauguagcccuaaaugcccugauauucauguagaccaagcuggccucaaacucagcagcccaccugucucugcuucucuugcauugggaucacaugugugcaccaccuuacccaacccuucuggaguuuucuaauaguugacuugguuacugacuguugguuauuugacuuggaguaauggaaaaugagucacaguaaccauguuucaugggcucaguguguggugcugcauauggccauguguaggaauaagauaguuggguuuuuuuuuuuuuuuguuuuuuguuuuuuuagaaacagugucucauuguauagacuguacuaaucuggaauuuguuagucucccugcaucuagaaugauugcagccugugccccacuacauccuacugucuuguccucccuaccccuggguuuaucuguauagcccuggcugucuuggaaauuguacuguagaucaggcuggccuugaacucacaaagauccaccugcuucugccucccacguacugggaucgaggguuugcuccaccacugccuagcuuguuacuuauuuuuuuuaagauggggugucucuuagcuguagucaagaaggcuggucucaagcuccugaugccccuguuuccacauucuuuaaggugguaauggugaagugaacaugcucaccgaguaugugagaaauaaguucauaguugauaguuccuuuauacuagaaugaguuaauuuuauguauaugccuugccaaaacuacaugaaaucagcuuaucuuguaagccaguggcaaucauacuuauaggugucuuccaucaacccaugaacucuaguuaaugcuauuaacuugaagauggccaaaagcuuggauuuuaauguauuaaugcaaaguacaccugucaaauguggguucugaguuucuuuuguguuaugggaaguauuuuuuuuuccuacucugaaaaacugucaaacuuaauuugacaaaaucaaacuuuauugacuauuacagccacuugaauauuuaaaaacuuguuaaacauuuuauuuucaucccucuggauaguucaaauuagccuccuuuuauagaugagaaagcuaaucacacagauagugauuagauuuuaauguuuauauuuuccguuuggcaagguacuuucuucagugaauagucuauauaguuuuaagugcaaaauuuacuacauuuaggucagugagaugguuuagaugguaaagacacuuugcugugcaaacccaaacacacuuaaaccccuugcacugaauaaaugcacaguuguccuuugaccuccacauauguagaauggcaugcauguauaugcacacacgcauugugugcgcauacauuauaauaaauaacauuaaaaaauuuaucacuauuguuuguucuauacugagguguucuuuaauacauauauuuaguuuuuuuuaaaugcauuugaguguuuuuuguuuguauguaugcaccaaaugugugcagugcccacagagacagaagagggcaucggauccccuggacaguuagaagucaccauauggaugcugggaauggagcccaggucaucuagaagaguagcuaguguucuuaacugcugagccauuuaucuagucccagcaguuuuacuuugggugguuuuguuuuggagacaggcucuugcugucuguguuuuagacuaugugcccuugaguucuucauccuccugucuuugcuucccaggggcuggaauuacaggcacaguccaccaugucuggcauaauagcuuuuauaugaaccaacauuuguuuuuuucucuuugccuuaauuauuuagaugauacuuuuuuuuuuuuuuccuucgagacaggguuucucuguguagcccuggcuguccuggaacuuacuuuguagaccaggcuggcuuugaacucaggaaucugccugccucugccucccagugcugggauuaaaggcgugcacuagcacugcccggcuagaugauacuuuuuuuuuuguuuuuuuuuguuuugagacaggguuucucuguguagcucuagcuauccuggagcucacucuguagaucaggcuggccucgaagaaacccgccugccucugccucccaaguacugagauuaaacgcaugcaccaccacugcccggcuagaugauacuuuuaaaggguguuuucuccaaguucucagcaaugaaauacccuagaaagauuaggaucaaguuaauuuuagaccaggauuaucuguauuccucucaaaguagaagcuuugggacuuuccaguugucuuuucuuuaaugacaaguguguguuccauucugaagccacuguuguguuuuuuuuuuuuuuacuuuauauucaugguuuuggauuuauacuaaugcaguguuaauacuuccuguucugacuuaaaaagguaaauaguuuuuguuuuguuuuuuguuugcuuuuaaguuagauaaagcagccuuucuuuuucaguuauuucugaaaagaauaggaaccaaacucauuaaagccacauuucaucauacuaugaaauuuaaacugcaguguacaauucuggaaaaugccaguuuggguuuuauuugauuaugucaggauuuuagcuugucucaacuuccucauuuaguauacacuuccuggcaacugugauguuagcuuauaguguagguuguguuuaugguauaguacuuagccuuucuauacauauaaauauuaauucucccaacugccuuagagaguugucuuuucaucuacuuaaagaauacaugcacagcauguugaaggacaaaacuacaaucugcccacuauugaagccaagcucuuggaguucugccagacuguuucccgcuuuucauuuucuaucccuaugcuauuucuggaguagggaagggaagcaccuauagugaugcacaccaaggggucuuagagauggucuuaaacuauugaaccggaaucuuaggagcugagaaguaggauucgguuaauaguugaggucauuuauuuccaacuagcuugcucaucugaaaugaaaccaccaaugacuacacauguuuagcuuguagaauuuauaaauguguagacuugguaacucuaaguggaccuuaauuauuugagaaugauuaaucaggugaaaagaaacccguaagagguacaugauucaugaaaccccuaucuuuccccauucugcaguagucuguauguggguauauugaacuguggacaagaugguuuuguguuuguuugcuuuuuaaccauaaaacauccucuaggaaagaaucuugguuaacucuggaggagcaggaagugcucuccucugcgccagcuccagcucggguuuacuuucccuguguagagaaaggcaaaugacuggguuauuuauuaaggcuacugaaucuuuuaaaguuuauacuuucaaaggggcuaaaagcuuuugcaugugaaugugagugugcauauuugcuuaguugcuggcaauaaaacagagggccuugccccaguuaaguguaagcucuuauuucucagcuaacacccuagccuuuacaagccuuuuucuuuuuuucuuuaaauaaaauucacaaaaccuaaauuagccauuuuaacacgaacaugaaugugaacagcacccugugccgaauuuguggcaacucuuggaaacccaucacucaccuguauucucagcucuagggaggcugaggcaggaggauuugaguaugaggucagacaagauuuuacaggaaggccucauuuccaaauaaauaauugaaugacuuaguguucaaaugugacaucaguuagguguauuuauuuucaaacauuuucaaugcaugagauggaaguuaauaccuguugagcaaucuuccucucauuucuuaccauccauuggcaacugguaaucugauuucugucucuaaggacuuaauuuuguggcucuuuuacauaaauggaaucacacauuauguuuugucuuguuucugcuaugauaaugggcaggcagagggagggcaggauuuugcuguguaguccagucuagagcuaacuuggcaucuuccuguauuagcuucuugagucuuaggauuacaggcauguaccaccaugccuguccaagaacaaguuacauauuuaggaacuaaagagaccaaaauaaauggaauaaaaguuauuuuuagauacuggaaacaaacuuugcuuauaugaagggaacaagaugaguaugauaaacuaaaacuuauuauaagcauuaaagauaucccuucuccuugaccaaacaaaagcaagauaucuaucuaucuaucuauauuuuuuuugagacagggucccacuauauaauccuaacuggccugaaacuugcuguguagaccauguuagccuuaaacuccaccugccucugccuccuaagcacugggugugagcgacugugccaccacccgccguggacuucagcuuuaaccuauucagugguuguauauuacugagguggauuuuuuuucccuucuuggaaaaggugaucuacaauuugaauacaugucccuaaaagccuaaaaucugcuucuucccccucaauuuccucaguaauaauugugauaaaguuagaauuuaauacaguaaaaguuugauacaaaaauuguacuuaaaauacuggauugaagauggcuauggggaaacaugcuuguaauuccagcacaugggaggcagaagagucucacguugugggcuagccuggacuauacauuugagauccuuuaaaaaaaaaaaaaccaaaaaaccaaaaaaaaaaaacaaaaaaccaaucgccaggcagugguggcacaugccuuuaaucccagcucuugggaggcagaggcaggcagauuucugaguucgaggccaaccuggucuacagagugaguuccaggacagccagggcuauacagagaaaccuugucuccaaaaaccaaaaacagaaacaaaacaaacaaauaacccccccaacaacaacaacaaaagacaaucaaguugccaaauaguagguacuuacuuaguuaguguuaguugaagacaaacuaauugcaaucuuguuugaacuuucugaaaugcuaauauuaagugauuuugacacagccagaaacucuuuauguugaaagcaauuucauucauucaugugaaccugaaauuuguggcacuugagcucacaagaaaauauuucaguaauccauaaaauaaaaugauucugguuuuguaacuuauagcaccugguaaacuguaaauuggucaugcuacaaauaaguaauucaagcagaaaaugagcaguacagcauugugucuaacuuucuaacaggucugcuagcauagaguagaaguucacaggagagugugcagcaguggcacggcugggguugaacugaccugaacagucugugucaaggaguuaggaccuagaaaaguggauuuagagagucauaccaggaaacgcugcugucugcccauaccauagcuguguucauaccuaacagccauguaggugauauuuuuguggucguuuuugugcagucucagggacuaaacccagagccuuuugccugccuuugcuguuucugcuuuugagggucuguacauucuugagcucuuaaaauaagcucccucuccucccuuugguauauucuuugccugcacaauggcauuuguauaagaaagggccuaaucuugcaaugccauuuccauuuucaagauuuuaggcauaaaacuucuauauucucuggagcuuggugaaaauugaucaaauauuuuaucugaugauuggauucuuaaaugaaugaauaaauuuagaauuauuuuuuguuuugucuuuuuaauugaguaguagguuauaaguaggaaaaauucuuuaugucuuuaggagacgcuaguaugauccaacuaaucaucuuguuuaaaguccaugucucuggcuguggcuuuugcuugcauugcauucaguuuccauuuacugcugagagucaaaaguccucccaaaagugauuccuucagagacugcaguagaaacaaaccauacauuuuaauuuaauuuaauuuuacuuuuugaaacaggguuucucuguguagucuuuuuuuuuaaaaaaaagauuuaauuauuucauguaugugagcacaucguugcugucuucagacacaccagaagagggcaucggaucccauuacagaugguugugagccacuaugugguugcugggauaugaacucaggaccucuggaagagcagucaaugcucuuaaccacugagccaucucuccagccccucucuguguagucuuagcuguccuggaacucucucucuguagguuggucucgaacaucagacucacagagaaucaccuguuucugucucuugagugcuaggucuaagggugugcacuacuacugccuggcaaaacauguauguuuuaagugugggaucagcaaagguuaaaaguguuuuuauuuguuguuugaaauuuguggagccaacagaaacaauggcugacauccuguugauggaauaaaccaaaggacugcugcaaucucagcauuuuucuuuauuuccugacaacuacagcaacugcaguuuuugacauccuucuuucuaguuuuuaggaaggucuuagugaagugacagcucagcguuuuucaauguggaagacauuacuaccaguggaagacaggauguuuggaguuuacagaagaaauuaggcugaaugaaagaaauacuuaggcuaguuaggaaguuaacuaagucuauaggcacaugccuauagaauaacuauagaaugccuauagaauaacugguauauaaaacuuggccuuuuaaauugguggcucccaauaguaaguccuuucaugcuacaggaauuaccagaaguguccauagagcauggagaaaauagcuuugucugaaaugcauacacacuugcugaugcugucacuguucagaugaaacaagaaggaucugaaaaguggugugccaagcacuaauugugaaacgugugguguguaagucuuaaguaauguugucagaaacacaagcuuuaauguguuucagauuuucagcugauguagcugcuaaagagcugugcuccaaguugacuaggcauugagugggacacauccuccucggguguacuuuuggagaagaugguuugugauucauuucuuccuggcccaucccaugugagaacuggauggaugaggcagagcaaacauauuaucuaguaggcacaaauacaguugcaagugauggcagagacugagggauuagugggggaacugucuuacuacuuccaggagugugguuuuauuugguugugugccuucugcuaguauuuuguucugcauguguguucccagacugugcguauuuaugguucaugcaguccuuuaacaauguucucaugcuuuggucacuacauauuuugaugcugacuuaccucggaguuuccugguucugugacuuaccaagguucaccuguucuuuucaggaaaggaagagcaaagcaguugucuggcaaagcuuacuuaggaaaugauagauuagcauucacagcagucuguuucagaauagucuguaaguaacaagcuguaguccuagggcuugguaacuggaaggacagaacucccuaaaauacagugucucuguguggucuuaaaugccugauguguguuuaaucaguaacuuuauauauauauauauauaaaguauauauauauauaaauuaagaaaggacuuaacucuagcuggucucaaaaucaccgagaucuguuugcuucugccucugccucccaagugcagggauccaggcuugcaucacuaugccaagcaccagcccccuuuucaauaaaaacaacaacaacaaacaccaaaaacugagagcuggagagauggcucagcuguuaagaguauguacuacucuugcagaaggcuugaguuugauuuaugaggcacuguguugggugcuucauaacuucuuguacuccagcucaacggggccugauugucucaacgcucccaugggcaggugcucuaccagcugaacugcaucucuagcccucugucuagauggauuuguauagcauuuuguccuguuuacuuuuuaaauuuugcuuaaacauuguacaaggauucaaauuuugucuagauggauuuguauagcauuuuguccuguuuacuuuuuaaauuuuccuuaaacauuuuacaaggauucaaauuuugucuagauggauuuguauagcauuuugcccuauuuacuuuuuaaauuuugcuuaaaacauuuuacaaggauucaaauuucuaugguauuuuaccucuaaauacuugaguguauaucuuuagaaaauaacauuuuauaauuauauuuuuauuagcugcuaauacuuaauaacugaauaucugcugcaaaacaguccaaaugucugucacccccugguauuugguuuguuuaaaucuccaucucagucacaacuuuguguugcuuucaguuugucuacaguuuuaaaaaacauuuuugcaugaauuucgauuuagaauagaauuuccagguccagguuuuauccaugcucauaaaguguuaacuuuuguggggagggaggguguuggaaacuuaagcuggcuggaaacuugugauccuccugccuuagccuccuggggcugcagucacaagcguggaccucugccucaccagccuuuuaacuguuugauuucauuugacuuguauucuuucugacuaagugcacuucuuaacugcuuaccagcgauugacagaugugaugcuuauuucucaauauacccuauagcauguguuucuuaaaauuaauauacaguuacaucuuucaaaacuaagcuauaguuacuagaaagucaugacuuaaugugguuaucucaggucuugcucguaguuagccaguuacugcaaugauguugacuguauccaaagauaacucaaacaacagguugagauuuuaaaaucuagaaugugcuguauacaaggcauuuuuggaaagguacaguuauguauaauuuuguacauuugucccucauuugggggcuauuaaauagguuguagugauuguuugguugucuaaugugggcgggguaucuuuaaagugaaauaaagcagcugcugucaguuagacuccuuucuugucuugaaagucauagcugaguuuucugcaucacaaauuuccuuuuccucucuguuuuaggaagaaagcagcuuuugaaaccaaccucauguuaguuuuaacauuucauauuaaauccuuacaauucugagaguaaguagguggugucguuccaaaugguuaagaugaagcaauauacagauaucaacuugucuaugguuaauuuuaguggaagaaacuagggccacaucagacauuugggcucuuuaagaagaauucggcaauuuuuugaugccacuugaacuuuuuuaucaaauuauuuaaauuuacuauuuacuugaaugacauuagccuuaccagguuccuuuuucaucgagcauguuggagacaccgguugugauagaagacuuuggcagugcuguucuauauacuaguaaaaaguuaaagaggguuacucuuuaggaauauguggcgcggccuuguagauucuuuucuuugaaacuuaauuagcaaaauaaagagcagcauuauaagccuuaauuauagugucuuucucuaaagaaagaaagaaagaaagaaagaaagaaagaaagagaaagagagaaaaaaagaaggaaagaaagcaagaaaagacuugguagcacauccuugaagucuuaaguaucccuguuccuuauuguccauucaaggcuaaucuggagcacauacuuuguugcagggcacuaggccuacauagcaagguugucuuaaaaaacaaaugagccugggagagaaagaauuucagugucguggguaaguuucugagagccuacuguuaucaguguagugaaaugucacacccacgaccugaggacagcugaaugaagcagauaaugaaaugcaaugaaagacaguugccuugagcugagcccucuguucugcuguguguaguuacugauagugucuaugcagaccugauggugucagacaugguuuuuagcauuucacuuaaauccucucagcucugagaauugagaggaaggaacaauacacagauccacucuaguggaacuuuauuuacucuaguggaagaacuagggcuacauccagacauuugggcucuuuaugaggaaucuagaaaagcaacuuauuuuagaugcuacuugaaauuuauaauaaaaauuuuaggguguggaaaguugaaauauuauauuguacugcuacagaaucuuagacuagagugccuuccaucuccaguuugauccaaauugaaaucaagagaucauaaaucuaagguuuuuuccuuuugguuuuucaagacaauugcuuucuguaucccuagcuguguuggaacuugcacuguagaucaggcuagccuugaacucacagagaucugccugccucugccauccuuugggauaaaaggugugcaccaccacuccuacauaaaaggacauaaaagguuguguagacuuacgccuucugaaugcuucacuuuuucuggcauauaucauguaccaucacaccuuuaugguugacuuaauauuuucuggcuguuuugaaaauaaaaacuguaaaaguauggcugcauuuuuaaagauuugaucuguacaaauauuauuaaacacuaguaugggaccuuuuauguguucuuacucuacuggugcaucuaagccagaaguagaguuaaugguggcugacccuguucacuacuguuaggguauuuuucuguuugccuguauuacaggaaaauaggaucagaaccuaaugggugaguaaccuuggcauuugccucaaguaauaccaggaagggagaagaacuugccaauuuuuacagagguggaggcaagucacuuuucuucuguuaacuaauaggauccuugaggucucuguccuuugcuaacacuuucuaggaaagagcaguuucuuauuuaguuguacaaaugaucaucguuuaagugugguuuuuuuuuuuuuuuuuuuuuuuuuugcuguuguuguugguuuuuaaaggcguaaaggcgugcgcuaccacagcccggcugcucucuuguucuugcucuuugucuuuuuucuuccugaguuaagaagagucuugugguauagccuagguugaccuuauacauagguuccuucugccuuagcuccuuaguagguaggaucacagauagaagcuaccaaacuuuuaguauuuccaagucuuuucaccuuuacccuuaaaauauuuaguuaugugauguauucuucaguuuauaauggguuucccauuaccaguauucuccuuuuucuuacaaaaacgcccugaccugugcuccaugggacuagaccaaaccccuggcuauccugacuaaucucugaauagucuaugccaaacccccucgcucugcgaggucauucucaaccugacugacuccacaguucuuuuucugccugcuucccuugcuuucuauucuguuccccuuuuccuuuuuccucuuuccucuuucuucuuuucucuuuccauucuguucuguuccuuuccugaguuugguuuuuuuuuuuuuuuuuucuuguucaaguuggccugggacuuagagaucugcuugccucgaccuauaccaagugcuaggauuuaaggcaugcaccaccacauauagcucuaauuuuguuuucacuuuucuuucuuuuuuucuuucuuucuuuuuuuuuuuuuuuuucaagacaggguuucucuguguagcccuggcuguccuagaacucacucuguagaccaggcuggccucaaacucagaaauccgccugccucugccucccaagugcugggauuaaaggcgugcgccaccacgcccagcuuuauuuucacuuuuaaauaaaguauaugucuguuucacguggaauagcuugaauagugcuaguacauucuugauaggaaaacaaaagguucgaaugccuaauggucuugguagagucugucuaguaagaaaggauauaguguaggauuauauagauugcaagcaaccuaauucuuuuaaaaccaaaucuucauuuuuuuuccuauaaguaaaauacucugaagguauaggccauuuaacauuucuuacuuccuccucccucccccuuuucuucugcucuuguuuuucauguagaguuucucuguguagcccuggcugcccuggaacuuacucuguaggccagauuggccucaaacucagagauccaccugccucugcuuuuugagugcugggauuaaagguguguaccaccaccaccuggcgcgcgcgcgcguguguguguguguguauaaauuggaaaaaguguuauguguauggauguuguccugcauauaugucugggugccacacauauuuuugauacccacagaggguauuggauccacuggaacugaaguugccagugguugggagcugccgugucaggcugggcaucaaaccccuguccucuggaagaacagcuaauucucuuaaugcagaaccaucucuccagacccuuaauuugauuuuuguuuugagacagaggcucuguaguucagaauucuucugccucauccucuuguauguagaugguaucaggcacuaucuugcucuuuauauugcuuuuuuuuuuuuuuuuugguuuuucgagacaggguuuucuguguagcccugacuguccuggaacuuacuuugaacucagaaaucgccugucucugccuccccagugcugggauuaaaggugugcaccaccacgcccggcucuuacauuacuuuuuuaauuucacuguuuggcugacacuuuuauauaagucuacauuuuuucagauacuaaagaaacugaagccgggcgugguggcgcacgcuuuuagucccagcacucaggauacagagucaggcugauuucugaguuugaugccagccugcucuacaaagugaguuccaggacagcuacccagagaaacccugucuugaaaacccaaaaaaaaaaaaaaaaaaaaagaaacugaacaaugguauccgaaaaauucaaaaguguaguagguaaaggucugggguugaaacuuagagucauaguucucauggcuagugugcuguguuccuguagauaaccguaugaacucugagccauugaaauacuuuuugcaacuauugaaggaaaugaucugcaugaauccuucaagggucuaaaaacagauguguauuucuccccagaaacuagauggauaacuugguuuuauuuaguuuaucuaaggaaaagaccucucugaauaccacucauguuccauucauacauuuggugacaauuuccauuccuucuccaguccugaaguuaagaaguaaccaaccacauuuguuguaaguuagcuguuuuauaguuugucuauuugccuggcauuagaguauaucuugagcuuguaaaacugguuaauguucuacuuuaaugccauguguguauuaaugguuauauagcuacuuggcuuuuuguccucggugcuaugucuaaguuauaacuacauuuuauuacugguuauaccuguaguacuugaggaguuaaagggaagugaaaguaaaagagucuuaguccuauucuggaccuuacucagauccuggccuguuuguagcaggagaguuugauguaagauacagcugacauugcucagccagcacaguaaagggaaugcacagcuggggacaagggcuuuuucucaguuuacaacaugaaaauucacuaccauggagggaagagggcaggaugggacugcucuuuuuuuuuuuuuaaaggauuuaguuaaccagaggauuagugacccauucuaguagaaucuuucuaguaacaggugacuucuguuacucacacuuuuugguuuucaaagauuuaccaucuguagaaccacuguuuauugagcaaauacuauaguaucugcuuuauacagagcaaaaauucccucacucccucccuuccuuccuuccuccuuuccuuuuuucuuuugugugugugguuguuagagacauuuucucuguguaacccuggcuguccuggaacucucucuguagauuaggcuagccucagacucagaucugcuuuugcuuugauuaaaggcauuugcuaccauacccagguauuaaaauucuuaaauagcucuuucuacauauauuguaaguuuuggauucuuuaaaagauuuaucugucuauuuauauuauagugcuuuauuugcauuuacacuuguaugccagaagagggcaucagauaccaucauagaugguugagccacuaugugguugcugggaauugaacucaggaccucuggaagagcagacagugcucuuaaaagcugagccauuuuuguuuguuuguuuguuuguuuuguuuuucgagacaggguuucucuguauagccuuggcuguccuggaacucacuuuguagaccaggcuggccucgaacucagaaaucugccugccucucccucccgagugcugggaucaaaggugugcaccaccauugcccugcuagcugagccauuucuugagccucaagaucccuguucuuaagagguaaauuuaggccgggcagugauggugcacgccuuuaaucccagcacucggggggcgggggggggggggcagaggcaggcagauuucugaguuugaggccagccuggucuacagagugaguuccaggacagccagggcuacagagaaaccuugucucgaaaaaugaaaaggaagaaaaaaaaaaaaaaaaaaagagguaaauuuagcuugucaaacaagcaguucuuucuugugucucuguauaaucuuuauucccugccuguucaagccuuuccuagucuauacucucuaguguauuuugaaguaucucuagcucccuuaagacaguuguaccccugugcaguagcacauguuucuggagagaguucucuagacuggcuccgcccagcuucggaggcgucugauagagccccgcccauagggcugguucugacucugcacagguguggaacuuugucugcucaggguaguagucuguuccuccaagaauucugaccuuuuaaaucuuuuacuccuuuuuaaaauauuacuuuagcuuaaacuacagaucccugaggccuaaugaaguggauaaauaauuguguuaaguguuagugaggguaagagagaguaaguucaacgguucaaagaucuaaaaacucagcaagaaacagugauuauaaaucccgugacucauaaaugccagcccucagaaguugcuguguucuuaccuucaccucugaccucuguaguuguaaguuacacuacagcagcggaaugucacguuuuuuaagaagaucuauuuacuuuuucauuauugucacuauugguuuggcauggauaguuaaauuaggauuuauaaugauaauauaugaaugucaaauuuuacuuccagguuugguaacauggucuauauuuuuuuuucuagcuccagaaccuggguaucaacccagcaaacauuggcuucaguaccuugacuauggagucagacaaauucaucugcauuagagaaaaagugggagagcaggcccaggugguaaucauugauaugaaugauccaaguaauccaauucgaagaccaaucucagcagacagugccaucaugaauccugccagcaaagugauugcacugaaagguauaaaggauugugaauguuuuucuugaaauucuuauguguguuguaugcaaauaaaauuacugacuuguacuuuuucuguuauauguugaauaaauuuaauuagaucugcaaaguugaaauuaauucugaacuugaguuaguguuuguaauuuuaaccuugaauguuucucugaaauguuguagaauagauauacuugaaauaauuguaaguuuuacgauauauacauuuuauaucugacaugauaaaaggcuaaaagcauuucuguauaggggaaugaaaguaguauucuguaauaagucauaacaauauuaggaccuaaacauuucagugguuacuguaacaaucagcuucuccauucuaugccuuuuuuauaguuuaggcuucuuuucacuuagaucaucaagugcuaaaaguggcuugaauuuaaacuuguuagagagaguuggggagaauaacugcacacgguuuuuaaaauucaucaccaucaucaucauuuuaguugagucuuacuuuguugcccaggcuggcuuugaacuagaauucucuuaccuaagagaauuugaguagcugagaucguaggggugggcagccaggcccagccaaacuaacuaguuuccacagggagcaaugcugcggaucaaucuaaauagaguuaaacaaucucauuuuaucugagaaccuaucuucuuuuccuuugaacuuuagaaugaagguacaauagaaaacuagaaguuacuaagacuaagaagucuaggugcaaacugcuagaccuuugaaguagcauuuaaaacugccuccuuuuccuuugugcuuuaauuagggauuggauccaaugcugcacacaugcuaggcaagugggcagaggguugguacugggcuauaucucagccuuuguuuuucuugauaauaagaaagagaauucaguuuccugguaauuuauaaaguguggaugaauuagaggcacugagcuuuucaaccugucuuuucuucacgucauucaaacugggggccugauuuugguguauaguuuuguuuuggugacacagggucacucguuuuguugcccccgcuguccugaucuugcuauuagagcagguuagcuucaaauucacaaagaucaccugccucugccucccuagugcugggaucagagacauacaccaccaugcucagcccauuuaaucuuuaaaaauacaucuugaauaauucuuaauugaauaguuugggucuagaaguauugagaguuuuuuuugcuuugaggagauuuuuagaauucuuuuuagaacauucuguuuguuauuuugucuaucuauguggggggacauacaugugaaggaaacucagggaaguccguucaccucccaucauguggggcuggcuugucagcaaaugccuuuccuucccugcugcacaguucacagacuuagauuuggaaucucugcauagauuuuguucgugagcaucacuaacuaaccugaaagucaaagauuagaagccugaacuuucuaguuucgugguacagguuuuggaacauuuuggaguaucuuacuggcagguugggagcuaagaauaaccuagucaacauaacaucagaauuuaugucaggcagaauugaucucaucuucagaaaggauauuucaccuuuuaccuaugaccagauauuuugggauaguauacauuuugcuuuuaccuaaaaguauauuacguuuuaaaguauuaaaaugucugucgaccuccuuaaauaauuugaauucgagugcuuugcauacaucacacuucucuuuuuaaaggccaucaguugaauuuugccaaguucuuuucuauuuuuaauguuacuguuaucuuaucacauuucuuaaugcuuucuuaugugugcagauggugaguuaccuuaaauuagauuguguuagucauuguccuguucuauaaaaagaaugauuuaaaaaauuuauagcuuugcaaaauaguguguuauacuuugugucuaucugucuacuucauagcuauuaucccuuguuccuuccccagacgcuuacacauagucuagcccccuucauguaaaacagaauaaaagucuaguuauuuagagguugauggauacaguaaagaaaagcaaauucuuuaaauauucugcuucccucugaagccaguuuaaacuucaugccuucuuuuuauaaacaggacuauaacuuucacaauuucuccagucugguugugguuuauaagccgugugggaugggagucauacacugucuuauagaagaaggcuuuguuguuuaguacgauggguugccguacaaagcucuuaggcuuugucuguuucccaccucccuugucacccucccacucugacagcuuuuguccuuuaggagccagauucuccguggcucaggaacagaguuacccucaguuucugaggauuauccuucagagccuaggcauggcucugggcuuugacugcuguugauuucagugaaaucaccuuuccgacugugacaaauuucaaacgacaaguauaagcccuugcaucugacucuggacuuuuaacauuaaaugcgaauuuccccuacuuuuacuaaacgcuuacugucuuaacuggaugaagcuuggacuuuguucucacuccaguauauuaacagcauuggaaaccacccucccccugucuuccucuucuuucuccagcacuucuguuuucccuuuguaucuuagaccaguuaaauguagcaugcacuauggugaccagcaaaguugacauacaacuucuuuucaaaacgcaguuuccacaaaaucgaguugggugagagaugacugcauuuuaaaaaguggacauuuccuccuuguguuucuauuagauuggcuuugucuuuuguauauacagcuacuuuaguuuaugugugagcuaaguaugcaaugaaaguuacagcucuguuuuuuaucaguaagaaagcuuuuccuuagucuuauuuucacuuuggauguagaauccuguagaagucacauguuuauaguauugccguuguguucauuagagguaauaaagaguuuugccuaagggugcagguguacauugguuugcuuggucucagcuguaguucuagcaaugugacucauauaguuauuagucccaggauaaaaccacauuacuuggaacguagggauaguuagcuagguauuaauuuuaaacuuugcuucuuuuucauuauucuuuaauucuuuauucagcuggcaaaacucuucagauauuuaacauugaaaugaaaaguaaaaugaaggcccauaccaugacugaugaugucaccuucuggaaauggaucucuuugaauacgguugcucuuguuacggauaaugcaguuuaucacuggaguauggaaggagagucucagccagugaaaauguuugaucgucauucuagccucgcaggaugccagaucaucaauuaccguacagaugcaaagcagaaaugguugcuucucacuggcauaucugcacagguaauucucguuaguuugugaugaagaaguggccuaaagcccuguuuuguucaauaucacuucaguuaggucuuuaaacccaauguuacugaauuugauuuauuuugaaagguuuucguuuuuagugauuguuggcuuauaccuuuaaccugacgugaaacuugaguacucuuaccaguuuuuguguuuuuuuaaaagauuuauuuauuauauguaaguacacuguagcugucuucagacacuccagaagaaggcaucagaucucauuacggaugguugugagccaccaugugauugcugggguuugaacucuggacuuucagaagagcagucaggugcucuaacccacugagccaucucaccagccccccucuuaucaguuuuuaauuuucacagauuaaggaaagauugagugauuagaauguuuuuggagucucagugugcuucagagugaaucuguauuguuguaguaagauggguaaagagaugacaggaugagacauguuuuauucacauuagacuuuaauaagauaauuuuggaguuaaacuuuuaaaguuaaguaucaaucuacaauaagagacuaacauguggugcuggagagauggcucauugguuaagagcacugacugcucuucuagagguucugaguucaauucccaggaaccacaugguggcucacaaccaucuacaaugggaucugaugcccucuucuggugugucugaagacagcuacaguguacucauauacauacaauaaauaaaucugaaagagagagagagagagugugugugugugugacaaguacugcugaagcuggcaaacuauuguaacugcuucacuaacugaaucugagaucugcugggucauuggaucucuaaagauuuuuguuucuuguuuuuauuugcagcaaaaucgugugguuggagcuaugcagcuguauucuguagauaggaaaguuucucagccuauugaagggcaugcagcuaguuuugcacaauuuaagauggaaggaaaugcagaagaaucaacauuauuuuguuuugcugugcggggucaggcaggaggaaagguaaguuguguccaauaauuauuuuagugagucuguuuugcucuuugucaucuaaguuaaaaauacucauuuuucuuccuaaguuucauaguauucagauuuguggugccugacaaauauaauaauauaaauuauauuauauaauaauauauuauuaauuauuauuauuaauuuauauuauauaaauuauauauauaauauaauauaauccuauucugccaucugaggaucuuaacuuuuagcagugucuuuuuauauaaccuaggcugguuuugaauuaaguccucuugccucaggaucugagugcugguauuauaaaccuuuagagaccauugagcucuuugauugucuuuaucaaaggcuuuuuguugugucuuucacuuuacucugcauagacucauuaggguugcuaaaauacccauauaugugugcaguacaugucaagagucugauucauuaaguauugcccaagaagaauucgauucauccuuuuuaaauucccuaggugacuugagguagauagaauggauggucucuuaaauuagagaggcucaucucuagcuguauauugaaauuaccuagacagguuaaaguauuuuacauugaaauucuuaguugaggacagcagaaacaaggucugguugauuggaguauaaaaaacuuacugacagguauuggguaccuggcaguagcuaggacagcuguauaacuaaacuugggaaaggagaaauaagcaaaaaugcuaggcuuccaggcagaagucacgcuguagaucugugaccugugcuucugauaggccugcacugcuggggucuggugacucaguuugcugcuauuuucacugccagaguagacucucccucagucuuaaaauaaccugauguccugaguucccucuuugaagucuaguauaggcagagucacauggcuugcaugcuagcuuugagagacauggaaaacaacuguuugcugccucuaaaauggaauacuggcucuacucgcuacuagaacuugacuacucuccucucucuccccaagucagaaaaagacaaaccucaucuuuguuuucuauuucuccaccccaaucacccuaguaaguaguuuuuaagaaugauagcuugcagcuaucugaauccuagcacuuaagaggcucaagugauucucugugccuuucauuuaguccuaagagugcuggaauuccagcugugucuggcuuuuuuacauagcuuccagggauugaacuauuccauaggugcuuuuaccagcugagccacuuugucagccucagcaugacuuuagagucagacccacccccugccucuauaauuuugccacuacaagaaugguacauagcuugguaugccuuaaaucccaguauucaaggcacacagaucucugagcucuaggccagccugguccugauuuuuuuuuuuucuucuucuaggucauccugggcuacauuguaagagcuuguuucauaaacaaaguaaucuuacaggacauguaugacuuggggaccaucccuccccauucuguuuuauuuauggagaagcaucccacaguguagaugaucacacaguucacuuaccauagaacauuuggcgucaaaaaacuugcaguaaccaaacgauacaugauuuagguugauaguagauuuucuuuucuuuuaacaguuacauaucauugaaguugguaccccacccacagggaaucaacccuucccaaagaaggcaguggauguuuucuuuccuccagaagcacaaaaugacuuuccuguugcaaugcagguauuuuaucaaaauaaaaaucucaccuuuaauuaauuuauauccuguucacaguugguaugaguagugcuuaaaagaauuacucuaaaauacaaauuauuaauaaaacuuguuaaaauaguucucuugcuuucauguaauaaucgggcuaucuuaagaguuauguucucuuuugucuugcagauuucauucauacucuuguuuuauguauuugcuugagcuauccugcauuuagacaagcuauaaggaagaaaaccuuaguacuacuuuagcauuuuuuccuuuaagcgucaugucagaguuuuauagaaaguguucauuuucucuguucagaucagugaaaagcaugaugugguguucuugauuaccaaguaugguuauauucaccucuaugaucuugagacuggcacgugcaucuacaugaacagaaucagcggagaaaccaucuucgucacugcaccucaugaagccacagcuggaauaauaggagucaacagaaagggacagguaaggaaaccuugaaacuucagcauuuaaguagcacauuaucauuagcacuuuuuuuuguuuuuuuuuuuuuguuuuuuuuuuucuaaaaguuaauuuuggauaucagaaaagaguucuuaaugguagauggcaaagagaagaaaugagaugaaggucaaaggacauaaaauauaaaauagcauauguaagauuaacagguuuugacaucgguucaauaugaagauuaaaguuaauaaaauuguguuaggauuuuuuuuuuuuguauauuguguguauguguguguguguggcucucugucagucagucagucagucagagguugguagcaggugucuguuauuuuucuaccucauuuugaaagaaauuuuuuuuuaagauuuacuuuuugugucuuugguguuuuaccuccacauaugugcacuauguuuaugcaguagcucuggagacuagaggagggcaucagguccccugcauuguagggggcugugagccaccauguggggguugggaacuaaacccagguccucuguaagaguuacaaguucuuuuauucgcugagccaucucuccugccucuccuccaguuuaguuuuugagaagagcucuuuuuuuacuuuauuaauuaagccauuuccucagucuccaggauuuagaaauaaaauauaacuuuaaaaaacuaaacaaaaauugaugugagggucaguuaggauagcuuagcugguaaaagucaccugaguucaauccccauaacuugcauguuauaaagacucuugcauguuguccucugaauccauaugugcacugugacagaggcauacauacacucaaacacacauauguacacauacaauaaauaauaaaaugcauacauauacuagagcacacaugcacacacacauaauaaguaaacaaauaaauuaauuuuaaaagguacagagcaguguuagucuucuuuacuaugaccauuugcuauuuauugugugacauuucaaaaaucucaaauacacauaauaaaauuuacuuaaaaagacuauugggggucagcagacuggcucaagaugguagaugugcuugucagcaaacauggugaacuguuugugaucucuugguuucacguaguagaaggagagaauugacuuccccaaguuguccucuauccuccauaaacauguuauauuuguauguuuaugaaugugcacaaaccacacacaugcuaaauaaauauaauuuaaauaaauuuuaaaaacacuauuauauagaauuuggcauggguauuguacuggcuaguuuugugucaacuugacacagcuggaguuaucacagagaaaggagcuucaguuggggaaaugcagccacgagauccagcuguaaggcauuuucucaauuagugaucaagggggaaaggccccuugugggugggaccaucucugggcugguagucuugguucuauaagagagcaggcugagcaaagccaguaaagagcaucccuccauggccucugcaucagcuccugcuuccugaccugcuuaaguuccaguccugacuuccuuggugaugaacagcaauguggaaguguaagcugaauaaacccuuuccucuccaacuugcuucuuggucaugauguuugugcagaaauagaaacccugacuaagacagguauacaccuuuaauucccacacuugaaagguugaggcaggaggauuucuguguguuguaggucagucaaggcagugagaaccuguuucaaaaauuauaaaacaaacaaaauaauaauaaaauaagauaaaagguuguugucuaacuuuugugcauugacuuaguuuuauuuaccuugaucauuauuauuaugauuuuuuuuguuuuguuuuguuuuuugagacaggguuucucuggguagccuuggcugcccuggaacucacuuuguagaccaggcuguccucgaacucagagauccgacugccucugccucccaagugcugggauuaaaggcgugcgccaccacgcccggcuugaucauuauuuuuaagucuaguaaauggcaucaauuaguauuuaguuuuaugguauuuuuuaugucuggguauuuugccugccuguuuguuuguguaucacaugagucccugguuccuguggggauaagaggacauuagcacccccagaacuggaguaccauaugguuguacgccaccguguguauccugggaaucaagcuuugguauucuggaaaaggauccagugcucuuagccucaaggccaucucuccagcaccuguuuuuaguuuucauuugccauuuuaucuuuaaaguaaaagguuuaucacaaaaaauaaauaaauaaaaaagcacuacaauguauaaugacaaaaucuuuuuaauauugucucauaagaacuguuggguuuagagucaguuaggugcauuuauuuuuauuaucaaaagaaguaaaucuauggggaaaaucuguuucaguuacaaauuugacaaacuacuuuuuauagggcuuucuuuccuauuaucccuaagacaggauccaucagcuguagagauaagacuucuaucugcauccuacuuucuagcuucuuaaguauuacugaauauuuacuaucagaaggcuauauguuaaaguaccuauuguagugucugggaaguuacccaguuggguagguugauauuaguuauucugaauaacuuuuuuuuuuuaaagauuuauuguuuauuacauguaaguacacuauagcugucuucagacaccccagaagagggugucagaucucauuacggaugguugcugggauuugaacccaggaccuucagaaaagcagucagugcucugagccaucucuccagccccuugauaacucuucauauuuucuagcauauuaauuaucauauuaucuaaguaguucuuauucugugagaguauaguaauaagauuaagaaaaaauucuaccagaaaguauuuucucagaugguuaaaaauuuuuuuaaagauuuauuuauuuauucuauguaaguacacuguagcuaucuucagacaccccagaagaggggucagaucuccuuauagaugguugugagccaccaugugguugcugggaauugaaccuauggaagagcaguuagugcucuuaaccacugagccaucucuccagccccgguuaaaauucuuaaaagcuaguauuguagugguuuugucauguacugguuuuccuccagguuaguauauauguucuuccccagaguaaacaucuuucauuuaaucagucuuugaaaagugauaugcuaugaagaggcaauuccgucucuuaccucagcuccaggcucagguacuuugagucccuguaauggaagacucugucauuguaauguuuuugucauacugaauuacaguugcuugcugucucaguuuuuugucuucuuuguuuaauuguauuucuagcaccauccaaaggugguuuugaaaaguaagaagcucucaucucucuauuuaguugugucucugauagaaaaaaggccaaggaugagucaguuagggaugaucugacagucaggaguuaaggagccugcggggcuuccuucucucugcuacugugcugguguuaaaggugaagcuuaaccuggagcuccuucuaucacuuuaccauacacuguaaccaugcagcaaaccaagcaagcgucagcauaaucaauuaccuagugacuccgucuaaacagaucuagcacaguacaacuauucucuuauggguaaccugcagguccugucaguuuguguggaagaggagaacauaauuccuuauaucaccaauguccuacaaaauccugacuuggcucugagaauggcugugcggaacaacuuagcuggugcugaagaacucuuugcccggaaauuuaaugcucucuucgcccagggaaacuacucagaggcugcaaagguggcugcuaaugcuccaaagguaacuaguuaugaaguuaagguuggcaugcuugggcuggucuuacugggcuguauuuuugauacugcuacaagaggaaccagcucuguaagauuaacuaacuccuuuccaguuagauuuuucuuuuaauaaaauaugauaacuaauucucagugucucuagguuugguguguaaaacugcagaaucuuagaaggauuuauagacuuauagaccuauaguugauguaggcagaguuauguccacuuacuaaaauacaauauuaucugggcucauaauugauggcuuucuauuuuaauuugagcaguuaguauugguugguguuauaguguguagaguugucagaaaaugagcagaaucuauucccauaggccuucacaucaguguuaguuauggagugugugcuuacugaacuugacuuaauggcuagugguuacuguugcaggaauggguuuaucuuuuugucaccuuuaaauuuuuuuuucauuuuugagauuuuacuauaauuacaucauuuuucucuuccccuuuugcccuccaagcccucucauguaccccuccuugcuuucuuucaaauucaugaucuuuucaucaugaucauauucauauguguauaugaauauauuccuaaauauauaaauauaaccugccaagccuguaauccugcuuguauguauauguuuacauuuacauggcugaccuuuagauaguagauaaccaauugguguggucuuccuuguggaagacuauuuaugccuauaucacauguugacauaauuaccuuggcaaauuucugauuuugaauaauuuugugucauggaaccagagaugugaaucuuugcacuauguggugacuguuuguaauguggaggcuauaggucaaccaugugguucagauuggcuuaggacauggaggguuguuagugccacugggucacugaggagucagucacugagaagucuuuaaccuuucuuuuucuuaaagggaauccuucguacuccagauaccauccgucgauuccagagugucccagcucagccaggucaaacgucaccucuacuucaguauuucggaauccuuuuggaccagggccagcugaacaaauacgaguccuuagaguuauguagaccuguacuucagcaagggcggaaacagcuuuuggagaaauggcugaaagaagauaagguacauuaauuugaauuaauauaauuuuccuuuguuuaaauaccauguuagcaauuuaaaaugguugguuucuaccaaaguaucaacaucuguuaauuuguugcuuaugaauauaaaacaaaaccggaccuugccgguuuaacacaugauccaggauuauugcuugauaguuaaaacugcuaggcuggaagugaguuacuauugguuuggccuuggaaaacaguuaacaugagaggcuuccuucauuguacagucauauuuaucaguguguuugacuuugcuuagcacgugaucuuccauaucccacacuugauauacaugcccaguaguuccugcuugcgcucucucccucuauaagaauuuauaaacugucauuaguauguaacuuuugaugcugguaaacacacuuggguaugcaacagccagguuggcugcauuuaacacacugagguucugucugacagugauuuuauagaauguuaaaugguguuaaugugaaaaaguauuuaaaagaguuuaaaugggagucuuuuguaaaauaucuuauuuuuuauauuguauuauaguuuaauauaaaauguauuguuuucugugcugucaaauauaucuuuuauauuuagcauucuauacugucuugcaaagcacauauuucuaauagagaagaaugaaaaaugaagcaauaaauauuauuuguaggucaacaaacaaguuuuaagcaauuuauaauuauucuuuuuauacagucacacaagaaagcuuuccugccuaccugccuaaaguaacaguuugaguugccauguuuuaugccguuaucaggucugaggcagcauuccuggagugauuacucaccaagauauuaaaccuuucaacaucaauguuguuggugguguugguacauucuggagucuuaaguuccuguuucuucgucugucuucugcuagccuugucuuacagggcacuagaggacaguacuucagacuugagaggcuuagcacauaacauuuucuccuaaagaauagccaagcuaacauuuuuguuuguuuguuuuucgagacaggguuucucuguauaccccuggcuguccuggaacucacucuguagaccaggcuggccucgaacucagaaauccgccugccucugccucccaagugcugggauuaaaggugugcaccaccacgcccggcuaccaagcuaacauuuuugaaagcuguucugauuguauaaaauaacaggaugggaacagccaggauaacugagauuauuaccuguuguuggaagucaugggggcucauuugcaguaagguucauuaauuguccauuaguuagcauguucagguaaaauguguagaaugacagaacucuucgaucacaugaguuuauaaggguuauucuuuuuaaaaaguuaacacuaggacucaagagaugucucagugguuaauacuacauacuguucuuacagaggguccaaguuaaauucccagcacaaaugucaggcagcucacugcugccuauaacuucaaggggaaucuugacagccugacuucuguagucuggcagucaaauguacauaaacccacacaaagugcauaauuagcacuuuagaggcagaggcaggcugacugaguuugaggccaacuuggucuacauagugagauuuuuguccucauuccccuucacaaaagaaaggaaagaaaaaaaaaagaauaaaguagacaauuggacuggggguguggguuagugguauaggacuaauuuauuuaggauaaagccauaaguucaauucccaaaacugcaaaaaaaaaaaaaaaaaaaaaaaguagaaaacucauguaaagcagagcucuaggaagcugauuugaagaggcaccugcugaauacuaccuggaaauuguaaacuuuguaucuauuuuacuuuguaaauuuaguguucugccuaaccguuucaaacccuaaaguuaauaaacaaagauaaaugauggaucuuagggcucuugaauuauaaaagguauauccuaguuuuaaaauuaucccuaugguuuuaaaauaauccuaguguaaguagggagccauuagcuuacuuuguacaguugauuuacuucuuuagagacaaugagacaaugucuuuauuuguggcacaggcaggucuuguaccccuugcuuagcuucccaagugcuaauaguacaggccaacuggcaucauugauuuuuauuaacaagacugcaucaaaaguuguauuaucaguggacugaagagacauuucauugguucagagccucuaucacucuggaccugacuuugguuucuagcacccaugucauauggcucauaaucaccuccaacucuugcuccaggggaucugauguccucuccugcucucugugcaaacacucacaaguaaaaaaccagugacauuauuuuugaaaaguugaaaagauagcuguaauaguugaguaucuuaguuagauguauaagauucuacuagaaagaaaguguacauuccugacaaggucauaggcaauaccuaaaagcagaauuauccuuguuuaaggaaucguucuggagaauuauacauagucacuacugugaauaucauauucagauuuuagcagccacaaaucuuguguguuuaucuuuuuaaaaugaguaucuuuuauaugaguuauauuuauagagaaauguuaucaacuacucguuuuuaaaaaagcaaauaggucacuaacaaaauucuuuuuccuuuggcagcuggaauguucugaagaacugggugaucucguuaaaucuguggacccaacauuagcacugaguguuuaccucagggccaauguaccuaauaaagucauccagugcuuugcagagacaggccaaguccagaagauuguuuuauaugcuaaaaaagugaguucaguggggaaaauucucaauauaaguuuauuaaaaauaaaaaaaacagaaauuagccuuaacuugauugauucauuauuuauuggugaauuucuuuaaauuuuaaacuacuugggaaagcauaaacaguuccuucuuaacugucauaugcagaguucauaccuuagugauauacaugaaagcaacuacaauuuuaagauuguggaggcauguuaagcauguguuaguucaguuuuugaaauugucauucauugacaaguaauauaauuaucuuauaauuauauaauuauauaauuaucuuagcaaguaugucauugucauauuagcaagcaugucauugcaguggucuuauugaauguuuaaaaguauaguuuuauagucaccaguaguuaauauuuuauuauagaaaaggcuuuuauugcuuuuaaaauuaaacuuugugaccugauugaggucuuugucuauguguagguuggcuauacuccagacuggaucuuucuccugagaaaugucaugcggaucaguccagaucaaggacagcaguuugcucaaauguuaguucaggaugaagagccucuugcugauaucacccagguaaugucaucuuaaaacucuucuucauggaguuggaaguguuggggagucugaguuucacacacuuuucaggagaauaauuuaaacuuucagcugacagaaauuguauucaugugucccugcauggauaaacccugaauaucuuaccacaacauauugcaaaagaauaggcaguaagauaccaauucuaaauauugcuucaggcagaggugcacccguggcauguacggaggucagaggaccaugugugagagcacuuuugcagccugguugcauucagguagucagccugcauacaaguguuucugcugagcuagucacuuaauucuugucacagaaaaacuguuuuuuuuuuuuuuaagcuaaauaguaauaguaaauaauauuuacuguuuuaaaauagaacaaauaccaguuugauuagggacagauaugugaaaaugaaauuacuuuaucuuggucaaaaagacaagaaguaauauauaugaguggugugcuccccugguuggggagaagaacaaagagaauguguaagccaauuuuucauauuguauauccuugggguuuuuuuuuuuuuaaacuguaacuuagagaacugaguuuucaauaacuuuuuaguuuguuuugauagagucucauuauauagcucucuaaucuuggaauucauauguagaccaagcuggucuaaaacuuccuagugcugcucucugaauacuagccuuuauaggggugagcuggcauacccauauaccuggcuucucuggcaauuuaaauaugaggaaagguuguauaaauacuauucuuuaagucugguauucagggucuagaucgauggggcucagcaauuuagagcccuuguugcuauuacagaggacccuggcuugauuccaagcacccacgugguggcucacaaacauccuuaauucuaaguccacuggaugugcuaccguucucuucaugugaaauacaugcaugcaaaaacucaaaaguacaugugauauacuuauaaaauaaguaaauaucaaaaaacaacugguaaaacucauacauguucuuugcauuuuaacaugacuugcauacgugcacauuguuacuuguucauauuuccccuacacugaauugcccuuuuggucuuacagcucuuccccuucaguacugucuuauaucugauuuuucucuuuuaauagauuguggaugucuuuauggaauacaaucuaauccaacaauguacugccuucuuacuugaugcuuugaagaauaaucgucccucugaagguccuuugcagacgcgauugcuugagaugaaccuuaugcacgcaccucaaguauguguuguuguauucauuaggauuucuauuucugugauaaacaccaugaccaaaguaacuuggggaggaaaggguuuauuuuaccuuaaaacucuuuugacucugucacugagggaagucagggcagaaaccuggaggcagaaacugaaacagaggccaugcaggagcacugcuuauuauguugcucagucuuuucuuauaacccaggacuacccguccaaggacgguguuuuuccuggugggcuuuccccacuccccaucauuagucaagaaaagaccccacaggcuugccuguaaguagucuguuagagccauuuucaaauuugagguucccacuuccaagauguucccacuuucaaguugacaaaaaauguguccagcagaguugucaugcuuuuuaaucuugcuuccgauccuguucugguccauugugccaauguuuacaaguugucacucagaguuuugagaugcuuauuuccuaagaaaauuuagcuaguauucuuuguacuucauacuuucauguuauuuauucacuauucagucucaguguauuuucuggguguugguguaugcugaaguaaaggagaaggaaacacggccuuguccugucugugguuuucuagguugcagaugccauucucgggaaucagauguucacccacuaugaccgggcucauaucgcccagcugugugagaaggcgggccugcugcagcgugcauuagaacacuucaccgauuuauaugacauaaaacgugcaguuguucauacccaucuucuuaacccugagguauuuguuucuuaccuguuaguugugauuagucaguguguuuauuguuuauacugggugauaguaauuauuaauuuuuuuuuucccucuagugguuagugaauuacuuuggguccuuaucaguugaagauucccuagaaugccucagagccaugcugucagcuaauauucgucaaaaucuacagaucuguguucagguggcuucuaaauaucacgaacagcugucaacucagucucugauugagcucuuugaaucauucaagaguuuugaagguaauuaggaaugucagaauugauauaagagagacacuuauaauuaaucaggcaguucgaaauuaucuucugaaaaacacuuuuaugggacaugucuucucuaggaccccucaugucaugggauccuugagguauacaguguagaagaacaccugcuuggguauuuuaugaacuaaaggcagaaauuuggguuaagaaauuuauugucuuguguuagcugcauaauauuaaaauacugacgacuaauuacaguaauauuaaaagcaccgcucugacucuugcaauagugaacauuucuccuaaggggguuuugugcuucauuagcccagcuauuuaaaauucaauuaaauaauuaaaauauaauugaaaguuucuagaguuagucuagcuacgcuugaggugagccaugggagguuagugucuaaggcagaugauauaggucaucacuccagaaaguucuuauggacagcucuacacuaaauuuuugaaaguuuuaugcaaagcuaucugguaugugauacuugauuuaaagugucucaugaaaugugguauaaacauuugcuuugcuauugaggcgcuguccuuuacuauuugaaaacuuccgagccaggcagaguggccacucagaaaaaugagacagguuuaugauagauucaaggacagccugaacuauacgacaaauccucucaaaaacacuaaaacacagaaagauacuuuuaaacagaauuuccuguuguguagggacugaaauuuauaccugauuuguucaaguggcuucuggauuaauguguauucuuacugaacuuuuaaaacagccaacuuacuaggaaccuuuucuguaaucaugacuuguaauugcuuaauuuuuaguucuuucauucucaaaaguauagccaggcuugaugguacaugcuuuuaaucucagcacuuuggagucagagacaggaggaucucugauuuugugaccagucugucuggcuuauacagcaaaaucaggacagccaggacuccaugaagagaccagggcuucacagugagaccuugucuuagagcaagcaagcaagcaagcaaacaaacaaaaccugccuauguuccuuaaucucaguuacuuuuguuucuuuaaggucucuuuuauuuucugggguccauuguuaacuuuagucaggacccagaugugcacuuuaaauauauucaggcggcuugcaagacugggcaaaucaaagaaguggaaagaaucugcagagaaagcaacugcuaugaucccgagcgagucaagaauuuucucaagguaaguggcuuuaaguuacgugcuucugauugacuuaagcaguucuacaaggguugagucgggcuugagaauauuuuucuuacauuugaaaaucuuagcauucucaaauucugugcuggguuauuuuuucuaaacuuaauacucugugguuucucaagaaauaaggaaggaaauuaguaaguaguaccuaagaacgaccaucuguuuaaaaagaaggaaaaacaguuucauuuucaaagaacuuccuuuuuuuaaaaaaaaaaaaaucaaaagacacauuucuuuuuucucuuuucucuuuuuucuuuuguuacagggucucacucuguagcccuggcuguucuagaauucaguauauagaccaggcuggagaucugccugccccugccucuugagugcugggauuaaagaugugugucacuagggcugguuuaagaaaaacacaguuuaaaguuguucuugaugacauuuuagaauauucagcucuuuccccagguggugacacauaccuguaauguguacauuauuaauauguacaacaggaaguagauggccucuaguccauaaaaggcuuugauuccuuuauuuuuuuuuuaaggcacaguuauugauuuugucuuucuacugccuugaaaauuuuugucuggggagaacaaugugcauaagagcuagcucucuccuuguaucauggaaggcccaggggucaaacucagaucuucacauuuggcacaagugcccuuacucuuugaaucaucuuuccuauuuuuuuugagauagucucacuuugcagugucuaggcuggccuugguaugugguaaaaccagcaucuuccagaaggcaucauucuuggcuuagguuucuuauauuuuacucuucaauuuuuuuuaacauuuauuuauguuuucauuuuguguugauguuugugaugauguuucugugcccaggccauugcauggaggucagaggucaacucuugggagucaguucuaucuuugcaucauguaguuacugcgucuagaacucagaauguuagucuccauauaaacgucuuuaccuacugagccaucuuccagccucugccuuagaugcuuguauuuuucaguuuaucuuuggcaucauuuucaagauccuuuauuguagguuaaggaaacaucuagauuuacuucuagcaucacaucugucugaauccagaaaugaaguguuaauguauaauuuauaaaccaagugggaucaagauaaauugacuuugugacacaugaauucaguuggagagaauaaaggcugccucuggcuggagugaagaauaauguccuaaagaaugcuaagcuagagaauaguaaggguuuuuaauuuguuuaacuuugcuuguuaacauuauucucauaccaguuauuuuauggggaaaaguaaaaauuuguagcuaucuaucaaugaaagaugagaaaaauucuuaaacucagagaguaccacuuguccacugucacacaugacauuuuuuaacuuuuguuuuuugggagaauuguagauugagcacaaaaccauuauuacauggaauuugcaugucuugccucuaccuauuaucacuuggagguaguuuacagcuguaucaucugauauuuauucuuuugaauuuaacuggggucugauagccaaacccacagggauuuuauguaacaaaauagucaaaaugaugagauuaucuuauauuuucuuuuuuuuuuuuuuuuuuuaaagauuuauuuauuuauuaucuguaaguacacuguagcugucuucagacacuccagaagagggagucagaucuuguuacggaugguugugagccaccaugugguugcugggauuugaacucuggaccuucggaagaacaguugggugcucuuacccacugagccaucucaccagcccccaagauuaucuuauauuuucaaaugaaagauaaacuuucccccagugauuauaacuuuauaagucauaucuuagccacauaacuuuucugggcagccuagccagcaugauaaugucaaacuuucuaggguucccaagaaacuugccaaaugcaaggagugguuggucgugcugcugugcacccacuccauuucacaggacagagcucgcuuccucuggugaaucauugaggcuuaugaggcuuuuuguuuuuguuuuuuuuuuuaacacugcuagcuucuuaguugaauuucucuuuuguaauugaacucuuuucuuuaaauuucuuuagccuuaggagauaauguuugaguuaucuuuuaugucaaagcagaaguaaacuuaacuauuacaacuugaguaacauuuaaguuaaauaugggaauacauaaagaaucccaacacccacauuugacagacugagucagagggaccuggaguuugaggccaaccugguguauauauggccugucucaaaaaauuaauuuuaaugaauaaauagaacaauauaauacagugcaauaugacccaauacaaaaacaacagccuguguggaucaaaguuagggcuccuuccuuaccuguaaucccagcccucagaaacccaaggcaggaagaucaugaguccaaagcuagcaugagcaacauacugagauaaugucuggagaaaaacaaacaucaaacaaacaccaacugcccugugagggaugagaauguuauucaguagcgcuguacuagccuaagauucucuuaugaccuacagaaaaguuaaaguacuacaaagaauuccaaacaauguuguuagcauuauuugauuaacacgcaagugugucuccacccugcucccuuuucuuuaugccaugcuuugccucagugucccuggaugacucacuguugcuggcccuuggcuguuggggcuuugugucggcccuagacuguuuauguuuuuuguuuuuuuguuuuuucucuaagaccuucauggcuugcuucuugaccuucagguuucuggucaaauguuaggagagguuuuucucaaguuacucagccuaaaauagaaacuacuaggguaagugaaguagcucagucaguaaagugcuugccuugcaagccuugguuagaguccagaucccaggaaagaauaguacauguguuaacucaugcuuguaacccuggccaaggugggucccuuggugugcuccaagccagugaaaagacugucuucaguaaggggcacagugcuccugaggaaugacagcugaagucaguccucugcccuccacaugcauuugcaaacaaacaggcugauaucuguaccaguuccaucuugauggccuugcuucacuucugcuguaaugcuugcugcugugagggaaaccucgccucuucccacuuggaggcacuuuccgugauacacaggagugcuuacuguaguuguuaaauuuguguuguagaaaacuuguacauguauuuacccaagucuaauuuuugucuuagaacgguugcuaacaauaaugguuaauagcuuaguaaacgguuuaaaauguauagaucgcaugggcuggagagaugcucaccaguuagcaucacuugcucuccagaggacuugaauucauuucccagccccuguguguuggcuuguucacaaaguaccugcaauuccaggugcaccuaaugcuucaggcccuugcgggcuguauucauguguacaucaccauacacagaaucaaaaauaaaauauuuagagcauuaguuuuaugcacaaacuguugugaagguuuagauaaacaggaaaacgccauaguucuagucagaaaugaacuagcuaaguagucuccuugcauguuuuccccuaguugaugaaacuuguguuuuaugugcacagaagacuaauguaguccacugaguuuugggguuuguuuuguuuuguuuuaugcuuauuuaggaggaaaaauuggccuggaacuuuacauuuguagaacagacauccuuucuagggauaguugaagcagccauuaguacaguguuuuccauuucugaaauaaguucucacaugcuuugacuuuccuuaaugugaacagucugcaguuggacuuuuacuucaaauuuuuagcaauuuucauuuuuuuuuaacuuauuguagcucacaaaaauuucuugauauuuucugaaccuuucauggacuaaucuucaugugauuuauaauuugguggcuagagccuagucuaagaaccauucuauugucugauguuacucaguggcagauuacuguucuagccuaauccccaguacgacaccaccacccuucgcacacacacacacacacacacacacauucuguucuaacccuuaaaaggaguggcuaccauuggggaaaguccuauccugcuuaguauguauuucuuuagucagcucuuagaagaaucauggauugaggaaugugucacuguguauaaaugaauuccugauggaaacuguuguuuuuugugcuguaccuuuugucuguggaauauaacaggacauguaucagguaauugccccacacaggucuuacccuuaccugccugucuauaacaucucugucagucuauaaguaggacucuaucuagcuuugucuuuguaaugguaaaagcaaugggcaauuuaaagaugucuuuucuuuaaauuauuugguguguuuaauucauggccauuaucacaguguucuuuguagauuuaauuauaauagauuguuagaggcuagguguuuugguauuauuagagcuugguauuggggagggcuaggaaauaaaucaguaguuugaaacaaaugugagcauuugugccaccaaugugagaauguuacuaaaucagcugccgaauucagcugaaaugucuuuuauuagugaaaguccccauguagugauuuuuuuuuaacugaaaugucuuuuauuagugaaaguccccauguagugauuuuuuaaaaccuguguacugcuacugguggcucacaaaucuuaauuuguuaauuucuuuauuaaagaugugcaugggaagggcuugguguuuugugugugaaucuaagcuguacuuuaguaaaauguacugaaauggggagaaggacaugcagccuuggggucauuuguuucuuuuaacagaagagcuacauuuauguaagccucucccaucaacacagaaaggaggcucauauuuuaauucacgcaauggggaaauugaaguuucuuuuuuauuuuuuuuccccguuucaggaggcaaaacuaacagaucaguugccacuuaucauugucugugaucgguuugacuuuguccaugaccuggugcuguauuuauauagaaacaaucuucagaaguauauagagauauauguccagaagguaaguacuuugguuuuuagauaauuuaaauauuaucacuacagcauuuugaguucuucucauugugccugguaagaauggucugcuagaguagcuuuccaugguuuuccucagcucagucuuuucuuuuauuacaauuuuacauccaugccagaaugugaagugugagagagagcuacuguagucuaaaggguuggaaagucuaggaaccaaagcccaaagcacauggcuuaaauuagguacuagagacuuaccaacuucaggauacucuagugaugcuuuugugcuuaguaaucuuccauagucaucuuugcuguuguuauuuuuauacuucagcauuuggagcgauccuuagguagaacugauuaaccauagcagcuaaccauagaccacagggugagugcucccugcuuauuagaaugugaggucuuucuagcuagacuuuuccaucaucugaccauaauuuuagauucauaguuuauugcuaauuuuucuuuaaaacaaggcuuuaaaaagaaguggucuuuaaaguuuuucauucaguuuugcuuauuaauguaauucuuuuuauuuucucuuuuucaaacauagguaaauccaagucgacuuccugugguuauuggaggauugcuggauguugacugcucugaagaugucauuaaaaauuugauucuuguugugagaggucaauucucuacugaugagcuuguugcugaagucgagaaaagaaacagguguagcacuguuuucucuccuuauaacacacaaguuugucacuccugguaguguagaagaguugaaauacggcugacugacuugaguguggcuucucagcacaugggguaaaucauggaggcagcugacagaagggugacacacuugcucuuagaguugaaagguuuuuguuucugucauuuucuccugaaaugugauuguauuuguauaguuaggagaagacugugcuguuuuuaacacaguaugucugggcucuguuguucuuacuagauugaagcugcuucuuccuuggcuugaggccagaauucaugagggcugugaggagccugcuacucacaaugcacuugccaaaauauacauugacaguaacaacaacccagagagauuucuucgugaaaacccuuauuaugacagucguguuguugggaaguacugugagaagagagacccccaucuggcuuguguugcuuaugaacguggccagugugaccuggagcucaucaaugugaguacugagugugcugagugugugcagagauaccuguaguucucuaacuaguuguauuuccaguuagcaaauuuugagauucuauaugauuuuuuuuaguuaaugugcaacaguugugggcagaugugugcuuuuuaaaacuuuauuuggaaauaguaguaaaccuaagucuauauacacucucuccugaauugacauguauuagcuuugcuuggguucuuguacacggccugccacacaaagcauuuuaacuagguuacauaccucauggauuugcauccauuccgguucuacuuuguaagaaugaagaaguaucuuuauguggguacuagcaacagucagacauuagcaagauacuuuaaaaagcuuguuuucaguuuugucaggguuuucuguaguuuaggaucacaauuguguccacucuuuagccucuuuauucuaaauuaguucuuagaaauuuguuuuuguuuguuuauuuuguuuuuaaaugauugauaccuuugguaaacuaauuuuuuauuuguauuuuguuaguuuuuuuguuuuuuuguuuuuuguuuugguuuguuuguuuuggugaaauaggugcauaaccaaauuuuccauuguaaagugaacaucuaaguggcuuucagugaguucaguguugcaaaaucaccacucuuauccaggcgcucagcacugagcaaggauaccuucuuuuucaguaaaucuccauacacucccuucccauagaaccucacaacugcuuaaccacacccagccccaauggauuucccuguucuguaauuuuuuaauuaaaguauuuauuacuugugcacaaguauguagaagucagaggauaacuuguaggaauccauuaucuccucaguagauaugggucuaaugaacugaucucuggucaucagccuuggugacaagugaccuuaccuacgaagccauuuugcuggcuccugaacauuugauguaaauguaugaucuccauuuccuccuuuucugcaguguugagacugcaugugcugggagaguacuguauaagugagcucccugccuggccacaggaaaacaguccucaguuucccucugucacuuugcuuuguagcuagaaucaagcguuucaauaaggguuuucuauaauuagguuuucaggucuaauuucuacucagagcgcuguuuaaaugguauuugccccgugcuguuggauuuagaagcuuauuuucuuucuuuaugucgccagccuccacugaauuguccaccuucccuucaggaguccucauaaacagauggugcacauguucuuccuccuugucuauccuuggccuuuguaacauaaggcauucuuacuaggcugaugacuacuucaucccuuucuccuuuuaucaguuauggguuagagcucaaggguagaaaacugggccaccaugagugagguccugcuuacaaaucccagugcugaaaacaaauucugucauauuuauuagucaguauucuuggauucauagauuccuguugugcucuuugaauuacaauccauuacuguaauuucuguuggcaugcaaauuguugccugauugcuuugaggcacuucaaggcucauugugcaacuuuccuagcuuagaguugcucuuuuuuuucaggcaacccccaaccuuuuaaugaaagaugccauuaguaaccaaguucuaucuugaagguuccuucuagaauuguucaguggucagaccuuagaaacuuauguauguauguauguauguauguauguauguauguauguauguauguacuuucaaagauuaugcauauuuacaugcagauauauggagaaguaagugugcacuagcuaauaaaacacuggaagaaaguuuugaaggcgaccagaucuguauuggauuguaauacaaagcuauaauuuaagguuaauacaaaacuaaugcuuuaacaucaaaaauaagcuaaauaugcuagugugugucuguauuucuagcaugugagaaguaaaggcagguagguauaggacuuuagagcucagguacgugagaccacaaucucaaacaagaaaaauaaagaugcaguagugggggucuuuuuaaaagugccuaaauuuucccccauccuuuaguuucagugagaauauuugugauauucccaagauucuauauagaauagauuuuuuuuuaaaagaguugauaugauuacaaauaacuuucagacucgucuguaguuuuuacuauuugcacugaaauuaaccuuugcuauuuuaauuagguuugcaaugagaauucccucuucaaaagccuuucucgcuacuuaguccgucgaaaggauccagaauugugggguagugugcuacuggaaagcaauccauacagaagaccguuaauugaccagguaagaaucacaaaaauguuuccaaucauucuuacuuggaauacuuuccuaucauauauccaaauauauuuaaaugggucauauuuaacuauaacagaaggcagaaaaagugaaaaaaaaacauuaaaauuguacuauauaaauguaaaaucauguauauguguaaaauauuauaaggaaagugaagucuaaaaacauaaaauuaucuuaaguucaucaccacuaaagaaagggaauaaauuaggauugacuaaaaguaguuaccugacacaugaccaaaaucaagacauuuacaaagguacaucagcacacaaugaggauugauaauucaaaaacaaaaaaauccaaguaauuuugggguaugacagcuuaugccugaagucccuaguacuuaggaguuugagagaggaagaauaugaguuugaguucaccuuguccuaugacuguagcaagauucuaucucaaauucuuuucuaaaaguccaaguaagcaucauggagauuguuaaguucuggucccuagcaucacauaaaagccccuguauguaacugcagugcuggguagacagagacgggaagaucucucgggcugucagcuguccaaccagaugaaugagcuccagcugcagggagaggcuugucucagaaguaaaguagcacgugacugggcaggacaccuggaucaccuuuggauacaugcaccuguacauucaugcacacaaacacaggaauagcacacucgauacccaaaucaguaguaagucuuaacuaaauagcacagcacuggagugaagauuuuuauaccuauaugaaauugaaaucuugaauuuaaagugcuaauuguugcuuguuguuaaaaugauucuuaaauucuucugauagacaaaaagauagagcauuuugaggcauagauuacuagcucuugaguuauucacucacucucuagaaagugguuccaaggcacauucccaaguagauacaaagcucccugcaaucacauggcaucugagcacaugaaaguagacaaaacaagagcuguucaauuucuuaucugugccuagggauuugaaaauaagaauccauuaaagaaauagugauacguuauuauggauaguguuuuaacaggggaaagugaaaauugcauaaucacuaaugguaacaucauauauaaacguguucauguauauuuguguacaaagaucuuugaguagaaggguauuuuuccuucuauuugagguuuucuaaugaaaagcuaacuaacuuguucuuaccaggcaauaucuuuuuaaaaauaccuuuuuuuuuuuuaaacuauuccauguauauccuuuguagguuguacagacagccuugucugaaacucaggacccagaagaagugucaguaacugugaaggcuuuuaugacagcagaucuuccuaaugagcucauugaacugcuggagaaaaucguucuugauaacuccguauucagugagcacagguaugcuaugcugccaggggcuugcauuggcuuccucagccucucuuuguggccuguugguuuggggaaggaagagaaaacaaagagaacagauaguuuucuggauuguucuccuaauacacgcucuucucacccugacccuugagacaaauaacccucuagugucacagugguguuuccucaccauugaugacucuuugaugacauugugcuugaaugucuugguuucuuaaggaaucugcaaaaucuccucauccucacugcaauuaaggcugaccgaacacguguuauggaguauauuaaccgccuggauaauuaugaugcuccagauauugccaacauugccaucagcaaugagcuguuugaagaggcauuugcuauuuuccggaaguuugaugucaauacuucagcagugcagguaaaucuugaaauuacaugaauugagauauugacaauaaugucuucucuugaugcaaagaaugcguuuucuugugagaguaugcacagauugcuaucacaguagaguaaucauaaaaugcuauccguuuaaauguaacuauguugggugagauccauuuuacaguaacaccaauucaaaaauauugcccagguguugauugaacauauuggaaaccuggaucgugcauaugaguuugcugaacgcugcaaugagccugcuguuuggagucaacuugcaaaagcucaguugcagaaaggaauggugaaggaagccauugauucuuacaucaaagcagaugauccuucaucuuacauggaaguuguccaggcugccaaugccagcgguaagacuucuugucuuuauguccugagaccuccaaaaaaucacuaagccaagcauuaagguguuuaaguuuuaauuguauagaggucagacacucccugguuacgugugaaagcuuuuagcccagcaucuugaucuagacugacugaguuuagaaagucucuggagaaaguucauuuuguuuugaggucugauaaaauccugauagagcucuggaauauaacuuuaaagugggcagaaguaucaagcaguuucggggcaauaauaauauagauauguauuuuuauacuuuuaaguauauccacuuuauauuugccauucuaaguaaugucucuuugaaaaaggaguuaagcugguguggugauguacaccugccagugaggcaggaugccuuaaacucuuggacugcguaggcuguuuagauagcaugacacucaaaaaaaauugucagggggaacuaauagcacaucuaacauauuugcuuggaaauauaaaacaagggugcuaguuuauggacuuauuuuucucuuuauuuaggaaacugggaagaauuggugaaguauuugcagauggcacgcaagaaggcucgagaguccuauguggagacagaauugauauuugcacuggcuaaaacaaaccgccuugcagaauuagaagaguucaucaaugggccaaauaaugcucauauucagcaaguggguuuccuguuuaauuugccccccaguuccugugcauguguguccgucugucugucuguuuucagugggaugcuugcaucaaagugcaugugaaggccagaagacaggcucuuguuuuuauuccucaggaauuaucuacuuaggagaaaagacagggucucuuguuggcaaaagucucacuaaguaguuuaagcuagcuggccagcaagcacaagggacugaucuaccacuaguuuggugcugggauuccaagcacaugcaacaccugaauuugugggucauagguauuaauuaacucacauccuauuguuugcaaggcaagcacuuuccaacugaguuccacauuuuaacacaugaaaguucaaugauugaguaauuuuaucacccuggcugaaucaauauuuuagggcuaugaaauuaaacuguucuuaggagauagaguguguguauguucauucauuuuauuuguaauuuuugagauacaaaauucaguggcaugaagaauggguauuuguuacuccugccucaacuucugggugcugaauuuuacagcauauucaacuaaacccaucuguuccuuuguaguaagauaagaauuuggaaaagggauuaggcugaaaccuguguuuuacugaucauggauugcuuuuccuccuuagguuggugaccguuguuaugaugaaaaaauguaugaugcugcuaaguuguuguacaauaauguuucuaacuuuggacgcuuggcaucuacccuuguucaccuuggcgaguaucaggcagcaguugauggugccagaaaagcuaauaguacucgaacauggaaagagguaaucuaaacccaaguuugaaugaugaauuaacauuuuguuugauuuuuuuuucucuuguaccguuguacuguuuuuucuuuucuguugaguugaaauaauugcacauauuuauacuuggguucucauaguggaaaauguuuauucuaggucugcuuugccuguguagaugggaaagaguuccgccuugcucagauguguggacuccauauuguggugcaugcagaugaauuagaggagcuuaucaacuacuaucagguaacgacaccaggccuuuaugugaauugaaaccuucguacacauauucucuccucuaauugcauuuuuucuuuauguaggaucguggauauuuugaagaacucaucaccauguuggaggcagccuugggacuggagcgagcucacaugggaauguucacagagcuagcuauuuuguauucuaaauucaagccacagaaaaugagagaacaccuggaguuguucuggucgagagugaauauuccuaagguaaccaaccagucuucaccacugauuagcucuaauaauuuaaaauaccauuuucgcugggcgugguggcacacgccuuuaaucccagcacuugggaggcagaggcaggcggguuucugaguucaaggccagccuggucuacagagugaguuccaggacagccagggcuacacagagaagcccugucucgaaaaauccaaauaaauaaauaaauaaauaaauaaauaaauaaauaaauaaauaaauguaauaaauuaaaaaaaaaaaaacagccagggcuacacagagaagcccugucucaaaaaauccaaauaaauaaauaauaguaauaaauuaaaaaaaaaaaacauuuucccuguuaggcugauugcaggagucauauuuacaucuaaagcaacuuuguggugcaggugcugagagcugcagaacaggcucaucucugggcagagcugguguuucuguaugacaaguacgaagaguaugacaaugccaucauuaccaugaugaaucaccccaccgaugcauggaaggaagggcaguucaaagacaucaucaccaagguauauacacucagaagugugcacuguggaaagagaaggcuccuuggauagaaacugaugugcauuucuauuuuuagguggcuaauguggaacuguacuacaaagcaauccaguucuacuuagaauucaagccuuuguuguuaaaugacuugcucauggugcugucuccacgguuggaucacacucgugcagucaauuauuucagcaagguaacuguuuuaaacugaacuuuacagugaggauuucgauguacuuggauacaguucucaaccauggauaccuuucuaacaaacuuuauuuuaaagguaaaacagcuaccacuggugaaaccauauuuacgcucagugcagaaccacaacaacaaaucugugaaugaaucacugaacaaccucuuuauuacugaagaagauuaccagguaaaaccuuuggauucuugugaauacuuaacaguagacucugauuagcuuuaacacugacauguucugugguaaaaacaaacaaacaaacaaaagaacccuguuagccuuaauuuuuaaguagcaggcauguggaugcuuaguccuuaaauucagcaagguuuucgggauggguaaguguucagcuuuaugacaaguuucacucuuugaguuagauauauuuuauaugcaauaugugcuuccuuccccucuuacauccugauugcacauccaagaggcacugauuuuucaauuaguccauaaacuugacugcuguuaaguggacuuaacuguuuauuaauuuccucgccuaaugucuuaguauuugucauuuaaauuugcucuuaugaaagauaacacauaaauagaaacugucuagguuacuaauugcgauuuuucccucacuuggccuggcugggacuugccuaguagcgcaggcuucccucacagacaucauacuugagugcuucguuagagcucugugucagcaccccuggcucaaagucuagucuguaagaauaguuuccuaacagcuuacgugcuugucuacauuacauuuucucccaauuucauagucauuuaaguuaguaucaguacuguuuaucucaaagaaaauugcaccuucagaaaguuguacaguccauuuaagcauuuuauuuauuguuuuagaaguagaucaaagacgaucgagaucugaauacagguuacaacuuuuguaguguggugcuugcauccucucucuacauuguucuauuucauguugccaucuaacugccuccaucagaaugaacuguggaacauaaaugucaaaccgaaagcugcuaguugauucugaauggcuuugucucuuaaggcucugcgaacaucaauagaugcuuaugacaacuuugacaacaucucacuugcucagcguuuggaaaaacacgaacucauugaauucagaagaauugcugcuuaucucuucaaaggcaacaaucgcuggaaacagaguguagaguugugcaagaaagacagccuuuacaagguugguaagcgggugggcuguucaagcaaugggaauuggcauuucaacucccuuuugugaagguggcuuuuaagucagugcauucauuauuguuguuguuuaacuuucagugaugguuuaagucagcauguguggguuaaacucuguucuucucuguuucuucugaauaggaugcaaugcaguaugccucugaaucuaaagacacagaauuggcugaagagcuccuacagugguuuuugcaggaagaaaaaagagaaugcuuuggagcuugucucuuuaccuguuaugaucucuuaaggccagaugucguccuggaaaccgcauggagacauaauaucauggauuucgccaugcccuauuucauccaggucaugaaggaauauuugaccaagguaaugaugcucagaaguguauucagaacuaguaauccugaggauauauaacauucuacaugcauguuauuuuucaaguuuuuucucuauuauaaauuauuuaguugaccauaaaauguuccuauuauauggauucuuuuucuuaauagcugacaggcgauaugauuaggaauggaacucaagcuuugucaguguuuacucucuguauucuuauaguaaauaguacucucuuuuaauauuugaaauauuuuaagauagcauuuuaaaguuaauugcuacaacuuagaucuccauguacucccgauuuguuugguuccagacuucaugucuuucccguuucucaugcauuguauuauuaguucccuagucaacacagauuuuugauaaucaaguacauaauuuaaaaauacuauaggaaguuugcaauuaaccauguuuccuaaaugcacauuaaguaacuaaggauucggccaccguacaaaauuugcuguucauccuugcaccucuuucugaugugagaauagcuccugcuugccagaguuaacuagcuuuaugcauagacaauuuaaaugauuuuuaaaagauucguuuugucagaguaaauaaaacuugaagugaagucucuguucugaucucuucagcaugccugaguacaggaggggaacacuacuaacaccccaccccauagagauguuuccccgaaggccacauaacuagauaccuugaguugcucuuacaguuuuuaaaggaggaauacuuuauauguaagcucagugugauuagaacaguugccacagcuuagccacaggugggggaagcuucuuucuuaugcauaaugaaugccaccuuuggagaccuggcugcuguuaaccuaaaugcuguccauuuuccuagccauuaagcugcuuccuuucacacugacuuagcauaaauucuugugcagugagcuuugaaguuacacaggauucuaaguuuugcuuccguacgcccuugacuuccacucgcuccucccuuuuuuagugguuacauguuucuccccugaaccuuuguugcugauucuaccuuuuuaugcucaauauggaauuugauuuuuuuuucuaagcugcaccuucugaauuccuuugcagguugaugcaauaaaggaaaaggugaaaguugauucuuuugcaucuuuaagucuggagacuaagucuaaggauuugcaugauuuuuucccuuccuuuucuacacugcugcugcugcuuuuccccccaauaaauuuucacuaagccucugcaagucccuugaaacauaacuauaauagagcuguaggacauuaguagauguuugcuacuaaucggcuaauaggcuuuaggaagggcaggaggcuaaucaguaguugguucacagucucucuuaauauguuauuaaaacugagcauggugaguuucaauauuaauuccaaacuaucaggaaauugcuuuucccugucaggguaucuggaacguacuaggacuuucuuaauauuugaaauaaauuaaaacaucuucuuuuuuuauuuugugagcuugccugacaguuguugaauuuauaucuguauguacaugcccuaagaggccuuuggaguucuguggggcuguuuuuuguuuguuuguuuucuggguuuuuuugugguauugaaggacugugauccaguuucugaucucuugauucuuacuaauuuuuuuugcugaaaguagauacaagagauacuagcugcuuccgaagagacuuuccucauguuucuccagguguccaguucucauggugcuaguccauuuuuaagaagagccaaaaucuuuucaaucaugacagagccaaguuugcugcaacuguuauuaagcaacauggauuaucucuguguaugacaaggcaauauauuaacaccuaucuguaauuagcacgccuucaaaaccaccaaaauuugcugccaaguugauucguuggcucaucauccaagaaugccaaauuuaggcaccauuugguugcugcuuucuuccauuggcuuaucucuuucccaguauaaacgaaaugaacuuuaaaacuuacuccugguguaaaauuacggcuagaaagugguggggaaguaaaggaguguuaaauuuuaaaugauuuggguggggccaaugccuugggauuauguuguucagacuggagucaccacuggaacuuagggcaaaccugaguaaaugcauugugugugagacccuucagcagcuaguaagcaaggcagcuagaaagcgugugugugaaaaauggggaauugaacugcaguguuaugcguuguuuucaaucaagcauguacaagucaccgcaauuacaucauacuacuccgaaacauagagcauugcugugggcuguguguguuccucaagagccuguauggcaccagucauccucagaucucacuucuugcuucaguacuuuugccuuuuuuucaugcacacauacaccagaauaacugacugcauguuaacuuuuacucugcagcauauugcagucuuuguggaaaagccuuucgcaucuuaguggauuuucaauauuacaaauggaacugauuucagagacaugcuuauguuaaauuuuucuuuuuaaacccaaggaucagaaacuuuuguuacagcucuuaacaaaagcuuguguucauaaaaucuccucccauuuuucuucuuugugcaaucuaaauugggcuuaaacaaaaguuggauguuccugugccagaggcuaucccauuguauaaaaacaucaacauuuuugcuuauguugguguuucuccucugggauuugugcuuuucuuccucccugccuaugucagugaccgggcaguuagauaaugcuggcucuucuagucucccauguguuuccguaucagaccuguguucagcauuuaaucagacauuaacuuuugaaugugucuguauacugaagauuuuuuuuccuucaaagucugggguuguauuauauagugcuggguuuuuuggggucuuuuguuuguuuguuuguuuauuuguuucauuuuuuucuaucucuuaggaguuacuuagacauagacauccauguguucccuguauaaccccucuguacgucauucucacacacuagcuaggucagcagcccaugugaccuugacggcagagcagugcuuuaaauuccacagauggauaacuuuuguuguaaaguuggaugccaaauagcggguauuucacaugauccuuacauuccaugguagucuuuaauuugauauuaggauaauuuguaagauacuauguaggcuaugaaggaaauaguauguuaaaugaaaccaauacucagggauacacaaugagacuacgucucucacccccaccccaaaagccccaaaaccaaacaaagcaaacccaucuuccuaggguaggcagacuacugaggcuucucaaaaguucuuugacaagacuggauuagaccagaucgccuuuaacauggaguaauuagaacuaaguauaaaacguugucuggagcugcucagcugggucgggugcuuaccgcuaagcuucccuugauucucuccucugggauccacacagcagggcgggaaaacugacagucuauaaauuguccccugacuuucauaugcacaugcuuguugucccucgccccccaaaccguucauguaauuuuugaauacaguccuaauccccugccuguguguacacacagaggcacuauuuuaauuuuccaguagaacccagguacugcuuuagcauuuuaaaaagaucuaguuuuuaaugcucccuucuacacucagauucuuagcacacuuggccuucaaaacagcacauagaacacucagauuugaaaauuaguuguagagaaaaccuggcucagaugccaacuuuuaaauauaguuugaaauacaaauaagguauaaagucagugaaagugucuaauacaggagagucuguaacaccagguccuauuucuuuucucuggugugccagggaugaaauuguguuagcccauaauagcccaccgggaacuuccagcuucuuuucagccucguuuucuagaaggaaauucaaggacugcugaagugguuugcucccucuccccuuaacucuugacaggauccgggcaauaccacucuuguccuucacucauacgcuuggacugguauuaucugauguugcccacuuugauuagcuaguauauaauagccacuuacuucuuugccuucauuaaaaguaaaagcuuuuuucucaaaguugggaccaacucaagcaaucccaguuacuucuuagaaucauauaccauuuugucucaggcaacuaaggaaaaugacauuauacaguaagauugcauauggagcuacuugagagcuaagucucaagucuguaaaaugugagccucagcaggagcuaggcacaguuggcaaaacagcuuauucugcucaaauacuuaucuagccauuagacucauuucacguuuuugaaagccuauucuccuggggaaagaagucuugaugguucaugaauuccuuauuaccucugauaguguauguauacuucauuugaaaagugguuucuuuucacuuucucccuugcucaggcugcauccuagcauguccagucuuagccuggcgugagcuguuauggcauuuauaaaucccuccuugcugaggguuuauaaugacagugcugaaaaacaccuugacugaaguaugaauacugccauugaauuugaggggccugagaauguucuugccagucuguuuuauuuugacagaauuuaacauacuaaggcuuuuccacucucugccauacaccuaaguuugugaugcuuuugagguucuaacaugacuuguuuuucucuagguggauaaauuagaugcuucggagucgcugagaaaagaagaagaacaagcuacagagacacagcccauuguuuaugguaaucugucucuuuuuuaaguucagagggcuaggcuacauuagacccuucuuaaauguagcaagcuuggaaaggggcaaaacauuugucaaguuaaggaauaguucucucagcuauucacauuuucuccugaggaccauuuaaaacucaugguauccacugugauaagcuuccaugcauagaaucucucaaaaauagucauuaaagauggccuaggcuuucuuguugccugagugaugacugaucuguuuguuccuaagucacuaagaaagaguuuuggaagaaccaguauaacaagcuuguccucagugcgcuuuggguaaagaaugcauccuaacuguaaauguuaacuaggacagagaauggggguuaaguuucuauuugagaacuuuccaaagagcauccaaacccuaaaauaguuauuuaacgcaguuugacuucuuauacuagcccguguggguuacuuucccuuugaagcucacacuuggugaauguuggauuucagaaauaugauugaaaguuuuauaaucagauuuucuuuggaaggaaguauaaaauuaggaccauuuugucucaggcaacuaaggaaaaugacagugugugagucuuuauuauuauuauauuauuauuauuauuauuauugcagauaaacuguuugggggagucuaugggacaggguaguuuugaugaaggacuagguagaccuaaauuacaugagauuuggcauuaauugaaauagggaaaaaaagauagcugugguuuuuuucccccagguauccaugaacugcuagacuuucauggauuuuuaaauagggaguugaaauagaguuagaauuuucaauaguucagaagugauucuuugauaaaccaguuucaauacuugcuuacuaaauaaaauuuugguacuacaagggggcacagggaaccuguuguacugggaguguaguagcuuccauucuagugggagaggauaugauaugcaggacuagggaggcauuguguuucucucucuaaaaguucuuuacaugucauguuuucuuuauguggucagcaacuauuucagcuucaucagcaaguauuugauagaagguauauauguucucguguuuuucauaccuaaugcauugccuaucuagugcauauuugaaugugguuuuucuauugcucuuucuaaauuagcgcuggauucuuugcuagaacuguauaagguuucauuaccauucagauguuuagaaucagauauuuaacuuuaacaacuuguaaaguuuuccugugcuaaaauuuuggucacuaaauguaauguguauuaugugauaggcuuguuggcagauguauggccugauaaugucaaaugugcauguguuacugcuuuaaauauaggauguuguggcccucagcccugcuccguuggcuuuuuuaaggcaggaaccuucucagggugagacuguauuccaaauugggacagucaaaagugcccacacacaacuuacucagugaauugugagugugcugcuugaguggguaagagugcugagccuggugcuaacagauucuccuccucuuugucaucuuaggucagccccagcugaugcuaacagcaggacccaguguggcagucccuccccaggcaccuuuugguuaugguuauacugcaccaccguaugggcagccacagccuggcuuuggguacagcaugugagauggaagcugauccuguagucuccuauuuucauacugaagcauccucuacccacuucucaguuuauaaacggggaaacaggcaacguguucuuguaaccuuuacuucaugaaggacuacuuuuuuguucuaacuauagacuugggucgccuauguuaaaacuuuauuuucacauuccgcaucauuagaccuucuuuucaaaggggaauaguauucaugugggcuuuuuucucccccucauucuuugaagaacugcuuacuauucaaucuauugugaagaaccugauuugcacucuguaguguuuaaagaaacaaagaaacucuaauauugaaucucuuaaauuuaguguauguaaacagcuuucacuauguauugucuaaaugcauuuaaaucucuuuuauucaaagaaaagcuaaggugaaaauacugguaugugaccaugcaagacugucaaugccgacaaagacaacacuaaucagcauauccuauauuggaucacagugcucuccaaauuauuugaaaaaugcauacagacaacuugccugauuguuuuuuuuuuuuuuuaaugaguauaaaaggcccuuucaccuaugcagguuuccccauuaugcauauagaaaaugcuaguguguguugcucacuucauguguaacagguguccucauguugugcuguauccugugcuuuuucugugggaccauuccauucaggaacaagaagcaccaugauuccacgcguguguauuuacuaacccucccuucccugagguuuguguauguuggauauugugguguuuuagaucacugaguguacagaagagagaauucaaacaagauauugcuguucuucaguuuuguuuguggaauuugaaauuacuccaauuuaaaauaaauuacuggacuguggaaauaacauguagaauugcaguuuuaauuaaauacaucucaaaccagaaucaugguuuucauaguuucauacuggauacugcuggagcauuaccgggagccauagagggaaauuaugaaaaagagaugcauuaugucaauuacauuccuguaguuaugaaagauuauacagcagucagugaauaguggacuccuucucacguuuccagcauuuuaaucaaguagcacuccagggcuuuaugcauuucacguaacuaagaaaaguaugaguguuacacugacuugaaauaaagguauauuuuuuaaaauauca

SEQ ID NO: 6266 - RNA, 2757 nt, Mus musculus
acuuuaagauaagugccgguugcagccagcugugagagcugcacucccgucucugcucuaaaguuccuucuucucagaggguggcaccacccugaguugcuggcagugagucuguuccaaguuccagugagggaggcauccacccacuuggggcuucuguccaagguaaggagcaccugugagucuaacugccaggcucugaugggggucucaucucugugggacuagaaagucccaacaaucugaccaagguaacaggaaguuaagacaaagacagagaccaaagucagaaucagagcugugcugugagacaaaaagauaagagaaauaaaaugcuggucacaaaagucaggaaaacuagaaaacuuagauaguaccuggcaacaaacaaaagcuuuuggcugaagaucaauguguuuaagagauaacaaaaggggugcuaauacagaagcugaguccuuaaaagaguccgguggccuaccuguuaaagcagcuaaaaaagagacuguguuucauacuccuccacugaccagugcaaaacaagcuaaaaaguuccugggcacugcgggcuuuugcagauuguggauuccagguuuugcugaguuaaagagauaaacagcccuucguauaaagaaaaaaaaaaggaacaaucuuacauggccuuagaugcucuugagacugcccuaauguuauccccagcuaugggacuccuagaugugacugagaacaaagguauugccaaaagaaguucuuacucagagauugggacccuaaaaaagaccuguggcauacuuguauaaaaaauuagaccugguggcuguaggauggccugcuugucugcacauaguggcuucuggucaaggacgcagauaaauugacucugagacaaaacuuggcacauguccuagaaagugugguucagcccccaugaccgauggcugacuaacgcucuugaaaacauuauccaaccgucccccugaccgauggacacauugucagagcuuuuuguugacugaacgagugaccuucgcucccccugcuauccucaaucucacuacugccugagacuucaccuacucaucauugugcugacauucuggcagaagaaacucauacucgaaaugaucugaaagaucagaucagccuuggccugagaguuugagcugguacacggauggcaguagccucgagguuaaggguaagcggaaggcggggacagcagugcagugauggacagaaagcaagugaucuaggccagcagccucccuaaagggacuucagcccagaaagcuaaacuuguggcuuuaauacaagcucuauauauauagacaucugcagagaaagaccuaagaugcuguggcuaaaagaaaucagauggcaaaucuaaccgcccaggcauccuaaagagcaaugauccugacagucuaaagacuaucaaguuauagacaaauuaagacugguaaaagaaacccuguauaaaauaguaaaaacugaagaaagaaaacuaguccucucaugagaagacagaccugacaucuacugaaaaauagacuuuacugaaaaaauauguguauaaauaccuucugauuuuugugaacguucucaagauagauaaaagcuuuuccuuguaaaacgagacugaucagauagucaucaagaagauuguuaaagaaaauuuuccaagguucggagugccaaaagcaauagugucagauaaugguccugccuuuguugcccagguaagucaggguguggccaaguauuuagaggucaaaugaaaauuccauuguguguacagaccucagagcucaggaaagauaaaaaagaauaaauaaaacucuaaacagaccuugacaaaauuaauccuagagacuggcacagacuuacuugguacuccuuccccuugcccuauuuagaacugagaauacucccucuugauucgguuuuacucuuuuuaagauccuuuauggggcuccuaugcccaucacugucuuaaaugauguguuuaaaccuauguuguuauaauaaugaucuauauguuaaguuaaaaggcuugcagguggugcagaaagaagucuggucacaacuggcuacagugaacaagcuggguaccccaaggacaucuuaccaguuccagccagagaucugaucuacguacaccugcgucaugcugagacccucaagccucacuaaaagggucccugccuaguucuguuuacuaaucugccuuauucuguuuuuguucccauguuaaagauagaguaaaugcaguauucuccacauagagauauagacuucugaaauucuaagauuagaauuauuuacaagaagaaguggggaaugaagaauaaaaaauuacuggccucuugugagaacaugaacuuucaccucggagcccacccccucccaucuggaaaacauacuugagaaaaacauuuucuggaacaaccacagaauguuucaacaggccagauguauugccaaacacaggauaugacucuuugguugaguaaauuugugguuguuaaacuuccccuauucccuccccauucccccucccaguuugugguuuuuuccuuuaaaagcuugugaaaaauuugagucgucgucgagacuccucuacccugugcuaagguguaugaguuucgaccccagagcucugugugcuuccauguugcugcuuuauuucgaccccagagcucuggucugugugcuuucauguugcugccuuauuaaaucuugccuucuacauuuuau

SEQ ID NO: 6267 - RNA, 9048 nt, Mus musculus
cgcuagaggaagcucuuucuccgccauggcggggccggucagcuugcgcgagcugcucaugggggcgucggccuggcugggcucugagaguccuggaggccccuccgcugaaggcgggggaaacgcggcuggcacgcccgagcccccguggagggaggaugagaucugcguggugggaaucuucggcaagacggcucugcgccucaacuccgagaaguucucucuggugaauacugugugcgaucgacagguuuucccacucuuucaccaucaggauccuggagauccaggaacuggaaucaagaccaaagcugucucugucggagaggcgggaggagccggagaccccggggcugcagccggggauucacuucgcggagguauggcuacggcggaagguaaccgagcugagccagguccccaggacuucagucuuuugcaggccuauuacaaucaggaaagcaaaguucuguaucuuauucucacuuccaucugugacaacucacagcuucugcgugcuugucgggcccuccagagcggugaagccggagggggccucucuuuaccucaugcagaaacacacgaguucuggaagcaucaggagaaguuacagugucucagccuccuuuaccucuucucugucugucauaucuugcuccugguccauccgacguguuccuuugacaucacuuaugaucguguauucagagcccuggauggacugagacagaaaguacuaccccuccucaaaacagccauuaaggauugcccaguuggcaaagacuggaaguuaaacugccgaccuugcccaccuagacuccucuuccucuuucaacucaauggggcccuuaagguggaaccgccucggagccaggauacagcucauccagauaaacccaagaagcacucucccaaaagaaggcugcagcaugcccuggaggaccagaucuauagaaucuuucgcaagagucgagucuugacuaaucagaguaucaacugccucuuuacgguaccugccaaccaagcuuuuguguacauaguccccggaagccaggaggaggacccaauuggcauguugcuggaccagcuuaggagccauuguaccgugaaagacccagaaucguuguuggugcccgcaccccuuucuggaccuaggcgguaccaagcgaugagacagcacagccgccaacagcucuccuuccacauugauagcagcaccucgaguucuucaggccagcuaguggauuucacucuucgagaauuccuguggcagcacguggagcugguccuaagcaaaaaagguuuugaugacagugugggcaggaacccacagccuucccauuuugaacugcccacuuaccagaaguggaucucugcagcagcaaaguuguaugaaguggcuaucgaugggaaggaagaggacuugggcucccccacuggggagcuaacaucuaagauuuuaagcaguauuaaagucuuagaaggguuuuuggauauagacacaaaauucucggaaaaccggugccaaaaagcuuuacccauggcucauagugccuaccagucaaacuugccgcauaauuacaccaugacaguccauaagaaucagcuugcucaggcucuucggguauacagucagcaugcucgagguccagccuuucacaaauaugccaugcaauuacacgaagacugcuacaaauuuuggagcaauggccaucagcugugcgaagagaggagcuugacugaccaacacuguguccacaaauuucauuccuuaccuaaaucagguagcuacaaaguucccaacaguuugaacugaaaacuggagcugugcuuuuaguauuaguguguguuuguaugguguggugugugugucugagagagaccucgcacccuuggaggucagagggcaauguugugaggucaguagucuccaaccuuuucaugggucccaaguauccagcccauggaguuagccuugugcugcaagcacugugccugcugugucaucucacuggcaccugagcuggguguguauucauguauuaagaugauuuauuugguacauaauuggguuguuuuuuaagagcccugcagaacuuugauaguaaauacuuuuuuuuuucuuucuuugcuuuuauuuguuuucuguuguuguuuuugaaacaaggucucuauuuaauccuggcuggaccuggaacucacuauauagaccaagcugaccuccaagucacagaacuccuccuccugccucugcuuuugaaguccaugugccacuguacccaauuaguaaauacuuucuacuucuuuuuauuuuuaaaauuacuuugugugugugugugugcaugcauacauauauaguauaucuauuuguguguguguuugugugacugcaugaaauuuauguggaagucaggacagccuguuagucaguccccuccuuuaaccuguggguucuggggauggaacgcagguacuacaagagccaucuugucagcuccagcccuaaauuugaucuucuaccucuuaaaacgaaaacaucacccaugacugauuuuuuuuuuaacaauaaacuggugaguugguagaugaaaaguuuuaaguggcaugaaguuucagaaaauguaucacccuuuauccuaaagagguuuuguugaauuauuagaaaagaaaggucaccauaaugugacacagaaggggaaaaaagucaaauuuugacuauuuauuucuggggcagggucucacuauagacuacaccuugaacucuuagagauccuucugccuccagauugccacacuugcacugcagcuaugagugaggaggccccaggucucauucucaguguuguaaaagaaaauccuuauuccuguguauuuaaucaagauuucugauguuugcuuguuuguguguaucuguguuucuuaauggccagagaacuaugugaagaauuuggggaguugauuguuauagaacacaaaguaaacuuggcucugcaucgucuuugugugauuaauaaugaugguuacacuuuccaggagaaaagccagaggcagauaggaacccuccugugcucuaccacaauagccgagcccgauccaccggagccugcaacugcggaaggaagcaggcaccucgagacgaccccuucgauaucaaggcugcuaacuaugacuuuuaccagguaaacugaagcuuccuucucucuuuuuuuuuaaagauuuauuuauuuauuauauguaaguacacuguagcugucuucagaugcaccagaagagggcaucagaucucauuauagaugguugugagccaccaugugguugcugggauuugaacuucggaccuucggaagagcagucgggugcucuuacccacugagccaucucaccagcccgcuuccuucucucuuaaugacugaauauucuccauagcagaauaccuagaaaagccaacacaaccgcagugauaaagaacaagggcaaguucuuuacaugcacuucuugguuuuucauaucuuuuaaccauauuuuauacauauauauguguguguguauguguauauauauauauauauauauacaugcauauauauauauauauauauauaaaguauauaaacugucagaaugauauaguuaggguuuuuuuaaaaagacuuauuuuuacuuauuuacucacagagcucugccagccuaugcuuucugagagcugggauuaaggcaugagccaccaugccuggcuugggaagcucugauuagcuagcucaaaaauauccaugaucacaaucuuauuuguuacuaaaauaacuuaucagugguuuuuuuguuuuguuuuuuuaaucagugguauuuuuauuuaaguguuuaugugugugaauguauguuguguguacgugcguauggaggucacaagagcacguuggacccacuuaggcugaaguuauuaucuugaguuuuugcauucgugugcuuauauucaccacguguguaccuugugucuacuguuagggugaagcaguugagggguggguguagcuguucuuuacuacuuugugggucuuucuuccacccuucuccaccccuuuucuuccuccuguuuaaccccguaacacuaaauaagagaggaaaggaaagagaucccugaauaacgucagggugggaagggugcgacauuaucauuggacugcuuccuacugauuggggcauggaguuccuuggggcaaguucuucuuguuguuucuucuuggcacacucagccaacaacaacccacccaacucuugggccccuagcauuuauauacccucugaaaaguccccagaauuccaaacaucacacaaucucagaaacuaccugcagcuggcaaaaccacacccuugcuagaacacaaggcaaaccauagucagcugcugugggcaaucugaagucgccucugggaugaaaacaaaaacauauccuuacaauguuucucuauuuuucaaagaaaccaagacuccaaaucucucacugcagggauggguggggggaccuuugacaggcucaugcaaaugugucacugagaaauuaggcugagauaucuacugggcgaggggagagugaaagcuuuuucagaguuggaacaugagggagagauagaggcauacagacaaggagacagagagaaaggcaauggaagacagaaacaggcaagacaggaaagaaaugagagagaaagcugggguggcugggagcccccuucugggcugcacuuagcaccugcugcgccugcuggcggagggugaugauguaagcugucucuaggucccuggggguaggccagugggaaugcccaauugcuaauaccacuaagaucagaaggccgcaugggauccucugagacaggaauuaugcuugugggugcuggcagucaaaccuggguccucugcaagaacaaguccucuuauccacagagccaucucugcaucuccacugguaugauuuuaaacagaagugaagaagaaaaauuucugguuauaaagccacuccucuaaaauauuuuuuaaaaaucacuuuuacuagguggugggucagugcagcaaauguguucagugacuuuuuuuuuucuuuuucauguuuugguuuuguuuuuucgagacaggguuuuucuacguagucuuggcuguccuggaacucacucuguagaccaggcuggccucgaacucagaaauccgccugccucugccucccaagugcugggauuaaaggcaugcgccaccacgcucggcucagugacucuuucuauuaucacacugauggucacugguauuaaaaacgguccugcuuagaaucacucacugccuaaaggaauaacucauacuggauucuuuuggaguauaggaauacuucuugcuacgucaguacccagaaaauuaaauucauauagccauauguuggaggggaaaaaccuuccauguucuuuuuugcucacacauugauggcugacccuguuuguuagaguguaaugugugucugcuugcuuagagguaacuagcucaggauagucuagaacuuggucuguggcccauacuagcuuugaacuuugaguucugcuucauucagucuaccucucaaauacugugucacaggcacacacuacccacucuccguucaguaaaauguguggugguuuguuuacugauuuaaaugagccuacaaagaagaauguauuauuugaaauaaaaaguuuccccuucuuauuucucuuucuagcuucuggaagaaaaauguugugggaaauuggaucauaucaauuucccuguauuugagccaaguacuccagaucccgcuccugcuaaaaaugaacccucuccugccccgccagacucggacgccgagaaacugaaggagaaagaaccucaaacccaaggagagagcacaagccucagcuuagcuuugagcuugggccagucaacagauagccuagguaccuaccccgcugauccacaggcaggaggagacaacccagaaguccacgggcaaggagaaggaaagucugagaagagaccaaacuugguugaccgucaggcauccacaguugaauaucucccaggcaugcuacauucaaauugccccaaaggucuccuacccaaauucuccagcuggucuuugguuaaacuaggcccagccaagucuuacaacuuucauacagguuuggaccaacagggcuucguuccaggaacaaacuaucuuaugccuugggacauugucaucaggacuagagcugaagaugaaggagacuuagacacgaacuccuggccugcuccaaauaaagcuauuccugggaagagaagugcaguugugaugggcagaggaaggcggagggaugacauagcucgagccuuuguuggcuuugaguaugaagacucucgaggucggagguucaugugcucagggccugacaaaguaaugaaagugaugggaaguggacccaaggagucggcuuuaaaagcccucaacagugacaugccccuguacauccuguccucgucgcagggcagagggcugaagccacauuaugcucaacuuaugaggcuuuuuguugugguuccugaugcuccuuugcagauaauacugaugccucagguaggaaaugcaacccuucccuuaaauggcaauaauaauaauaauaauaguaaugguuugugguuugguuguuuuguuuguuuuuuuguggucuuuaugggacaaauccuguaagcccauguugacuuggaaaugaaugugcaguuugauaucucuaccucccaagugcugggauuauguuugugcuuuuguguaucccuuuuuuuuuuuaaagaaccauuuauuuuauuuuauguuauaugaguacacuguugcugucuucagauguaccagaagagggcaucacagaugguugugagccaccauaugguugcugggaauugaacucaggaccuuuggaagaggagucggcagugcuugcugagccaucucuccagccccuguaucccucuucuucaucaacugagcuguaucccaagcccaugauaauuauuuuaauuuuuguuugcuuguuuaagacagucucaugugguccaggcuagccuucaacucugacucuccugucucuaccuucuuggugcuagaauggcagagguacacaccuacaucuaguuuaggcagugcuagggauugagcccagguuucuucauguuugcuugauaagcacuguaccaacucaacucaacucccguccuuuguucuuaucacuuuuauuuauuuacuucggguuuuuuguuuguuuguuuguuuuugagacuguccaucucugcugcccuggccguccuggaaccugaaacacagccuaggcugaccuagagcucagaguucugucagugcaugugcucugucauggaauugccugccagccccauaucugcuucaacaguuuauuuccauuuaucuauuuucuuuucaaccuaaguguuuuuacuuugcaguccugguccuuuauuucuuuguguacauuaggccaugaauucguauggaaugggcuccaaaggcucaggcucuuuuccguuaguccucacaaagugugcuucucuggguggcacaggcuggggcuucagcugcacccaggugcccuucucuuuggcuuccuuuuucuucuggucguuccccuucacccgcuuccggaagcucucccugcucuuugagugcuugaugugcucaguccgcucauugauccucuuggccggaaccuugcccugauuugcuuguuuacaaugcccacggcaugcugggugacauuguagacucuucugguuuugccgcgguagcacuuauggggcauuccuuuuugaacagugcccauucccucgauguccacaauaucacccuucuuguagauuugcauguauguggccaacaacuccauguuuccuaaaaggccuagagaacauauaccgggugccucuccucuuucccuuuguguuugucauuuuggcgaguuaguggaagauggcugcccuauuuaucaauuguuuuuacuugcuguuugugugcucacuaguacgcuuagccaguucucugcccacuaagcuacauccccagguuccuaauuucuuuuuaagucccagagauuuuuauugauuuaacuauuacagcuguuaguaagaauuuaacccuaguuuaccugaugauuuagacaugcagacaaaaacaaaaaacaaacaagcuaggcuuggugacauaggccuuaaauccuagcacuccagaggcagguggaucucugaguuugagggcagccuggucuacagagugaguuccaggacggccagggcuacgaagagaaagauccuguagccaaaaaaaaaaaaaaaaagaaaaagaaaagaaacaaaaacaaaaacaaaaacaaaaacaaaaacaaaaccuggucaacgggaaaagagagcugaggguaccagacauccaaagaggugaagugaggucccagaaaaucaguuuccucauuuuguucaauguggcugcuugaccuucaguguucuagaacccguugucugguuagagauuuaucugccaggugugucuuauugagaaaucuaaaagguaauuuuguaaccccuguuuuucagguucaaccaggcccaccaccauguccaguauuuuacccagaaaaacaagaaaucacucucccaccugauggccuuugggucuugagauuuccuuaugccuaugugacugagagaggaccuuguuucccucccaaggagaaugugcagcucaugagcuacaaggugcuccgaggaguccucaaagcaguuacacaaugagucuuccagccacucugccgcagacugaagcugcuguuugucuuguuuuugauguguuuggguuuuuuuuuaauguguauacugugucuucccaaaacccaauguguuuugguuacaaguauucaguauuuggacaauaauuguuccauuauuucauuauauugauauuuauuguaaaaucaauaaaaguuuguucuagaaaaaaaaggauacaaaauguau

SEQ ID NO: 6268 - RNA, 15437 nt, Mus musculus
uggagggccucagugcuagcacggcuuacagcuuaagcgccucagcggucugaggaaugucaacuauucaauauggaggcggaggucgauaagcuggaacugauggugaguggagagugaaggaaaccuacuggguaauuaaugugcuccaccgauggccuagaaggugaagcgcauuuuagagucuccugaaacuggguuguggaagcuggaaccugaauugaguuccuucuuucugcaccuacgggagcuaccgccgccuuggucucuuaaccgccgcgggggaagggguuacauccggggaacucgugagggaaauggcgggagauguugaggguguggggccuuuguaauucccugguccugguuuucuccuucaucggcuccaggagccgcgcccggcacagauaccgccucacgaauuucuaccuuccuugcccaagcgugacuggaacggucuuuaauagcucggaggaggagagaggucguuuacgucucccgaaaagggggauggaggaugagguggggcagaagucuaggggcgcggagaaauucaaguccaccaugcaccuacucgcaggcgagcugggacagucugaaagaagaugcuagacuugcacgagaaacuugcccgcgguuccgcagacugggcucuuugcggcuugggagaggagccgccgcggggaccgagccuggagcuccuucccggggcgcgagcggcguugccccaggcccggcuuucugcuuccuagaugcucaauuccuuuccucugugcaaggagaacccuggacgaaggcccucagcggcugcgggcaaggcuggagugcacugagcguccagccgaguggccuugucauucuccaucaguguucucuuuauucccgcccucccauccuuccacugcccgcuagaucgccgcgccuuuuuucuuaguuuucuuguucugucuucagacuucuuuuugcaugaucacuuuucuuccagauugaucaucggaccaccagcccccuuuuaaaaaaauaccaagauuaauauuaaaaaguaaaacacuccaucugcagucugcccuuuuucccucugcguagguauccguugugucugagccacucucuccaaggaaaaucuugaguuuguaacuucugcuuuggaauagacuuuggggugauccuggaagauagcgaguaccaccccgacuuccccauucccacaccagaaggugugaggccucaguuucuuuucucuuggguuaauuaauucagguguuucaaacacauuuuauuagaaagauuuccagucuuguuuaacauuguauuuuaaaacuuucuuuguggagggaguguggggaugggggcggggguggggggagagaagaggagaagaauuuucugcugcuuuccaaaucuugaaaaaaugaauauuugacuuaagaauuuuucgugugugggugugugauuaccaucuuaaaauacgcacaaaauguuaaauauugugguuagagucuaucaaacaaccugcauguaaauucucuuguuccucucccauaguaugaauuccuugcacuggaauagguggagauauuuuuacuuguuagaggcuaauucuguguuuuuaacggguugcuuuuuguaauugguggaucaaguucugagcuuuaucuaacccuuccauugcaaucaauucucaaacuuuuaaaaaauauugagcaaauuaucuuaaagaaaauacaaguuaaacauccuguuaaagguaaguuuuaggaaguuaugagguuguugaacuuuaacauauuuuagauacuguauaaauuauggucuagcuuuaacauuucuuuuuucagaggaucaaaggaaaacagcuuuucccuuuguaacauaaccugaaguacauugaugguaguagcauuuacaauuuucaaguuacugaacuuuuuuucauaaccaagggcuugaaaaacauuauuuuuaaccaugauuuucaauauuaacugcuuuuuauugacuagacaacaaaagacauuucaucuucacauugccauguuccuuccuuucuuuuaaaaacaguaccuguugagaaaguuacuuucuaagccagagauaaaugauuccuugugcaaucgucuuuuauuaguaggucuuuacaauacuuaaaagguuugcuaaggagcccuugcauauauaauaggagugccuauuuaucuuugcaaaggcaguaguuaucuucacuugguaaaaagucuaaucuuaauaaauuauuugauauuuuuccuguguugacaucuaauucagaaaauuaaauuugccuuuuaacauuugucuuuaaaacccaaugcuugguuagcagaguuaaauauucccaaauuuggguuuuguagcccaggauuugaggauuaguaucccauuguuuaguagauuugaucugccugaguugcugaacuggaucauuuaaaggaaggucagugaaacuaaugagaauguauuuucucaucauuucagcauuacuaauggcggaauaagcucauccauuguaggguaaccuuugcucacuaauguuuucccuucacuaacugauugagagguguuugucuccuggccuccuuuagugaacccacuugggauuguucacaaaggcaguguaauaggauacuuggauucuguuucuugguuuacuucugacuuuuaaagaaacauuuuauuccucucauuguuuuuuuugauaguucuaaguuugaagggaaugcagaugccuuucuucacuaccucagauauuuuaagaaugaaaggugaggcugggcuaacaucaucuucagaauauacugguucccugauaaucgcuucccauguuauaguagccuucaauaaacucuugaauuaaaaaaaaaauaagauuuuuuuaaaaaagauuuguuuauuuuauguaugcgaguauacugucucucuucagacacagcagaagagggcaucggaucccauaacagaggguugugagccaccaugugguugcugggaauagaacucaggaccuguggaagaacaaccauugcccuuaacuucugagaucucuuuccagccccaaagcacaagauuuaagugcugccuaaguguguuugugugugugcacaugugugcaugugaguaaauucuauagagaucaacuggguauauagguuugagagagguauauuucucuuuuucuauugagauuuauuuuaugaauaugaguguuuugccugcauguuugugacggcaccacauuugugccuggugccugaggaagucagaagagggcauuggauccuguggaacucuucauggaugauuuugagccaccaagugugugcuaggacucggacccaagaacaaauacucuuaaccacugaauccuuuucauuuguuuuuugaaguaauuacucaaaggacuuguuuucuaugguagguaacccagacgcuuuggaaaaggaguuaaccaacauuacauuuaggcaaaaaacauaguuuuucacauauuugccuuaguaguaauuacagcugauuuuguuaauaucaauuauaaaguuuuuaugaugcccauguuagcuacuaaaggcucaggacauauuacaaaauuccuuuacaucugugcauguuuaugucugaaugcugcuaauuucagguuagucaacaaaaaccaauuaucacuuugguccuuugcccuuccaaaaauauacugguauaaauguuuuuagguuuuggaugucuucugacuaaaauggcaacucaacuuuaaggucuuugcacacugagccuugcauuccuuuccugcucacuccugcuaacggcugcucugacuuuauugcacuacuguacuuuacagcgagcagugcaauaguauugucaaagcauccgcgagcagguugcacaccuuuccugguucuugucuuacaucuucaguauuugugaaaagguuucuauaacuuucaguguggaaaacuguauaauuuuguuacuauguauauuuuuuagaaagucaucauuugaaaaaauaucauuaaauuaacauuuaucauuucuguauggcacugaaaauucauuacuguacgcugugaaguaauggccugucuaacugaauaguacuuuguaauuugcuucuuuuuguaauagacuugaauagguucugggaacucuucggucuuauuauaugaguugguaagugauagucucucaugucuauuuacuaugguaaugguuuacaucuuaguguccauuuuaguauuauauuagaaaugcuuaaauuuaacacuuugggaggggacuagagagaugguccagcaguuaacacuacagaggaccugaguuuccuucccggcacccacaucuaguagccacucucagccacuuguaacucuagcuccaggcaguuucgugcugucuucuggucucugcaggcacacaaauacaaacacacacacugauacaaacacagaauaauaaaauccuuaaaacuuagaaaggcuugauuauuguaacuauaaaauauaaaucacuuuaaaaaaaacuuuuauuggcugugaauuucacaucaugcaccccagcccuccaauuccacucauuuucccaucccuuaguaucggcuuucugcccuugcaacuuccuccucaaaacaaaauaaagauagaauuaaaaaaucuugucauagaagcuggaguaugucacauugugucacacaguauauccuuuuguccauacagaagucaucacuuuuugguaauaaguuuaaugcacauuuuauguaaguaaaacuaaaaauguaaguguacacugaugaguuuuggcaaauguauacauaauguaacucccuccacuacuaagauaauaaaacauuuucauuacauuucauuucaaaagucucugugucugucugcagucuccuuccaaacagugcuuuugugaacucugacugggccagcacaguauuuguucuuuuaguuuugcauucuuguacuuacuguaagugcuuuugccaucuugccuuuguugcauguguugauaauugauucauuuuuauuguugaguauauuccauuguauaaagucugacaaaguguuucuuggguuguuuccaggcuuugccuguuaugaauaaauuuguuggaagcauugucuuuacguggccauaauuucuuauuucuuuuguguaaauacugggaaaugggacuauuaggagaaguugcuaaaaucaacuggguggcggcauagccuuuaaucccaucacuugggaggugggccgggggugguggugaaucucugaguuugagaccuagucugcagagugaguuucaggaacgcauggcuugaaaaaucacaccaacacacaaaaggcaaaaacaguuugauaaaaucuuuuccauaguccucuuagugauauugaauauuuuucaugugcuuauuugcaacugauauauguuuuuuaaugucuuaaagucuuccuguccaugcaugguacaugguauacguacauacgugcauacacaaacugcagacacaugcgcacauuuuuuuuucucaaucuaaugucacuaauuuuuuuuucuuggagauuugugguuugggggcuggagugauggcucuggggucaaagaccuucuuguuuuccagaggacuggaguuugcuucucggcucagcacccagguugggcaguuuaguuugugauuccaacuugagaggauuguacacucucuuguggccucuguggguuccuuuacacacauggcaaggcaaacauagacacacaaacaaacaaauuuaaaagaaaaauuuuugguaaaguauuuaauaucuuuauguguaugugugugcuugcuugagacuguccuucacaugugugcaggagcuuguggaagccagaagaggguacuggaucuucugaaacucagaguugguuuugagcaaucauguggaugcugagaauggaacaaaccuagaugcucugcaagacuaagagcucucuuaaccacugaauucucucuccaacccccaaaugaaagcuuaacacgauuuaacacagcccuguauaaaacagcuaaugcaugugugugguggugcacaugccccuggcacauguagaggccuaaaguucaccagguagguucucagauggauguagcuuggugaggcauaccagaggcccugggacuggauccuaccucugccugauagugaagguggccucucuaauuccagccacuccagagggguaaaccggaggauuaggauuucaaacuuauuuucugcuguagccagcccuaggucuaccugguuuacauuaaacccugucacagaacaaccaaagcaagcuuaagucuuuccuuucaccauguggaucuuggguuugaacucgggucaucaggcaugccugcaggcaacauuaccugcugauucauguugccauccagcauagucagccuuagguuuugauagaguagaauggauaguguuugcuuuauaagcuuguuugguuuuguucauuuuuuuucacccaggagucaggguuuuucccuguagcccuggcuguccugaacucggccucaaacucacggagaguugucaaacuuugccucccaugugcugggaucagaggggugagccagcgcugccuggcuuguacauacuucuguuuuuggagacaggguuacuuuuuguagccuuggcuguucuggaacuugcucugaagaccaagauggccucaaauguaaagagauccccuugucucugccucccaaaugcugacauauauauacuuuauauccacaaauguagggugaguguuuuaucacauauuaguauaguauucaaacgugaaaagaaugaauaauuauguuuaauaauauauuuuuguuuacuaaauaauacauguauacugguuuuuuaguuccagaaagcugauucugauuuggauuaccuucaauauaggcuggaauaugaagucaagacuaaucacccacauucagcaggagagguaauugggaauaaguaaaucuuuuuuuuguuuguuuugguuuuuuuuuuuuguuuuuuguuuuuuuuuuuuuuguuuguuuguuuuuguuuuugagacaggguuucucuguauagcccuugcuguccuggaacucacucuguagaccaggcuggccucggaacucagaaauccgccugccucugccucccaagugcugggauuaaaggcgugugccaccacgcccggcuuuucuuaccucucaguuagcauguucccagcuuuauuccauguuguaacaugaccagaacuuaauucuuuucuauaguuagaagcuauucauuguagaacuauacuguuguugguuuuuuuuuuuuuuuuaaucuauucaucugugagcuauucaggcaauuccuaccuuuagguacaaugaauagucccuuuguuaacauucauguagaaguucuaugugcacauauuuucauuucuguggguauaucuaggcaugaaauuacuagucaaaaaagcaacucauaccugauauuuucgggaaccaucaggauguucaaaaauacuugucauuaaaaaaaauuuuuuuuguaacuuugaaacagucucaguacuagucuagguuagccuuaaaauuauguagcccaggcuggucucaaauuugcuauggaacccaggauccagucuggaaggaacuucuuaucaauuuaagccucccauuugcugggauuauaaacaucugccauugugcuuggccauguaaaucuuugugaaguguaccauucgggugcuguuuucaucccauucauuugcuuuguuaaacauagaugguaucuccaccaucugucuuacccaguugccuucuuuuuuuuucuucgaagacacgguuacaggguuuuucuguguagcucuggcuguccuggccaagggcuggcuaucuuagcauguuuucaucuuuccaaaguuaacacacuguacucauuacagcauaccccuccaucagcacuccuacccaacuccagcccuuugugaauuuuacugcucuuaaaucuguauuuguuuguuagugacuggcuuauuucauccaaaauguccucauauucagaaccugggcuuuccaagcaggacugacaaccugaguccagaaacacagaauucauccauguuguaucgcugccagaauuuccuuuaaaauuuuaaguauuuauuugauuuuguguguaucuauacuugugugcuuguguacaaacaaggguauguccuuucuagcugggccugauggugcacaccuuuuaucauaguguuuaggaaguagaagcagaagcucuaaguaggucagccuggucuauguaguguuuuaggccaaccaggguugcauaguggugaaauaaauaugugguagaagguguuguaaauauugauuuaaaaagaagcuuaauauuucugcaacaucauuuaauauguauuaaccuuauuuuuucugauauagaaaaaugcaguuacaguuuuaaaggaauuaucagcgauaaagucucgcuaucaagcuuuaugugcacgcuuuaaggcaguuucuguugagcaaaaggagaccaagagcugcauuugugcuacuuugaacaagacaaugaccaugauacaagaacuacaaaagcaaacaaaccuggagguaauguuuccaguuuauagguuggaauugugaaguuauuccccacccccacugccacccccaguacagguuucucuguguagcccuggcuguccuggaacuuacucuguagaccaggcuggccucgaacgcauaaauccacuugccucugccuccugaguuugugcugcuacugcuuguuggauuugugaaguuuaaguugugaauauuguuuaaaaaaaauaaaaccccaauauguugugccacauccgugcacugcucccaggcucuuggaccugacugggguggugaaggaaugaagaaaagacagacagacagacagacuugggauucuuugcauacuaggcaaauauucuauccucaguuccuugugauaacgucuaaaucaucuaaacuauaaaaucagccacaaguagaaaugucugaagggagaaauaauuaggccagauguaaaaaaagcuaugggaacguucauuuuuggaagagauuaugucaaguaagagaaaugauuggaaggcagguuaugagccuuaaaaaaggaaacuauauuaguuuaaaaucuaugacacucauauuggaauagugugcacuuguacucaucacuuuaaaaaugggacaaggcagccgggcaugguggugcgcgucuuuaaucccagcacuugggaggcagaggcaggcgaauuucugaguucgaggucagccuggucuacagaaugaguucuaggauagccagggcuacacagagaaacccugucucggaaaaaaaaaaaaaaagaaaagggacaagucgaugggucuggauagguaucugagcaguuagaagcaauaagaacacauacugcucucccagaggacccacgguuggcaguucacuaacaaccugcacuaacuccaguugcaaggguucuguguccuuuguccucgggcaugacacucacauguauacacccacacacugacauacacauaauuagcauguacauguuacauguacaugaacacacccacacagugacauauacauaauuaacaacuuuauguuuuucuguuuauuugagacagggucucucuauguagcucuggcugcccugagacuugcuuauaaaaccagaaugaccccuaacucauacagaucagccagccugugccucuuaaaugcuaguauuaaaaacauguaugggugccagccacacgccauauacauaauuaaaaauaacaaaaauuaauguuuuuuuaaaaaugagauuuuaaaguuuagauaaauuacagauguggcauucacacuuagagauguucaaguuuaaggggggcaaaucaaugaaacuuauagugucaugauugccauacccaguugucgugguacaaaucucucucucuaguaauaacuuuuauaaauaggcauauuuaagccugucuguugucugaauaugaaagaaauggaaauggcaccuauuagaggguuguauggccacgaguagcuuugagccuagaacccagaggccaugcagcugagcugucuguagagcucagugguagguuacugacuuggcuauggcccuggguuugacccucgggaucaccagaaagagauuuccugcucagggaagagggggcaagaagggugcauguuggauggaauuuauaaaggcuuuuuaaauuuuaaaagcuuuuuuucaguagcagggacaaauguuugagaauaaagucaaaggcuaccuuuaaccaaagauuuacugaaaugcucucaaauaaccuaaaaggcuuuaccauaauuuugugagcaucucuauguaauugaggaaaacggugcuuuaugugcaacagaaaguaaaacugcucuaaucuuuaccagugaccgugacuuuucauucggaaaaguaacgcagugucuuugaauuaacuauauucaaaaggacauuuaaauugguauucuuaauaaauagggagccaagaacagaagaggaaguugggggugguggugagugaguaaauagaaauaucuaagauguggaggcuuaaguaugcucaguuauaaaggguuacuaacuagagagagagauuuguaccagaacccuggguauggcaauccugauuguaaaugcaguacuuggaaggauaaggcagaauugauguagauuccaggacaauaugggcuacagaguaagauucugucucaaaacagacaaaaaaaaaaaaaacaaaacaaaaaaaaaacaaaaaaacaaaaaaacaaaaaaaaaccccaacaacaaacagaaacaaaacaaaacuuuagaacaagaaauaauaauagucaauaaaaaaggcucuaaaagaauguauuguguuuuauugaaagaugcuuccaaaaaccggaguuaagaaaaauuacugcagggguuggagagauggcucggcaguuaagaacacuugcuguucuucuagcggucccaagauugauugccagcacccacagagcagcuuagaguuguucauagcucuaguuucagggcuuugucucucucuuggcuucuuaggcacuugauaacauaguggucugcggacuuauaguggucugagaaguuuugccuagcaaucuuaggaauaauaucuuagggauuuauugagaacauguuuauauuccucccuaacaucacucccuuccuuugaagcagaaaaguucuguaacuguuugggucggacagugugagcauaaacuuuuacacauaagaauauguugggccaguguuaauccaucaaaccagcugccuggaagaaucauggaguuuugagguuuuggacaacugggcuauucaauaaccacacaugguuguauaaauuuaaauguaacucuauaaccuaagaacucaguucuucaucuuguggucagacagugcagauagagauugcuuccagcuucacgggaaguuggccugagcuaccuuagagaugcugacucugguucuggcauguuccagaucuggucgucuuucuagagaugaccuauauaauuaggcugguuuguaacugcuucagaaguuggagcuguagcuugugcuauuugcccgucuaacccuucucagcuaccuuuuugguguucuguaaacaucuuucagcauucauuuuauucccuucugucucuugcucuugcuccgaccugcuuugugcggauaguuauuucuggcuguuuccuaaucauccaguauuuauuuuuuaaaaagauuuauuuagcgcccggcgugguggcgcgcgccuuuauuuaaucccagcacuuggaaggcagaggcaggaggauuucugaguucaaggccagccuguucuacaaagugaauuccaggauagccagggcuacacagagaaacccugucucaaaaaacaaacaaacaaaauguauaugaguacaccauugcuuucuucagacacacuagaagagggcaucagaugguugugagccaccaugugguugcugguaguugcuggaauuugaacucaggaccucuggaagagcaacugaugcuuuuaacugcugagccaucucuccagcuucuaaucauccauuauuacuuaucaguacuuccucccacccccuuccccuuccagagacaggguuucucuguguagcccuggcuguucuagaacucuguagaucaggcuggccuccagagaacagccugucuuugccucccaaaugcugggauuaaaggaguguacaccauugccuggcuuuuuuuuuuuuuuuuuaauuuuuuuuuuuuuugagauggggucuucaaaauucagcacacaguuauuucucuggguaaaauuccuacuguuuuggucuaaaucucuuuuccaaauaugguauucaaacauacauuuaguucuguuaaaugauaguccuuuguuugauuucuugaucuuguuuguacagccuaauugcaaguucuuugaaagcccaacuacaguauauaaauagccagauggcuauuguuuucccuugccuuucaaauuucaagacuaaauauguaguauaagauuaugaaaacguuugugcaaugaagcaaaauuuaacucguuuaacaaccuuugaagguuuugaaauaaacauuuuguuauuuguuuuucuagcuaacucuacugacugaagaagagaaagcugcaacagagccauuaaaaucucauaugccggacugauaaaaaauguuaaagaggaaggcugguggaaagaagaccaacugcagagauugggcgagacgucuagaggcggggcugaugaggaagccugacauuucccuugaccgagaggaucgugaugcauuucagaugaggaaauuguaagaagcguagauguccugugacugaaaaccaaaaggaugggauggaaauaaagcaauguaaauacugauacccagcauucauuuuaggcaaugaaaucccuuaguacuacuuuuuuuuuuauuuucuguuuucuuuuuguauaguguuggcauaauuuuagauguuuugggauuuuguaaaauaauauuuauguacauuuuguucaguauguaaaugggcaaaauacuuguauaaaaauucagguguuguuugcucuuuugagacaagguuucacuauguagcucuggcuggcccuggagcucacuauguagaccagaccagcucugaauccuaaagaugccugccuuugcuaucacgcugggcauugucugucugucugucugugacaaggucuuccauaucccaggcuggccucagauuuggugucaauagggauaauauuugacauugguacuuccugagugcugggauacccagugugcagaagcacgucugguuuguguaguaccagcuagcacggcucagcugagccacaucccaacccuguauuuuuuuuucuuuaauguacauuacaguuaauaacacacuuacuuguauguauauacuguccaguuuucccaaaaucuaacaaauuaauaggauguuuugugagaacuuuuauuuuuuuuuuccuuuuucccauugcuugcuaguaauaaaacaucauuaguuuguuuucaaaugcuguuuuagacuuucuauugguguuacaauaauauguuaucuuucaguguaguuuuguauuuguuuauucuauaugaaugacagacuaaaaucacugacacaucugcuauuauccaguguguguguguguguguaaaucaguuucacuauuuuuuuaugguucugggcuugaaucuagggugacacaugcaugcuuaugauauaaucuaccacugaguuaugucccuacaauuuucuuauuuauuuauuuaucuaucuauugaccuaucuguuuauuuauuuauugaaacagaguccuucuaugguccauguuugucuagguaccuuggugaccugccugcuucagcccuuuaguguugugauuacagggaggagaaacuguguccaucuguuuguuuuuguuuugagacaggacuuuacuaugaaccccaggcuggucuggaccgauauagaucaggcuggccuagaauucagagaucacuugcuucugcucugggugcuagaaacaaagcugguccuguuuucucuuuaaagauuuauuuuaaccagguauugguggcgcaugccuuuaaucccagcacuugggaggcagaggcagucgaauuucugacuuugaggccagccuggucuacagagugaguuccaggacagccagggcuacacagagaaacccugucuggaaaaacaaaacaaaacaaacaaaaacauuuuauuuuuauuuuaaguacaugaguauuuugccugcauaucugucugugccugauguucaugccuggugcccagggaggccagaaauggguguuagauccccuggaaauggagcuaaagacaguugugagcugcuaucuuggugcugugaauuguaccugggucuucuggaagagcagcaggugcugagccauuuuuucagccuucucuuguuuuuuaagacaggaucucacucuguaggccauguugggcuggaacuagagauaaucucacuucagugcugggauuacagacauaaauuuucauaccuucuuuuaaaauuuguuauaagcacagaacucugucugccucucccuccugaguucugggauugcaugcugugcaaccaggcugagccugauagauuacuguucugagagcaggucccaguauaugguucaugauggccuggaauucaacuugccuuacguaccugugugugagguuacaaucaccuccaaacccagcuuaagguauauacugagaggugcacagaaaaccaguuuaguaggcugagaggagucaagaagguacuauacucaaaccggccauggaguuccaggugagucgggccacacagcaagacuugcuuucaaacaaaauccacacgugugaauguuuuccccuuccauuuguuuuccaggacuugagacucugugacccucccggccuggagauggcucagaguuuaagagcacucacuguuuuuucagagguccugaguucaauucccagcaaccacauggcugcucacagccaucuguaaugggaucuugugccuucuuguuggcgugucuggagacagcuacaguguacucauaaauaaaaauuaauuaaaauagacucugugauccucaaauauugccaguaaaauucucuaccucaacauuuaaauugaacauauucggauuacuuguucauuuuguaguuuuggcaguggcuuuuguuagcuggaaugguuaccuuuuuaauguauuugcauccacuuaccuauaaaauaaaaccuaaaauuggucauaguau

SEQ ID NO: 6269 - RNA, 5394 nt, Mus musculus
auuuuuuuuuuuuuugagauggggucuucaaaauucagcacacaguuauuucucuggguaaaauuccuacuguuuuggucuaaaucucuuuuccaaauaugguauucaaacauacauuuaguucuguuaaaugauaguccuuuguuugauuucuugaucuuguuuguacagccuaauugcaaguucuuugaaagcccaacuacaguauauaaauagccagauggcuauuguuuucccuugccuuucaaauuucaagacuaaauauguaguauaagauuaugaaaacguuugugcaaugaagcaaaauuuaacucguuuaacaaccuuugaagguuuugaaauaaacauuuuguuauuuguuuuucuagcuaacucuacugacugaagaagagaaagcugcaacagagccauuaaaaucucauaugccggacugauaaaaaauguuaaagaggaaggcugguggaaagaagaccaacugcagagauugggcgagacgucuagaggcggggcugaugaggaagccugacauuucccuugaccgagaggaucgugaugcauuucagaugaggaaauuguaagaagcguagauguccugugacugaaaaccaaaaggaugggauggaaauaaagcaauguaaauacugauacccagcauucauuuuaggcaaugaaaucccuuaguacuacuuuuuuuuuuauuuucuguuuucuuuuuguauaguguuggcauaauuuuagauguuuugggauuuuguaaaauaauauuuauguacauuuuguucaguauguaaaugggcaaaauacuuguauaaaaauucagguguuguuugcucuuuugagacaagguuucacuauguagcucuggcuggcccuggagcucacuauguagaccagaccagcucugaauccuaaagaugccugccuuugcuaucacgcugggcauugucugucugucugucugugacaaggucuuccauaucccaggcuggccucagauuuggugucaauagggauaauauuugacauugguacuuccugagugcugggauacccagugugcagaagcacgucugguuuguguaguaccagcuagcacggcucagcugagccacaucccaacccuguauuuuuuuuucuuuaauguacauuacaguuaauaacacacuuacuuguauguauauacuguccaguuuucccaaaaucuaacaaauuaauaggauguuuugugagaacuuuuauuuuuuuuuuccuuuuucccauugcuugcuaguaauaaaacaucauuaguuuguuuucaaaugcuguuuuagacuuucuauugguguuacaauaauauguuaucuuucaguguaguuuuguauuuguuuauucuauaugaaugacagacuaaaaucacugacacaucugcuauuauccaguguguguguguguguguaaaucaguuucacuauuuuuuuaugguucugggcuugaaucuagggugacacaugcaugcuuaugauauaaucuaccacugaguuaugucccuacaauuuucuuauuuauuuauuuaucuaucuauugaccuaucuguuuauuuauuuauugaaacagaguccuucuaugguccauguuugucuagguaccuuggugaccugccugcuucagcccuuuaguguugugauuacagggaggagaaacuguguccaucuguuuguuuuuguuuugagacaggacuuuacuaugaaccccaggcuggucuggaccgauauagaucaggcuggccuagaauucagagaucacuugcuucugcucugggugcuagaaacaaagcugguccuguuuucucuuuaaagauuuauuuuaaccagguauugguggcgcaugccuuuaaucccagcacuugggaggcagaggcagucgaauuucugacuuugaggccagccuggucuacagagugaguuccaggacagccagggcuacacagagaaacccugucuggaaaaacaaaacaaaacaaacaaaaacauuuuauuuuuauuuuaaguacaugaguauuuugccugcauaucugucugugccugauguucaugccuggugcccagggaggccagaaauggguguuagauccccuggaaauggagcuaaagacaguugugagcugcuaucuuggugcugugaauuguaccugggucuucuggaagagcagcaggugcugagccauuuuuucagccuucucuuguuuuuuaagacaggaucucacucuguaggccauguugggcuggaacuagagauaaucucacuucagugcugggauuacagacauaaauuuucauaccuucuuuuaaaauuuguuauaagcacagaacucugucugccucucccuccugaguucugggauugcaugcugugcaaccaggcugagccugauagauuacuguucugagagcaggucccaguauaugguucaugauggccuggaauucaacuugccuuacguaccugugugugagguuacaaucaccuccaaacccagcuuaagguauauacugagaggugcacagaaaaccaguuuaguaggcugagaggagucaagaagguacuauacucaaaccggccauggaguuccaggugagucgggccacacagcaagacuugcuuucaaacaaaauccacacgugugaauguuuuccccuuccauuuguuuuccaggacuugagacucugugacccucccggccuggagauggcucagaguuuaagagcacucacuguuuuuucagagguccugaguucaauucccagcaaccacauggcugcucacagccaucuguaaugggaucuugugccuucuuguuggcgugucuggagacagcuacaguguacucauaaauaaaaauuaauuaaaauagacucugugauccucaaauauugccaguaaaauucucuaccucaacauuuaaauugaacauauucggauuacuuguucauuuuguaguuuuggcaguggcuuuuguuagcuggaaugguuaccuuuuuaauguauuugcauccacuuaccuauaaaauaaaaccuaaaauuggucauaguaucuagccuccauguuauauuaucuucauucuuauuacuuuuauuuaggauuauuucucaucuagauacuauuuucuguuacuauaguguuucuauauaauacuauuuaagauauuuaaaaacaagcauaaugcauauuauuuagaaguagucagccuucaguuucuuuauucauuucuauacauauucacauagaauuuuucuuuagaaaaaaacaaaacagguaagcauacauuauacuguagcauuuaaaauuuucauuuuauaugauuucaugacauacauuauacauuuaacauccuuuuuaacacuuguaacuacuguauggcuauaucaugauuuuguuuaguuucuuauugauaaucugagucauuauaaaaguaauagcauuuugggggaugugucuuguggcaaagggcagagcaaagucagccccuaagugcuguuuuugugagacauggucuugggcuagggcucugguuggcuuucuucaaguucucaaucuucuguuucaagcucuccagugcuagcagacucccucacccacgagcugacaaaggaccuuuaacccuuacuuagccaacuaccaauuuaagcacuguaugccuauuuuuuaacaaagaccucuaacuaauuacagauuucuuuuauuuucuacuauuaugaacuagccugauaacuaguuccuuaaacauuuuggguauauauggcaaauauaccauaaucuauaggcuacuguuaucaucuguuauacuacagggcaaagguuucuccauauuguugagaauuccaaaugccauaauauuucccacaaacuuuugauuguuuuuuuagucuggcgacuuagcccaggcuggcuuugaacucacuaaguagaccaggcuauucuggagaugguuucugccuggucaugaaaggcuaugauuaaaagcuaaagacauguaccaccacacccggccuccacaaauuuuuagguauagauuaaauuuuaaaguguaaauagaaugugguggcauaccuauguauauccuagcacugaagaggcuaaggagggaguugaaggcuggcauaugcuuuauagcaaguucuaggucagugcaggugacaugggaacaucagcaaaaagguacaauucaggacacguuaguaaaauuauucugcaacuaucagccugcaucuaguucaaagaccauaagugguuugaaaugaaagccuuuuuugcuuuugguuuuucaauacacggugucauuguguaucccugauuguccuggaacuccaccugccucugucccccaaaugcugggacuaaacgagugcuccaccaugcccagcuugugaaagcauauucuaucucuacuuaauuaaauuauguguguguagauuauuuuggguuauauuaauauaugugcaugugaguguggguguuuuaggugggcagaauggaguuggaguauaggcuggagaccaaaggcaggguuagagagugguccucccccggaguagcaaguauucuuaaccucugggccauccguccuaccuccauaaaucuuguuuauaguucauauaauuuuuaaaaaauguugcuaguaacgaaaagauucuuucuagauuaucaauucucuggauuggguucauaaauaacuuuguaauaagcuuaagagaagaauuaagauuuaaguauuugaccaacgccuuuugucucacauacccucaauuucugcacccuaacuggucucuucuggaaggaauuuagaagcgauucccuagacucuuuguuaguccccauagcaaaaacaacucaagcugcaagaaagccuuagucggugggauguggauccaauugucucaccaaaaugagaagacgugguaccucuccccugcaauccuuacuuccaggaagcuuggagacuucacuauacguccagucuaucaugaacuaaagaaaccuugucucaaaauaacaggucaagagaaaucgccgguccauuacaauuggagcuuucaaaugcauuuacuauggagggggacuaaguuuuuuuuuuuuuuuuuuuuuuuuuaaagcuuaaagucugcguuuccucccagaggcggaaagcaaacacuaaccaagcaagaguucccggcuccagggucuccuuaggugacccacaaacaaugggaacgcaaauaagacucuccgucccuuccuaauacucgggagcguggcuucuuccaauuaggacgcaccaaggagccuacaucacuggcgguaaaaucugcgaggcgaagggcaccgcgccgacgcccgacacgccuccccgcggcaccgccucuccaagucucgug

SEQ ID NO: 6270 - RNA, 6283 nt, Mus musculus
accuugaugcugauuuacgguuggacuugggguguguguggccuuuauuguuuacucuuuaugaguuuguucuuuuguuugauuuuugacuuuuaagaacagauuuacuuugauuuuuuuuuuaucauauauuugucuguaugugagaagguuuuacucuugauccuccugucuuagccucccgaguucugggguggcugacaugcaccucgggcucuaguaucugaucucaaaucagagcaguauuuucaacuauguauucuggacuuguuaauuuuuaaguagcuagucaaaaagguugggguauauuuuuaauuuuguuuggagauuuuacuuaguucaaaauguucauauaguaggcuggagagguagcuccuggcuuagagcauuguuucagucaugcagaggaccuggguuugauugccaacuccccauggugacucacaagcauccguaacuccacuuuuaggggaucugaugccuucuccuggccucuauugacaccugacacacauggugcaucuucauacaugcagacaaaacuacucauuuacauuuuuuuaaaaaauagauacauuaagaaaauuucuaaacuaagagaauguucauauuuacugucuucuuucuucuuuccugaaggcuccucgggaagcucucagucugggagcagacacagcuccccccgggcucugacacacggcaucauuggggaucuucugcccaaaagugaagaccgacagugcaaagccuuggauucugacgcugugguuguugcaguuuucaaugguuuaccuacuguugagaagagaaggaaaauggucaccuugggguaaauaauacucuuuuuauuguuuggaauuucaagucuaaaucauaaugaacgauuucuauagugugcuguaaguuuauuuuuaaaaaauuauggcauuguuuccuauucucucuccucucucuaacauccccugacccagcaugacaacaguccuccugccuuagcuuccugagugcuguauuacagaagugagcauccccagcuagcuuagagcugacagcuuucacugacaccaaggaugccugagcauacuuuguuugugagaugugugcacuucagcuuugcucuuguccaugguuuaaucugcuugcaucuuuccuaaccaucugugcugugucaugugcugugggucacauacuuguguggaauaaagcacuuucauuaaucuuauuuauuauugcuauuuuguuugcuuguuuguuuguuuguuuguuuguuuguuuguuuuuuaaauacugcuuuuaucucacuccuuuucugucuuuugaaaucauccucuaaaaugcaacuuggaauuuccagaaaggauaaugaugauuggcaccuuuaucuuuauucaaagcccagccacgugaauuaaauuacagccaauccaagaaaguaguucaagaauguauugucuaugguguguuagcuaggccaucaguauucaucuauugaucugucacauaaacauuaaauauguuucuaauuuaaauaauggaauuguucuccauggagacuuugaaaagaucuuuauagaaagaccaacauccuuaaaucuaucucauuaccaaauccaaaaggauagauggggguuuuauuuuauuuuuacucaaugguucaacaguggaagagaaaaucaugagaguuuggcauaguggugagcucuugcaucacagcuacagaggagauuaaaggccaggugguugaaaguuggggccugcgugggcaacccaagcaagauccuggcuuaaaaugaaauuuugaaaauugccugaagguauagcucagugguagaacauaucuuaacauagucauugccaugguucaauccccagaccugggguagaggagaggaagucaggaaauggaucaucccuaucgccucgccugauacauacauuucuuucaaguuaaagcuacaacuagcuuccuuccuuccuuccuuccuuccuuccuuccuucuuuccuaccuuccuuccuuccuuccuaccuuccuaccuuccuaccuuuuuucuuauaaaauuuuuuaauauauggucauuuugucuguauguauaucuggugcccaaguauuagauucucaggacuagaguuacagacacuaggaaucaaaucuggguuuuuuggacgauagcuaaugcucuuaaacccagcauuuuucuugcccuuagcuuccuuucuuucuuuuuuaaguuuauuauagagguauuuauaucauuuagucauaaagauuuuacguauacuuugggugggggagguauaaaauauuauauagaagucuaaaguucuuucauaccacccagaugaucuuguucuuaaaacaaucccucacccaugcuccuguaaaucacuucaugaaauucauugcuuucccaaaaagaaaaaaaaagggcauuaaaguaaaaggugagugucuuaauuacuauucuauugcugucaagagacaccaugaccaaggcaagucuuaucaaagaagggauugaauuggaggcuuccuuacaauucuagagaguuaguccaugaggaccaugucaggaaacagacaggccuggugcuggaguaguagcugagagaucacagcuguccucaaacagcaggugaaagagacagacagacaaagaacccagcuggguuuggagugagcuuuuugaaccuccaguaagaccacaauuccuucuaauuuuccccaaacaguucuacuaacuggggaccaagcauucaaacauaggcuccuaugagggaccauccucauucaaaccaccauggugagugaguuaggaagaugucagccugguucaucuggaugcucucuagcugugucuuuucuuucucccugcugcuuuggagcagugaggcaaaaaacaauuaaauagcaaauuaaauaaaauaguucccagugaaaaugggaaacacagcaagggaaaguguccuccuccuuauuugcauucccugcccuuaggauccuccugugugcugugucuuccaugacgguaugcauauuaaauaagcaaccgugacugucuuuaccugcugugucccuugauuucuaauguuucucuuagucuuucaguaguagugugaauuuguguuuauauuuauuuuaauugauaauuacugauuaacaaaccauuuuaagaaauagcagagggacuggagagauggcucagcgguuaagagcacuggcugcucuuccagagguccugaguucaguucccagcaaccacauggugucucauagccaucuguaaugggaucagauggccucuucugguguauuggaagagaguggcaguguaaucacauacauaaaauaaaugggaaaaaaaaaacauguuaaaaaaauagcaaagagauccuacacaccuucucuuugucgucuacuguuaacauuguguaaaacuauuacaaauugucauaaacaggguuugguaauuuacaucaaaaucuuuuauucugaaucuucaguaaaauuuuuaaaaaugcaaauuuagaauuaaacacaaguaaaucuuccaugcuugauucaaggcucagcuuuaggaaaaaaagaaaauuauuaugucacuauuaacauuugaaaauagcuuguuguuuuuccuucuuugaggacuaaugcaaaaggaggucgucuggaaggaaugcagauggcagauuuggaaagucauucugaagcuggggagguacagcccacacuaccugaaggagccucagccgccccugaggaaggugagcauugaacaaggacggucaggacuagcgagcaggagacacugcguucucaguggcuauagcaguaggugggaauucauauagacacauauguguaaagcaaaaccuuaaucuuccaaacaaaaacccagcuaauuagaauauuguuaacccuuuguuugaggucagguuuuuguuugguugguuuuuguuuugauuuuagagacaggguuucucuguguagcuguggcugucccagagaucucugccucugccuccugaguacuaggauuaaaguuguacacuaccuacugccuuugagguccauuuugauuaaugucuauaaauugcuuuuuuuuuuuuaaauuuauuauauguaaguacacuguagcugucuucagacacuccagaagagggagucagaucuuguuauggaugguugugagccaccauaugguugcugggauuugaacuccggaccuuaggaagagcagucaggugcucuuacuugcugagccaucucaccagcccuugcuuuuuuuucauauguauguauaugugugugcuaguaaguucccaaggaggccaacagcauuagcucucacuagggcuggaguuaccuguaggcugaugugccugcuguaggugcugggaacugaauuuaguucucuaguuguaguacucacucuuaacuggagucauuucgucagcauuccuuugcucugauggaagaauuccuuggcuuaacuguuuagcauccccuaaaacaaccugcuucaucucugcagaugagccucaguuauaauuuuuaacauuucuucuaagauaucaaauaaaauaucugguuauuuuagcaauacaaguuauuuaaaacaaucuuaagucauuguucuuccucuaucuuuuauagguuagcaaaaaagaacaacuuucaaaaauauuuugauuucccccaguauuacuuuccacuucauuugaauuucagucauugaugaauuauuguuuauaacacacagagagaugcuagcauauacuucuggcuguccuggucaguguaauagucugaccaggguaauaguccuugagacacacuugcauagugggcuacagguacuaacuaauaaaacaaacuguagauuuuuuuuuuuuuuuuuuuuggagauaggguuucucuguauaguacuggcuguccuggaacucacucuguaguccaggcuagccucgaacucagaaauccaccugccucugccucccaagugcaugcgccaccaccgccaggcaaacuguagcuuuuuuaagguaugcuguguaugugugguaggaggggagaggugggaagaaccacuuaagaaguagagauuagauauugaagacacugguaaauagccuuugauaauauugugugauaaguguucugauagaggaacuaaaaguauaucaucaaaaaaguugauauuuaguaaguucuugcuauguuauucucaaaauuauucuuuauagucauuaacuucuuuuauuucugauuuuacaaacaagugauuuaagacuuagaaauagaacacacaugauaugcacucacugauaaguggauaguccagaagcucagaauacccaagauacaauuugcaaaacacaugaaacucaagaagaagggggaacaauacccaauggaaggaguuaaagagacaaagugugaagcagagacugaaggaaugaccauccagagacugccccaccuggggauccaucccauaaacaaccaccaaacccagacacuauugcggaugccaagaagagcuugcugacaggagccugauaaagcugucuucugagaagcucugacaguaccugacaaauagagaaguggaggcucacagccaucuauuggacagagcacaggguccccagugaaggagcuagagaaaggacccaaggaacugaaggggcuugcagccccauaggaacaacaauaugaacuaaccaguacccccagagcucccugggacuaaaccaucucucaaagaaaacacauggugggagucauggcucuaguugcauauguagcagaggauggccuagucaguuaucagugggaggagaggcccuugguccugugaagguucuaugccccaguauaggggaaugccaggaccaggaagugggaguggguggguuggugagcagggggagggggcagaggggagucggauaggggauuuuuggaggggaaacuaggaaagaggauaacaauugaaauguaaauaaagaaaauaauuuaaaaaaacaaaaaaauuuuuaaaaagacuuagaaauauaacuuaccucacugaaagucacagaaaugguccuuguaaggguuagaauuugaaccuagagucagugcuuagaauuuccaucucuguaugcuugaguuguaauguacccuuggaaguuucacuugaaggcaugaguagacagucaggugaugagccaguacgucugaggccagaguagaaguagcagucagauugugaggagugggcuuaucuuaaauccaug

SEQ ID NO: 6271 - RNA, 6283 nt, Mus musculus
cauggauuuaagauaagcccacuccucacaaucugacugcuacuucuacucuggccucagacguacuggcucaucaccugacugucuacucaugccuucaagugaaacuuccaaggguacauuacaacucaagcauacagagauggaaauucuaagcacugacucuagguucaaauucuaacccuuacaaggaccauuucugugacuuucagugagguaaguuauauuucuaagucuuuuuaaaaauuuuuuuguuuuuuuaaauuauuuucuuuauuuacauuucaauuguuauccucuuuccuaguuuccccuccaaaaauccccuauccgacuccccucugcccccucccccugcucaccaacccacccacucccacuuccugguccuggcauuccccuauacuggggcauagaaccuucacaggaccaagggccucuccucccacugauaacugacuaggccauccucugcuacauaugcaacuagagccaugacucccaccauguguuuucuuugagagaugguuuagucccagggagcucuggggguacugguuaguucauauuguuguuccuauggggcugcaagccccuucaguuccuuggguccuuucucuagcuccuucacuggggacccugugcucuguccaauagauggcugugagccuccacuucucuauuugucagguacugucagagcuucucagaagacagcuuuaucaggcuccugucagcaagcucuucuuggcauccgcaauagugucuggguuuggugguuguuuaugggauggauccccagguggggcagucucuggauggucauuccuucagucucugcuucacacuuugucucuuuaacuccuuccauuggguauuguucccccuucuucuugaguuucauguguuuugcaaauuguaucuuggguauucugagcuucuggacuauccacuuaucagugagugcauaucauguguguucuauuucuaagucuuaaaucacuuguuuguaaaaucagaaauaaaagaaguuaaugacuauaaagaauaauuuugagaauaacauagcaagaacuuacuaaauaucaacuuuuuugaugauauacuuuuaguuccucuaucagaacacuuaucacacaauauuaucaaaggcuauuuaccagugucuucaauaucuaaucucuacuucuuaagugguucuucccaccucuccccuccuaccacacauacacagcauaccuuaaaaaagcuacaguuugccuggcggugguggcgcaugcacuugggaggcagaggcagguggauuucugaguucgaggcuagccuggacuacagagugaguuccaggacagccaguacuauacagagaaacccuaucuccaaaaaaaaaaaaaaaaaaaaucuacaguuuguuuuauuaguuaguaccuguagcccacuaugcaagugugucucaaggacuauuacccuggucagacuauuacacugaccaggacagccagaaguauaugcuagcaucucucuguguguuauaaacaauaauucaucaaugacugaaauucaaaugaaguggaaaguaauacugggggaaaucaaaauauuuuugaaaguuguucuuuuuugcuaaccuauaaaagauagaggaagaacaaugacuuaagauuguuuuaaauaacuuguauugcuaaaauaaccagauauuuuauuugauaucuuagaagaaauguuaaaaauuauaacugaggcucaucugcagagaugaagcagguuguuuuaggggaugcuaaacaguuaagccaaggaauucuuccaucagagcaaaggaaugcugacgaaaugacuccaguuaagagugaguacuacaacuagagaacuaaauucaguucccagcaccuacagcaggcacaucagccuacagguaacuccagcccuagugagagcuaaugcuguuggccuccuugggaacuuacuagcacacacauauacauacauaugaaaaaaaagcaagggcuggugagauggcucagcaaguaagagcaccugacugcucuuccuaagguccggaguucaaaucccagcaaccauaugguggcucacaaccauccauaacaagaucugacucccucuucuggagugucugaagacagcuacaguguacuuacauauaauaaauuuaaaaaaaaaaaagcaauuuauagacauuaaucaaaauggaccucaaaggcaguagguaguguacaacuuuaauccuaguacucaggaggcagaggcagagaucucugggacagccacagcuacacagagaaacccugucucuaaaaucaaaacaaaaaccaaccaaacaaaaaccugaccucaaacaaaggguuaacaauauucuaauuagcuggguuuuuguuuggaagauuaagguuuugcuuuacacauaugugucuauaugaauucccaccuacugcuauagccacugagaacgcagugucuccugcucgcuaguccugaccguccuuguucaaugcucaccuuccucaggggcggcugaggcuccuucagguagugugggcuguaccuccccagcuucagaaugacuuuccaaaucugccaucugcauuccuuccagacgaccuccuuuugcauuaguccucaaagaaggaaaaacaacaagcuauuuucaaauguuaauagugacauaauaauuuucuuuuuuuccuaaagcugagccuugaaucaagcauggaagauuuacuuguguuuaauucuaaauuugcauuuuuaaaaauuuuacugaagauucagaauaaaagauuuugauguaaauuaccaaacccuguuuaugacaauuuguaauaguuuuacacaauguuaacaguagacgacaaagagaagguguguaggaucucuuugcuauuuuuuuaacauguuuuuuuuuucccauuuauuuuauguaugugauuacacugccacucucuuccaauacaccagaagaggccaucugaucccauuacagauggcuaugagacaccaugugguugcugggaacugaacucaggaccucuggaagagcagccagugcucuuaaccgcugagccaucucuccagucccucugcuauuucuuaaaaugguuuguuaaucaguaauuaucaauuaaaauaaauauaaacacaaauucacacuacuacugaaagacuaagagaaacauuagaaaucaagggacacagcagguaaagacagucacgguugcuuauuuaauaugcauaccgucauggaagacacagcacacaggaggauccuaagggcagggaaugcaaauaaggaggaggacacuuucccuugcuguguuucccauuuucacugggaacuauuuuauuuaauuugcuauuuaauuguuuuuugccucacugcuccaaagcagcagggagaaagaaaagacacagcuagagagcauccagaugaaccaggcugacaucuuccuaacucacucaccauggugguuugaaugaggauggucccucauaggagccuauguuugaaugcuugguccccaguuaguagaacuguuuggggaaaauuagaaggaauuguggucuuacuggagguucaaaaagcucacuccaaacccagcuggguucuuugucugucugucucuuucaccugcuguuugaggacagcugugaucucucagcuacuacuccagcaccaggccugucuguuuccugacaugguccucauggacuaacucucuagaauuguaaggaagccuccaauucaaucccuucuuugauaagacuugccuuggucauggugucucuugacagcaauagaauaguaauuaagacacucaccuuuuacuuuaaugcccuuuuuuuuucuuuuugggaaagcaaugaauuucaugaagugauuuacaggagcaugggugagggauuguuuuaagaacaagaucaucugggugguaugaaagaacuuuagacuucuauauaauauuuuauaccucccccacccaaaguauacguaaaaucuuuaugacuaaaugauauaaauaccucuauaauaaacuuaaaaaagaaagaaaggaagcuaagggcaagaaaaaugcuggguuuaagagcauuagcuaucguccaaaaaacccagauuugauuccuagugucuguaacucuaguccugagaaucuaauacuugggcaccagauauacauacagacaaaaugaccauauauuaaaaaauuuuauaagaaaaaagguaggaagguaggaagguaggaaggaaggaaggaagguaggaaagaaggaaggaaggaaggaaggaaggaaggaaggaagcuaguuguagcuuuaacuugaaagaaauguauguaucaggcgaggcgauagggaugauccauuuccugacuuccucuccucuaccccaggucuggggauugaaccauggcaaugacuauguuaagauauguucuaccacugagcuauaccuucaggcaauuuucaaaauuucauuuuaagccaggaucuugcuuggguugcccacgcaggccccaacuuucaaccaccuggccuuuaaucuccucuguagcugugaugcaagagcucaccacuaugccaaacucucaugauuuucucuuccacuguugaaccauugaguaaaaauaaaauaaaacccccaucuauccuuuuggauuugguaaugagauagauuuaaggauguuggucuuucuauaaagaucuuuucaaagucuccauggagaacaauuccauuauuuaaauuagaaacauauuuaauguuuaugugacagaucaauagaugaauacugauggccuagcuaacacaccauagacaauacauucuugaacuacuuucuuggauuggcuguaauuuaauucacguggcugggcuuugaauaaagauaaaggugccaaucaucauuauccuuucuggaaauuccaaguugcauuuuagaggaugauuucaaaagacagaaaaggagugagauaaaagcaguauuuaaaaaacaaacaaacaaacaaacaaacaaacaaacaagcaaacaaaauagcaauaauaaauaagauuaaugaaagugcuuuauuccacacaaguaugugacccacagcacaugacacagcacagaugguuaggaaagaugcaagcagauuaaaccauggacaagagcaaagcugaagugcacacaucucacaaacaaaguaugcucaggcauccuuggugucagugaaagcugucagcucuaagcuagcuggggaugcucacuucuguaauacagcacucaggaagcuaaggcaggaggacuguugucaugcugggucaggggauguuagagagaggagagagaauaggaaacaaugccauaauuuuuuaaaaauaaacuuacagcacacuauagaaaucguucauuaugauuuagacuugaaauuccaaacaauaaaaagaguauuauuuaccccaaggugaccauuuuccuucucuucucaacaguagguaaaccauugaaaacugcaacaaccacagcgucagaauccaaggcuuugcacugucggucuucacuuuugggcagaagauccccaaugaugccgugugucagagcccggggggagcugugucugcucccagacugagagcuucccgaggagccuucaggaaagaagaaagaagacaguaaauaugaacauucucuuaguuuagaaauuuucuuaauguaucuauuuuuuaaaaaaauguaaaugaguaguuuugucugcauguaugaagaugcaccaugugugucaggugucaauagaggccaggagaaggcaucagauccccuaaaaguggaguuacggaugcuugugagucaccauggggaguuggcaaucaaacccagguccucugcaugacugaaacaaugcucuaagccaggagcuaccucuccagccuacuauaugaacauuuugaacuaaguaaaaucuccaaacaaaauuaaaaauauaccccaaccuuuuugacuagcuacuuaaaaauuaacaaguccagaauacauaguugaaaauacugcucugauuugagaucagauacuagagcccgaggugcaugucagccaccccagaacucgggaggcuaagacaggaggaucaagaguaaaaccuucucacauacagacaaauauaugauaaaaaaaaaaucaaaguaaaucuguucuuaaaagucaaaaaucaaacaaaagaacaaacucauaaagaguaaacaauaaaggccacacacaccccaaguccaaccguaaaucagcaucaaggu

SEQ ID NO: 6272 - RNA, 855 nt, Mus musculus
ugacuuuucugacuuacgaccucgucuuuucaccuaacggcuugcucgguaggguuuuacuuacccuuccuucccaauuccucccuaccgcucucaauuauaugcugucaaaugucugcaaaguaugauacuaggcucucacguaagaaagccaucuauagagccuuuucauuucaacagugagcgccugacggaaaaucuaggggucugggcuccucugggcaccgacgguauuagcuuuguugcgguuauguagaaaggcaccucuuacugccuguaaaggagucgcgcguccccaccgcccaacaaggaacgcagcccgggaaaggacagacagacgaaggugggaggaaaccccgggaagaaaggcgcagggaagaauggggagcccaagacgggagggaagaccuuggcaggaagguucuggaggaaggugugcgaaguggccgagaagcuggccgagagggccagcgaagaggggccgggggcaggcgggggggaccccgcccgggugccccgcggggacauggguagcggggacgggaacccaggccggcaccccggggauggcggcccacccgcggccgagccccgcuacuuaacuauuuguagagcugcugcaggcacagguccaggcucucgcccuccaccuccucucgggugaugcgcuccgacagcggccgugggagcgggggcagcgguggcagcuggggcugcggcgguggcggcacggccgagugccccggggcagccgcuuccuccucuuccuccuccucgcccuccgucgccgucuccuccuccaccgccucgucuucgggcucggggucuugguccugcucccccuccucggucgcc

SEQ ID NO: 6273 - RNA, 2590 nt, Mus musculus
ugagacagguucuuacuauauagcucugacugcucuggaacucacuauuuaaauguaauuugacaugugaaaggaaaacacagagcguuuuuccuaguauaaugauauccaaguucuauccacuuuucugcaagugucauaauuucauucuuuuaaaaauuguguguguguguguguguguguguguguguugugugugugugugugugagaguaaaugaguauguuuauacaugucacauaccacaguguucuugggaaagucagggaagaacuuggggguguuaguucucuccuucuacgcuguggguccuaaggacugaacucccuagucaggcuugaguggaagauguuucccugcugagccaucuuacugggccuuguuccuuuucacagaauguauacuuagcacuucuuuuguuugagacagggucugacacuguuuccuaggcuguauuugaacuugugccuguugugguaauuucuuaccccaauaaacccauaugaaaacacacacaacugaauuauuacaagugucuuaguuaggguuuuacugcugagaacagauaccaugaccaaggcaagucuuauaaaagacaacauuuaauuggggcuggcuuacagggucaguucaguaucaucaaagcaggaauauggaagccuccaggcaggcaugaugccggaggaacugagaguucuacaucuucaucugaaggcugagaguggaagacugacuuucaggcagcuagggugagggucuuaaaguccacacccacagugacacaccuacucuaacaaggccacaccuacuccaacagguacaugccuucuaauagugccacucccugggccaaccauauacaaaccauugcauaaguuauaugccuaguuugggcagaucuaucacuauacgugauauacuccuuguuaguggcagccucucuugagaaagcagaauuaacaucaaaauacaaacaguaccaggguaacccacaacauaugccaggccuccugccuuaaccucuggacuguugaggcuauaggcauguuccauaaugcugggcuucaugguuuuuuccugguuuaucuguugauggaacuguaggcugguuuugaggucuugcuuucaauuuuuaaaagauuuauuauuuauuaguuuuuguguguauguaugugugccaguguauguacaucaguguauguguauauguauaugugccaguguauguaccucagugugugcuugccaguguauauacaucauugugugugcgugcgugcgugcauccgccaguguauguacaucaugugcagucaggugucugaagaagucagaagagaaaguuacauagggguucugagaacuaaacucagguccucucuaagagcauuagugcucuuaacuccuaagcaaucuuuccacucccuugccuucaguuauuuugauauauacccagaaaugauauuucuagaucauaugguaaaucuauuuuuaauuuuuuuaaguaaucauugcacugauuuccauagcagcugcaccauucugugcucccaucuacacuacacaaggguuccacucucuccucgccuuugccacuuguuauuucuaauauuggccaggacuaggaagaggcgaguuuuacauccuugaacacaaccugaaggguuuuuuuuuuuuuuuuuuuuuaagauuuauuuauuuauuauauguaaguacacuguagcuguccucagacacuccagaagagggcgucagaucuuguuacagaugguuaugagccaccaugugguugcugggauuugaacucuggaccuucggaagagcagucgggugcucuuacccacugagccaucucaccagccccugaaggguuuuuuaaugauuuauuuuaugacaacacacacacacacacacacacacacacacacacacacguguucuacuugaguguauguuuguggaccauaugcaugcccaaggccugcagagugcagaaaaggauauugaaucuucuggagccacagucacagauggcugugaggugucaugugggcguugggaauugaacccagguccucuggaagagcugcaaaaguccuuaacugcugagcugucuauagugguuugaagaagaauggcuuccaggccaggcagugguggugcgccaggcagugguggugcacgccuuuaaucccagcacuugagaggcagaggcaggcggauuucugaguuugaggccagccuggucuacagagugaguuccaggacagccagggcuacacagagaaacccugucucggaaagccccucucccccccccccccaccaaaagaaaaagaagacuggcuucccuagccgcauaugugugaaugcuuggucaauagagagugcacuguuuuuaggagguguggccuuguuggagaaagugugucaauuggggugagcucugaggguucagaaacccaggacaggcucaguggucuuuguggauccagauguagaacucucagcuacucuucuccagcaccauauauaccugccugccaccaugccucccaccauaaugauaauggacugaaccuuugaaacu

SEQ ID NO: 6274 - RNA, 6901 nt, Mus musculus
aagcugcgugcccgacgcgucuggcauucuggguaauggucuguuuacuuccugcggcuggaggaaccuguguugucguaucggugaggauggcccuggagacgguaccaaaggaccugcggcaucugcgggcuuguuugcugugcucguuagucaagguguccguuggggccuugguuguaggagcgaucggggaggcgaaacgggagaaagagggugaaauggggccagacacaggaaaggaaggcucugagauucggggagugggaagcccgaaagccuaagggagccguuguuuccguccacggaacgcgagccggguggcugugccuacugggggcugcguugcaguucucggcauaacugagcacaaguuugucuccccgacagacguucggugaacuugcugugguggacuggaaagacacuaggagccagagcagccgagagaguagcaggagaggguaccugaccccaaagaggcuagaaaauauguaagcugaauuagggacgcgagcaaaaagguaugaggguggaguuuaggaacaguuuggagaggagaggguguuggguuguauagaaaacgaagagguuggcuuuguugaaauauuaaggcguuguucaugcucauacuugcuuuuuuuuuuucuuuccagacuauagaccaguucgaauaugaugggugugacaauugcgaugcauaccuacaaaugaagggcaacagagagaugguuuaugacugcaccagcucuucauuugauggguaagccccuuucacgcgccuuuguuuacuucugcacccagaaaguuaauaugggauagauuuuugaggucauaagacuagcuggucucagcaguucugagagcuagucuauguguccagcccaguagcuguaaacuuuuguaguguaagacccccuuucggggacccccgcucuagucucaggagugugagagcacccaaagaaacacgaggacccaucuugcuguaauuacaugaggacguuuaauuacggagcuccggaccgacauguaucccacacaggagauaacggaugccggccacgaggcucgaaagcuuggggguuuuaugggguaaggggcuuagggguguggaauugagcauagcgacacacuauuggcuuauucaaacauuaacagaaagauuacauguacgugcagggugucagaguucugugaguaguugacucaguucagauagcccuguuauguccucacauuccccuuuaucuuauggucaagauguucccaggaauguuuuaacuauggggcauacccagguuuguuuuucucuuuucucagccccaggcagccucuaggcucacaaacaaccagcaauuucugaguacuuuauaugacuuacaggucuugaaauuucaucuuucuuucaguagcuacugaguacuugacauguggcuaguucaaauucgaauaugcuuaagugucaaauacauaccagcaaacaaagauucagggugaggaaaaaggaugucaaaugaucugaauuuuuaaaagauuaguuaaauauugaaacaauguuuuaggguuauuugauuaaaauaaauauugaagcagggaaguggugucguacgccuuuaaucccagcacuugggaggcagagacagguggauuucaaaccaaaaaaaaaauuaaaaaauaaauauugaaguuauuuucaucuuuauuguuuuaaguaguggcuaagaggacuuuuuuuuuuuuuuuaccucgagacaggguuucucuguguagcccuggcuggccuggaacucacuuuguagaccaggcuggccucaaacuuagaaauccgccugccucugccucccaagugcugggauuaaaggugugcgccaccaccacccugcuuaagagaacuuuuuuaauguguguacuucuucuguaguccuauuuaacaaugcuucacaacucuugucugcuccauuaucgcugagacuauguuuauguuauguccuaaugccugacacgggauguacgagguguagaucuuuaauguuggagagguggaagugugauacagcaguagaacacgugacuaccacauacaaagaacacaugacuaccauguacaaaaagcccuggguuuaauuccuaaugcuccuccaaaaguguuggcuacaugaacgaucuguuuuggaaaugaagggguauaguuucaguagccuacucccucuuacaguaucuuagugaauauggugacuugcaccuauagucccaucaucugagagagagacaccagagaauuggaaauucagagggaaccucagauacauagugaguuugaggccagccugagcuaccugagacccugucugucucaaacaagaccagcuaagcuaucucagcaggguaaggcggcugauggcaggccugcuaacccugaccucaaucccuggaucccacaagguggcaggagagaacacacacacacacauacacgcacacgcacacacacacacgcacacacacacucacacgcccacucaccccaagagaguuaacuacaaaaaaugggagaagaguggucuggucuuugcucaagguagcagcauugcuaaguuucuucuggucagcaggccaguuaaagaccucauauaagcugggcuuacgccuaguguuuguucugugagagugggucugguguccuuuagaggagaauaaaauauugggcaaagagauguugauuuggcucccuuuggcuaguccauuguuaguauaugaguuuacccuuucacaaguauuugucaugaacuguugcuagucaauugcugucuuacaauguauuuaucaauacacuaguucguaaguacucgaaugcuaaauuauucacaaagaaaaugaacagaaaguaagcuaaaucuaagagagagagagagagagaugcugauuuggagccuuuagcuccugugugugcagaugcguauuucuguauuuccaucccuuuguuuccucaagccguucaaggcugacaaugaaugacgaagcugguuguguugaugcagccuucaguccuagcucucaagcugagcaggggacacaagugucggguagccuucugcugcaucaugagacgacgcccccaucuaaaaauuaaaauguaaguggagucgcucucaucuguaagggaacaccugugcuagcugcguugaaagauguuaagaguuacacaguaagauauaagcaagggucacuuugaauccuuaccaguuuaaccuguuuaaacaucuuaaagacaugcuuuguuuuuaaauuauguguguguguggcuaugugcacaugaaugccaguguccucagauccccuuggaguucgaguuacaggcagcugugaccuguccuguaugggugcugggagcuacugggguccucuucaaggacaguauguguuguuaaccaccgagcugccucuucaguuuccaaagguuucguucuuuuuaaaguuugcuauuuuuauuauauauauaacagggauuuuuaaaaugccauggcuucuuaccucuggccaucgugaagaacacacuuauguagauuaacuacagagcuuugggugucuguuaguagaaucgcuguaucagaaugugauaacuggucaucugagaaaccuaaaaggaguacuuuuauuuuccaacauuuauuuauuauuauaugugaguacaccguagcugacuuuagacacaccagaagaggcaccagaucucauaauagaugguugugagccaccaugugguugcugggauuugaacucaggaccuucagaacagcagucagugcucuuaccugcugaaccaucucaccagccccuaaaaggaguacuuuaagguuccagguuuuuuguucuucuguuguuuaguuggguuuuuuuuuuaaauuuuaauucauuaacuuaguagguugguuauuggguuuuuuuguuuguuuguuuuuuugggcuuuuugagacaggauuucucugucuccuggugaccucgaacucacagagauccaccugccucugucucccgagcuuugggauuauagguguguauuauuccugguuuuguuguuuguugcuuuugaagagccauccugcugaguguggauuauaucuuuauaauuguuaccauaauagagcaacccucuuuuuaaaauuauuuuggaaacaggguuauuuuuaaguuggccaaauagaccuuggaaaccuucugcuuugccuccagacuaacuggaauuguggguuaccugaucaggccugacuagaacuguagggucucagaggaaguugagacgagguagaaaggacauuucaaauauuaucacugagaaggucaguuaugaaggguagagaaaguacgggggugggggugggcuguguaacugccuguccgggaucagucugcagagccacuugcuaucuuacccuucuuccacuccuggacgccagcacuguugccaggaaaaaggaggcggccauggaggaggcagucaguagugucgguuccuagaaaacuauuugauugauuggaugauuaacacauagccucauaguuccuccuagcaccugccugcucacauaguggcuuuagcccuugaguaggguuucugcuccucagccuguggaagcagagcucucugccaaaggauugauggacugggaagggacacuuggcaucugcuauguccguaucuguacuagguacuuugcauguaguaucucaaccugagucucacuggugaaacugugaaaugucuccaacuggacgugagacugcacagcucauuaaaggaaggguuauccaaauguaguucgcuuccuggaagaggauucauuguuuugacuccuuugcagcaggcgccagaccccuagugauugggcugguugucgucagugcuggacauccacagguaaaaacuuacuggcccggcaguaguguccgcacggcuuuaaucccagcacuugggaggcagaggcagguggauuucugaguuugaggccagcuuggucuacagagagaguucuaggacagccagggcuacacagagaaacccugucucgaaaaacaaaacaaaacaaaacaaaaccucuucuuacuggcuguccagggacauaggcagaaaggcugugucacucccuucccgguguuagaagcuucccagcuucccuguggugauuuucuccucaggugccuugcucgggcuguugcuuuggggagcugcuguggcccccuccagcagggcaggcuugggcugacgcuuugucuuccucucuagaaucauugcgaugaugaguccagaggacagcugggucuccaaguggcagcgagucaguaaguaucuuacacaugcacgugaacgugugagagcucauucuuucucucucucucucucucucucucucucucacacacacacacacacacacacacacacacacuuucaugcaugcauccuaccccucuuccauuuuuggcuuaauucuuucuugcuuuucagucuuaacucaauucccauuuuaaucuccucucuuccucagguaacuuuaagccagguguauaugcuguguccgucacuggucgccugccccaagguaauaguugugacuucagcagugagcaucugccaggcccagggcaagccucugucucccagugccgaggaugggguggugggcguauuuauccuugugacugucucaugggacuguuucuuuuucugucauaggaaucgugcgggagcugaaaagucgaggaguggccuacaaauccagagacacagcaauaaagaccuagcuaggugcaggccauagcaucuuguucuucacuucuguacuuguuuucuuguggaacuaaaccgugggaccccaaagacuccccgcccuccaucuccgaaucagcagacuccacgaaagcagcacaucggccuuaagucaucucacuuucucugcccacuggugaagugggagugucugggcggauucucagaggcugugucaacagaggaagaugcugauuucccaccuguguucaggguuuugccuuugucuaugggcaggacuuugguucaaauaccaauaaagcgagccuuuggaacauacuuaaaggguacugaggccugugccuuguguuccauuuccucucacagugaggccucacuugccuggugggcucugaggcagcucagcugagguccuuucucuggccugccuuuaagggguacagcugcuaugcugugcuugcugcuguaucgugggaaggucugcuguccugaggcaaggaaacugugcugacuggaaaucagcguucuguccucuagaccuggugcacacucuccuuugaaggaacccggggcuccuuagugccuucacccuugaugcuccuacuucuccuacuuccugugucucuuuucuaugcucuugcuguaccucugccagcuucagaguucacauuccccuuaguacccuuaguggcuguugggucuugaucuggguuuuuguguuuccauggaaacacaaacuccuccuaagaagggagccauccauggguaaugccacauuggccaagauguguuguuuuuauaauaacauauuuaccauauauccuuaaguugcagaaauuguauccccauuuugguuucucuuuaguuuucaucuguaaaauaggagugauuauuccuguuuacccuguauguuuauuucaggguuauaaggccuggaaaugaagaauaagaaaaguacauagcagcgggguggugguggcgcaugccuuuaaucccagcacuuggaaggcagagacaggcagauuucugaguuugugaguuccaggacagccaagauuauacagagaaaccuugucucgaaaaaaccaaaggaaaaaaaaaaaaaagaaaaa

SEQ ID NO: 6275 - RNA, 10591 nt, Mus musculus
cgcuuuccggcgcggucgcagcgcgaagcagcugucauggcggaagcggucuggagcacugacaccggcgaggccguguaucgcucccgggaccccgugcgcaaccugcgccuccgguagucacucgaccccaguuucagggcccccuaacuuuaugcuccgaggcccccuaacuuuauuccacccuaagcuuuuagaugcucagaggccccuacuuccgcuuacaaucccaacuacuuccucugccaucucugcgcgcgucuuguuaucaggaucuuuuuccacugaaagcuuccaaguacaccuuucagauucacccugcccaagucccuucaaguucucgccacuuucaaaccccucgggucccugugcugauuuauccagcagacgccccuacccaccucuucuuugcagcagccuugacuucucugccucugugauuucuuuccccgauucaugcucuguauaucuccuugcugugugucucugacacgcguauuuggggcuucucuucucuugacagaguucaucugcaaagaaucacaucaagcaacuuccuucauuaccagccugcugcccagauggggaaggaccucauagacuuggccacuuuuaggccuccgcaagcugcuaguggguguuugugaugacgcuacauucauuugagacuaaggcaggggugcggggcaguagagguacagaggaggaacggaaggcucagagagguugaguuuauugcccagugucaccuagccgaggaauauagaagcauuugaaugaaccugggcaaucaucuuuuuaauuuuuuauuauuuauuuauuuuuuuacauuguaauuuacuuuugugugugugugcacgcccaugccacagugcgagagugaaguucaggggauaacuuuugcgaaccaguucaguuaucucuucaccagaugaauccuggggcuugagccaucuuacccgaguugugacuugggggauggggaaaggacuucuaagagaaauauguuccaaacuccaaauguauguauaaauacacuuaaaaaacaauuuuaaaacaggaguuugcacgaaaauaugauuuuuuccucuugccuugaaagccaaaagaaaggacaggaccgucguguuuggccaauaauuuuucaugcuuuugucauuguucuuucuacucagaaauauucuuaggcaaaaaggguagccuggcagaucacaaaucaugcaucuuguguuucuggaugauucgguggugguuucagaaaaacaucaggguccuuaucuagcaaauucagccaggauugaggaagggcuggcccuucagccucuagcuaaacucuagugccuuauacgggacuagagaauguuucuuggaaggcagagcuaccuuuuauucaaauuagaguaaugauuaggacaccucaggcccuaaucuugcuucuaguauuaaccaaaguauguccaccaccugcauucuauguuuagagugagcgcuuagugagucacuaaauuccagugggguuugcggucaaugugaguagggacuuugaaggcagaccuggugguauacacguguaaugucagcguuuuucugccgaggcaggaggaucuggaaugugaggucagaccgggcugcagaaugagacacuuccaaacaacaauagcaaaaaauuuuaaaacccaaaugagacaagaauaggaacacugguuguaaucaaccagagaggaagaaauguugcuggucugacucacucuguuguguuuggagguggacaccgcccugacgaagaagaggaggaagagguuguaauuggauggcaggaaaagcucuuuagccaggugagccagcauuucuugucuucagucuaccuccaccuaccugacucccaccgggccagugacucauaccgucaaacucaucuccaggaaagguugugguggcuuauacuuauguuuauguuauguuuauguggcuauuguaauauaacggcugccauguucaguuuagcguucuagguaaggcacuccccaucuccgggcucuauaacaucucuagcaacaagguuggauuagaacaucagcuuggauccuuuuaacucgaauauucuuagauuuuuuucccccugcccuucauuuuuugaacaaagugacagucgguuuucaaaacgugucagcuagcgcuagaagugauuugguucaguagcugcaggaaccgaaguuugagguagucccagcugaucuguuucuuuguggugaccucaguuugaagucgaccuguaccaaaaugaauccgcgugccagagcccacuggaucaucaguaccgccaagagaucuugaaacuggagaauucuggcggcaggaaaaaccggcgaaucuucacuuacacugacucggauagauacaccgacuuggaagagguaucauuccuucugggcccucauugcuuucuuguuugucuccccugguuuucuagccucgcuggcucuagguuguaaguggaaagcccaguaaauggggcgauauagaacauagaugguucuagaagcugcuggaagcugcuggcagccaggcugcagugggcagaugcaggugauguccuucugccugucagagggcccaugggaccugauagcauaggaauugaugacauagaugggcagggucuagaacaauccauuuacaauucagucaaagucaggaguuuauaggcaagaagaggaacaugauuaggcuguggggauaccugugucuuagccugugucccugagcccuugugggcuuguuuuacauucucuuccauuacucuaugucuucucaggaagagauaauauauuccuugaaggcgggacuguauuuucugauuuuuguaucuaugagcucugcugggagccgguguuagugggugcuuuggacugcuuucuucaggaaagcuaugagacagcagcauauacauuugagacuguuuuggaaaagcauauaaaaauacaguucauucuagcucacccaagugagaacuuucucaagaaaacugguguccuguuuggcacuuuugaccaccaagugagcaucaacauuuaccagacaaacuuacccaacauguguucagagaaggcagguugauguuacuguuagcauaaacaacuugucucuagaccccuaaggaaacccaagacacaguaggagucuuccuuggacugcgccaucucuccccucccccagcacggguaacugugagguucuaccuguuggguuugcacccuggaggagaggucaaaaggaagguuucccuucagguguuucuccccaauagcucugaccacaugccagucucagcucugccuucuuuccccaguacugucagaaaauaaccacuucagccagcgaggugccaucguuucuggcugagcggauggcgaacgucaggcggcggcggcaggacaggcgaggggugugaguacaagcagcgaucagguggucuccguggucucucccaucucugggauuccuacuaacacuccccauccacugagggucggggggaugagggagguccccucaugaucucuuucagugacccuuuccuguggucccucgcagggagggcagcaaacucaagucucggaucgucacgugggaacccucggaagacuucaucaagaacaaccacgcuauuaacacuccucuucagacaauguacaucauggcggaccugggacccuauggaaagugagugacccuucgcccugcuggcucugguugucguccucguccucauccucuucuuccuccuccggcccuucaccacuaccuuccuguuacagcccuaugggauggagggucucuuucucuuuuuugcuuuacucaaaagcgccaccaugaagauucuugcugcaucccuccccagucccugaaguggcugacucccucucucuuccccuggugaccugagccuugauguugauguccugcuucuuaggcuuggcuauaagguacaugagcacgugcucugcauccugaagguggacagcaauggcgugaucacagugaagccugacuucaccggcaucaaaggacccuacaggugggaauggggaagaaguguggcagagaccucucuaugugcccuucuugccucuagcugagcagacucccagaaggcccuugaccugcuucugaacaucuaguucccaggcacuuggucauacucuguucugggucgcaagccuuuagggaacagcuggaaaaugugcaggaaucccauuagcugugucaaugagggaggaggauuuuggugcugcaggggauggggacuggcuagugcaggggagguagacucagccaggccagggccagccgugcuugguuuugucugagaggacagcucuaugaguuagcaaccaaacacaccccaagcuguccauuucucaggcgugagagcugagugguuaggguccccaugucuucaggguaggaauggguccagaucccauagguguugucuggugcccuuucuguuuuaucaucuguaugacugucuucuccaucauauaccucaagugagccuugucaccagcauagcugauuccuggguccggaaggccacacgucuuaccaacagaaacgauccuuuuuguggcuuugaccucacagaaucgaaacugagggagagaagcaggaacacacuucugcuuggaaauacacaauugacaacguguccucccucgcacagccagaggaggaagagcgggagcagcgaguguucaaggacguaagcaccaacugauuccauguccucccggcacguggaggaaggagccccugugcugggagcugaaaccaugucucggugucugcugagagagagggcagcccaccaccauccaggaaauagagcugacgugacagcugaguguugauuauguucuacgccagcccgguuccaagcaucucacgaagcucuuacaacccugugaggggaacacuauuaccacuuuauaacaaggacccuaaguuacagacccaaguaaucgagcuugggaacuugaaagccaggcucguucccaggcuggccaacuucagagccucuguguuucgcuuuaguuuagugaucuuuuagcagguauauguguugaggcugucucacucugucuagcucagacuagccggggacccccuauauagcccaggcuggccuugauuugacagcaguucucuugucuuagcaaucaguauugguacuucaguucuuaugucuagcugguggcacagcccugugcccugaaacaaaccaacaucuuuuuaaaaugucaguaucugauuuucucccauucagaacuaaacccugggauggguugagccgaauuuugagaacugguuugcuuuguuuccucagcuuuacggccggcacaaggaguaccucagcagccucgugggcacagacuuugagaugguggguagcucagcuccccacagcucugugagcuguuggggagagugucugacuauagagggacugucucccucucuuaaacgacuccaagaccaacucugcaggguagaaaggaggucaaagaagaguuucaugacccugcauuuugaugaggguccuugcacgcauagaccgggucugaaagggcacacaugcuauguuggccucucuugggacaggcuggguggguggugguaauuggguauugggcagugagaaaaauauaccaggcauuuugacuucuuguucucuaggguuuggugguuuggggaauuuuaucagugguaaugcauucaugcguuaauuuacaauuuauuuaaaaaacaauauaaugauaaaaagugucuuccuuauuacucauguggauauuguuccagagcaccuuagauaggcaaagagcugucauuuuuugcuggucagauguuuuggaucuuagaaaaugaaaccaaaacaguuuaggucagucacucugggguccugucuguguuuuccccaccaccagggauucaauuucuagaccugcaaacaaggauagaacuacucacccucgcccccgucucuagaaaauuaacucguauuguuuuaugcuacaugagcaacagauucucauguauuuaaaaagaaaaaaaaagcgcccagacagauaacacaaacaauuaaugaagaaaaccuggcugcccgcgaguucuagugagcccucccugcccucucagugccgugcugcuaaucugcggugucagaaauaggaaagcgucuuguugagaagugucaggguggagagaacgugcagaguguggccaagcuuggagagcaggugugaggucaucugcagauuuggggacagggcugggggcgggggguggggggagcgcugguucccucugggccugacaccucccauuucucucugcuguagauugccccaggugcccuccggcucuuugugaacggagagguggguaagugucuucuggucaagagucugauggagcugugagcagccacucaccuuggauuagucugggcccagcauggucuuugggaagcugagugaugaggaaacugaggcuccugggccccaagaaggauuuauuuguagagcauuuggacccuucaagacgagacugaguugcugaguaguggugacaaacaacuuuaaucccaguaccugggaggcagaggcagguggaugucugugagucugaggccagccuggucuacagagugaguucgaggacuacacagagaaaaacugucucaaaaaaaaacugauagauaaagaaaggagagacagacagacggacagacagacagacuagacugagugguaaggguaauaagagaacaagcuaggcuuacauuccgcuuucucucuaaguuucagcccaaggcuaugaguaugacaaccucuacguccacuucuuuguggagcugccagcugcuaguaaguacuuuucggacauuucuguuccaaugguucuaggggcauucugaccacucucacugaaaccguucaaggucacaggucaccuccacauggccaguucuaacggugccucuguccuucuagcacauugacuucucugaagcaccugacauagcacacuuuucuucaugaagcauuucucucggcaucauaguccugccuucucucugagggcucuccaggcuccugggugaagucuuccucuccuccgagguuaagcugaccuguguuacuuucuaccucuaguguuccuagcgauugcacccauuccauagcucaaaucacaucugugucucuuguccuacccauaggcacacuagaaucuuagcucuaggagagacaaucugguugcuaacauccuguaaacacaucagccuacaucagacacaacaaaugauagugauuggcauugugugaaugcgugggcgggugaauggcugugugaaagagccuugcagcguggcucuguuuucucacgugaccuccgcccucucuagugagcuuacugugucugcucuuugacuuucagacugguccagcccgccauuccagcagcucucgggaguaacccaggccugugccaccaaaucccugggaaugguacggagggugccagggugccuggaaggaaauggcagcuccggguggguggcaugugaaacgucaucaggccagcuucucaguggaggagccauaguuagggcuccacagggcugccuaggccagagucacucuuugaucucuuagagacugacagcagcuuacuuucagcugucccuuugccugccugcggcuuccuaccaggaggacaguguuucuuuccccugugugaaggugaccucgucacuggacaccgagaacccauuccaaugaggcugcgcccacccagugacugugaguugaaagugacacuccucuuuuuuaggacaagguggccuauuucuccuuuccguucacauucgaagccuucuuucugcaugaggacgaaucggcuggugaguagcugugguccucagccucacuaacguucagccagggaccucucugaacaaaggacccuguaccccccucauuuacauuccagagucccucccggaguggccugugcucuacuguaagguccucucacuggacuucuggcagagguaucguguggaaggcuacggggcuguggugcugccugccacuccagguaaccucuugucccugcccucccgacgcccuuuguccugucgacaagaccagcacuugccaaaggcucucaugcuucugaugaggagaaaugaguaggaacugggagcucugacuaacaaaucacuugcggcuuuucagaauuucucaccucucaugagagacgagugaagccagaacugaccuagugcagcaaccugacgggcugucacaugucacaguccuccgguuagaccuugagagagaagcugcaccaaccgugugcucugggccccagggguauuggaugaauugacguuccuguugcugugcgcugggcaccguaguaaaccucauguaauucucccagcccccugcgagguguaguguccugauugcuucuauguuuuacuagggucaaaagagaagcuggcccucagagguugacaagcuugucuagagcacacaguggugccuggaguagcugagauuagaacuucugucuuccugucuuccagucaggcacuguuguuccccaccacgcuaaccucugcuaggucaucaccagccgaggucauugcugggaagucagggauggaaccccgccccuuugccccuuuccuugcacaggaucccacacccugacugucuccacauggaggcccauggagcugggucucguggcagagcuaaggagguucuucauuggcggcucucuggagcuggaggacccauccuaugugaggauaccaggaaccuucaaggugacucaccucuggggagacuucaggcugagugcuuauauccuguuugagcccccuacccuaguuguucaucauacacucaugguauagccccuuccccccuaugacuuaugcugccaggccugcccguauuuuagaggaacuaauaucuauacgaggagguccuuggggagucguguaauuagagauuuccucuucuccuuuccaccauggaaggccuugguaaucagaugcaagguggacucgcaagaagcauucuugcuucuugcucauucucaaaugaggguggagccuggugccccccccaccccccuuguguugcugucugaaugacaaaguaaaguuccugguaggaugaugcuacgcuaccuaagaauagggauccggauggcagcagcgccccagucuagagucugcacaaacugauucugucuccgcugucuacccagggggagcgccugagccgcuuuggauuccgcacugagacaacggguacugucaccuuccgauugcacugccugcagcagucccggugagugacacugggccccuagggauccuugagccccuugucacugagggcuggagagcagccuugacuauguuuucgguuucccugcagggcuuucauggaaucgaacucccuccagaaacagaugcggaguguguuggaccgucuggaaggguucagccagcagaguuccacgcacaacgugcuagguagacaccucauucccucacccggacacccaggccagggccacuugcuucuccuccccacaguagcugacugcuggcaauauuucccucccuuacagaagcauuccgucgagcccggcgucggaugcaggaggcccgagagagccucccccaggaccuugugagccccacgggaacguugaccuaguucucugcaacccuggccuguggagcaagggaaagaugucugcauccagugcucucacuuugucuugcuuauuagagaccacauuggucgaccaaacuggaugaucuagaaacuucccaccggcuccccugccucaucuucagcaggacauucuuuccuccaugcagaagucaagccugagacucuggggccccaccugacacccugcucauguuuuggcuaucaaacacgggcaucauaacaaggcaggccgugcagucugaaacucgucugggggaaacccagcauuagccucuccucaguacagugucuuuucugguuuguccuggaaccuccauagcagagggcuccaaaagggaguuuggcaaccaggcguaauggugcacacaccuuuaaucccagcacucaaguggcagaggcaggaggauaucuaugaauuugaggccagccuggucuacauagugaguucccagacagccagagcaacauagugagacccugucucaaagcaacaacaaaagcagacagcagcagcauggaguuuggcaucuuccgaggaggaaggugcauuccggagcuuagacucuuguuucuuccaagaaaaggugagaguaaggggccucaacuuccuggcuaagucucuguccccugacauuuuagggcuggcuggcuuugggacauagccugggggaguucucaguucuccugcuggcugggcggggucuuuuauuguauuuguuuguuuguuuuucauauaaaaaguauuuauauugacugau

SEQ ID NO: 6276 - RNA, 7659 nt, Mus musculus
gcucagucgagaguuuguuuauuuugauuguguccauccaguuccagcggcuccgcccccaucacgucccauccaaacauaaauccgguuggacugcugacaacuccucuccccaccccaccccgacccccaacccgaggaaaaaaaaauggugccaauuuuauuugggggugaccucauugguggguccguguauuacucuucgagcuugcagagcaccccucccccgguguccacucccucccccggccccugccccggccccagccaggaccccguacuguacuuuauacuugccggcuuuauuccagucuagugacauaagcuccugacggugguggugagugugagcagucauguuucuguugucuuuucucuugcuugguuggggcugcggugagagagagugucugaggcaaacuuucccgccucucuuacacuaggaccugcacacguccucucagacacucuucugagcacgcucagcaggaagguuuguccacaccuguuaaccucucucaguguccagcuuccuguuaguaucagcugguuugcauguuuugcuuguucagaugaaacaguucaagaaacaaacucauauccaacucucgagaaaugucucucucucucucuuuuuuuuguacacuuuacguuucucucucucucuuuuuuuuuaucaguuacaacuccaaaacaccuguugucuaguaaaacauuucacaccucccuugccuguucuuagauuguauguaucugugggacugaacuaaaugcaugcauuguaguagauguccugguagcuguagcuguaguuguagaacaugcauuguugaguugauauuacagggccuccgaaggcgcggcccaacaccgcuguccgaaggggaguacggggaccaggaagagaggggggguuccauguuuucaaugucgccaagggcuuggauccauguucucgccaucagccaccaccaccucuccucacgcucuccacugggucaccacccucagcucuagccugcccaaugagauccguguucaccauagugaaagcaaggggagccagaguuggaaggaaccacccuguucuuccgaguucuucucuuccccacacuguucuugaccaaagcaacagaucuuuucuuguuuugaaggccaucagccaggcuccucugagcccagcuucuccuugagcccugcagagacacaggucccuauagaaaaaaaaaaaaaaaggaucaguggguggagggaaauaagcugugguaaggaagagacugagagcuuugacccugguagaugcuggcauuggcucuuaugaguggugacgacaugaacgauggcccggcagcccucgugguggugacuggcacagcgucucggggaagagagaagcaugauaggccugagacagccacagaagagcuccuauucucccuaagauucccuagaaguguuuuuucuggagggagccuuuguccuccacuuggggcaugugugggcaagcauuuuugaacacuccaucuucucuaccuguauaacaagccauaaaggaguuccagacagcccagagcuucugucccuaacuuucuaagaccauaugaaguaaggacaguaccuacuacguagugcauaucaagucaggguggacaguggcucuggccaaacccuacagucagaugggcucugggcagaaucuguagaauucaaguuaucuaucaugggacacagaacucagggaaaaaagucaccgagcccauaacaucuucaaaaggcuaugucaugcuagaaugaaauagaagccucauggggguggggaguugggggggggggagcugugaugcucuggcagaguuagaacacgaaagagcugagcaugcgcuaggccagacagaaugaggacacaaagguuccagguggaaaaauccaggaagggccauccuuccagcauggucucccuggggacaggggaagcaggcaacagaagauggcugggacaaggcuucagugcugccgccaaugcaaacugauguagggcuagcaaagaagaguagcaaaugggagcagaaaccagagagcagaaccccaggcuaccgaccuggauccugcauccugcauccugcauccugcauccugggacagcucuggugccuauagaacccucagaguuucagcccaggaggcaagugagcagaccagcgugccuaccacagcaccguaaggccucuccuaaaccagcagaggagguuagggcccaagaaccugacauggacaucccagcccuucugagauggcucugggucucugcagccaccuuugugaaagugucucaaagcucuccauucucccacauaagcagaaauccuguggcuuucaggagggucccuguuuccugacaguguagugucuggccugacaagagccaccuccagcuucauuauaaaauggggaagugagcuagggaaacuggaguggguaaaguacuugccacgcauacaugaggaucugacuuucucgagcccuaaaauucagaaaagcccgauauagcagacugugauagcacauaccugcaacuccccagcacuaggugggcaugcaggcagauccuggaggcucaugggacagccagucuaguuaaaacagcaagcucuggguucagugagaaaccgugucucaaaaaaauaagauuuuuuuaaaaauguauauaauauauauauguauguauauuauauauauguaaucugacaucaaccucugaacucuacacgcaugcacccacacagguaaguacaccugcauacaugcauacaugacacggggaguguguguggaucagugugugccuucaucucugcgaauagcuuuucagcacugaucugaugggagaugagaagugggagacacaggaccacucucugcuuuccucucaacuucauguuaucaaaaauacauccuuugaggggcugugaccuaucugugggcaaaguaauggagagagccucuccuuaggauacagucacaucuguugccauacguagaaucaguauaguggcuagggggagagaaaaguauggcacauugggacaggacaagauaccaugaguagcuggauuuagcuuacccacccgguguuaccucaguauucaucuuucaggcccuggccuguguucuggagagcaccuacuuucccagguugucauuaaaaauuucauuucuaagagagcagggcuuuaaccacaaagacuggcaaugggauuuaacuaacugcacugagucuauaauaacgugcacaggcucccgcugcugaccucggcuccauucauucuccaagggcuuucggaccagccccauugaggauacaguacgucagcuccaaucaauaauuuuguaauagaaauaccaugcacuugauaaaucaacucuagagcaauuagugacuagccuuaaaguccaaaccgaagucuaaguuaaucuagaagcagauggaguugggggauguuaauggucuuuaaaucaguggaaugguuuucaguaggugacauguuccugacugucccuuaagagggcuugccauugcuccggugcuggcuagaaagccuaggcccagcugucaaggagccuacuguggaaaguguagugguucucuuggacacugcacaagcauggagaacacacuaggccuaggccuagagacccucucccauugguggagggauugaggguuguaagaguccuguaagguggucacccccuaggguugacaagagccagcagaggaacacaggcuuggaggcaucauggugcuguagauuccaaagagcuuugauaacuauauacagccacaccuaagccgugagcuacacaggaaagcaggguugccuugguuucacguguuuuuuccugaaagagcagggcuacagaacgucugugugacuuauccagagucacacuccugaugaccuggaaacaaggcucgagucgaggugcagagcacuggaucugaccaggcauuuggccuccuaaaaauagcccuguggaggaacugccaccaaaggccugccacccagacacccgacauaaucagcaauacagggaacacccaggcagcccugaggucuaggugugugucauuccaaggucuccagcuccagcccaagaccacaaauguaguccagcccuccagauggagauugcagaagcagaccaaggccgucugccaaaguuuaacucaacagguacuucccacguauauaguuaguacuagauaggguaggugcauugcuaggccugauuugugauguuuuuagcuguuucggaaagcuuauauauaaagcauguuuauauuuuguagaggauguaugggcugagaacccgaaagcgccacagagguguaggccccaugugugcauuuuuccagacccuucuauguaguuacauugacuuuuguuacccuccuagcuuuaguacuuucuuuaucugagcugcuuugccucaugacggcugcagcuguguggggugucaugccaucccaucuaaagaaggagguggaucuggagauguagcucagcugauaauguacgaaguccuggcuuuguuccccagcauuggauaaacccaacagaauggcacacacccgaagacucagcaguuacgaggcagggaaauacggaaguucaaggucagccucaguuauacaacagauucaaagccagccugagcaguaugaggucuacuucacaaaugcagugcacagugcaguguagcacggaaggugguccagaauccuagcaaaagccaaagagcuuugugcugauuggccaaggccucugcuauaagaaccugccacugaauguuagcgcuaucuccuaaaccaaauggcuuuuauacagugggguugggggaagaacugcaucccaaaggaccgcuuugggucugauaaagagaaagaaaauaacauuguaguaacaacagagacacacaccacaccccuggggggcuuuugguagaacaccagcgcuguccacacccuuaggaaccagccagccugaagugaagacaacagguaguuaaugacccuacaccaccaagaagcccagucacagaaaccuguuccaugcacaggaggagcagguuaggaugggguucacuagucuagaugaggguacauuugaagcccugcaaacaguuaacuguggcuggagauuucaauacagucgggguggaaugagcauccggugauguuagagagcugaaaagacuaguguagagagagccccugguacccagccaugaagccuggauucaccuggcaacaaguagggaaaccccaaagcaggaagagaaaccagaggugcgugauugacauaccuuggcagcauuauucaggguagcaugaaggagcugguaauucuuagacauuguggccucugagugcacaucaguaaauaccuacauaagaggucucauacucuccucaaccauggcgacggaggcugggcuaggguacggaaggauucuguggagacucagucacacagucaaguuuccgaucaggcuguaggugacggagagcucggcagccaagcucaguacgugaggagagaccugccccugccuucagagauugggaacagaagacuggcuacuagggagugcaauauagacuuaaagagacugggcuaccuagaagccagccagggucacuauguauauuguggggcuggggacugguucaaauucuucauagcaguaaacugagaaagacagagccaccuaagagagaugaccugggcagggccccagagcagacacaagucuccauuuuaccuucagugauaaguuaucauccacucccacccucaggaugucaguucucacuccguugcccucacggcagccucugcccucguccuuucugcugguccaucucucauugcccuugucuggcucggacuaguagaaagacagccacaccuagugaccggaacgucucaaaauauacaucugcuggaaguuuccuuaaagaguaacaggagaguauuagaaacauuccccuacuuuauuaauacaauaauaacaauucaucaguaguugcucacauuaugugagucaagugcugugugcgccaagcccacacgccauaccccuacuuaauucggaagccauaaaugggugccaucaguccccuucccauuuuagagauuacaaacuguggcucggggaagagauaguagcuuaucugagguggcagugacaggauuugagccugucccaucagccuguguucugagccacuauccacacaugcucuguugugccagucucucucccgcggugguugagccagacugcaacuuuuaaacacucgacagaaaggugcagcuguucccacucaauucuuccuauccuuaggggaggcgauaacccaaaaucauuuacaaguggucucgagaggcacgcugugcauuuuugcaccugcuucuguuguugggacuccgcagcaugguucugccuggcugaucuuuggcugacauuuugauuugaucccugcauccauucggaccagugucagacaaaggagauccagaagaggugugguccaucaagacgaagccagguugaagggaauucuuugaagggaacucuuaguuaaaauacagcugaaggaaguuagucacuguccgaggugauagauaagggagggaucucuggguaggcagacuucucuaagcaggggggagucagcaucccuuucuuugccuugcacaaacagcaucuggaaagugguuaggaaacacugcccagcccuagagcaaggaggccauuggcugcucaguugcugggcugggcugugggccaaugguggagaaggggguguggccacaggcgcagccggcuccuuacccaaucuucuuucagggaggcuugggcaccagguaccauagcaacugcaaacaggggcucauuuguuuuguagaugaguaauuacuacacaauuaaagaaggcuaaaaauaaaugggcccuuuguuccaggcuacuuauuaauauuaauaaaguggucuguccagguccauggcaaauagugaaucccacacuugcgcccgggugucugagguagagaccggugugugaagaaagcaggccagcccugcuucgcugccagcuucccucucuuucuggaagcuauuucuggcuaugucuuggagagggugggcuuccugggucuuggaaaguucagccuuacagauagauacacacagaacgguggguacccuggagagucaggcagaaaacuaauccaccccucccccaccagagaacagaccagaaacacagcagaaaccacaugacauggaagaaacuccuugucucuuuaugcucucuuugaccucacauugucuucuuuaauccagaaaaacacccuuuaaaccuuccacugagauuucagggucuuccucugccagccucuuuuucuguuugccugucuuggggaauaaacucaccaugacaggcuaggggucuucaccaugacaggcuaggggucucgucgaguucaugaccuccaucccuuaggucuugaccuucaagguucaaauagcuaagaggauauugaaaccaccaagaggugcucccaccuccuagaggaggagauggccuug

SEQ ID NO: 6277 - RNA, 2361 nt, Mus musculus
aaagcauguaccaccacagcccagccaagggauacaaucuuaauugaaguaaaaauaauaucccaagaugagcuaaagaccaucaaaguguaaaaauggaagcaaauagccucauaaauaaacuaggugacaugaagaagugagguauuaaaaugucccuauccucggaugcaggaugaaguaugauguucagucuugggauaucuucaggagucccaggcaaacugugaagcugggaugcauuaaggaguucacugucuccgaugcccaacucggugcugacagaggcccuuguuugugaugacagccuaaaccagcagcaggccagugccgaucucuuugagagccacagguagcugagaaagcaauuugaaagguuaagauugcuuuucaaauacacaguuagauuaaccuccaaaaccaguauugagcuuucagugggugcuguguguuggcacgauauaaaugaagucuguugaauugugaaacgugaaucuuuuucuuugugugagaccaauuuucauuuccggaaacauggcaggaucaauacacuuauugaaaaguaacuaaauauucuggcaucaaaauaaauccuucaagggccucggagaaugaaugacugaugacgugaggaaauuguaccugggaucaaguuggagcauuugcugagcccagugaacuugaccuuugaugaugauguccucagaaaaaaaaguuugagaggugaucuucccacacagauguggaacaucuuagaguaaacuuagaaccuucaaaaaucacagucccuuaauuuacacugauguaugguguacacguguguaccugugagugugugugugugugugcgcgcacagaaauuaccuccaaauagucaaaccacaagcuaucugugaugcuuucgaucaguuuauggcaaaagaaaucuacccaaugggugaucuggauaccccaagggaggagaauguaccuggaguggcccugagacacggcaggaacaaaaggagggccuuuaaaauagagaaaaccaaauuuaucccaggcugcaaagcaucccacaaccacaauaucaaggaagacucucaaaguuagauggcagagagaaagaaauuagcuaaccauccagcagaauaaagcacuuaagagcuaagagugggaggugggagagaagcaggggcaaaccugcagaauucugcagugguaagauaaggcacuagccacgggugccuaacacgcuuggaaaaaaauagacuucauucacaggaguauacgcaggaaaccauaggaaugaucaagccguuuaaaaaaagagucguaaaagaaccagaaaacaaaauaauaauggagcagugguggcgggggugggggcuggguggguggggggugggggaguggggugggugggggguggguggguagagaggugggggaguggggggcgggggggggaaacggggaggggaggugugggcggggaggcaguugggaauggauggcccuucaguuaagagguuaagagcacuuggcauucuuccggaggacccaaguucaguucccagcacccacaucugguggcucacagcugccugggagccugacauucucuccuggccuccacaggcaccuguacuccuacacauaccccacacauagacacaugccccuacacaucauuaaagcccaguaaagagagauccuagaugaucucuuagaucuguaggacagaucuccuagaguaaauccgugugaagaucugucucucuagccacccccccccccacacacacaccagugcauuuucacacaccacagaggauauuuuaagaaacagggaagccaggcaugguggcacacgccuucaaucccagcacucggaggcagaggcaggccgauuucugaguucgaggccagccuggucuacaaagugaguuccaggacagccagggcuacacagagaaacccugucucgaaaaaaaacaaaaaaagaaagaaagaaagagggggagagggagggaggaggagaggagaggagaggagaggagagagagagagagagagagagagagagagagagagagagagagagagagagagaaacaguggggaagaaagcaaaugacuacuuuuaaaauuuuuguauugcacuuacuauggcgugucugagcgccguggcgcacacguggaggucagaggguagcuuuugggagucaguuuucuccuuucccuguggcucagggcucagaugcagggcaucaggacucucgggacaaauacuuuuccucacugagccaucucgaugagccaaggacuccggcuguuuuucaaaauguuuucgacaacuuucugcucauuagcggccgc

SEQ ID NO: 6278 - RNA, 34234 nt, Mus musculus
cgaggggcggggccuugcgucgcgccgcgggcacgucguugcgcguccucaguauuuaaugucucuguguucgcccggccugggcuagcacgugggggagcggccgaagcgccgugcagcgcugcggggcagggccgcuggacuagguggggggccagggggcgguggcgggaggauugagugccuagacggucgcccaggagcagguaagugacggcuggcacgggcacccgcccgccgggcccggagagagaacgaguuggggugauggggagccuggggugcaggugcagggugcgacgcgcgcgccagguacuccggggaccgagagccuugugcaccgcgccugcugucaagcgggcgggucugugccuugaugacccgcgcgccccgcuggucuuucccggucccagggcugcugcugacagaucgcgugcgcugagcucggggcgcugcuuuaagccgcugcuuuccccucccauccccccucacgucacuggccucuaggauggaggugagggcgcaauuccccgggcgcuccggugcgccucaacuuucccaaugcuggcucacccuucuggguagccugcccgagcgcgucccaaccaaggucgucuagucucgcuagcguuuacuuuucaaaggucguguguacccaguuuacgcguggagaggaggcacuggggcggucucugccaaggacccagugcccaaggcgggagaggagguccuuggggaccccuucccuuccuaacuuucuaacugcugggcccaguugacucuggguuggcccggcagugguggcaaaccggagcaggaagacacaauuccuggaguucagugccgcgaauuauuggagcggacucugccguuguagcggggagaaugggaugcaagacaggucccaaaccuuuuggcgguggagagaccauaagaccaauuaggauccggaggucgugagcuuggguguccgaagggaauuagaguuuguggccccauaagcauguccuaagaggugggagaccucuagcuagaggugcccgcugacuucuugcggggguggggagguccagggucacgugucgcgccccaccuuucuuuccgucccaggacagugaucuggagggacuuugcaggggucauggggggacuuugccaggguuauagguaaaaaccugcguagagaagccuccauacgcguaaaggagccuacauucuggugucaacuacugcuguguccuaucuuuuccuguuuccuuucuccgggagggaaggugcugauagucaggggcugugcagaagggaccucugagacgcccugugccuaaccggaccuuuucccuccgggaaaugccucgagcaacuaguaccuuuccacccuugggcugugguuaacacaaacccgguggacuucgcuccaggugagaguggaggcuucucaaaccgguaaggucggguguauguguagggcaauuaguaagguuuaaacugccuaucuuuccgcuauugaagucgaggcugcuugggguuuaaauuuaacgccugcagugacaacaggguugcuggaccuaauguaaccaucucgguuggugugcuaccacccucuguauccguguguugcaauuacaauugcuauugcuucgggaaaucaaucuuacaugcucauuuaacugcagaguccuucccaaauuaguaaccgugggguuuuugguuuuguuuuaaacgcuuaacuuuagaaagcgaggcuuagaaaagcgaggcuuagagucuacgggcuuccuacccauuccucucuuaaaggcacaaagcaucuauaaacucugugaacgaguugcucuccugccagagucuucucugauuggcauuuaaguguuucaccuucagauuauuuaggacucuuuuagagcccaaggaacaagugagauuauguuuggggagcuuucuggacuuguugucgagccuucuuucgcuucuaaccuguuuuguagguucuggguaauuccuggguguagucuugugaaauagaaagaauggccuuggguuagaggacauucuccuacccuaaggguguaugcaaaucauuaaagcuucugguuagguuguuaaaucagaaggcuuuguucuguagagugggucaguagcuauccaacccagugggugagaccugauguaaaucuagugaguuugccucuacuuggggaguucucccaucucccagcuaauuguaggaauugcauucacccuuggccucugcugggugacagcagagauacagguaucaguugucuguugccugcucagaugcuggaagugaugugucugagcaucaauacuuuaaaacaaucugucuugcuaccugguaacccagauuauauguggaccugggccccaggcuggucauagcuagaguuuguggaagguaguuuuagcuuccaguuuucuucuucucauccuaaacauggauggagaucaucauauuuaagacuugggacuauuuguagcagaggauggccuagucggucaucaaugggaggagaggcccuugguccugggaaggcucuaugucccaauauaggggaaugccaggacaggaauggaaguggguggguugggaagcagggggagggggaggggauaggggauuuucggaggggaaacuaggaaaggggaugacauuugaaauguaaauaaagaaaauaucuaauaaaaaauggaguaauaauaaaaaaaagacuugggacuauuccuggccuaugcuaggcacuuaaguaugguaucccucacucccaaggaauccguuugacucagucauuugauuagauauaaaagcacucccucgccuagccucugaccuaguaacuugguuagaaggaagacaaauugguguauccaggcuuugccaccuagccuacugggucaacaugucuuggucgcucuagcauuuuaagacaccgaaguucaugugcccuggagcugcccuguuuucccuggcuacuccuuccuaauaucccuugugaguuugccaugccccggcuucucugcggcucagucuuuuccugugugugugagauuuguaucuggcauuugucauccuaagaacuuuauuauggggagauguuuggguucugugggccccaugugccaccgaucucaugucaaguuugaggguugcuaaucucuacaaugggguguguuagguccuaaaucuugcuucauagggcaaauucuguuucuccuuccugguggagucagucucucucaagcacuugggauugguuuaugugugguaaguacuguacaauugagcuucaggcucaagugugccccucccacaccccccuuuugagacaggagucaugccauguacugaagccugccuaaacacacagacgaccuacucacccuuccaagugcugggauuacagacacacaccauaacugcuaucaccucauugucauuagcuuuguuuuccuccucuugauggugugugacagugaggaguacugcugccagcacugggacgacuggggggggggguuggggggguuggggggguguucagcaacaucauucuguccagguccuugcuauuuggaugcuccugaaguucacguuaguaaacauucuguccccuguccuguauacugguggcuuguguucacuuagccuugucacugaugcccauuugcauugggagcaaagcaaggaaggggguuaguucuggaggaaggagaagccugcagugcucaggacagaggacaccugucacugcuggccuuggcuggcaagaggucagggcuugcugcagcucucuaagcuccuaccagccgauuggccaucgggucuauuuuuuuuuuuuuuucaauugguaaaggacacuuggugaacuaaagguguuaaaaguauuuugauuaugggcaggagggagagcuggucaagucucaggcuuauaccuauacaguauucugacucuguaccuagggggcugcuggaggaaugugauugccugccacgcuggggagucaagauuucaucaccauaaagaguuuuggguggugccagucuauaauauucuuuguccuacucuaaacucuuaguuaccucaaccuguaaauguccaaaaagcaccacguuuggguuuuaucguuuauagcucccaaacagaacaacuuuuucaccaaguuuuucuuuucacagcaugcuaagaagcaaggucugguccacagugaggagggggcugagggggcugagggggcuggguucuuaggagauagguugagaaaggaacuuacuaagaggccggugagacucgagcaugaaacagagcgaccagaccugaaaccccuccagagccacuuugguuugagaccuugcucauuacuauaaagggccuuccugcuucuacacgaccuggcgucuguguucacgguuuuuggucugccaaugccauauuaccaggcccgagagcuuccaaagggccucaguaugaaaccucccugcuaaaccaguuugaauuuucauucugugucaguaacagggucugcuuguguaucuuaggcaugugcuguauagcccuagcuggccucauaucauucugucagaacccuccaagugcugggguuguuacagacaugauuucccaguagcccaucuuaacgucaggagguguccuuuacagaaggcagugggaaaagaguggccaugguguacauccagacauguugguguaggauacacuuguggacuuuauauagaugacucuuucauccauguuaugugacaaaacuucccggggagaugcgacacacgucuacucaccccaguuagggaucacaugacagaccaauguguauaccaccaaaguccagcuuaaugaaccaaugagucuuacgggcguuacuuauaggaauaugggggagggguuacuuacaggaguaugggggagggguuacuuacaggagcagaaaugacucaaagacagcugcaucaccacggcccaccccagcaugggucacagcuccgagcugggaacuuggaagucacugcccagccugcaggcagcucaacagguuggagagauccuuucucagcgacucucuuuggucuacaccucuuccaggcagcauggcugguauucuucuaggcugcuguucuggucugagucuuugcagcucuccugucuuccuuguggcucacuuuucccucugagagggacuuucagcuuuuauaguuuacucuggcaaggaggagccuagugaaucuguucaguuucagggaguucuuagcuaauuuuaguaguuuuccuccuuguuuaagugguuccccugcaggauggaauguuugugguuuuuuuuguuguuguuuugguuugguuuuuugagacaggguuucucuguguagcccuggcuguccuggaacucacuuuguagaccaggcuggccuugaacucagaaauccgccugccucugccucccaagugcugggauuaaaggcgugcgccaccaugcccggcuaagauuuauuuuauguaugugaguacacuguagcuguacagaugguugugagccuucugaauuuuuagaaccuuugcucgcucuggucaacuccacucacucagucucugcuuguucuggcccaaauauuuauuuauuauuauacauaguacccuguagcugucuucagacaccagaaggaagaaacgguugacgcaacagucugguccugggucugcuuuguuuggaccuugccaaaguagccuugaacuugaugccucagucuacauuuugcguaccuguuacuauacuccaaauugauugauugacugauugauugauugaaauggggucuuacuguguugucaugguuggucccaggcuccggggcucaaggauucucccucagcuucccaaguaccuaagacuacagguagauaccacugcaucuaccuagcugggguuuguuuuguuuuguuuuguuuugguuuuuuuguuuuuuugguuuuucgagacagaguuucucuuuuagcucuggcuguccuggaacucacucuguagaccaggcuggccucgaacucagaaauccaccugccucugccucccgagugcugggauuaaaggugugcaccaccacgcccggcuuuguuuuguuuuuuaaacauuguuuuuauccuuuugucucugaggagguuaaguaucucuaguuaaaacugagaccccaaauaagauaaauaaggugacuuccagaacacuggaugggcugaucugcuuuuggaucugggaugguguaucuucuacuuccccauauacuggccugcucuguuaucacucccucuucagcuacaauaugaaacugggguguucaagaauuaaaaaguuagccgggcgugguggcgcacgccuuuaaucccagcacuugggaggcagaggcaggugaauuucugaguucgaggccagccuggucuacagagcgaguuccaggacagccaggacuacacagagaaacccugucuugaaaaaccaaaaaaaaaaaaaaaaaaaaaaaaaaaaaaaaaaaaaaacuugauccuacagacugagucuguuaaguguaucugaguuacuuaagccuccuuacaacccuguggagcuauuuggaucgcauuucacaggauacugaaguucagaucuuacucuuuuaacucuuuacaaagcccugucaccauuagggaagugcaccuuugaaaugcacaaguaauuacugaauaagaaaucccucagggcugggaaacugagcagguuucaagacaaccuugaagucacucaagauuucuaauaauaacauugccugucagaccucacauggaggucaugagaccauccccuggacucagcaggcugcuacccaagagaggaggagacugcaaagaucuggccaggcagcccccagacccuugucuucucagccuugguccggcugugccuuuguggggaugagagagcacuccauuuggaggcagcucuuagcucuugccugcuguucaucucuuccuugucacuggagcagaggccaggcagugaccccagcuuguccagcugcccuggagagagaccagcucuugagaauaaccucccuggcuuuguccuuuggcuuuggugucacccacuccaccaagcuugugguuauuuuuagcagguggcauccuucaggggagucaagugcauguggcugcaaggguccaggacagguccuugggggggggggggccaaugcuaccuaaccaggggauggaggagacaagagcggccuuaggaacugcuguagccgcuuuugcucgggaggucuccaagguggccuuuucuauucugaguucaguucagaacagggccaggcaggcaugugacugagaccagcagugagcuagggagcuggaccaaguacuaggaaaugaggaucccuuguuaccgcauuagcuaauuuuccggaaaaacauauuaacguccacuccugucccugccuguuuggugaaguugcccaaaccuaagggcuggccacaaaguagcaaaaaaaggucugaagaaacuauguguugacuggcaguccaguuacuggugucuucuggcuuucaucaaaauaccaacacaggaggggacaaaguggcucuagguaggaggguagguagguagauaggggugucuguguguguguguguguguguguguguguguguguguguguguguaacucaagaacuugugcaugcuagauucuaccucugaguuacaucugcaucccacaccuccuacccccacuaggaauuuuuuugcugggaggaagccaaugaggcggaagagggaugaaaaaggaguuugacaaguuugccugguccucaucccuuucucuccacucucccccuuccuccuuccccuaacucagcugccagcuccagcccaucuaucuguuucugauuaagaaagcuucaagccauauaaggcccucuguggccuaugguuuauguuggcuggaaagcaggguuguuguugcaagaucugauucagaguaguagugagggcuuaugugaggguguguguacuguguguaggugcaccucccacuaggggcuggacccuuuagugggcuagacccagcuugagggguaggaguaaggauacugguccagcaguggcucuaagcuaauauguagugugguuucaggacuuccuggcaagcauguuugccgagguuccggguaaaaauaauuaacugguuuacccacaaagcauaccuguuauguuucuagccaggggugucaugauuuuggaaaagauucuggaggcagcuuaugaguuaagaacaaagcuccuugacacuugaggacaguggucccucucuggaaggauguuccaguauguuucugagucccgugauuccuggaguuuagcuucugugggggauguggagccagccauuccucugaccccuuuuuggccucuccuugcugucccuugagcuagcugagcuuguucuggccccgaggacuugggucguuuucucugccugggucuuuucucucccucucugugccaccuucauccuggcauggcucccacuguugagcucugagaugcugacagcccuucuuccaggaggcguucucucacacuuuugcauacagcuucccaucccauauauauucuccauagcccuuuucaucucaaccgcagggcccacagaaaagcauuuguuaacccucccauuacuuuuacaugcauggggaaugugccaggggugccuuagggcuuugucugugcucucaaccaguucagagacuacaggcauauuacauuaaguucuucauugcauugucuuauuaccugaaguuugaguccccagcccccaugguacuagcucgcaguagguauugauaccuuuauuaaaugauggguccugcuaccuuagcauuggagagccugcugccaugguuccccaaagcucuauuggugagcgcguucucuucuugauuuuucacuguguuaguuucagggguaucugaagcaaaguugccaccaguucucagagaagagcauuaccuguuugugcgaguugacaccacuacauguuuaccuuggguagcaggaacgucacacuguggugauagaguauccuuuguggggaguuuuggcugggcacuguggcgugugcauggaaucccagggcuugggaggccgaggcaggaagguuaugcuuuaaagaugucaggucagcuugagcuacauaaugaaaaccugucucaaaacccaaaccccagaucaacagucagcacugccuauggaaagagguuugcuuaucuguuguucuggagguuggacccagugccuuggcaggcuacacugagguuuugauuauguucaaauuugaaaagacaguucuuugcaggggcuguaugacucagggcucgccuagaauccaccuggcaaaccuggguuugguuccccaaacaguccuuugcuccauuagaacauccuggaagcuaccgggaacauuucuuccuuccuuccuuuuccugucucucucucucucuuuuuuuuuuuuuuuuuuuuuuuuccgagacaggguuucucuguaaagcccuggcuguccuggaacucacuuuguagaccaggcuggccucgaacucagaaauccgccugccucugccucccaagugcugggauuaaaggcgugcgccaccaccgccugucucuugucucucuuuuuaaaaggaauauauuucuaauauuuuauuuauuuuuauuuuauauacauuaguguuuugcuugcacguuuaugcaugagggugucugauuccccuggaacaggaguuacagagagcugugagcugccaugugggugcugggaauugaacccaggucuucuggaagagcauacagugcucauaacugcugagccauuucuccagcccccuuaccuauuuuuaauugugugugugugcuccugugugcgccugccugccauguaugaaggcaccuaaagaggacagagggauuguauuuccuagagcuggacucacaggugguugugagccaccuaguguggggggcugggaccugaacucacgucuucuguaagagcaauacaugcuugacacugcuugcgcuuucucgcuguccugucagccgacuuucaucuguuuccagucuucgagauugcuugcuuuucucuaucuucuccuccucuuccuccuucuguucuucagaaaacacuaucugguuuucuacuguaaaugucugcucaucccuacaccuucuuccucaguuucucaauauagagguagcguaauuugaagguugcuauucauaaacauuaucugugucuacagagcucucagguuauagauauaauuuugucuguccccccaccccccacccuggucugguguucgccauccucgccccucagacccccuuucuauacuuuucugugucuuuccuaguucccacuccucccuagccucugucauuauggcaggcaucaugccauugguggagaggcuuugugguuccgcaucccagcuccuucuaagaguuccacuuugcucugcagaucuaucccuuucuguuggcucugccuccucuuccuccuggggauuuucucugucugauguguuccuuggaugugauaccuguugcacuuuuaacccagcuagcucccaaauaauugagacuggacuauuauauuuauuuaacaagcuuuaagggcacaacagccgaacagcaguaugacuucuucuaaacugauccggcuaccucccagccaaaaucccagagauauuugcauuuuaguacugaucugacucucugggcuccaggucuuuucucaugaugccuccuggacucuccccccccuccccucugggagaaagagaucagcccuauuggcucagucauuggcugaucagcuagcuuuauugacuauucagagaauaauuggggagcaauguuaacacaauauugaagcaggagauucuuagaauaaaaauugcuaccagauaugggggcccggaagucagcacuugaguaacacaaggauacucuuuacacaacacacaauaacaacaugccuacagagacuccccuccuuucuagauucacuccauugucuugggagaacauguccuccaguaccuugcugcgagugugugcgugcagaggugaguagcuaucaagcaugcugauaugugcaggagagcaggucccuuugagagugcgcauuaggggauaugugacugaacacaggacuauucagcaaggacaaccaagccaggagguuccuucucccaagcuaacagaaggcuuuaccuuuuggaaguugugaaggagacgacaccuggauuugaacccccaggugguggagacaguggucacugaguguagcccaaguaugcuuggcucuucagcacacagucuaaaggccucuuauccuugcacaaggaacuggagcauccauguuuggggaaaugguacucuguuuucugcucauuccuccaaccaccagacauuuuuuuuuuuuuuuuccucugccccuuggaccaguccuuggcagcgugggcagcagagcagcucacuagggaagaggucacggguauucaccuccaaaaauguuguggaagguucagagcuucucacucauuucugcccuacccugccugguacuuggacuugucaauacauauuuauugaauagaguuuuucucuucugccuuugugauuucuccguugcuggcaucguuagccacacaucaauaucuuuccuuacuuaccucuugugaagccacauaccauuugguuuuuauuugcuuggucuugagacagggccucuaacucgugauccuccugucuuuuaagcaagccuguugucagaucacugcucauaucuuuggagcaggccugugugguaccuucuguggugaggugagaacuccauguacccaggagugcauuccugaaucugcuuuguaaucacccccuagagccugacagaauucucucguaaaaaccaggcaauaauaaagagaccaagaugggggccaggagggacuggacacagccuucaaacuuuucaaaaaccacaccccugugcaaaggcaugguggugcauaccuuugauccuagcauuagagaggcagagguggaugucugaguuccaggacagccuggucuauaggacagcuagggcuacacagagaaacauugucuugaaaaaaaauacuaaaaaacaacaauaacaauaaaugguugugcuuaaaacaaacaaacaaacaaaacccccaaaccacaccccuaccugagaugaaguaacuggggagaccacuguaggagaguuugcuuucucacaucacuagaaaggacugaggcgcuggaccugucugcaaggagagguggacacucuguuccugauugguugguugguuccuuuguguuaccaagguuuuuuaaauuuuauguguguagguauuuuaucugcauguguguaugugcaccacguggauacagugccuucaggaggcagaagagggcaucagagccucugggacuccagucuaagaagguuuugagccacgguguggguagugagaauugaacccagguccuauguaagggcagccagugcucucaacagcuaagcccuuuuaaccagauucuuuaagcuggaaguuaguuaacuacugauugggcuggcaaggaagaucccaugcuuagaaugggaguuuuaguuuccagcucgucuuaccugggccucucaguucuagaccuuagcuuuccuuuuuggccagagaaguuucaccaagugggucuugagcuucugcccuccugcuguggagcaggcugagaaaguguuccaggguguugguuggggagauggcucaucuguaccugugcaaggaguuaguuacccuagggugaaucugucugucuugucugccagucuacauaccugcacuggcuggcuugcugcccuguaaggccaucacaauagagguguagggcuaaccuugggcgggccagccagcccauuaugagcuaacacggaauccugauggugcucgcaugagucagcuugcucagacccccagggaugaagggaacacccgggcuaggcuaagaccagcgggccugaggcauggcuccaucucugugacccugggccucagccaugcugccgcgggagaguggcccaggcucaccaucacccccagaacugcacucugccagcaagguuggugcuaggcaggaccucucauguccugggauuuucuggggaaaccuucuaguacuugcugucacccaagcugucgccaccagcguguggauauuuaaacugacuuuacauaagacuagacauugagguuuuucagucgcauuugucauacuucagugcucaguaaccuccuauggcuaagugccugacugccaguguuggccagaaaucacauggggaucgccgcagucagccguuaccucuggugaucugccccacuugacgagacugccaggccuucucgccaguucuuuaggucagcuccuaggacaccuucaggcucugcccagggacuuugcuccccucuccuacccuuaaaaacaucagaaccauaaaaaggucaccucuccccuguaucuguagcagccuauagaaauccuugccuuaaagauuagcuuauuuuuauuuuauguguaugagaugagcuuuugccugaauauauauguaugagcacugcaugugugccugguaccuaggcaggccagaaagggggggggucaucuccuggaacugauggcuauacacuuccuuauguguccugggaaaugaacccauguccucuggaagagcagaaguacccuucacuacugagccaucucuccaguccuuuuuuuuuuuuuuuuuuuuuuuuuuuuuuuuuugguuuuuccagacaggguuucucugugcagcccuggcuguccuggaacucacucuguagaccaggcuggccucgaacucagaaauucaccugccucugccucccgagugcugggauuaaaggcgugugccaccacgcccggcucaucuauccaguccuaauccagaucuuugaaaaaguuuuucugggcuccaccgagacuuguguaggugugugugugugugugugugugugugagagagagagagagagagagagagagagagagagagagagagagagagagagagagagagagagagagagagagugagagugucuccgagauagucuucugguagaucaucugcuccuuaggagcagcagagcugagagcucagaaaccgcuguggacagaaacuagaggcucuuucucucgcugccaggcagggaaccacaauuguauguucuucuuuccuuaacucacacgccaaggaacuuccuauggaggccagcaaggcugcaucuguucuccacacagaaguacaggagagccugcaggacugcugggcuuggcucugaucgccugcccaggggaagacccuugaagggaaggcacauuuaucaagagcgagcugugcuuugcucuggagguggaguggcuggggcacacacucccccaguggucauaccugggauaaugggggaauguucuaguucugacagagagggugugugaacagcuguccagaacacauccucccccuaucagggccaagccuagaguggacuugggcucuuggccucuaagcuguuguuuuuaugauugacuuuccugucaauuacaugcagcccuuuuucccaguaacugcagccaaaacugauuuagucacuaggaccaacacuguuuugugccaucccggggauuauuuucuuguuuagaaggcucuagacuuggguuacagguuugucagcugguuggggaguugaggccauuacuucuccagagggccuucugagaagccacagguacuuguagaaagagaagggauccuucuagaaccuggagugaacagaugcaugcaaagggcugccugauguagcacgugccugcuuucugcucugugugaccgcuuggcugccagccagugugcaucuauuccugggcaaacggaccugcuaaaaauacgcaggcaggaguuuaauuccagcagauucaaaauagcugaguguccuccucaccagccuggggcagggcuccgaaguauccuugugugggguuuuccccgauugcaggcagccugcuucuggggaccagaaacuggucucggaagaguuucugguuagcauguggguauagagugcuggggccuuugggaccuguaguguucgguccacucacaacuugggaaguucaaguuuaaaaaccaaguguuuaggacaaagagcaacuagcuagcuuugccggggagcaaagguagugggaagcccuugugaggaugaaggguguguguauguauguaugugugugugugugugcagguucggacacagcagguuggugcaucauuucccaccucuacugaccugucagaccauuuaagucuggggugggguugcugacaugagacugccuggggugaggaagaagugggcuauuuguuuccuggaugguaggaaguagagugggguggagaggcaucaggugccucggagagcccccgugggugccccuuggcaccggaucccuuaagaugaugacacuccuaggccuggugcauugcauucaaauccuuuguguucccuguagcugcugguccggggcugcccucuggggagagaauagcugcugccucuaaucucacccauugucuuggaagcaggggacaaacaaauccugcccucuacagggcuguuggggaacucccucacucagaccuuggcuuugucuggaaacaguccuggaaagaggggcuuuguccugagccgccucaguagugggucuuuagacccagcucagauugggcuguggagcagugggcacugagucucuucuagguuccuuguguuggcuggucccagguuagcaguguucaucacccccuaggaggcugauuggcacaagacaggaagucugucugggaaaugucacuaccacuguuuccuucuucaacugacgaagccucuacaacagacugauuugcacugaguaggggugagacuuggagucccagucucuggggaacaaauuaacagggaggcuuagguagacagugguggugauaagccgggauauaugcucagaguggcaggacugcugguucuucucaggguugugucugagcuuugggugggacagcuggugaaguggugggaggaggccauuggcuuggugggccugggccucgggacauugcggauuggccagguacuggacuaaagcagacuagagagcaugcuguugggaugcuucagggguuuggggagauagaguggggugaucuguaacugagguagagggugggacugugggcguugguuuaguuucaaagggcagaauugcucacagcugaacuggaagccauuuuuguuuuagguaccaagcuauccaucacacacaugacuguggucguggcccuagcauauuagaagggauagcugcucucuguuggagagauuguggguuguuuguguuuuuguuuuuauguaucccauucuaccaacucuuuuuuuuccccccugaguccagaggacuucuauaguucucuaggaaucacaaauuugagucuugcuggggaagggauuuucaaguuaguaaggagucagacagaaauuuauggccacuuccuguaaucuuuugccugcugggcagugcuuucccgacucuaggcuguggguuccugcccuguuccaggcaugcggacuuacuccuuaacggucucaaguugcuuuuguucuuuucuguggauggcacugagcacagacccagugagucucacugauucuguugcuguguauaggaugcugcagaugagagguucucaaaccuggcugaauaccuggguuuaaaacaagccacgccugguguuaaaucuugccccuuggguucugauuuaauugguuugagggccacguuggccuugggcucaggaaagcuuccucagcaucuggguggugacucacgcucauaacccagugccaaucacuguauuugagaggcugaagcaagagaacuuaaaguucaaggccagccuggguugccaguaaaacaaaauaaucuuccucggugagggggcuggcgagguggcucagugguuagggacacuugcugcucuugucugaggccugaguuugauuccuggcacccacaggugacucaaccagccagaaguccaguuccaagggaucugaugccuccugaccucugagggcacguauacuacauauauucuggcaaaacagaggugaaucuuaagaaaaugcuuccuuggugaucuauguagauccaaguuggaaaacuacaacuguaaggcagcucucugauuauagauagaaucuacuaaaagaccacucuagugauuuaagcguucauauuugacuaugcgaaaucaauuugcagaaacugcccuuuucccccagccgagggcuuaguccaagucaagucuccccauauggcuuucgguuucuucacuacaguguuuucugucagugcacaauaucugugacacugguacauccucggcgugccgacuguacaaguguauuuaccagccauugcucugaaaaaggcucauccuaacuuuguuucaaacgauaaccuugguggggguucuuaggcgccuuugccuaggcacaguuauuuuugcuuuuguggaauugccggaucauagggcaggcgucagguuuccugggcuguuacucugaaaggguagcaugggacaccgccuuccugacucaguugcgucuuccccauggacuggucgccugguaguaggucggcugccaggcucccauuccucagcugcacuacguugaguuauguagucacuggaguagugaagaauggguagguugagaaugaagacgcuggagauccugcuugaauccgaagccacagguagcaucaugaaagguuucuaccuuccacagggugucuacaaagcacccgaucccuggccacugcucauagccaucuugcuucucugccuuuggauauuagugaaggauguccgucuucacagcugcaagggcuuucuggaaugaccuccucugucuacgcuccugucaugccguucauuuugggguagcuaggucuccuggugucaggauuccuccugacuguggugugcuuagacuuuuccuggggaacuuguuaaaggaccagugugauucaggggggcuguacuuggagcagguacuggggcaggugugaucagcagcuuuggucuguaguccacucuuccagacgagacacaggagcuccacagcaggguuccugaccuugcugaaccccagagccagccggggugugcugggguguuuacauugugacucucugcaaccauacacagaccccugugucgugucaguguacaugcgguuccuguacccccacauuaguuuugucuguacuguguuuuggaacagaaucucauuauguagcccuggcuggucuggaacccacccugugcacaccuugacuucguagauccacccaccgcugcuucccacgugcugggacuaaaggggaccaucaccaugcccagcguacuacacucuucauuggcuucuguaauaccuccuuuucucucccuacuuuccuagguguagcuacuucacaucgacugacuccaagauggcaauccaguugcguucgcucuuccccuuggcguugcccggaaugcuggcccuccuuggcugguggugguuuuucucucguaaaaaagaucggcucagcagcagugauaagcagguggagacacugaagguuggcccugccaucaaggaccgacggcucagugaagaggccuguccuggaguccugucuguggcccccacugucacacagccuccuggaagggaagagcagcgcuguguggacaagccuucuacagagccccuggccuugccgaggacucgccagguucgacgaagaucagaguccucaggcaaccuccccagcguugcagacacgaggucgcagccaggaccgugcagagaugagaucgccaaaguggaacucucccugaugggggacaaagccaaaucuauuccucuuggauguccgcuucucccaaaggaugcguccuuccccuaugaagcaguggaaagguguaagcaggaguccgcacugggcaagacuccuggaagaggcuggccaagcccguaugcggccucuggagagaaagcgagagagacaggugggacagaggggacuggagaugcuguguugggggaaaauguaucugaggaaggccuauugucccaggagugugucucagaaguggagaagagugaguuuccaauccuggcccccgggggaggugagggagaagaggugagccauggccccccacagguagcugaacuuuuaaagaaggaagaauauauuguugggaaguugccgaguagcuuuguggagccaguucacucagagccgguuaaggacgaggaugcguuggaaccccaggucaaagguagcagcaauacuucggauagagaccuggcuggagagcuggacaaagacgagaccgugccugaaaaugaccagauuaagcaggcugccuuccagcucaucucccaggugaucuuggaagcaacugaagaguuucgggccaccacagugggcaagacuguggcacaagugcacccaaccucggccacucagccuaaggggaaggaggagagcuguguuccagccagccaggaaacuagcuugggacaagacaccucagauccugcuuccaccagaacaggugccacugccagcccuucagcagaagcucugccaccaaagaccuauguaagcugucucagcagcccucugucaggccccaccaaggaccagaagccaaagaacucugcacaucacaucucccuggcucccugcccaccgccagucaccccccagaggcagucucuggagggggcaaguaacccgagaggugaugacaacuuugucgccuguauggccaacaacagccagaguguccuuucaguuagcuccuuggggcagugcucagauccugucaguacuucggggcuugaagacucuugcacagagaccaucucaagcuccggagacaaagcuaugaccccaccacugccagucaguacucagcccuucagcaacggggugcugaaggaggagcugucagacuuagggaccgaggauggauggaccauggauacagaagcagaucacucaggagguaggaaggucuuggggugcuuucuugaugaaucugggaggggucccauuauuugcuagaaggcaacaagcuacuggccacccuuaccuucugccacuugugcaacaaaacaaugcugcccaucccuguguuauccagccaccuguacagauggauacccgagaagucaggugaucacaugagacccuaauggcuaugagaguuguccguggguucacuagccagggaaccuccccagaccuuuagaagggaccacgucuguuggguccaccagucagccuuagugccucuucuccuuuggacacaugcccuuggaggggccuuuggggccuccuuaguggucccucccaagugccaggaaugggugagcaucucuuaauggccgacuuccuuuacuuaugugcuuguuccgugucuccaccugcucuccucagaagcccucgaaggguaaguucacccaggacagccgcagcuucgagcgcuggugggaggcucgagcugucugcgguuguugcugugaucgccuccuuugcagagccucagccguccuuucucugugcaguugcagcuccaccccaggaaagagggcacuuugguaacggagggugcacuggguuuuucgagugcugaccccagccagcguagacaguucagaccgcuaacuuacaggucagcagcagcuccugacccugcuuugcagcuccccgggguguguucucuccuagugaccuccaagcaggucauggcuuguuuggcccggaguguucccaaccgguuucguccaggaagcuugggcauuugucucggguguuuuacuauugucauuagaaucugggguggggguaccacacuucgggauuuuuacacccaagaugcuguugcuugagacuugagaccauggugacuuaacauaccucuaaaaggaaguaccuucuuucugcccauuguaacuguggaggccagauaauguauuauacaucuuaugcuauagugcuaaaaggcuaagauuaaaaaaaagaaugaucgggcgugguggcgcacgccuuuaaucccagcacucgggaggcagaggcaggcggauuucugaguucaaggccagccuggucuacaaagugaguuccaggacagccagggcuauacagagaaacccugucucaaaaaaccaaaaaaauaaaaaaauaaaaaaaauaaaguuaaauuaaaaaauaaaagaaagauagaucugcaucuuaaaaugggcaaaaaggaaggcuuuuaaaaauauuuuaagaauaaagaauaaagaguuuucuauuuguccggugcccauuauuguaaugaaugagccccucagguuuguagcuguguggaugccugaggcuucugagcauagcucuagagaagagaccuuaaucaauggguggggaggcaggguagcccaucagucauagccuggggguagugacuggggcguguucagcgggugccaagccacacugguguuuucagguuagccuuaacccugcuugugugcuucccuagaggccggagguaaggggcugggcugggaacaaggccuggcguggcucugaguuacuccugggagccacugacacgcagguauuggcuagucuaguucucuuggacagagguuaggggcuuugugguaaaaucccccaccagccuauuuuacuucaagauggccgcccaaggugcugcuuucucgugugggugggugauguccucugccggaagucucgugcugagggaggucacuugagggagaucaccuuggaggucucuuccuugucuagggguggagaguggcauagucuuuuuuuuuuuuuuuuuuuuuccgagacaggguuucucugugucguccuggcuguccuggaacucacuuuguagaccaggcuggccucgaacucagagauccaccugccucugccuccugagugcugggauuaaaggggugcaccaccaccgcccggcaggcauagucuuuuauauccagacaguguauggauugcuuggaaaagaaucauguccugaguuuggggaaaccaggugggaaauaggcuuacaggagugauguguuucaggccccauugaguuugguauuucagccagggccguaucuccuaacuugcccuggaugucccugguguuuauuugaucuccucuuccucuuccucuucuucuuccuccuucuccucuuccuuuugucauguccuauggaagaguugaguggccuaaguugguuccagagucacauucuccacuguucucuuggaguaagcguugguuucucucaccaagggccuuuugaaucaucccauauucagagcuucacaagccugucccaaaaggggaaggaaggaggcccaccugccuuuguuuuuaccuggcagagauuagcaggcccucagcaggccggagaaaugggacccucagaaggcuaucuuacugugauugcccaacauacccaggacacccucuccccgaagccuuguccuuggagacuagagauccuuggucugaggggcugggacauuuggaaagggauuaaggugauugugacaagaaggucaaggcuugcuucuggaacuauguagaucugugagucaucuuguuggcucccuuccccgauauacccuguauaagccccucccuggguauagaguguaccucuuccuagcuuaccacgugugugucuguccuagcagcuguggcuaggcacggcugccagauaagcaagcaggacuguuuagugacgggcuaaaauuaggugccuuaguacgcuaagccuccuuucauuggguugccugagccuucuagucuguggugucugccaagcuugcagagggguauaugugugcaggaccccccagaauuguaaauuugggaagcuuugauaguuacggcugagcuggugucuguguguguguguguauauaugucacuuccuccccugcagguucugacgggaacaguauggauucaguggauagcuguugcgggcuuaccaagcccgauagcccccagaguguccaggcaggcuccaacccuaagaagguugaccuuaucaucugggagaucgaggugccaaagguaagggcagugaccucccuguacccuggauucugugggagcucaaaguucccucagugacaggguuaaaggaugccagcgaauuccauuagauggaccaagcugggaagcugcaggaagaccaucuucccucacuucccugcuuucuggguccuccaggcugcucuguguggguuggggcucggucuucccugaaugcuagaaaacaucaguuggaggagugagcgccagagccucccugcuccucacuguaaaggugucuagaugacuuagcugagcucagcugcuguaaaauccagagagccuggggcagaagcgcaggcaggcaggcaggcaggcagcccgcccugagcggcugugugugagcaugcucauuccccucaccucacacccugugauuacuaaacaagccaagauuguggugucuuaauuaauacuucuaaauauuuaacaauuuaauuuucccgugcugguuuuuaaaaacauuguuuuaacugcauugugcauuguaugaauggcuggugcuucaccagcccccagcgccugaguaguuuucuagccccuugcuguuagaacuuaacaacuuauuaguguuuaucgccgggguucagaaguaauuggcagacuaccgaaucccagggcgcuuggcuccaugcugagcuggggagacucagucugaacuuugggucaagacuccucugcugaccccgggcugcuggcucccaugguaguuuccuucccucgugaccuuguuaucaguccugcccucaguggucacagagggcauagugaggcaggcccugggugaguagggaccgugucccuugccacccuccagggcuggggucauuaagaauuguugaggagcuugucuuacauuaugcuuacggcuggcgucuucuguuugccgugaacucuggugcacugggcacuuguauaugcuguuagugguagggugggaguguugcauguucucgggcuuucacuguccaaccaaguuccucugucuguggcccugagugaggggcaaggauggauguucagaauuugagucaacucuuauagcaguggaucauucagcgugugugugcccgcgcgcguaggaggggugcugugauauucugggucugggccauaugguugggaugagaugcugagucccaggccaggcugucccuuucagcugcugagcagcuguguggucuuggguggguuccggagcaugucucagccuguuucucuucauguguaagacgauaaaguugucugaccauagguccuauaagugaauguaagugcuuagaacaguucugaaaacuacaugcugacaguaacagugugggcuugacugagccuggguccucgggccucgaggagcuggguuccugucacccucaucucucucuuucccuggaagcacuuaguuggucgacugauuggcaagcagggacgguacgugaguuuucugaagcagacaucuggugccaagaucuacaucuccacccugccuuacacacagaacauccagaucugccacauagaagguuaguggcaucguggcccuuugcucagcccccccucccugaaaugcaaggcagcagcacccugguugcagcuguccauuuggaaguuuagccucuaaauagaaacuguggguuucuaguuaguuggagggcaugcugggugucuucccgucagaccuguccaguuucaggugcuugugggagacucuaucccucugcaccgugucucugucuggccaggauaaggaugggugcucagugacaggcccagggccugucauccacauuucccucacagugcauaggccccuucuggcugaguccacuugugccuuucccaucugccagcuucuuuauguguucaaagcaugggucagcauggcaaagguaccagaggggaguggacuuacgugacuucguuccuaaagcaaagccacacguuuggcaucuuagagacccuugcacgggaggauuccgaggaggcccuggggggggggguguuggguguuugcugucacuuuucuucuacccacagaggccguguguucuguccuuacccguaggcugugugucuguccuuacccguaggcucucagcaccauguagacaaagcucugaacuugauugggaagaaguuuaaggaacugaaccucaccaauaucuaugcgccaccacugccuucgcuggcacugccuuccuugccgaugacgucuugggugagcauguucuacuggaucucaauucuugacccuuucccuaaacguaucccaguugagagacuccuggcauccgggccaagcgggccgaggggugugugcgcuccccgcucuggccuccacgcaguucugcuggcguguucccugaaggcaggauagagugcuggcaagaagccggggccucuugaccccacugggagggucaugcuuuccugccccccaggcaugcuuucuuuuuucuagguuuuugacuauagaggacugagcuaggugacugggugugggccuucugaaaugcuggggcuguaccuagagccacucacuccccagcgccagaguccuggguaggguuugccaguaaggauuugugugcgacuuagaugcacauucuucuagucagcugggcuggauaguggcccuggcaaaggacccuuuccucgggaacugccuggauuuuaguugguaaaggcagagucccuagccuggaagcccaggagguuagcagaagagaagguacugucugcagcagccaugccucuggugcuccuugggccuccuguugcuggaagugggccacauucuguuuacugcauuucagacgggcugggccagccacuucaggaaagucgccccuuuggguuuuguuuagaaugguagguguuucagcucagucguccccagccagagacccuugugcuguagggguggaggcaggggucuuucacuuugggcauuaggggauagcguggcucccacucugugcuucacuucugaguuagagguugucccagaaggcuuggcuguagccucucuucuuaaauaauagaguagcuagugcgggugguuuccuucucuuguguucugcuugcucagugggacugcagaggagacuccaggaacuuugaagucagcagggcugcggggucccauagaagucaaaggacuuguucuugggucaccagguuugaaggugcagugcagaccuuccugugugcggagcccugcuuugucgcccauagcuuaguggcagggaaaaggguaccggggcagggggcuuuuagaaagcucugcaggaccugcuguacagugccuuagcagaugaacacaccuacagaccccaucucacaggcggagguggauaugauacgaucgaucuaggggccaaguagaaggcacagaggaguaauuaggacacaaggggaccuggcuuuugaggcuccugggugcucuucuaguuaacugcagguccaaagaggccugaggcagcccaccaguguucuuaggcauguuguucugagcaaacugcucacucccauacuugcuuuccuugacuucagacucauguucagcaguuaggagcacugcuugcucuucuaguucaaaucccaguguccacacugcagcucacaauugucuguagcuaugcgcgcgugugcgcgcaaaauauccauacuggagugauugcaugcuccaggagauggacccuugucacagagucagucagcacugcauauacaguuggccucuggcugccuauuuugggcuaggggucuccccuaucuuaucugaaggugagaucgacucuaaaggcaggucuggguauuacaguacaacagccuacagaccucugcuaucugggugccauguuccugauggcuaugccaguucaugggcuugcccuggggccuugugacauaaacacgagaauaacaguguuggcugccucuuccuguccccuagcucaugcugccugaugguaucacuguggaagucaucguggucaaccaggucaaugcugggcaccuauuuguccagcagcacacacaccccaccuuccaugcacugcgcagucuggaccagcagauguaccucuguuacucucagccuggaauccccaccuugcccaccccaguggaaaguaagugcuaccuagagagucagggggaguccuggugccugguuaggacucuccaagacauguaggcaaggaggguugcccacauuacccuuggucuggaccaggaaaagacuuguucaggacucccuugugugccagcguccauaaguucuugcgcuguuaugggguuauacugguuugaguuuucuggcuagccaguguuagcuugacuggccaaagcaguacagauuggagugaugucuugacgggcggacucuucuuuuaaacauuuuuuuaaagauuacauuuauucauuuugugugacguguauuuuugccuguguguauguauguguaccaccugugugcuuggugcccauggaagucagaaagggcuucagguccccuggaacugaaguuguggaugguugugaaccacuguguugguacuaggaaucaagcccaggucuuucucaagaacaauauguccuccuaaccccagagccaccucuccagacugggcuuugugucuucuaaguggggugauaccaggugguacccaggcuugccuaccaggaaguagaguggauaugcugucugugucauguagggcaucgggugugacuugucuccugugcaguggucuggguuguuggcacaugacaggugaggccacugucucugaaacaagggacuugcucagucagcaagugagcagggcugggguaccuuuguuguguuuaucagugggcagggggcuaaaugcaaaauauuuuccccaucuccucgugggcuucuguagucaucuguaguagccccgcccccuggccccaccccaguccccuuuggaagaaugagguauuuuuaauuuucaucagauucucuaaugaucuagcuagaagucaagcucaaacugaaguggaagggaagccagcugcacuggggcuuugccccuggaucaagaccaagugcaguugguuacuggagauccuggaggugcugcugugacccuuaccugacccuucccagcuccugccuucccgaggcggaggcuggauggugugagccaucgucaggccgaauagaccagauccuaggugcuugggucucccugggaccuuuccuuaggcccaggggcugggagguaauucagugaaaugcuugucauaggaugcgaauuugauuuccucuaguuaugagagagagggagggagagggagggagggagggagggagggagagagagagagagagagagagagagagagagagagagagagagagagagagagagagagagagaauaugaaugaaugauaucuguguagugguauaugcuugugaucucagcacugaggagagagacagacagaggacuggaguucacuggccagccagcauuuuuuaaaaaaaggccuaauaucugaggaacgacacaauaccugaggaauggccgcuaaggucauaugcggccuccgcacacacacauaaggcaggcccuugcugaguuuuguacuaguuuuaggcuauaguugugagucagcgguccagacugaaggcccuucaggauuauugggcagcuuuggggaugugcugagcuggguuuccaacgugcuggguuuucccuuguuugucuuuggcucugggacagguuuuguggaggauucguguugucccugucuccucccggggaaaaugcaugccucugacgaugcgggaggguggggagcaauggccaggggagcccucacagcccugcccuaggccagacgugucccacacacuuguccucccacccugcagucacgguuaucugcgcugccccuggugcggacggggccugguggcgagcccaaguaguggcuuccuaugaggagaccaaugagguggagauucgcuacguggacuaugguggauauaagagagugaaagucgacgugcuccggcaaauuaggugagugggacuccuuggccagccacaagucaccccugcauggugugcauggcucaguucuacccagcuucgcggggcgagagucuucccuccugcugccagcuuuauguucacagucagauguagacaagcgugaugaccugccucggcuacacagaacuagagagcggcucugugggagaagccccaagggccaggccucaaaaguaugagagacgcuugaguuuggugaaggacucccucugagucaggcuuguugcagcuguucgccugcacucgggugugcuggguagaugaugaauucagggacugucaaccaugucaaacccaccccuuucuugccuuuccaggucugacuuugugacccugccauuccaaggagcagaaguccuucuggacagugugguuccucugucagguaacaggcgaacccccaacugccgagggaagagggugaggaacacuggcgcacggggcucucgccuauagucuguguuguguagacauaauugcugucacuguuagcuucugguugaauagucuagacugaggccuggggucucagauuccuagcaaguccccaggcaaagccagugcugcuguggccuuguucagggucugcugcugucugcuccuuacccagcugccagccugagcggcuccauugagguccuucagaguguggcccggagaggacaggcacgcuggucugagagaucgccuggcgguguggggacugugccagcccgugugucugagaccgagagcauugcuagagagggugcuggccucccuuagcuguguccucuggcacgacgggauggcgccugcacaucagggaggcugugagagacacacguacugauguaggaaguggucagaucgcagcucucaagccguagggaagucuguguaacccccugcccucucccaggccggccccuucggauccugcuguguccagagcaguuuuaagugcucaagacuuaccacaguguaaccaggcuugguguugcacacuugaaauccuagcauuugggaggacagagcagggggcuugccaugaguuugaggccagcaugggcaacagaagcugaaguccagcugagugucugccagagcuccagcaggcucugucuuucccucuucucuuccuaaccuuucucucuguucuguccaucuaacaaucugaccagacccaggagaacaggcccugccuugucacagacucgccaccauacuuucuaagcuucgccuuccaccccacuacuuccugccuuggcacauucuuuucuuagauauuacuuuuauaagucagccaccucgaguccugcccauuagaggguauccacccauacugggcccauugcuggggcuagaacgcugccuaguuccaaucccagcgcagugggaagaaccaaagcagcucaggagccaaggucagaggcuggcauaguagcugucuacccacugugcaaggccucgcuccaccagcgaccuggaaaagagagaauucuugagaauucugcauggcacccaggggcuaggucucaaaucagcguggguccaagucucccuuugggggucagccuuuccuauaaaguagacaugcccuccugucuucuggggcauugcugguuugguugcaaucacacaaacuuguucagcacagcuggccccauucugugcacccuaugccuuggggaacacaugcagccugggcuccccuguguuuacacacuugagucaccagaggcauaggcucagguggccagguggcugugcuacacacaguucugcagccugcagggucuggcgcagccuauagguggacgagccuguuuugucuuuuucuuccuucuagaugaugaucauuuuucaccggaggcagacgcagccaugagugagaugacaggcaauacagcacuguuggcccagguguguguguggggggagcaggaggcuggcccaagugugguguguauguguaggaggcuggccuguguuugggugggggggcaguaggaggcuggcucgugugugugugugugugugugugugugugugugugugugugugugugugugugugugugugugugagagagagagagagagagagaguguaggaggcuggccuagguguguggggggugggggguaggaggcucgcccguguguguguguguguguguguguguguguguguguguguguaggaggcuggccuagguaugggggugggguggggggcaggaggcucgcccagggguguguguguguguauauaggcuggcccagguguguggugugugugugugugugugugugugugugugugugcguguguguaagcuagcccaguguguauaugggggcaggagucuagcccagguuuggggguaggacagaagguuggaaaccagccagggauugucaguggaggcucuugccuagugcaacuaaguguccagacuucuugagaucugacacuuaaaauucuuccuguccuauggucaugagccuggaguggccugcagucgugaagaagugcauaaggcaggccuggcacacuccuugaaucgagcacucuguaggcugagagagggagauuuugaguuugaagccuguguguuacauagaaaaacuugucucacaaguuuuaaguguguacagccuaagauguuuucuaugucccaugucccuccaggugacaagcuacagugcgacuggccuuccucugauucagcuauggagugugguuggagaugaagugagucugcccccuucgucccagauccugacugggaacuaguucuggccacuguuagcaugauuguggaccagugccacaucaugguugggggugaugauauuagugucauguaauggguggugccauguagugucaugaagcuagaugugcuauugaacauguaacuucugggacggucucucccaacacaaaguacccuuaguuccaagcgggggagaccccacucuagaccuuccaggaccucuguccauuguuccuauccuuaccaucaagacucgguuucuucaggauguuagaagccugugccagagggcacaacauuugaguaagaacccuguugugguuuuaugcgccaggucugcacccauucccuggcugaugccuggagacuuggguugaaggacccacgcugacuugagaccuagccccuugggugccaugcagaguucucaggaauucucucuuuuuuuuccaggugguguugauaaaccggucgcugguggagcgaggccuugcacaguggguagacagcuacuaugccagccucugaccuuggcuccugaguugcuucggucuucuuugcacuguugagaguggguuuggcacccaggacagaguuuuaagagcagaguaacaaacacuguucucacugagucuucuuuccccauucuguaguccuguggaggaggaggguccucccaggaggaccuguguguucuuucaaagccuuagaguggcgcuacaccggccagcuggcuuagcugcaggaaggccucuuagccaggcuauucccauuccauccgcucccuucuccccacccaaaccccacacugcagcaggcaggccagggcggguguggggcuggcugagaggaucaauuuuagagucuuuauucagggagugagacauggacuaauugguaucgauucccuggauagcucgcuuggaugaauugaugguguuuagcaguuuuuauauacuuccuccgggucucuaggaacucagacuuuuuuaaacauagauguaaauaaggaacaguuugucacaccugaccccagugaguggggggaagggcagcuguuaucuugccaagccugguuguaauuuguaaccauuuucuauuuguucgaacucuguaaauaauauguuuaaagauguaauauuuuguacaagacacacuggagaacaaagggaacucaaaacucuuccacauucuucccgaggaaaucgacgacguccauccgucccacagagugggaccgaccgccccugcugcuccagccagggccccugcgcuuccugugcagacaggaagcugugugggagacugucauuugggaauuugauuuuuuuuuuucuguacgaauuuaaaaaaaaaagaaaaaaaagaaacuucauugaauuaccuugcagugguguugacucuuuuauagacugucuuuagcauugugcaauuuaagaauaacuuaaggaucuuggacuuuacauaaaucuugaauuguauaaacucuaaccuugaguccauuuuuucuucaguggaguggugacaaagauuuggggcugggacuaagggugguugagagugguguggccagcugugacucuccaagggccaucauaaaagaaagagaagacccaaaaucuuggaagacauuuuggccugcucuucccccugcccccaccagguggcaacccagcuuacucuggcuccugcauucagagaacacugggugugguguagggagaggauguagaagguagaagauagagacacaggccucuucaggccugaugacaccagagugcuucccuugggauggguuagguguugagacaggcuccucuggccagagccguagggucugggggaggguguagauucuuggucucucagaucuuaaggucucauccucggagggugaucucaugggacaug

SEQ ID NO: 6279 - RNA, 29794 nt, Mus musculus
ugaugaguaauucauuguuuagucaacaggaggcacgagacacaucuggggugaugaguugacagagggcaggacagaucagcuaucagcauccugggcacagcugagugguguggucucugcuccaaauaccuuuggaugagcauggugguacucaucuuuaguucugguacucaggagacaaaagcagguaagacugugaguuucagggccgcccagguuacauagacacaccuggcccgcuguuggaaaaacgauaaagacuuuugaggggcugagacgauggcuuucuguggaagugugaggaccuggguucagauuccuagcuagcacccacauaaaagcugggagcaacaccauguauguaaacccaaaacuagaggggcagagacaagaggucccuagggacucccuggccagccagcucaccgaaauggugagcuccagguuuagugagagauguugucucaauaaauaagauaaaaauaagauaaagaaugacugggggguggggugggggacggggagugguggugguggugcuggagagauggcucagcaguuaagagcacuaacugcucuuccagagguccuaaguucaauucccagcaaccacaugguggcucacaaccgucuguaauggaauccaaugcccucuucuggugugcauaagaacagagcacucacauacauuaaauaaauaaauuuaaaaaggaaaaaaaaaagauugaccagggaagagcuaacguauggcaaguacauauaccacuugcauauacuccucucucccacacaaacagaaauuuucugaaugaggccaaagaucugagacuagcagccaucugucauagaaguaccuugcacuaugugaucacaccacacucuagccguuuguaauucugccaagacaaguaugugaauccccgaguauguuggaccuaguaagugaaugaccaguauuccaucugcaugugagugugggucuugguccauaacugggaaugcagacacucuccuuuguaauggagaggggggaguagcuaaaagcauuuuccaccaagccugaugacuugaguucaauccccaggacccacaggguaaaaagugaaaacugaccuacacacacacacacacacacacacacacacacacaccccuccaccacacacacacacuacacacacaugcacgcacacauuuaaaaauaaaugaaauguaauaagucgggugugauggugcacgccuuuaauaccagcacucgggaggcagaggcaggcagauuucugaguuugaggccggcuuggucuacagagugaguuccaggacagccagggcuacacagagaaacccugucucuuaaaccaaaaaaaaaaaaaaaaaaaaaaaaaaaguaauaaacgugaaauacagggagaauauuagguguuagaagguugagggggaugggaaugggggcuaugcagggaagcaauggguauagcaagggcuggggaacacuacuuuguaagcuaauuagaaaaugugauuuuuuuuucuuuaugaaaggaauuugaugucaggaauggugguacauaccuuuuaucccagcacuugggaaggagagaugggugaauugcuuugaguuugaggccugcugagucuucagagugaauuccaggcugacuggccagccaccaggugggauccugucuguaaaacaaaacaaaacaaaacaaaacaaaacaaaacaaaacaaagcugggcauagugacacaugucuuuaaucucagcacucaggaggcagaggcaggcagaucucagaguuccaggccagccuggucuaccaagugaguuccaggacagccagggcuacacagagaaacccugucuuaaaacaacaacaacaacaacaacccaaaagaccaaaaacuaaaaaccaaacaaacaaaacaaaaaccaugaaacaacaacaaaaggaauuugacccccacauuaugucccaacaauucauagggaaguaucauauacccaauaaugaaauuuucauggaauaacucaugucuucuucaagaagcauugucggcccauguagaguaguacucucuucgaauugccaucguuguucaccauaaccauuugauaagacuuuauugcugggcuggagagauggcucagcaguuaagaacacugacucagagauccugagugcaauucccagcaaccacgugauggcucacaaccaucugucaugggaucugauguccucuucuggugugucugaagacagcgacagugggcucauauauauauauauauauauauauauauauacauauauaaaauaaauaauuuaggaaagaagacuuuaaugguaaauauagaauauacuuuggauugcaggacaaagaaaucacaguggaauugucggaaaaaccugcuucuugcuagcuaacuuucaaaguccuggaagguguuuaguaggcuacuggaguagaaaaucauuagugguuuucuacagacauaauaauucaacauuacuaaccugcagaugagauguguucacugguacaguagugucaugaaggcaauggggaaaaccaaucacuuucugauugaauuugaggcccugcuccacaggaaggaauucccgcuuggaccuguaaaacuggucaaaacccccugggucaggaaacauagaccacagguggugaccuauuucuguuguuuuauugaauggacaugaugucaaauugccuucuaaagguauuuauguugaagccuagagcuuaaugcuguucacagucuuggucaggaaagcuuaugguuaaugcagagacucauaauuggggauaauaagugugaaugcucaggcuaaauagaacauguauaucagccuucaccgagcuuagggaacaucacagagaaagcgaaagagcgaauguaagagcccagagauggggaggaucgcugagagaugaggagggucccugagaaauguggaggaucacugagagaugaggaggaucccugagagaugcgcaggaucaccgagagaugcggaggaucgccaagggaugcggaggaucgccgagggaugcggaggaucgcugagagaugcugucuccuggccaaggcacagcccuugcacucgugaacuaacagcagcugugaggaccuacacuagaccuuuccaagaucaagccagucaacauuccggcauggaugggggaggggcccuugagucuucaucccuaguugaggaguuauuuguuguggaaaauuuuaaucccaauccaagguuuuuacccagccuuugaucuuucaguuucgggauaaaagacucacaacuuuauuauuugcaauaagccuuaaacagcauaagagcuggcagauagcuacccuugaugcaguuagaagcuacuuuccuauagauaaccagaguuaguacuuaauauuuuucaucugggcuacucuuuuuuuuuuuuuuuuuuuuuuuuuuuuuuuuuuuuugauuuuucgagacaggguuucucuguauagcucuggcuguccuggaacucacuuuguagaccaggcgggccuugaacucagaaaucugccugccucugccucccaagugcugggauuaaaggcgugcaccaccacacccggccaucuggacuacucuuaaguccuauuggccagcccuaagucccucaggaccacauuuucaugagcuuaccuaacccagggaggcuucauuuucuucuugcaccaucuccccaucucccccucaugguucuccuccaaccccaagcuggggaaucuuaaaccucaccuaucuuucuucugaauauguguaugaaaauaacagaauaauaaaaauugcucucucuuucucugucucucucugucucuuuaucagucucugucugugugugugcacgcgcgcacacgcacguguaagaaguaucagggcugaggaguguaacucagugauagagcauuuaaaaggggggcuggagagauggcuuguggggcaaugggcuaugcacagacagccuagucuccaguugagcuuaggucuugaacccuggugggacccggugggugguaauuuccaccuacaugggucggaaggcauucaaucgcuucuccuggaccccuggcuccuguggaaguuaccaccuccacagcccccacaggagagcccuguggcuaucagucacaccaagccuucccacaugcaaauaagguuuucgccaagcucucaguccaagccaaugagagguugaaaucugaaucacccccagaacuauauauaaacccauccagggaacuaaaggugcaccagaacuacuccuuccucugagucuuuuguuccaagagccguauguaacacuugggaagagaucuucucucccgaagagccaccugaggucccaccgcacuccacacuggauagucggcuucugguuggcccagcccgacccaauucaguucagaguuacggagcaaccuggaaggcguggcagagacuugucccugccuguacucgcuucccuucgcuggaacccucacaccaugcuugagcagcgauuuccauggaaaaccucugguacccaggcccacaauggcugagugguuaagagcaccgauugcucuucuagaaauccugaguucaauucccagcaaccacaugguggcucacaaccaucuguaauggggauccaauaccuucucuuggugugucugaagagagugacaguauacucacauaaaauaaauaaaucauuuuuaaaaagucuuuaaaaggaaagauagguggugagagaggugagagguaaggaaagaaagggaaagagagagacagaccaggcacaggcagacagacacagagaaggagagggagacagggagauacagagagagagguuccgaggaaagcuacauuucagagaaaaaggaaaggaagugaccccgugaggagagguggccuuuugauucuggagaacaagagccagcugugcaaacaguguaggaggugggcacagcuuggggaaggguugcucaagcuuguccuguuuguuuuuauagaaaaggagcuugcaggggcugacguugggcaagcuugugaacagguagcagagccacggagggcugccggauggaguagagaggggauggaguagagaggccagaccugggcagaggaagggggacaggcugaugggggagagaugaaagaagcccuuggucucagaagagcuggagggaugcucaacggaucaucacaggaccuucagcauaaagagugaggugggagucagcuaacagaacaucaaagaugaccccauagcagacuaguuuuaugugguguugcuagaacagcaggccaaacagacuucuggguuuguuuuguuguguuuugccagcaugcaugucugugcaucauguguguuccuggugccugagaaggcccaaaaaagggucaucagaucuuucugaacuggaguuacagauggaggucuuagcuuccaugugggugcugggaaucaaaccugaguccucuggaagagcagccagugcucucaaucacugagccaucucucuugcucuuguugcguuuuuuugagacagggacucauauauccuaggcuggccucaaacauuuuauauacccaaggaugauuucaacuuuugaaccuuccgccucugccuucuaagugcuaggauuauuggugugcacuguccuacccaguuuuaugccguguaguuucaggcaugcucaaugaucacuccaccaacugagcuacaaccccaaggcugauucuggagacaggguguaacuauguaucccaaccucuuccugucucagccucccaagugcuggaaugacaggcaugaauugucaucaagucuggcuuggucuaaauacucuuuuuuuuuucuaaagauuuuauuauuuauuuuauuuauaugaguacacuguugcugucuucagacacaccagaagaggguaucagaucucauuacagauggcuguaagccaccaugugauugcugggaauugaacucaggaccucagaaagggcagucagugcucuuaaacacugaguucaauucccagcaaccacaugguagcucacagucauuuguaaugggaucugaugcccucuucuggugugucugaagagagugacaguguacucacauacauuaaauaaauaaaucucuaaaaaacaaaaaagucaaagaucaccuuccugaguucgaggauuaaagugcaccccacugccuggccuaaacuaauuucuuuaugcugagcacuaccgucagccuucugagaugacaugaaaacugauuaguuauuacguugugaauuugaggcuaguuugagacccuauagcaacccucaggacugaucagcgaaucuuagacuuugcugaaagcaucuacuaucaacuucaaaauauucucagaggcuaaggugcgucgaacaaagaucugcuuagcuuuuacuauuucuuacuugguuugguguuuuugaaacaggauccaauguaagcugaggcuagcccugaacuucugauccuucagcuucuaucgucccccacaccccaccuccaccaccaaguguguccuuucugguaugcacccuccccacacaccucuguuucuauucucagccuuccucuuucuuuccuuuucccccaucucuuuccuuccuaccuuucccuucucuuccucuguuuucucuuucuuuccuucuauuuauuuauuuacuuauuuacuauauguaaguacacugucacugucuucagacacuccagaagagagcgucagaucucguuacggaugguugugagccaucaugugguugcugggauuugaacucaggaccuucagaagaacagucggugcucuuaaccacugagccaucucaccagccccuuuccuucuauuuauaguugaagucuggggauucagucuaggacugugugcaugcaugcugggcaagcacucuaccacugagcuauauccccagccaaaaucuguuuuuuaguuuuuaauggcugcuaacaucacaagacauccauagauacuuuuuuuuuucccagcgcugaagaucuaucucagagucuugcacauaccaggcaagaacuuuacugagcuaaaccccuaauccaauauagacaaauuuuauguauaaguuacauaauaaguuuuuaaggggcuggcaagauggcucagugguuaagagcgccgacugcucuuccgaagguucugaguucaaaucccagcaaccacauggugguucacaaccauccauaacaaaaucugaugcugucuucuggugugacugagacagcuacaguguacuuacauauaauaaauaauaaaucuuuuuuuaaaaaguuuuuaaaccgguaacuucccuguuacccuaauucccucauuuccagagaaaaugaaagaaaaggcauccuagcgcuccuaucccucaggaaagggagggucacagcugcucacagugggagacaggcucauaaucccaucagcaccgucuacuaagauggaaaugcgacuuccuucugcuugcgcuucucccccucagccgaggcugccagcucuucuugccagguuguuauuuccuuacaugguacagaaccacacgugcgucuggaaagcuguccugucuuguucugcauuauauauuauaaaaaccuacaaaucauacagaacacaacaaacgagaaacguaaaauccccaggagcaggcucggguucuauggggggcggaguuacgauuacuuauguuuuccuugcggggcaguuucugaccagagaguauuuacucuggagauuaucugaggggauuaaagcugagugccccccucaguagaucucacccugcggugcguccgacuuacguguggaauaaauacagguuugucucaccugcaacccucugagucugcagugagaagcucagauguggcucuaacugcccucugcacgccgcucugccacccacuccgccggcgcugacccucuccuuugucuucucucccuccuugcccucccccauuuuccccaagucucagguagcaucgcuugaacuaaaauuuccucaguaggucagaaugaccuugaaauccuuauccuccugccucaagcucucaagugcuuggaucacaggugcucgucaccacgcccaguguacgggguacugggaaccgacucaggacuuccugcacucuagguggacgcuuacuaacugagaucuauccuaccgguuuuuuaguuuugguuuuauuaagacaaggucucucuguguagucuuggcuguccuggaacucacagagauccaaguaucuaugccuucugacuacuggaauuaaaggugugagccaccccucuguuuuuuuguuuuuggguuuuuuuguuuuuuguuuuuuguuuuuaauaagccauuucuuuuuuucuccccaccccucugugcuggagaucacaucagagccuugaauaggcuaagcaaacacuuugaacucauccccaaccccacuaaaccauuuuuuaauaugccccuugccuaauuuuuuuuucugauuuugguuuaaaaauaacaauaaggaauauuuaaaaggaaaacuaguaauuccaaaucaguuguccaaguacuaacauauuauuucuguggcucuauucuuaauuauguguaaagaccuuuaaaauuugacacuaagcacuuugauacuuuuaaauuuuuucaugcagccauauagugacagaaauugcuaaauaguccaucaagaguauuuaccuguaccauaauuuagcuaaccaggucccuauuggugggccuuucagcugugacuuuauuuuucaguucucauaaagaaaaacagcaacaaguuguugaacauaaguggauuuggauuuucuuuugagucaguucccuuggguaguuuugugggaagcugguuauugggucaaaggauaggaacuggguuuuuuuaaugacucuaguuaaugauuacuaaauugcuuccucagagauugaacagaucuauagagcacccucucccuggcauaaucccugagguuucacgcacugguggccaguacuacuacagauguagcccauuaucccaugauagauggaagagauggugguuccauuuuaucagucacauuaccuuacugagaaggcgagaacccucacguguaccuuaaaccauuucuagauaucucauaauaucuaacauagcauaaaugccuuggaguuaguuguuuuagugcauugguuaggggauauagugacuaacaagaaaaaaguucauacagguucagaauaaauaauguuguuuuuuuuuuuuuuugagauaggguccuagcuauccuaggacucacuauguagaucaggcuagccuugaacucauagagaucugcacgcaucugccuucugauugcugggaucaaaggugugcauccuaugcuaggcuuaguuaaucuugguguguagccagcccagccuggccuugaguuuuacagcccuuuucucuguuucacuugcccuagugcugggauuccacaagugcacuuuccgaguauuguccauccucaguugauuagacccucgaaccuggacccuuggggagaugaagggucaacuguacaucacuugcuuuccuccauuauauuauuggaucucaaggcacccaucagcuguaauuuguuuacaaacucauacuuguuuuuguucuuuuuuuuuuuuuuuuuuuuuugguuuuuugagacaggguuucucuuuauagcucuggcuguccuggagcucacuuuguagaccaggcuggccucgaacucagaaaucugccugccucugccucugccucccgagcgcugggacuaaaggugugcgccaccacgccaggcuguucuccuucauauacauauauucauaagcaauguauuauagguuuuuagaaauguuauuuaaauguggugaaggagaugccucagugugguaaagugcuugucccauaaggaugaaggcuugaguucagauuucccagcauccuugugaaagccaggcauggaggcacaggucuguaaagccagugcuagguagcagggaaagguuagcccuaggggcuuggaaccagccagcuagcugaaaaagaagcuccagucucagugagagaacccauguaaaauaaauagguagauagagcgauugaucaauugaucgauagauaaaguagaggcccaguugguaaaaggcacucauugaauaagccuggccaccugaguuugaucccuagaacccaccuaaagguggaaguagaaaauaaacucuauaaaauuguccucugaccuccacguagauaguauaguaccaagaaacaaucaugaauccugaaagaccaaucaggagcugaucugaugcaaucacacgagggucuuuauucacaagcuugagcuugaagauauaacucaccugagucuacacagccagaucaucucucccaaauaaugagaauucccacuuaacaauguuuccaaauguagaguacuagcuacuauuagaauccuggguggucacaauguuuuaaugauguguguguguacgugcgugcgcgcaugcauguucucuaggcagaucuacaaccauuuccacgaggaggcacuuucuagggugauggaugaugucuauuuuacuccaauacauuugccugccgccuuucuuccuuuuuucuuugacagauuuaguauguugcccuagcugacuuccaacuccuauguagccacauucaaggaugaucuugaacuucaguuuguuuucugagacaagguuuccccuuguagccugaccaguccuggagcuuacucuguugaugagguuagccucuaaaucacagggcucugcuugccucugccuccugagugcugagauucccagcccgugccaccaucuccuggcuauccuugaacuucuuaccgucugaccuccaccagugcuauaauuacaggccuguguuaucacacccaguuuguacaaugcuggggaccaaaucuagggcuuuguguaugacaggcaggcauugucaaccgagcaaauccuagccaguaucugccauguuuuagaaucccagccccagacaucuaucugccaugcuuuagaaugaggagagccagaaagugguucuggagagauggcagggcaaaguguggaggcuggggacaauggaaacuaggcugcaaggugccaguuucuauauaauaucccccaccucuccugggaacaggacaccuuggcuaucucacccacaaggaagcucagguuucccugaguuaauuaggauugcuggauugcuaugcugcagugguguguagaacagcuaugcaaacuacccagauauacacagcacacuggauuaucuagaucccagcauucaagcagcugcacacuggcguccagcaagcuuagauagccucugggagggcucuaacuguccuuucucagaauaucucucaggcauccaaugaaguagcuaacaggcucacaggacauguuugguuuccuaccuggaaggcuuauguuagcuuuagguagacgccauccugccaagagugguauagauuuucucaugcuccaguuccaagcagaaauguccaguggaagaagcugggaagaguggaggggugggcucugggaaauggcccaucuuacccaggucagccacauacggaacaggagaagaggaacugaaacugggaaaaugcccaauaagaaguuagugauggugacuggccugagcuaugacugucuaaggccacuucaucaaagccauuugcacaagggcccugcccugugaggccaaaggagaggcaggcaacagcuccuguucaccacccacugguaucacauuuccucugaugaauuggucuccaggggcucaggagaggagggcauuguguuaguuuaugaagauuacagugggugaguucaguaugucaacugacuugaucgaaacaacagaaacguaauggucucacacuucugaaggcaagucuaaaaaucaguguauggccggacggcuguagaggaaugacaugguuccuggucuguuccagauucugcugguuugcuggcaaucuuugccauuccucugucccaccauuuauuucuucccaaggcuggagaucagacucaagggcuuugugugugcuaggcaagugcucuaccaccaagcuagcucuuagucuucuuuggcacuccacccucacaugauauuugacuuugugaaucuucuuauggauuagaacugagacugggaaaguagcucacaccaccaaguagauugaauuaguauuucuuccuguaacagcgguucucaaccuguggguaacaaccccugggggggucucacauaucacaucuucugcauaucggauauuuacguuacgauucauaacagcagcaaaauuaguuaugaaguagcaacaauauaaauuuauggugagucuguguggggucaucacaacauaaggaaugcgauuaaagggucguagcauuagggagguugagaaucacuguuuuagaagaacccuaguccuacuggaaagaggcauggccuccacucaguaccugcaacagccuggaaaucaggacgcccuuggagauaaaaugguuuaagacuugagugcaucuuguuuuagaugacacaauuucccccacagcagacgcauuucuguguguaaaacugccccuggaggcccuaggucucuauuuguaguaaagccagccagucagucaaucaguucugaaucagaaaguuuggguugaaauuuugacuuuguugcugcgugggaccaagggauaugaaacaggaagacauuagaauaagagcuuucgaggcuggaggauuaggacaaagagcuuugcuucaugcuagggauuaaguguuggggaguuucaguuucucaugugcaguuagaguccuucuccaacaccucuuauugccuuuucuaggaauagccucugcagacacacaggccuggggcaaaaccaagggcauuuucuuuguaagggaauuagauguagguuggauguguacacauaaaggaaacagcucauauuugucaucccuuggaauaccucugugggcucuuccaaaagaaaugggaggacauuucucagagauguguucuugagacuggagggacugcuaagagaagacagcaccucacaaggagcuagagaugaagccuagcugguagagugauggucugccugcaagaggcccuggguuugauucuccagccaaggccacauaaaccaggguuaucaugcacuucuaagauaccagcauuccagagguagaagugugagagggaaaggaagaagaagaagaagaagaagaagaagaagaagaagaagaagaagaagaagaagaagaagaagaagaagaagaagaagaagaagaagaagaagaagaagaagggggaggaagaagagaagaagaagggggaggaagaggagaagaagaaagaaggaggaggagaaaaaggaaaagaaagaggaagaagaagaagaagaagaagaagaagaagaagaagaagaagaagaagaagaagaagaagaagaagaagaagaagaagaagaagaagaagaagaagaagaggagcagcagcagcaggaggaaaauuuguaggauuugguuauuuucuuccaagugaguucuggaaauggaacucagcuuccagccuugccuuucgccucugagccaucucaucccacacaccuaguuuuuuuuuuuuuuuuuucccgagacaggguuucucuguauagcccuggcuguccuggagcucacuuuguagaccaggcuggccucgaacucagaaauccgccuaccucugccucugccucugccuccugagugcugggauuaaaggcgugcgccaccacgcccggcuacacaccuaguuuuaacguggguccugaggagcugaccucaggucuucaugcccguacagcuuuuacugcguguacucugaagcuaucucuccaacccccuauuuucuauccccccuccucucucugcuuuucuccuucucuucuuaaaaauaucccccacuuugagccagguauggugacacagagcuguaaucauagugcuagaaagaccaacauaaaacaaucacaacuagccaggcaugguggagcacgccuuuaaugccagcacuugggaggcagaggcagguggauuucugaguucgaggccagccuggucuacaaagugaguuccaggacagccagggcuacacagagaaacccugucucaaaaaaccaaaacaccaaaccaaaacaaucacaacuuugacgccagucugaguuaugaguaaaaacugauuuaaagcaaagcaaaaucaaaacauccuuaaguacauauggaagugugugugugcuccccuuuuacacaauuuuuacauauuuguauuuccuauccuucuccuuugaucuccagauuugcacaaccaaaucaguugcuauuugaaaacuaaaaaaacaacaacaaacaaacaaaaacaaaguuaaugggccccaacuaaaccaaacgcugcuugucuaccaguauucucaguucucacaguaacucaagccagugggauugucauucucuguuguuuucuuucuuucuuuuucuuucuuucuuucuuucuuucuuucuuucuuucuuucuuucuuucuuucuuucuucuuccuuccuuccuuccuuuuuaaaaaaagauuuauuuauuuuauguaugugaguacccuguagcuguauagaugguugugagccuucaugugguuguuaggaauugaguuuuuaggaccucugcucgcucgguuccugcuugcuuuggcccaaggauuuauuuauuauuauacauaaguacacuguagcugacuucagauguaccagaauaguucgucagaucucaguacagaugguugugagucaccaugugguugcugggauuugaacucaggaauuuuggaagagcaaucaguacucuuacccacugagccauuucgccagucucucuguuguccuuuucuuaaccacaacgugagugagccucccucucccuuuaacacccgccagagucacugagugaugggucauuaguucaguaucuagucucaagugaauuaauugcgucuuguuuguucccuuacgccacagucagucacuaauccacuauuauuuacagaacagguauggugggacuuaaauuuggguggcgggguggugguagagagaugguuccguggcaagagcaccauccaauuuuccagaggaccagaguucaguccccagccuccuguggaggcuuuaaacuggucuggaacuccaguucaagaggcuccaacauccucuucuggccgucacaagcaccagggacccgaaugauaaauauacauguaugcagcuaacacucauaugcauaaaaauaaucuuuaaaaacaauuugggcuguguacuuugagaucucaacucuguagcccagggugcuuugaaauugugguaaucuucccucagcuuuccaagugcuggcucaagaaauaaaugaagccgggcgugguggcgcacgccuuuaaucccagcacuugggaggcagaggcagguggauuucugaguucgaggccagccuggucuacaaagugaguuccaggacagccagggcugcacagagaaacccugucucgaaaaaccaaaaaaaaaaaaaaaaaaaaaaaagaaaaagaaauaaaugaguuagacaguagauacucaaaauuauauucaguaugcauagucucuuuuuaaaacuuaaaauucacauuugaucaccagugaagauuuuucccaaguaaugguugguucuuaguaugguaccuuuccuauauuucguucaaaaaaugugcacugaaagugcccuguaaugccaacacuuagggagguggaggcaggaggaucaggaguucaaggucaaccuagaacuucccagcuugaggccgugagacaugagacacagucucagaauaucaaaauaaauaagcaaguaaaggaaagugccuagguuuuaaggaucagagcugggcugguuggcaaguggaaccuccgucggauacaauuaucugcagguaguuugguuuucucaagucguugggggaggcagugacucauggugaccauuucuucgaaggcaaacuuugcaaaaccccagaucauuuagagaaaagccccuucgacaucacuaaaguugcgaaaaugagaaaucaacuugcccuugagggcuacacaguauccacauuacugaucaaccaauggccaccuauuauacucgaaaagcuaugcuaugcucgcaagguuacgggaaagccagauuccuaggcaaggggaacaauguagcaucgucccucaccagccucagcaaccuuuuccaggagaggcaccaucccaaggcaggaaccugccugacaccucuccccggagaagaagcagagaccccgugcgagccaaguucauugugccgagcacucagacaccaggaacccaccccagcccgagugugggacguaggggccaucucccaugcccgccgugaauauuguuacucucgcgagagcgccagcaaggcgggcccguacagcuccgggaugucagcggagagcuccugaccgcgccccucuuggcgcagcugggagagaggcgcgcgcaagucgggggagggagcggccgauggcgcgcacgcgcaggagagcgagcgggcgaggggggcacgccagggagccgagggcgaggggcggggccuugcgucgcgccgcgggcacgucguugcgcguccucaguauuuaaugucucuguguucgcccggccugggcuagcacgugggggagcggccgaagcgccgugcagcgcugcggggcagggccgcuggacuagguggggggccagggggcgguggcgggaggauugagugccuagacggucgcccaggagcagguaagugacggcuggcacgggcacccgcccgccgggcccggagagagaacgaguuggggugauggggagccuggggugcaggugcagggugcgacgcgcgcgccagguacuccggggaccgagagccuugugcaccgcgccugcugucaagcgggcgggucugugccuugaugacccgcgcgccccgcuggucuuucccggucccagggcugcugcugacagaucgcgugcgcugagcucggggcgcugcuuuaagccgcugcuuuccccucccauccccccucacgucacuggccucuaggauggaggugagggcgcaauuccccgggcgcuccggugcgccucaacuuucccaaugcuggcucacccuucuggguagccugcccgagcgcgucccaaccaaggucgucuagucucgcuagcguuuacuuuucaaaggucguguguacccaguuuacgcguggagaggaggcacuggggcggucucugccaaggacccagugcccaaggcgggagaggagguccuuggggaccccuucccuuccuaacuuucuaacugcugggcccaguugacucuggguuggcccggcagugguggcaaaccggagcaggaagacacaauuccuggaguucagugccgcgaauuauuggagcggacucugccguuguagcggggagaaugggaugcaagacaggucccaaaccuuuuggcgguggagagaccauaagaccaauuaggauccggaggucgugagcuuggguguccgaagggaauuagaguuuguggccccauaagcauguccuaagaggugggagaccucuagcuagaggugcccgcugacuucuugcggggguggggagguccagggucacgugucgcgccccaccuuucuuuccgucccaggacagugaucuggagggacuuugcaggggucauggggggacuuugccaggguuauagguaaaaaccugcguagagaagccuccauacgcguaaaggagccuacauucuggugucaacuacugcuguguccuaucuuuuccuguuuccuuucuccgggagggaaggugcugauagucaggggcugugcagaagggaccucugagacgcccugugccuaaccggaccuuuucccuccgggaaaugccucgagcaacuaguaccuuuccacccuugggcugugguuaacacaaacccgguggacuucgcuccaggugagaguggaggcuucucaaaccgguaaggucggguguauguguagggcaauuaguaagguuuaaacugccuaucuuuccgcuauugaagucgaggcugcuugggguuuaaauuuaacgccugcagugacaacaggguugcuggaccuaauguaaccaucucgguuggugugcuaccacccucuguauccguguguugcaauuacaauugcuauugcuucgggaaaucaaucuuacaugcucauuuaacugcagaguccuucccaaauuaguaaccgugggguuuuugguuuuguuuuaaacgcuuaacuuuagaaagcgaggcuuagaaaagcgaggcuuagagucuacgggcuuccuacccauuccucucuuaaaggcacaaagcaucuauaaacucugugaacgaguugcucuccugccagagucuucucugauuggcauuuaaguguuucaccuucagauuauuuaggacucuuuuagagcccaaggaacaagugagauuauguuuggggagcuuucuggacuuguugucgagccuucuuucgcuucuaaccuguuuuguagguucuggguaauuccuggguguagucuugugaaauagaaagaauggccuuggguuagaggacauucuccuacccuaaggguguaugcaaaucauuaaagcuucugguuagguuguuaaaucagaaggcuuuguucuguagagugggucaguagcuauccaacccagugggugagaccugauguaaaucuagugaguuugccucuacuuggggaguucucccaucucccagcuaauuguaggaauugcauucacccuuggccucugcugggugacagcagagauacagguaucaguugucuguugccugcucagaugcuggaagugaugugucugagcaucaauacuuuaaaacaaucugucuugcuaccugguaacccagauuauauguggaccugggccccaggcuggucauagcuagaguuuguggaagguaguuuuagcuuccaguuuucuucuucucauccuaaacauggauggagaucaucauauuuaagacuugggacuauuuguagcagaggauggccuagucggucaucaaugggaggagaggcccuugguccugggaaggcucuaugucccaauauaggggaaugccaggacaggaauggaaguggguggguugggaagcagggggagggggaggggauaggggauuuucggaggggaaacuaggaaaggggaugacauuugaaauguaaauaaagaaaauaucuaauaaaaaauggaguaauaauaaaaaaaagacuugggacuauuccuggccuaugcuaggcacuuaaguaugguaucccucacucccaaggaauccguuugacucagucauuugauuagauauaaaagcacucccucgccuagccucugaccuaguaacuugguuagaaggaagacaaauugguguauccaggcuuugccaccuagccuacugggucaacaugucuuggucgcucuagcauuuuaagacaccgaaguucaugugcccuggagcugcccuguuuucccuggcuacuccuuccuaauaucccuugugaguuugccaugccccggcuucucugcggcucagucuuuuccugugugugugagauuuguaucuggcauuugucauccuaagaacuuuauuauggggagauguuuggguucugugggccccaugugccaccgaucucaugucaaguuugaggguugcuaaucucuacaaugggguguguuagguccuaaaucuugcuucauagggcaaauucuguuucuccuuccugguggagucagucucucucaagcacuugggauugguuuaugugugguaaguacuguacaauugagcuucaggcucaagugugccccucccacaccccccuuuugagacaggagucaugccauguacugaagccugccuaaacacacagacgaccuacucacccuuccaagugcugggauuacagacacacaccauaacugcuaucaccucauugucauuagcuuuguuuuccuccucuugauggugugugacagugaggaguacugcugccagcacugggacgacuggggggggggguuggggggguuggggggguguucagcaacaucauucuguccagguccuugcuauuuggaugcuccugaaguucacguuaguaaacauucuguccccuguccuguauacugguggcuuguguucacuuagccuugucacugaugcccauuugcauugggagcaaagcaaggaaggggguuaguucuggaggaaggagaagccugcagugcucaggacagaggacaccugucacugcuggccuuggcuggcaagaggucagggcuugcugcagcucucuaagcuccuaccagccgauuggccaucgggucuauuuuuuuuuuuuuuucaauugguaaaggacacuuggugaacuaaagguguuaaaaguauuuugauuaugggcaggagggagagcuggucaagucucaggcuuauaccuauacaguauucugacucuguaccuagggggcugcuggaggaaugugauugccugccacgcuggggagucaagauuucaucaccauaaagaguuuuggguggugccagucuauaauauucuuuguccuacucuaaacucuuaguuaccucaaccuguaaauguccaaaaagcaccacguuuggguuuuaucguuuauagcucccaaacagaacaacuuuuucaccaaguuuuucuuuucacagcaugcuaagaagcaaggucugguccacagugaggagggggcugagggggcugagggggcuggguucuuaggagauagguugagaaaggaacuuacuaagaggccggugagacucgagcaugaaacagagcgaccagaccugaaaccccuccagagccacuuugguuugagaccuugcucauuacuauaaagggccuuccugcuucuacacgaccuggcgucuguguucacgguuuuuggucugccaaugccauauuaccaggcccgagagcuuccaaagggccucaguaugaaaccucccugcuaaaccaguuugaauuuucauucugugucaguaacagggucugcuuguguaucuuaggcaugugcuguauagcccuagcuggccucauaucauucugucagaacccuccaagugcugggguuguuacagacaugauuucccaguagcccaucuuaacgucaggagguguccuuuacagaaggcagugggaaaagaguggccaugguguacauccagacauguugguguaggauacacuuguggacuuuauauagaugacucuuucauccauguuaugugacaaaacuucccggggagaugcgacacacgucuacucaccccaguuagggaucacaugacagaccaauguguauaccaccaaaguccagcuuaaugaaccaaugagucuuacgggcguuacuuauaggaauaugggggagggguuacuuacaggaguaugggggagggguuacuuacaggagcagaaaugacucaaagacagcugcaucaccacggcccaccccagcaugggucacagcuccgagcugggaacuuggaagucacugcccagccugcaggcagcucaacagguuggagagauccuuucucagcgacucucuuuggucuacaccucuuccaggcagcauggcugguauucuucuaggcugcuguucuggucugagucuuugcagcucuccugucuuccuuguggcucacuuuucccucugagagggacuuucagcuuuuauaguuuacucuggcaaggaggagccuagugaaucuguucaguuucagggaguucuuagcuaauuuuaguaguuuuccuccuuguuuaagugguuccccugcaggauggaauguuugugguuuuuuuuguuguuguuuugguuugguuuuuugagacaggguuucucuguguagcccuggcuguccuggaacucacuuuguagaccaggcuggccuugaacucagaaauccgccugccucugccucccaagugcugggauuaaaggcgugcgccaccaugcccggcuaagauuuauuuuauguaugugaguacacuguagcuguacagaugguugugagccuucugaauuuuuagaaccuuugcucgcucuggucaacuccacucacucagucucugcuuguucuggcccaaauauuuauuuauuauuauacauaguacccuguagcugucuucagacaccagaaggaagaaacgguugacgcaacagucugguccugggucugcuuuguuuggaccuugccaaaguagccuugaacuugaugccucagucuacauuuugcguaccuguuacuauacuccaaauugauugauugacugauugauugauugaaauggggucuuacuguguugucaugguuggucccaggcuccggggcucaaggauucucccucagcuucccaaguaccuaagacuacagguagauaccacugcaucuaccuagcugggguuuguuuuguuuuguuuuguuuugguuuuuuuguuuuuuugguuuuucgagacagaguuucucuuuuagcucuggcuguccuggaacucacucuguagaccaggcuggccucgaacucagaaauccaccugccucugccucccgagugcugggauuaaaggugugcaccaccacgcccggcuuuguuuuguuuuuuaaacauuguuuuuauccuuuugucucugaggagguuaaguaucucuaguuaaaacugagaccccaaauaagauaaauaaggugacuuccagaacacuggaugggcugaucugcuuuuggaucugggaugguguaucuucuacuuccccauauacuggccugcucuguuaucacucccucuucagcuacaauaugaaacugggguguucaagaauuaaaaaguuagccgggcgugguggcgcacgccuuuaaucccagcacuugggaggcagaggcaggugaauuucugaguucgaggccagccuggucuacagagcgaguuccaggacagccaggacuacacagagaaacccugucuugaaaaaccaaaaaaaaaaaaaaaaaaaaaaaaaaaaaaaaaaaaaaacuugauccuacagacugagucuguuaaguguaucugaguuacuuaagccuccuuacaacccuguggagcuauuuggaucgcauuucacaggauacugaaguucagaucuuacucuuuuaacucuuuacaaagcccugucaccauuagggaagugcaccuuugaaaugcacaaguaauuacugaauaagaaaucccucagggcugggaaacugagcagguuucaagacaaccuugaagucacucaagauuucuaauaauaacauugccugucagaccucacauggaggucaugagaccauccccuggacucagcaggcugcuacccaagagaggaggagacugcaaagaucuggccaggcagcccccagacccuugucuucucagccuugguccggcugugccuuuguggggaugagagagcacuccauuuggaggcagcucuuagcucuugccugcuguucaucucuuccuugucacuggagcagaggccaggcagugaccccagcuuguccagcugcccuggagagagaccagcucuugagaauaaccucccuggcuuuguccuuuggcuuuggugucacccacuccaccaagcuugugguuauuuuuagcagguggcauccuucaggggagucaagugcauguggcugcaaggguccaggacagguccuugggggggggggggccaaugcuaccuaaccaggggauggaggagacaagagcggccuuaggaacugcuguagccgcuuuugcucgggaggucuccaagguggccuuuucuauucugaguucaguucagaacagggccaggcaggcaugugacugagaccagcagugagcuagggagcuggaccaaguacuaggaaaugaggaucccuuguuaccgcauuagcuaauuuuccggaaaaacauauuaacguccacuccugucccugccuguuuggugaaguugcccaaaccuaagggcuggccacaaaguagcaaaaaaaggucugaagaaacuauguguugacuggcaguccaguuacuggugucuucuggcuuucaucaaaauaccaacacaggaggggacaaaguggcucuagguaggaggguagguagguagauaggggugucuguguguguguguguguguguguguguguguguguguguguguguaacucaagaacuugugcaugcuagauucuaccucugaguuacaucugcaucccacaccuccuacccccacuaggaauuuuuuugcugggaggaagccaaugaggcggaagagggaugaaaaaggaguuugacaaguuugccugguccucaucccuuucucuccacucucccccuuccuccuuccccuaacucagcugccagcuccagcccaucuaucuguuucugauuaagaaagcuucaagccauauaaggcccucuguggccuaugguuuauguuggcuggaaagcaggguuguuguugcaagaucugauucagaguaguagugagggcuuaugugaggguguguguacuguguguaggugcaccucccacuaggggcuggacccuuuagugggcuagacccagcuugagggguaggaguaaggauacugguccagcaguggcucuaagcuaauauguagugugguuucaggacuuccuggcaagcauguuugccgagguuccggguaaaaauaauuaacugguuuacccacaaagcauaccuguuauguuucuagccaggggugucaugauuuuggaaaagauucuggaggcagcuuaugaguuaagaacaaagcuccuugacacuugaggacaguggucccucucuggaaggauguuccaguauguuucugagucccgugauuccuggaguuuagcuucugugggggauguggagccagccauuccucugaccccuuuuuggccucuccuugcugucccuugagcuagcugagcuuguucuggccccgaggacuugggucguuuucucugccugggucuuuucucucccucucugugccaccuucauccuggcauggcucccacuguugagcucugagaugcugacagcccuucuuccaggaggcguucucucacacuuuugcauacagcuucccaucccauauauauucuccauagcccuuuucaucucaaccgcagggcccacagaaaagcauuuguuaacccucccauuacuuuuacaugcauggggaaugugccaggggugccuuagggcuuugucugugcucucaaccaguucagagacuacaggcauauuacauuaaguucuucauugcauugucuuauuaccugaaguuugaguccccagcccccaugguacuagcucgcaguagguauugauaccuuuauuaaaugauggguccugcuaccuuagcauuggagagccugcugccaugguuccccaaagcucuauuggugagcgcguucucuucuugauuuuucacuguguuaguuucagggguaucugaagcaaaguugccaccaguucucagagaagagcauuaccuguuugugcgaguugacaccacuacauguuuaccuuggguagcaggaacgucacacuguggugauagaguauccuuuguggggaguuuuggcugggcacuguggcgugugcauggaaucccagggcuugggaggccgaggcaggaagguuaugcuuuaaagaugucaggucagcuugagcuacauaaugaaaaccugucucaaaacccaaaccccagaucaacagucagcacugccuauggaaagagguuugcuuaucuguuguucuggagguuggacccagugccuuggcaggcuacacugagguuuugauuauguucaaauuugaaaagacaguucuuugcaggggcuguaugacucagggcucgccuagaauccaccuggcaaaccuggguuugguuccccaaacaguccuuugcuccauuagaacauccuggaagcuaccgggaacauuucuuccuuccuuccuuuuccugucucucucucucucuuuuuuuuuuuuuuuuuuuuuuuuccgagacaggguuucucuguaaagcccuggcuguccuggaacucacuuuguagaccaggcuggccucgaacucagaaauccgccugccucugccucccaagugcugggauuaaaggcgugcgccaccaccgccugucucuugucucucuuuuuaaaaggaauauauuucuaauauuuuauuuauuuuuauuuuauauacauuaguguuuugcuugcacguuuaugcaugagggugucugauuccccuggaacaggaguuacagagagcugugagcugccaugugggugcugggaauugaacccaggucuucuggaagagcauacagugcucauaacugcugagccauuucuccagcccccuuaccuauuuuuaauugugugugugugcuccugugugcgccugccugccauguaugaaggcaccuaaagaggacagagggauuguauuuccuagagcuggacucacaggugguugugagccaccuaguguggggggcugggaccugaacucacgucuucuguaagagcaauacaugcuugacacugcuugcgcuuucucgcuguccugucagccgacuuucaucuguuuccagucuucgagauugcuugcuuuucucuaucuucuccuccucuuccuccuucuguucuucagaaaacacuaucugguuuucuacuguaaaugucugcucaucccuacaccuucuuccucaguuucucaauauagagguagcguaauuugaagguugcuauucauaaacauuaucugugucuacagagcucucagguuauagauauaauuuugucuguccccccaccccccacccuggucugguguucgccauccucgccccucagacccccuuucuauacuuuucugugucuuuccuaguucccacuccucccuagccucugucauuauggcaggcaucaugccauugguggagaggcuuugugguuccgcaucccagcuccuucuaagaguuccacuuugcucugcagaucuaucccuuucuguuggcucugccuccucuuccuccuggggauuuucucugucugauguguuccuuggaugugauaccuguugcacuuuuaacccagcuagcucccaaauaauugagacuggacuauuauauuuauuuaacaagcuuuaagggcacaacagccgaacagcaguaugacuucuucuaaacugauccggcuaccucccagccaaaaucccagagauauuugcauuuuaguacugaucugacucucugggcuccaggucuuuucucaugaugccuccuggacucuccccccccuccccucugggagaaagagaucagcccuauuggcucagucauuggcugaucagcuagcuuuauugacuauucagagaauaauuggggagcaauguuaacacaauauugaagcaggagauucuuagaauaaaaauugcuaccagauaugggggcccggaagucagcacuugaguaacacaaggauacucuuuacacaacacacaauaacaacaugccuacagagacuccccuccuuucuagauucacuccauugucuugggagaacauguccuccaguaccuugcugcgagugugugcgugcagaggugaguagcuaucaagcaugcugauaugugcaggagagcaggucccuuugagagugcgcauuaggggauaugugacugaacacaggacuauucagcaaggacaaccaagccaggagguuccuucucccaagcuaacagaaggcuuuaccuuuuggaaguugugaaggagacgacaccuggauuugaacccccaggugguggagacaguggucacugaguguagcccaaguaugcuuggcucuucagcacacagucuaaaggccucuuauccuugcacaaggaacuggagcauccauguuuggggaaaugguacucuguuuucugcucauuccuccaaccaccagacauuuuuuuuuuuuuuuuccucugccccuuggaccaguccuuggcagcgugggcagcagagcagcucacuagggaagaggucacggguauucaccuccaaaaauguuguggaagguucagagcuucucacucauuucugcccuacccugccugguacuuggacuugucaauacauauuuauugaauagaguuuuucucuucugccuuugugauuucuccguugcuggcaucguuagccacacaucaauaucuuuccuuacuuaccucuugugaagccacauaccauuugguuuuuauuugcuuggucuugagacagggccucuaacucgugauccuccugucuuuuaagcaagccuguugucagaucacugcucauaucuuuggagcaggccugugugguaccuucuguggugaggugagaacuccauguacccaggagugcauuccugaaucugcuuuguaaucacccccuagagccugacagaauucucucguaaaaaccaggcaauaauaaagagaccaagaugggggccaggagggacuggacacagccuucaaacuuuucaaaaaccacaccccugugcaaaggcaugguggugcauaccuuugauccuagcauuagagaggcagagguggaugucugaguuccaggacagccuggucuauaggacagcuagggcuacacagagaaacauugucuugaaaaaaaauacuaaaaaacaacaauaacaauaaaugguugugcuuaaaacaaacaaacaaacaaaacccccaaaccacaccccuaccugagaugaaguaacuggggagaccacuguaggagaguuugcuuucucacaucacuagaaaggacugaggcgcuggaccugucugcaaggagagguggacacucuguuccugauugguugguugguuccuuuguguuaccaagguuuuuuaaauuuuauguguguagguauuuuaucugcauguguguaugugcaccacguggauacagugccuucaggaggcagaagagggcaucagagccucugggacuccagucuaagaagguuuugagccacgguguggguagugagaauugaacccagguccuauguaagggcagccagugcucucaacagcuaagcccuuuuaaccagauucuuuaagcuggaaguuaguuaacuacugauugggcuggcaaggaagaucccaugcuuagaaugggaguuuuaguuuccagcucgucuuaccugggccucucaguucuagaccuuagcuuuccuuuuuggccagagaaguuucaccaagugggucuugagcuucugcccuccugcuguggagcaggcugagaaaguguuccaggguguugguuggggagauggcucaucuguaccugugcaaggaguuaguuacccuagggugaaucugucugucuugucugccagucuacauaccugcacuggcuggcuugcugcccuguaagg

SEQ ID NO: 6280 - RNA, 24067 nt, Mus musculus
ggacauugaguuugauaugauuuuauuuaaaaauuugcaagguugaaggaggaaucugauuuuucguucaaagaaagcaauuuugcaguuuauauucagccuuuagcuucaugcugaagaaaacaacagaaaaggaaauuucuguuuaagauccucucuucaguuaugaggagcccaaguuccuugcauugugcagcaaggccccuugccccagccuggucugaggcucacgcccagccuucuggcagugggaggccagcgcuccuccacacaauacaacaaggaugccuccccacugcgggcugcgcgggcuccuaggaguccuguguuucacaucuggaaagugugaaaggacucuuuaacucaucaccucugacaaauccaaccccacuaacuccugaggagagcagggagaaacuguggaaugggcgagaugcucuaugcuucacagaacagcucacaugucaaaaauuaagucaagaaacaugccuuaguacuuuacaaugugacuuaaaagaaacaaagcaagaugcacagcacauucuugugugugguacuguaaacuccuacggacgauugcuacugguagccaaacaggugugaaggagccuagcacaccgccauuuuggucagcacccagguuuucaaguggguuacugaauuuagccagaaggaaauaaggaucuauaaacuaacaacuuuguuacucuaaaugaugagguagaucuuuuuuuccuaauaugguaaagugaagagaaacagaaagucuacacaacauuuagucuucuuuuuaaaaucuucaggcuauacccauggucccaaacaaugcgguuacggagcgcgggguggcgaggccagaggucagauccagacaccuuauguacucgagaugcuaccugaagagucaaugaucagccucggaucgaucaacucucuccagagcacggugaucuaagggaaaaagacaaaacaccacacuuaauucauucuugacuccacguaagcuaaaaucuauagauuaguuaagcaaguuucugugaagaaugguuagauaaugaaaauacuuucaaagcuaauaaaacugaguuuaaucacuuuuguuuuguuuuguuuuguuuuguuuuuggauacaggguuucucuguguagcccuggcuguccugggacucacuuuguagaccaggcuggccucgaacucagaaauccgccugccucugccuccugagugcugggaauaaaggcgugcgccaccacugcccgguugaguuuaaucacuugaaaugcaucaacuuuuauguuaaacauauuucuuuucuuuuuuuaaaaaaauuuauuuauuuauuacauguaaguacacuguagcugucuucagacaccagaggagggcaccagaucucauuacggaugguugugagccaccaugugguugcugggauuugaacucaggaccuucagaagagcagucagugcucuuaaccgcugagccaucucuccagcccucuuuuuuuuuuuuuuuuuuuuuuaagauuuauuuauuuauuucauguaaguacacuguagcugucuucagacacaccagaagagggcaucagauccccauugcagaugguugugagccaccagguugcugggaauugaacgcagguccucuggaggagcagucagugcucuuaaccacugagccaucucuccagccuauguuaaacauauuucaaccuuugacuuagaacagggucugggguggugaaaaggagauuccaaggugucagaaagauucgccuuauagaugggcggcucugggagcugagguggggccuggcagccagcacgcggcugcugaugaccuuucucugacacaggguaguucucacccuaaucugcacccuaaucugccuaggacagaacuaccacacaguguaccaauagagacgccccuagcacucugcaagggugaaugaugagagccaucuagugucaaaaaggggaaacuacagguuuucuacauauuuuuuaaaaaguauguuuaaauauugcaaucauagaagcacaggacaugaggccaaaccaucugaugcugccacaaacccuaagaaccuguuucuagggagaaaaaaacccugaaaguaucuuauaccuuaaaauaaaaacacagacaagugcagggcaugauagugcaagcuuuuaaucccagcacuugggaggccagccuggucuacaaaaccagucugggacagccagggcucuguaacucugucucuaaacaaacaaauaaacaaaaaaaaaaacgaaacagauaaauaaaaacacaggcaagcacaaagucugauugagaguucaaacaaaaugugaauuuucagcacugaaauauaauagcaaauaaacacaauguuucaagugcaagcacaagagggacagaguguugcuuaaccauacucaagcugcccagaaguugccaccaauagcugacugcuggcucccaacacagggcaccaccaugugcuuuccaggagguuagagcuggcgagauggcucaucaggaaaggugccugcugccaaguccaagccccaggauccauaugguggaagaaaagaacagacaacuggaaguugucuucugaccucuacacacaugcgaccguacacgaucacacauacacaaauaaaucucauuuaaaaauuaaaauaagggcuggugagauggcucaguggguaagagcacccgacugcucuuccgaagguccagaguucaaaucccagcaaccacaugguggcucacaaccaucuguaacaagaucugaugcccucuucuggagugucugaagacagcuacaguguacuuacauauaauaaauaaauaaaucuuaaauuaaaauaaaauggaacgucagagggcagaaucgccauguuauaucauucuuuaugccaucuaugcuacuccaggucaacacuggggagccugagagcaguuaacaacuugucaggcacacggugcaggcuucggagcucacauuuccucuugaucuuagucuggucuccuggcuaagcucaagcuauagcaauggcucuccaagucgugggcacuauacagucugacacaagucaauccccuaaggaaaccuaccugauuaagauuuuaaagcagugcugugcuuuuagucaaggacauaguguuugugugguucaggugggcucugggaaguccaugauggcaccuacuuagaaacuuggcaggcuggacgugguggcaugccuuuaaucccagcacucgggagguagaggcaggcggauuucugaguucgaggccagccuggucuacagagugagcuccaggacagccagggcuauacagagaaacccugucucgaaaaaccaaaaaaaaaaaaaaaaaaaaagaaacuuggcacuuguuggcuauuccaaaggaggauaaugcccccagagcccugauccucuaggauuuuaacacaagcgguucaggaagcugcaaugucagcccuuguccccacccccaccccaucaauggaaaguguuaagaguggcuagcaugccuacccucuucuccugagucacagcguauuccaccaccucgguuccauuuucauugugauagaccaaaucaaacuucccagguucuuucaaagcugaaaccagaggguacagacaguaagucacuucuccgugguuaaaauguucuucauggggauuucaaaccacugggaggcagcuguguuaccuggggacauauaggaaaggggaguauaauacagcuauaaaaagacauggccgccuuagcaucucugagagaugagaccgccucaucagaaugacacaggcuugauaaacacacugggugcacccauggagaaugugcaaccacggguauuccccagggaaguuacagaaagcugcugucaucaaaaaucauguaugccuaaacuuuaaaacacgagcaggcuucggccuuggacaguaauuugggaucagaaaaauguugauacaagccaaaaccauucaaacaaccgguaacugaccggcaaaauuaugaacgucugaaaaacauucuaaaaauauucaccaaagcacugaaaaccuugccagggaugcagcucaggugguagacuuucccuagcaugcagccagcccuggguucagcccucugcacccauaaagcuaggcaugguuguggucaucugaaacucuagcccugaggaggaggaucagcucaaggucaucacuggcuacacagcaagguccacacagggaucuacgagacucuagcucaaaacgaacauacaagcaaacaagcaagcaaacgggaggaggagcaggggcucagcaaacagaggugcuuguagaagcuuuaagaccugaguuugauggccaaguacccacaugguggaaggagagaaccaacucuugccaguuguccugaacuccacaugccuaaacauacacauaagcacauauauacauacauccacaauacauguuuucuauaacaaaaacugaggggaagagggauaaaaauuaugugaauacaguacucauguaugaaauucuccacaaaagaaaauugaaauuaaacacaacaaaacccccaaacuuuaauaaucuuuaauacaaaccaccagcaaaggcguacuguguauuuggaucuagaagagcagacgcugagaaaccaaauguuccuuuucuuugucccagggagagccgccugcccccugcagccuuccuacuuccucccugcgccugugggcggcgcugugucuucugggcuuggauaggcugagcugugcugugcugccagcugcaccuugcaacagcucuggaaaguguccuuuuucacuuggcaggcuuuuuggguugguuugagcccuagcugacucaaacugggagcccuccugccucagcaucagagugcugugacucgagccacuuugcaaagcuuuuggcuggagucgccugacaccgucauccuguucgucacagccagaacaauccauuaacuucgggaagcucacaggcacagcgccaccauucccacugcugaccaagccacacacaacucugcucaccucaaccaugagcccuuccugcggcuaugccccuguuuguuguuguuuugagacacagguucuuauugggccgguugggcuggcuagucaccgagucccagaacucuaccuguccccacuuccacagcacugggguggguuccaggcacccacuaucaugccaggcuuuugucuaacauggguucugaggucaugcucugguccugaacuuccuccaggaacuccaucaucuccuuauuuauccaucuuccugcuuagguacccauauuauauacaguaagcgauauacaguaaaagcccacauucaggcuauaaggaucgauggguguagcuaaccagggauaauggagaaagggccauuuacaguaauaugccacccucuagcacauuccaggcccugggucaaccaaucuccaacaucacaaaaauauacguaaaaguauaaacuuauacauauaaaauaaaaugucugaaauguguguauauuuaauacacaaaaguauguucauuugccaaccuucugaguggauuuuguucacugaaaugauugaauauacacacacacacacacacacacacauauauauauacacacacacauauauauauauguguguguguguguguauguauguauacacacacacacacacacacauacacacacacacacccuauaucccuauuauuuauaacuuucccuuucugguuuauuuuaaauuucuuuuucuucuuuuguuuuuuuuugugggguuuuuuggcuuugcuuuuuuguuguugcuguuuguuuugagacguggucuuauauagcccaggcugaccucuaacucuuugacuguaacucugaggaugaccuugaacuucuaaucuucccgucucagccuccuggcuucugggauuacaggaauaucccaccaguuucaggcagugcuggagcuggacgugggcuucuuuguauaugcuaggcaggcaggccaucucuagucuucucgccguacguuauagcuuuagaacguaucccacuugacagcucaggcugcgcuuaagcuugccauucuccggacucuuccgcccuugagugcccgggaucagacuugagugagcacagccaagcugagaggagaggaagggaaugcagcacagacugggcuccacgcccaccugucaagugggcagaagccaugagucugagcccuaacccaagacagagguaagaaaaggacgcccaagcguaaugguccucaaggugaucgggugcagagucuccuuagcagucuuuauuguaaccucccugagccugcauccaguuuagguuucugagaaguaauugcuuuugcagucccaggugaguggaggcugagggagagcacuccucaggaggaaaggcugugcaggagcuacuguggcuauggagucuccuacccacuaggagauggaucgagcaugcgccacacucacccgguagcgaggagaggaccucuauguccacuugcugggucucuggaucgugacuuaauauuuuuccuuccuuccaaaaauaaaagacugugucaaaaaugucuauguaaaacacuguauuaaaggucagaguaaauagacuuuaaauggcuacuuuuauguaauauaaauuuaucuccauaaaucaacauguuagggaagaauaaaaacaacagacuuauaggcacucuaccugaauauacagaaaaauuguuagugguaaaauaggcacacgguagucauggcuggcagauaccuacagcacucgacaaaagguaaaaagcuauuauaguuccccagaauggaugaggcacggccaagaaagcaggcuaaagccauguguucgagugaggaguagcaggacagcuuucagugggagagccacauacacaguggugcuuccaagcuagcacugcuggggccgcucaaaaucccagguccccagguuccaaaacugguuuucagaugcaugaagaugcacugaaucuaggugugauggugcaugccugaaauccagacacuccagaggcagaggcagaaggguuaugaguucaaggccagcuuggacuacacaguuaaaacacugccucucaaaauuaucaagugggggggggggagagacuggagagauggcucaaggguuaagagcaauaaugucugcucuuccagaggaccuggguucgauucccagcacccacaacugucugugaccgcagcuccaggggauuugacacccucaaauacauacaugcaggcaaaaacaccaaugaacauaacauaaaaauaaaugaaucugggggcuggagagauggcucagugguuaagagcacugacugcucuucugaagguccugaguucaaaucccagcaaccacaugguggcucacaaucauccguaaugagaucuaaugcccucuucuggggugucugaagacagcuacaguguacuuacauauaauaaauaaauuaauaaauaaauaaauauuuugaaaaaaauaaauaaaugaaccauaaaaaaaaguuaaaaagaggacccacuauccugugcauaugguugacaaugggaagacaaaugggcaauggggccauauacugaagccaagcgaugagaucuuuucccuuguacuucaagacaaaguuucuccgaguaaaagcccuggcugaccuggaacuccuuuuguagaccuggcuguccucagacucagagauccaucugccuccgccucccuccggggugcugggaucacaaaggugaacaugaccucaccuagcuuccaaucagcucuuuuuuaaaaagauuuuauuuguauguauguauguauguacguauguacguauguacguauguauguguuagugggugcaccugcaugcuggugccugugaccagacaagggugcuggauccccugaagcuggaguuacggacggguuuuugagccacuugacacagaugcugggaaacaaacucccguucuaagagcagcaaacaagcccuccuugaagcugagaggucucuccagccccagcaucggcgccuaaccuuacccucggcacagacaagaggugcucuguuucucacuuguuuugccuuugcagagcuguguauuuauucuuaggacaggccagaguuugauccucagaagcacaaugguccccugucccccacacggugcuccucauucugauucaguccccuucucaaguaucagcgacacuagacucagagacuucaugauaaacguccaugggccucgcaccuucacuuuaugacauuauuuaccaacagugucuacauuacccacgcaaauauuaaaguauuauauaaauacaucagcacgggcuggagaaauggcucagugguuaagagcacugacugcucuuccguagguccagaguucaaaucccagcaaucacaugguggcucacaaccacccguaaugagauuugacgcccucuccuaguggguuugaagacagcuacaguguccuuauuucuaauaaaucuuugggccagaaccagcgagguugaccagagugagcagagguccuaaaauuucaauucccaacaaccacaugaaggcucacaaccaacuacaguguauacucauauacauaaaauaaaucuuugaaaaaaaaagcuuuugaaaagggaucuauguuagcccagcaggcuucauauccaaaacuccggagugcuaggauuauaggugggugcuauguuggacaaguuucucauauacugaacuuaaucuuuuuuuuuuuuuuaaagagacagaggcucauuauauuguccaggcuagcugugaaugguuuccugccucugaguccugggugcuugggacagcaggugcaccccaccaccaacuaacuucauuauuuucauagaaacaggcuuaccuuguagucagagacaucaggagaguagucggaugugaguuccaaaagcuaaaacagaagaaaaaacccuucagucucuuaggacuccuccuuccuaccccaagaacuugggcggugcagagguggccacucccacccauccgaggccccaccaugacuccugacaauugcagacaguugucuuugucaacauuacuuaaugagauucacuaaggaagcugggggaggggggguaaccuuguuuuuguuauggucagugcuguuuuaaaauauaccuuaaaugcaaucuuuucuccaacuugaggggcagcugccaacagugguaauagacuauaguccuucuuggggggcucuacuggauucuggaaaacagacaugugccuucauuacuggcgagggaaugagagcccacgccaugccacaagguugagaaaagcugcauggggaagggaggagggcagcucacaaacaucacacgcuuaccuggaucaccacagaugaguuuguuagaauaucauuuaacugucucugcuucugacucucagagcuucuauuaaagacacaggagaccgcuugcccgcgcccucgcccucggccccggacaccccggccccucagucccuucccaaacaacaaguccucuccucgcccccauccucuucccaaacugguggggacaggcguacugggaggaccaggagcuugucugccccgguuugagucagaagacuuccaucccauaauacccggagucuccaaugacagcccuggaccagaacccccuugcccugcaaagaggccaguuggcuuuaagaagccagcagaugcgcccucgagcauguucuuggacaccaggaacuggucuuccgacucugaacuggagucugaacuggaugacgagguucuggaggccuugcccuugccggagcugaagguaaagccaggcuuugaggccugccuguuggcagcugcagucuugguagcaggugcaucuuucaacagcucagcugacaguuucucugaaaaggugaccuccugcaucaugacacugcaguggccaucgcugacugacucugggcaggacucagacucugacagguggccugagcuaccuuuuagccccgugcugcuucuccuucgggcuuuaccgaggcuucugggggaggcccuggggaagcugcaguucugugaggcccccucuuuaggcgucuguuguuuggaagacuuggaggcccuggucugcuucuucgguucacacuucuccuuucuuuuugaagacuucuuuuuggucucuuccucauccucuucggcugggcugccugucacuuugcucuuuuucuugcucuuuguccgccccgucucaucugggaggaguuuaguuuccagguccgaggccuucucauucuggccgcuguccuccugccucuugcagugcuucuucaaagacuuguaucccugaucuguuuccucauccuccaucaacuuaaaagcccguuucuuugcuuuccugcaugggaaacuagagucgccaccauugcuuacuaucagguucucagggaguccuuggucuucuaacuuaacccuguuggaagaggagagaaggcucaggugagcccagguccgacaagcacaggccuggcgugcacuggugcaaugccaagacugcagacugucacagagcuaaggauggaagaugccacaaaaucacccacacaacacagcucuuucuuucacguggcugcuuuuuuuuuuuuuuuuuuuaaagauuuauuaauuuauuauaugcaaguacacuguagcuguccucagacacuccagaagacggagucagaucucguuacggaugguugugagccaccaugugguugcugggauuugaacuccugaccuuuggaagagcagucgggugcucuuacccacugagccaucucaccagcccccugcugcuuuguuuuaucuuuguuguuuugagacagggucuugcuaugccaccuuagguggccuggaacucacuauggagaucaggcuggccucagacucacagacauccacagucucuucuuccugaaugcugggauuaaagguguguguaucaucaugcccggcucacugggucuaguuuuauuaacuucauguauacuggggcccauguguuuuucucuaacuuauacauuaaccacaaacuagguuaucuuucauuucugaggucccaaaauacaacucagauagguaacuugcuaagacccacagcugauagauuaguaacaggaacgauagucugaccuugcuuugccuaacuucaaaacucacaaucuuuuuuuuuuuaacaauauaaauuuuuaaaaauugagaauuucauacauacaaaauuuauuucagucacacaaauaaacaccaacuuccaucuucucucagaugccccaacuucaggcccuuuuuuuuaaacuaacaaucgucuucuuauauguguguuagccauccuaaaaggcgaacauauuaaccguccggcuuuguguuagaaugaguaaagacauacaaugaaucugaguauuaaguagggaaaaugugccgcacauauacauaaugggauguuacucagcuguaaagguauauaauuuccauuaguauggaggcagugggagggcagcaugcuauaggaagacaaaugccacacauguucacuuacaugaagacuuaauaagaaaaaaaucacagaggaaugacagggccaagaagugggagugggugggugggggagcaugugggagacuuuugggauagcauuggaaauguaaaugaaauaaauacccaauuaaaaaaaacacacacacacacaaaauagaaaaaaaaagaaaaaaaaucacaagaaaaagaaaauagguaguaguuaucagaaccuaaggagguugugggggaagguaagacacuccuguacacucugauagaaagacuaaauucuaauguuccucuguaguauaggacagcagugguggacaauaauuaacuguccucaaagagcuacacaagacgcuuuccacuuucuuucuuucuccuuccuuccuuccuuccuuccuuccuuccuuccuuccuuccuuuuuuuccuuccuucuuuggaagacaaugguaucuuuaccuggcuugaauucagugaucaaccuuucucugcuagccaaaugugaagauuaaaggugagucugaaaaagggcuuucagggcuagagagauggcucagcaguuaacaacacugacugcucugccaaagguccugaguucaaaucccagcaaccacauggugguucacaaccaucuguaaugagaucugcugcccucuucuggagugucugaagacagcuacguauaauaaauaaauaaaccuuuaaaagagaaagugcgggggcuggagagauggcucaguggcuaagagcacugucugcucuuccagagguccuaaguucaauucccagcaaccacaugguaacucacaaucaccuauaaugagaucuaaugcccucuucuggugugucugaaaacagcgacaguguacucacauacauaaaauaaauaaaucuuaaaaaaaaaaaagacaguaauuucacugucccccaaauaaaaaacaguacgaggagcugggcagugguggcgcacgccuuuaaucccagcacuaggaaggcagaggcagguggauuucugaguucgaggccagacuggucuacacagugaguuccaggacagccagggcuauacagagaaacccugucucgaaaaaccaacaaugggcuggugagauggcucaguggguaagagcacccgacuguucuuccaaagguccagaguucaaauaccagcaaccacaugguggcucacaaccauccauaacgagaucugacgcccucuucuggagugucugaagacagcuacaguguacuuacauauaaucaauaaauaaaucuuuaaaaaaaaaaaaaaagaaaaagaaaaaccaacaauaacaacacaacaacagaaacaaaacaaaacaagaaaacuaguauaaggagacaaauaugccaaucaauucugaucauuaucauguauguauguauauguguauauauauacauauauguguauauauauccugaaaugacacacuguacccuacaaauauguauaauaacgauaugcuaauuaaagcacuuaaaauaauaaaauacaauguuuuccuauuccuguuuggguccugaauuguuucagcugugaugguuauauuuauguaaaccugggauggcggcggggcagggugcucagugugucuauggcucagugugucuauggcucagugugucuaaggcuugucuaaaaugguuccggaugagaaucccacugagaucucaaaacugacaaagggcaacuugauuuugagaaccuucucugcucagguagcugugagucuacuuuccaugucucuguuuauuugauuuuguuuuuuccuguguagcgcuggcuguccuggaacucacucuguggccucgagaucagaaauucacccaccugccucugccucccaaguacugggauuaaaagugugcgccaccacugccugaugucuccacuucucucucaguucuaaagaggugugugugugugugugcacgcgcccccucugggagcaagagagaccguuggauccccuacagcugaacauagguaguugggaaucacugugugugggugcugggaaccaaacucaagaucccauccccuacagagcaggcagagcucugcacuacugggcugucuccccagccccucuccuuuucucucucucucugucugucugucuuaaauuuguuuuaugucugugaguacacuguagcuguacagaugguugagagccuucaugugguuguugggaauugaauuuuuaggaccucugcucacuugagucaaucccacucgcuccgguugucaacuccauuaacucaguuccuguuugcucuggcccaaagauuuauuuauuauuauacauaaguacacuuuagcugucuucugacacaccagaagaggaaaucagaucccauuacacagguaguugugagccaccaugugguuguugggauuugaacucaagacuuucagaagagcagucaaugcucuuauccgcugagucaucucuccagcccccucuccuucccaauaugugucacuggccauggaccucuguccuugcuucucuguccucacaauggcgagauggugaguuuagcacugacucaggagauggcuaccacgcucaucugggggcaggucuacuaaaacuacagugacaccagaaagacucacaggacuccuguaccaggaugacacacaaauguguuccauccccgccuccaaggcucaggggacauccgagaggaaaggggagaaaauaauacaagagcugaccuagccacugcauacauagacucacuuaugggaguggcugucugcaaaugagauacacagggcuggaccucucaaaaucaacugggaugugagaagggucucugagaggccucucuuuaccugaggaacuauuaaaaauaaacaggacuaaguaaaguaaauugcuucccucaguacuucaaucacuagaguacuugcugggcaagccugagaaccuagcuuuggagccauagugugcugguguguaucugugguccuagcacugggaaggcagagauagacagcaauagacagacaccuggagcucacuagccaggccagccuaacuuaguuccaggcucagugagagaccggucucaggaaacuaaggguauugagaaagacacuaggcaccaagcucuggccuccacacauacguuuacacacaugccugcacacccaaugcuaugagcacacauacauuuaaguuguagacauauaugcauacaauaaaucugucaggggaagacaauuauaaggaggaaaaaacaaacauaaguuaaaaaaacccauaaauacuuaguugcuauuuuucuaaaauauuuuuucagauuuuauauauuuuuucuuuguaaggcuguuuugacugcgugugugugcuaugugugcucaguacccaugauggccagaagagggcaucagauucccccugggacuauaaugagcuaucuaucaggagggaccugaacccugaacagggguccucaaaaagagcagucaguguucuuaaccacugagccgucucaccaucccucacagguaguuuuuuccuauggucuacaccauuuaccaccagggcuagcugcaacccagcucucuaucucccuggacugagcccagggccucaggcauccuagccaggaaggcacucauucacuuacugagugacauucucaggcccacagagguaaugucuuuccaggcccaauuguccaguugaggcauuuaggagaaaccucccugucaucugcugcaauuacugcuuguaaccguuguuucaccguuguuuuuuacaucauuacaagaguguaauucaugggugauucauuaauuuaaguaguaacuguagccagcagcaagcuauuaagucauuaggcaggguaccuuucagggagugaauuuaacaggugggggacacagcccucucucuuguuuaaauagccuuuaaagggcacuggggaaugagcuuacuucugucaguaagaggggaaaagaggcuuggcugccuggagucagcagcaggcagaccuccaaagcucaaggccagccuccucgucuacacuaagagaacuugccucaaaaaagaaagggagcgagagaaaggggaggaguuggagaagguggaagaagaggggaagggaagggagagaaggggaggggaagagaggagagaagagaggaggagagguuugaaauuuggacuauuucaaguugccaccugaagcagaaugauuaacaaaucauaguauuccugacuuaaguauuccugaugcaaagauauggucaguguuucuaauuaauuucccugauguucugaagaaauuuugcaaauguggcacucucgacagaaagcaacacuaaacaaaggcaagcaagaaauagccugcuuuauaauuccauuuuuuuggguuuuuuuuuuuuuuuuuuuuuugguuuuucgagacaugguuucucuguauagcccuggcuguccuggaacucacuuuguagaccaggcuggccucgaacucagaaauccaccugccucugccucccaagugcugggauuaaaggcgugcaccaccacgccaggccuauaauuccaaauuuaacucaccgcagcggaagcuuagaggugugguuggaaguggugggaccauagacuauaucaguauguaugccaacugguaugaccaaucgcaucagcccgccaucugagacaacuaagccaccugccaacuagucacacuguagucgcuccuggauacucacuucagugacaacgauuaaauucuccuucuuguuguuuugagacagguuucucuacccagcccucacgaggguggcuucaaauucagagaucugccugccucugccuucugagaguuaggauacaagguguacgccaccuccacucgggccucucucucucucucucucucucucucucucugucucacauuuguuucuuuuguuuuccaagacaggguuucucuguguagcccuggcuguccuggaacucacucugcagacuaggcugaccucaaacucagaaauccaccugccucugccucccgacuacugagaguaaaggcgagcgccaccacgcccagccugauuuuaccuuuuuucuuuuuuaaacagcucucacauaugccaggcugaccuauguagccaaggauacuuugaacuccugauccuccugucugucuucaccuccucagugcagggauuccugguuagccagcugggaaucaaaucuagggcuuugagaugcaagcagucaagcuacugaaacacacagccuucugugugacacgugaaacgcauuccgauaccaauuggaugggacccaaugacaccugaaugagacacagaaauccaccagaaguggacacugccaaggcgcuaaggugggccauuccauacauuacucagaaaacaucucugcuuccugccugcaagugcagcccagagaaggcgggucuguggcauauuugcgccaugcacacugcacacagagccuggcagagugaguacuggcccugcucuugagcaccggagcugcuccaaguuuagucccccugaaaugagaagcgucccggggaacccggggaaggaugcuccauccugggcuggaccacucaggaucucgcgaaccugccuuuccgcagcuggcuagcucgcuacccggauccugcauccugcgguccagcaagcgccccccacccgcacccgcaccccgagccgcgcgcccccacccccacccccgcgcgcucccgcgcaccugaggcugucguugucucucaccaggcgcgcgcucucggcagggggcagcagccccccuuccagauagaggcccaggagcgccccggaacugaagccgaagcgcuggcggaugagacugaugagauccgugacaacucgacaucuguucagguccaccagaagccagaagaccgugcaguguggaguggccggcggcggguagucaaauugaagccguagccuaaccgucucggaggcugccaucuugcucaugcucgacggaagccgagagguuccaagggcuuucgcagcggcgugguccggcggcccgcccccagcagcagcuagcgugcgccgccugggggcgcaaguaggucuguaaggcuccccucgcgagcuccccauucuuucucagggcugaacauacaugcaaguugacugucaggauagcugcuacgauaucgguucguguaauuaaacagaaacaaaccaaaaaucuauaaaauuaauaagcagcaagccugacucgaaccccuguaauagguuuuuacuuuucuaccaaaaaggucaggaaagcaccaaauuguggugcguguccaagcagaaaaugagacauucucgugaugcgagacuuaaaguucucauaagacuguuuaaaacucacacacacacguccuugggggccucagggaguucaguguguccucugucccugaccagaucaagugcuuuccucaucuugaggcagaacaguauucugaaaguguugacgguccagagagucagaaagcuaaauaaauaggaagauuuucuuuaaaagauuuauuuauuauauauaaguuacacuguaguugucuucagacacuccagguggugccuagguacccagagaagacacucaggaaccacaccauucacuccagagccugcuguucccgaccaguccugccuguagcaggcccuaucaucccagagggaaucauccccuacggacgcccuguucuagcuuuguuccuuucuccucagggauggcugcugcuggcugcuggcugcuggccaccuccagucgagagguagaauacaguaugacgcgagagcaguauuugugcuuuuaggguuauuuaauauuuauuuuaaaagacagccaauuuauuuauuuauuuucaacuagagaaugggucucuaggucucuaggaauuggcuguggggcccucacugcacaucuuguuccuuagcacuguuuccagaauccuuccucacgucuggaagagguggaggaaaagauuagggguggaucuccaggccuucaaagacaucuccuguucugaaggccaggcccacuguggcuggggucucuggccuugcuaccugaaaagugaagccacauucccucagaguuuucaucucaucaaggagcugguuguccuugaacagcagcugcuccucaggaggccucuucaugaugcccucaaugaugcgcuugagcucccacaccgugcuugacuccuuggcaucagugaagaugguggucuucuugugucggaucacaagaaacacaaacaacccugugucugcuugugacuccaugcaccucacuggaccugagaagugucaacaacagacuuuaagucuuuucauugcucuggggcugaguuucucugacccugacaggaaaggcugguuucaauuggauaucugcaccugcaggaggccucuuaggguguuguuaaucugaauucauuagucuaaugcuggucuuugccccaccuuaugcauauugcagagggcugaggccuucuggauuauuucuaggaauaaacaaaacagauucuaggaacaccuacccuauaaucccuuuccaaaugcccuugcuuaccacaguuaagacaucugacaguuugauuuuuuuucuuaagacuuuuagaauuuacuaucagauuagcaucauaaaugugagauccaauaucucuaaucuauucuauuggugcugauggugccuaaucauccuuuugcauucugaacuagcguuuucaaaagccaaggauucaauuaauauuuuucugacuucucuuuacaacugaagucaaucuuugcaaaaaucagggaaggcugcuuuggggccuuguguauuuuaaggaaaagacucacaccuuucuugguucuucaaccucaucucaagcauuaaaaagcugcuaaaugacauagcaucaaaaugugaucaucaaauucaagcugccuuucuaaaucuuuguuguuguuguuguuguuuguuguuguuuuguuuuguuuuuucaagacaggguuucucuguguagcccuggcuguccuggaacucacuuuguagaccaggcuggccucgaacucagaaauccuccugccucugccucgagagugcuggaauuaaaggcgugcgccaccaugccaggcugagguugguuuucuaauaagcuugagccagccccuuucaguuucaucaugugacuggcagaguggcaaguucuuuccuaaauuccucaaucugugucucacugguuuuccuaggucuuucuaaggguuuuuuaaauuucugaagucuguguccaaguauuuuucuuauucuccuuuucagucuaauuuuccugcuucugcuuggaucuuaucaauccaguguuuuuugagcagguacagaaagccaugauggcuauuaagaauauaguauaaggggcuggagaaauggcucagcaguugagagcacugacugcucuuccaaagguccugauuucaaaucccagcaaccacaugguggcucacaaccauucggaaggaaaucugaugcccucuucuggagugucugaagacagcuacaguguacagauacaugccuggucuccuguacaaugauuuugacaaugcuauuuacuuauuuuguagugcuagagagugaacaaggggcccuguacacgucaggggagcaccacaccacugaaagacauucccccagccuggcuacuugauaaagaaaaagcaaauagccggauauaguggcgcgcaccuuuaaucccagcauuugggaggcagaggcaggcagauuucugaguucgaggucagccuggucuacaaagugagugccaggacaaccagggcuacacagagaaacccugucucaaacaaacaaacaaacaaacaaacaaaaaaacaaaaaagaaaaagcaaauaaggcuggagagauggcccagugguuaagcucaccgacugcucuuccagagguccugaguucaaaucccagcaagcacauaguggcucacaaccaucuguaauggggucugaugccuucuucuugugugucugaagacagcaaugguguauucauauacauaaaauaaauauuaaaaaauacuacucauauauauacaauuuauuuacauauaauaaauaaauccuuuaaaaaaaguauaaaauaccaaaaugcuaauaaugguaaccuguuuugagccaaguggagcugaguuagcuuucuaagccuucucaaguagcacugugcuggguccuaaacucuaaagucuuuuuuguuguuguuguuuuuguuuuuugagacagguuuucucuguguaacccuggcuguccuccaacucagaaaucagccugccucugucucccaaaugcugggauuaaagucgggcaccaccacugcccagccuaaagguuucuuuuaugguaccucccaucccuaagucucuccuugaggacuucccaggcgacuuaccagaucugauggcuucucagguuguccucagcaggagugaucuccuagugucccuagggccccuaccacaagucagagagccaaaauguuauuugagaaccaaaaaucccagacauucaguuauacucaggggccagaugcuggguaaaagccugccagcucagagaggcagagaaagcacccagcugaccuuccaacucaacucacuuuccauaaggaaacagcuccuaucugcuuccccaugcugucuuaaauacccuuagacucaaagacccuccuuucuguucacuucuguucacucccugucaggagguuucuagcacugccucuugaccuuggguugacuuucuuuaucucuuggauuaaagugugugauagguuugagccacaaugcgaaacaggguuuuuaaaaaaaagauuuauuuuuuuuuucuauuuauaugaguacacugcugcuauuuucagccacacacuagaagaauguaucaggcugggugugguggugcaccccuuuaaucccagcacgugggaggcagaggcagguggauuucugaguucgaggccagccuggucuacaaagugaguuccaggacagccagggcuauacagagaaacccugucuugaaaaaccaaaaagaagaagaagaagaagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaagaaggaagaagaaggagaaggagaagaagaagaagaagaagaagaagaagaagaagaagaagaagaagaagaagaagaagaagaguguaucagauuccauuacagauguugugagcuacccugugguugcugggaauugaacucagggccucugaaccuggaagaucucuggaagugcucuuaacugagccaucuuuccagccuaagaaaugggauuuguucacaugcucaggguucacaaugugaucaaucaggcaauaacuaauuacauuuucaguugcuucuccuguuaaagaauuagcgguauguaaaaaaggaacaguuucaagcaauugcaaaccauggauauaaguaaacauauuaaagcuggauuggucaacauuucaaaaacaguagcuacaacauuaauucaauuauuugugcugagugcagaggacucaagagaauaaacaugugauccaauuauauauguugccuucccauuagaugagucaccuguaaauacaguaaguuuauucucuaugggaugcaugggcaaauuuacaggagaugcauccauagaggcaaauuguaacuugucuuuuggaaaaugauuaucaauugucccugagauguuugcacaugggaugggccaaauaucagcauucugcauuaaccaauuuaauugcuguuuggaauaaggaguauauauuucauuaguuugaggcaucaucugacuuagccugcucagauggucagcagggucuggagugaaggagggaggauuuaaaagaagaaagacaauuagacaacuuuguaacaugaccagagccaguguugggggggggcuuauuuuuccaaauuuuuaucgaaaagugucaguuucaguaccuuucuaguuaaaugaaaaguauaggccaguucuaggucaagagaaagugguccaggaacaaacaaggcaauaaagaaaggucacaagauuacucuauucagggucuuaacuagaugaucaagauacaaagaacacacauuccucagcuguauucaucuugagccaacgcccuggucccagcucuugucaaauucuugccuaaaucugguaucuaaacuguaucuaaacauuuuuaccaaauuccaggaagcagccccaagagcucugccgaguccaggaagaauguaggagaguggaaaccucugguguguuuagaaagucaguugucaugucaagugauguuuuacuggggcacagaugaaagaaagaaugccuuggucuuccagaggacacaaguuugagucucuguacucacguggcgguggcucauaacugcaccaacaaaacaucccaucaccugugccugcuucaggaaaauaucucuucaccugugugccccaacagaccaucauuugacuuaacugacuuuccaaaaaaaaaaccaaaaaaaaaccaaaaaaaaacccagaaauuuccacuucacaacauuauucccacacacacacaaagaagggauuuuuagauuuauuuuaugugcauucaugugugagugugugaaugugugugcauucaaccugugugucuggcauagguguuaagauacaugccuagucuccugggcaaugauuucgacaacgcuauuuacuuauuuugcagugcuaggcuauuuacuuauuuugcagugcuagggagugaacaaggggcccuguacacaccagggaagcaccacaccacugagagacauucccccagccuggcuacuugauaaagaaaaagcaaauagccggguaugguagcgcgcaccuuuaaucccagcauuugggaggcagaggcaggcagauuucugaguuugaggucagccuggucuacaaagugagugccaggacaaccagggcuacacagagaaacccugucucaaacaaacaaacaaacaaacaaacaaaaaaccaaaaaaagaaaaagcaaauaaggcuggagagauggcccagugguuaagcucaccgacugcucuuccagagguccugaguucaaaucccagcaaccacauaguggcucacaaccaucuguagugaggucugaugccuucuucuugugugucu

SEQ ID NO: 6281 - RNA, 20923 nt, Mus musculus
cagggcgccgccccuccuguucaguuucgauuccuuccucgcugcuucuuaaguaccgcgcgguagggugcgcagcugucccugcgcgucacgucgggugagcccacgagcgcgauggcggagcugaauccucuggccgaggagcuguccugcuccgucugccuggagcucuucaaggaaccugucaccacuccgugcggccacaauuucugcaugucaugccuggaugagacgugggucguccagggcccgccguaccgaugcccgcaaugucgcaaaguguaccaggugcgcccgcagcugcaaaagaacacgguaaugugcgcggugguggagcaguuccugcaggccgagcaggcgcggaccccgguggacgacuggacgccuccugcccgcuucuccgccuccagcgcagccacccagguggccugcgaccacugccugacggagaucgcagugaagacgugccucgugugcauggccucuuucugccaggagcacuugaggccucacuucgacaguccggccuuccaggaucacccccuacagucgcccauucgugaccuucugcgccgcaaauguacccagcacaaccgccuucgggaauuguuuugucccgagcauggcgagugcaucugccauaucugcuugguagagcacaagaccugcuccccuacgacccuaagucaagccagcgccgaccuggagguagggaguggcugguugaggguauagaggacagcuuggaucagcugaauuguggagaggccauccuggguaucccuguaguacaguggguugcuagaggagauaggcuuugcugggccagagaucccauuccuucacagaccucauggccuuaggcuccgugggccgcagucugggaguugggcaguaggaagccauccccacagaccaaacaaguagauuuuauauagccucccgcucauccauuaucgccugccuucuccagcccucuuaguucuauuuuacauagagcacaacggaaggcacagguaagagugccugccccaagucuguguuuguccaguggaguucaguaguuuugaauauuaaccaggaacccuggggguuaccucuccaaccccuucagauccuggcagcacgaaagggcugugucuguuuaguucauuccacagcucagggcugugucuguuuaguucaggaaaacaggcccagagaaauuagcuuagcaggaaccaggcugcuuugagucacagcuucugguuuccuuuuucccuguagaccacagaucuguugaguccagagcauggagcagucuuggaagcuugagguuaaggguaacagaagccucuguugaggagggugugaauggauagugagugugaacacagagccucagaaaucccugcuugugacuuuggcacugugguauagcccuuuuuugguuguuuuuaagacugucucacuauguagucuuagcuguucuggagcuugcuauauugaccaggcuggcuuugaacucauggagaccugccugccucugccucccaagugcugagacuaaacgcacgcgcucaguugguguaguccaucuugcugugugaaaauugagcagggccuggcgugguggcgcaugccuuugaucccagcacucgggaggcagaggcagguggauuucugaguucgaggcuagccuggucuacagagugaguuccaggacagcugaagcuauauagagaaacccugucucgaaaaaccaaaaaaaaaaaaaaaagaaagaaagaaaagaaaaaagaaauugagcaggaauugggccucuggaccuggguccgccuugcuaaagacuggaagcgugugucagggagucaggguuccuaauggccuugugggguugcaaugauuuuaguggcuuuagaggucccccccccauuacagacucaaagcaguuguugccucucuucgguacauuugucaaagugugaucugaucuccuuucucucucaaacgucugagaacuugaggccugucccaacauuguggaaggaauuggaaaccugggugagguuggcaagccuugcuguguggugccaagaucucagcuccgcucccuccuccugccacagcccuucccuggccuugccugccugucugggucuuagucaggucccuuagaaugucuucccucugauucuuggcaccuguaucuacagguaacaucuuuagaguucucuucaguauaccccauguggguacgggguacggauaccuccaagucuagcuguucugggagaaagucugccccgccuuuggugcuuuugucuuugcuaccaccagagcuagcuguuuggcuuggggcaagacccuacagaucucuggguaggucaagagccaccagggaagugccgcagaggcaggauccggugucaggaggcuuggcacuuaagaggucccucccagauucagugccaagaucuugguuuaaauugugacccccagcaguagcuuccagcuacagaagaauaaaauggggaacaugauggucuccaguuacagugagggcuggugagauggcucaguggguaagagcacccgacugcucuuccgaaggucuggaguucaaaucccagcaaccacaugguggcucacaaccaucuguaacaagaucugacucccucuucuggagugucugaagacagcuacaguguacuuacauauaauaaauaaauaaaucuuaaaaaaaaaaaaaaaaaaaggcaugcuccaguuacagugaaccuugggugaagugaagcugguguaguggcucaugccuguaauuccagcccuugggaggcuuaggcagauaaaucaugaguuugaggccagcuuggacuacaucguuucaggucagcuacagggugagacucuugucucagaaagacaaccacaaauaaccaguggccaaggagguggcuuggcugguaaagggacuuguuaccaaggcucuggccugaguuugaucucugggaccaaugguaaaaagagaaccaacuccagcaagcuggucuuugacucgacaauccguaugcaugugaucguguguguguguguguguguguguguacguguacacacaacuaaaugaauguaauaaaagaagcgaaaguggauaagucaacucucugcaagauuuccauguaaguuacuaccuaccgguucuauuauugggcuugggcacccuggucugugcucuggggcagccccaggcaggacaaaguguccagauuggucucugucccagucaaguggacuugccaucaaucccuguaguaguacccugcuguauaaguacauauuuaccaaggcagaaguaagugggggcaugaggggccuccccagccaggagugagcggccauuccugcugacuuuuuaaucccgauaccaggauuccuccugccaaccuccugcccauauguuuuucaacccagcugcuguucuuccugucucagugccagacccuggcaagcgugcucagucuugaguaucacggcuacuaguuugggggugcagacucaggauuccccucucucccccguggaggacccagguccuuggucugccacaagcucucccaggcuucccagaguucuguauccuugaccaguccucaagcugccucucuuugauuuggaguggggugcaguggacccccauccacaaugaggggacuguuaucuguguuugcuuaaugguggauaaccuuuuuaguguggagggcucauagugcacucaauucuggaauugagucaguugcuagcacccguauguuucuuccagcccgggagguaguucugccuggauuugcccuuugacccaaaucuaucuccgccacuguuggagaccugaggugggggaaggguugugucaaagagauugagccaaacaucacugaucugggcuuucuggcuacaguuugcgcagccuugaucucuguauccggcccuuaacgagugccaguggauggugcaaauccagccccaagguuagguccagcucugauggaguagaggaagcaggaaaguagaagagagagcuacuguguguugagcugcuucauuaggggaaggaaaugcuauuauaauauuuuuuuuuuuguagaaauuccuagcacacacaguuuggucacuuguuuauaaauuuaguaccauuguuaguaaccugugccaguuacuaacaauguggucuuggcugagucgccugauuccucgacauccuucugucgugucugagugaugucuacuuuuccguguugcucuagaaguaguaggugucaggugcuggcagagugugugagcccuucaugacagcccucaugacugaugguggagugucccuucucaucucuguauggcaccgaucuaucuuagcagggacauaggaaacuugcuccuggagguggcugagagccagacaguuuugaaucaguguaguucuuucaagccccaguggccagcuuacccugauucucagcccucaguggcccuggccugggguggccaaguacaguugugcauuugucccugccuugcuggaggugacaaagccucacccagcuuccuucccccuccuggaagucuccccuggggaggacagccuuggguguugggcuccuucguuggguccccuucuggaaaugccaaggcuuucuuaguucuccagcaccuuugauauuuugucuacuuucaaggcuguuugcugugguagggugagcgaccucacccugccguuacagaaucagcuguuccagauuguuacgucucugugagcugggccacuugcugucccccuugcuuggauuucaugagcuguaaaaugaguaggagaaaaagaaauguauuagaauagaagcugacauuuaguauugacagauccuccaggcagggcucugagcacaguccuugguuagucuuccugauugucccuguagcugcuuaaccaaaccagugguuucuguucauggccaaagaaagagacagaagacauauggcugggaacaggcuuucaaacaaacagggucauuuugguuccaagucuuuuuuuuuuuuuuuuuuuuuuuuugguuuuucgagacagggucucucuauauagcuucggcuguccuggaacucacucuguagaccaggcuggccucaaacucagaaauccaccugccucugccuccaaagugcuaggauuaaaggugugggccaccacgcccagcugguuccaagucuuguauugucuuccugaaggggcagcggaguuagggagggaaugguccucaaugugggggaggggcuaggacauaggcuaaggaggggcucucucacccuauguguuuucucuacaguacaaacugaggaauaaacucacuaucaugcacagccacaucaauggggcaaccaaagcauuggaggaugugagauccaagcaacagugugugcaggugagugacccucccccacucuaacuccaaacccccucauucuucugggaggacuuggccugggcgugccugggaaucggguggucagcagagugcuuagguagcucacuugaagccuuggguuccauccugauaccacagaaacugugguagaaucggggcaugguggcgcaugccuuuaaucccagcacucgagaggcagguggauuucugaguucgaggccagccugguuuacaaagugaguuccaggacagccagggcuauacagagaaacccugucucgaaaaacaaacaaaacaaaacaaaacccaaaaacaaacaaacaaacaaaacugugguagagugggguuauaaguucaaggccaccuuugguuccauagucaguuccagaucagccuggagggggacaggaaauccuggcuuuuguuucauuuuguauuugagucagggucucacuauuuagcccuggcucucaaggaacucacuguguggauuaaucuggacucgaauccacggagauaucugccuaccucuguguccuaagugcuaaguauuaaagguguggugcaccccaaugcaggaaacucuugccuuaaaaaaauagccuugcaaagcauucagaaagcucuauguccaagaaauagccuuuauaaaugcucaucagaaaaacucccugcaagcccggccuugggagaaucauuaaaaaugaagggguaaaaggcuuagaaagauggcugaguugugauuguugugcagccugacccccaaguucaaucccgggaauccaagugaaggugggaacugacauugcagaguugaccucugaccuccaaauuccugcugugguacucgccuucacucugacaggaaauaaaacauuaagagucagugaauacgccaaggcaugguggugcacacuuuucauuccagcacuuaggaacuagagacagguggaucucugugaguucugggcuagccaggccuacauagugagaccugaucuaggaaggaggaggaagcggaagaugaaggaagggaggaggagaagaaaugaugaugguuacaacgacgaugaugaugaaauaaugauauugucauuguugucacgucguccucuggggagaauccuuccuaccucuuccagcuuccaggaggaagcuucaggucuuccuugucuuguugcugcuucugucuugccaguaccuuucuuccaucuacaauaagaccauuguuauuggacucagggcucaccuggcuaacucaagauggucucucuccuuuuuuuuuuuuuuuuuuaaauuuuuauuucacaugcauugauguuuuggcugcauguaugugugugugagggugucggauccucuggcacuggaguuacagaaaguugugaacugccaugugggugcuggguaucgaacccuggauaucuggaacaacagccagugcucuuaaccacuacaccaucuuucucucuagcgcccugaggauuucacucuuaauuuaaguacauuuuugaagaccgaugaugaugaugauggacuauuauuaacaugugccuguagggcuugggauguauguguagacucauuuggcaguugugacuaagaugacuaaauucacuugagcaaacuucuuggguaaccucaauagaucagacacuaggucacccucaccugcuuucucuagcuuucaaaaaaaggaacaagauggaagagacuggcaacaagcaauuuccuuuuaagcaaucacugugauguuugcugcacauacuacuucuagccuugccucaguggaagaaauuuagucacccuggccaagccuaguugcagaggacccuggaaaauguagucuagaaagcuguauaccaggugacucuccuguguguucccuuacuaaauagaaaaggaggaagugggcuggagagauggcuuagugguuaggagcauugacugcuuucccagagguccugaguuugauucccagcaaccacauggugucuuacaaccaucugcaauaggaucuaaugcucucuuauggugugucugaagauagcaacaguguacucauauaaauaaauaaaucuuaaagaagaaagaaaaagaaaaggaggaagugacggacacgccuuuaaucccagcacucgggaggcagaggcaggcagauuucugaguucgaggccagccuggucuacaaagugaguuccaggacagccagggcuacacagagaaacccugucucgaaaaaccaaaaaaacaaacaaaaagaaaaaagaaaaggaggaagugacaccgaaagauauuaauguucccaagaggagguacucugaaaggauaccucaguggauaaagaguugagggucagugagauggaucaguggguaaaagugcuugcugaacaagccugaaaacuugaguucaaucccagggcccacaauggaagaagagaaccaacuccugaaaguuguccucugaccuccacgugugcaccugaggaugugugcacacccugagagcagcagcaacaacaaaaguaauaauacauuuaacaggguuuuuuuuuuuucauuuguuuuuauuuuaugugcauuauuguuuugcuugaaugugugucugugucagugucggacguuggacugacagacaguugugagcugcugugugggugcugagaauugaaccuggguccucuggaaaagagcagucagucagugcucuuaacccgacucaucucuccagccccaaagcgaacaauuuuuaaaaaggugaauuccacucucuuggugugcauuguauaguuuuuguuuguuugucguguuugauucugaacuauugaaguuacucaagaaagcuguccaaacauacuauugaaaccacacugucuaccagaaacauccugaccaccucugauuaauuuaaaacgaauuugaauuacaugugugguggcaggccuugaaccuuggacccaugaccucacacaugcuggguaaacacucugccacugagcuaugcucccaaccucugaaacuaauuuuaguaauguaacuuauuuaucucaguguguccaaaguguuauuucaauguauuaucaauaaauuuuccuuugaugauacuggggaauggaccuagguccuugugcaugccgggcaagugcucuacaagugagcugacucuagcucaauaaaaaguauuaaggaauuugggguggguauuaagucuuugacguccauucauugucuacucacaaguuaugggccuuuuuuuuuuuuuuuuuuuuuuuuuuuuuuuuuuuuuaauuuuuuuuugagaugguguuucuuuggguagcccuggcuguccuggaacacgcuguguagaccaggcuggccucaaacucagagauccuccugccucugccuccagaguacuagaaucaaaggugugugccaccacugcccagcugacgugacauguuucaaaugcucagaagccacauguagcacugaaaagaguucuaaaggauggucgucuuugaucaucuuuaggaauuuguuugaaauuguuucauggcucccggaaagccacaaauccuugggcucaagugacccuccugccucagucucuggaggaacuggagugauaacaaauuaugugacuaacucacuuuuuacuguuucaaaagauuugcuugugaacagucgucuccccucucccaccaucccaauuuggagacaagggucacauguauguagccugggguggccucaaguauauaguguagccagugguggccuugaaauucucauccuccugucgcagccucccuagugcugggaugagaguuaugagucaccacaccgggcuuugcuuguuaacacucugucuguuuguuucuuugguugguucgauucuggguuuugagacaugguuucucuguguagcccuggcuauccuggaauucacucuguauaccaugcuggccuugaacucagauaucugccugccucugccuccccaaggguuaggaaaggcaugcacugccaccagccuggcgcgugugaacuuccuauguguauuucucugggcaaguaguuacaguacccuccuaggaacugggguugcugggucuugggguguguucaccuccaagcaggacuuugccaaguggcugcccaggguggcagcaugaagugucacagaguuccuggugcuccauacacacacacacacauacacacacacaaacacacacaacacaggagugcaaccuuagcguuaucagcagucugacaggagcccccucaucuuggccucguaggauucuaugaagaggaagauggaacagcugagacaggaguauauggaaaugaaggcugucaucgacgcagcagagaccagcuccuugcgcaaguuaaaggaggaggagaagagagucuacggaaaauucgacaccaucuaccagguucucgucaagaagaagagugagaugcagaaacugaaggcagagguugagcucauuauggacaaaggggaugaguuugaguuucuggaggugaguuguggcuccggugcucuguguguguguguguguguguguguguguguguguguguguguguguguguguguguguguuuguguguguguguguucugcccauguucugccuaacauugcagagcugauaggagucuggaccucauagagucagggcuuuaagaggucaauuuggaaagcucccagagacauacuguaugucuacacucugcaauagcuuaccugaguucaggggcuuuagagaaccucugaugaugaucugguucccucagcucagcgucugggcguggcuuccgggcuauugcccuaguaccagcagucuagcugcaggcugggcuguauugauuuuggagcgcaggguuguuuuguuuccaagagcaccuggcuacuuaguuccucggggcuauaauuaaguguacauuuucuugccggcugucagcugaggccuucuuucagcuugccaaccaguguuugccuuaagccagcagaaacauuccucuugaaggccucuuaccccguugagucuggucuacccaggauaaucgcccuuucuauuaauucgacugguugaagaucuucauuguuccuguggugguguucccucucuguuccuaguaguuugucaugcaguaaugcccuuuccaucugcccuguacuuggggggaugguuaugggggacucuugggagcaucuuacugugucacucccuuugguguugcagauuaugccuccccccaacuaccgccaccaccguagcacugaugacgucauuucagaugugcuuguuggcuauaagccauaucuugucacuuaucucuucucccucaccugucuaguucacggcccagaucuccgugaacuaccucguuuggucccccaaggacccagauucccugcucaguacgggaaugguggaacuuacccuguucgugaugcuuacugguacuuagguggcgguuuuguuuuguuuuguuuuuuuuaagauuuauuuauuauauaaguaaguacacuguagcugucuucagacacuccagaagagggaaucagaucucauugcggaugguuguaagccacgauaugugguuacugggaauugaacucggggccuucagaagagcagucagugcucuuaaccgcugagccaucucuccagccccagguggaggcuuuuugcuacuccagggagcucaguccuaugccuagaaacuacuguguuccgugagaaaggauucaaagcccuugucugagcccccuucuuaaaguucuuaaaagagcacuccagcucgguucaggaucagaaaccuuggccgugugauugaggcaggaaguuggauuuacuguugccauaggaaccaucagugugugugggggggggggucuaugaggaugcaucccaaacccuggcuuuccuccaaucaccugugcuucacaccuuggcuuguuccagaaagcugcaaaauugcaaggagagucaacaaaaccagucuacaucccuaagauagaucuggaucaugauuugauaaugggaaucuaccaaggggcggcggaccucaagagugaacugaagcacuccauuaagaagcuacagaagaagucugaggagcacaauggcucagguaacagcggugacacauccaucacugacgaugagcagaacauuggcccuugaauuucaaggguccugaaaccgucucugcuuuguccugacgucacagcuacuuuuccagaaagaggauugaggcuuuguuauucugaugggcacuggaggccaacauggaugggcuuugaguagacucuggguugccaguguguuugguggacagagggcuagcuucagggucagaggaaugugaaauuccuccuuaccacuccuuugcauuccuuccuccacaucccaaccaccaucauguuucucagcuuuacacacacacacacacacacacacacacacacacacacacacacaccacugacugccaacacccaauucuggggucuggggggggacuggucccauuguaugcuagacaaguaccccaccacagaccccuguaccuaauuaacccuuggcuuuuugaaacaagaucuaucuagguagcccaggccaucugucaccucccaaguacuggcauuacugguguaaaccagcacaccuagcugucaaauauuuccuuucacuucugacccugcccacugagccuggugaaacaccagcugccugcugccugaucaucacuugcuccaugcccaugcuagcuuccuacaaggucccccccaugcccgcucuuauagccagggagguuuuauaggauauagaugucaccguguuucccucauaaccccuucgggaacuuuccaguuauccuaaaauggcaggccagacccuugaccuuggcugacaagcaauaguaggugcugucuuuucaucucugggucccugcaacaccucccaccaccucucuccauucagucucuccgugccaugccuccugccacaagcccuuuguauauauccucucuggcacacauugcuuggggauucuucaccagcuaaucccguucuauuguuuguauuuuugguuuugcuccacugccaaccaaaccuagggccuucauauaccaggcaagugcucuaccacauagcccccuugaacauuuuauuuauuuauuuauuuauuuauuuauuuauuuagagacagggucucucuacuuguaguagcucuggcuguucuggaacuugccauguggaccaagcuguaucucuaacuuaccgagaucccccagccacaggccucccaaguguugggauuaaaggugugcaccacccccucgaauugaagaaggaucuuguuggguugccuaggcuggccuugaguuuguaauccuccugccucaggcuccuaagugagaauucauaauccaugugccauuaggcauuuugguuguguuaggcgucuuuucuuguggcugugauuaaacuauccagacaaaagcaacuuaugggagaaaaggcuuguuuccgcucacaguucaggucauagucugucccacaggccaggcggcagggcuugaggcugcuggucacaugguuucugaaguccaaagugcaaggaguguuagcacauuagugcucagcucgcuuucuccacuuuauacaauucagcauuccagccaaggacuagagcauccagaguggacagcuccucccaccucaaccaauggaaucuugaggaccccccccccccugccaagaugugcuuuaacccgacccaucacauuggguuuuccucucaccauaugaaaaucauuaaaccguuacaauuuucuaccagguucccuuaaaaccuuuaaagagaaaacacauuuauuuauucaguauggauacguguauguauaugugcauguguguggacauaugcacucugauguagaggcuaaggucagaggacaacuuauggaagucaguuuucuccuuccacuguguggguccuggggauaggacucagguuugguggcaagcuccuuuacccacagagccaucuugacagagucauuuccacucuugggaguaggacucuguucuuuggggaugcaggugauggcccugaacgucacuguggccaucccaguguccucgcagaagggcuucugaagcagguaaguacuucugaaccucauggaagguucuggaaaugcuucacauggauuguaugaguaacuagacugccaagagagggaggaaaggaccagggggcaagaaucugacauugacuuagccuccacuccacaccagacaccuugaccucacucaggggucccaucagccauuaaguucacauucucccugauguauggccagagagagagagcaaccagagaagucccggagcugcgugcugauggaggagacuuuuucccaucuguaucugaagcagaggagagaaggaacaaacacaauuggucggccucacacugauucugucucuugcaaaugacugaaugggacaugcagugggagggcugucuguguggauguucugccccagccucaacaaacuuggcucuuaagaguugguggggaggauccacauauagcuggacucuuuucuccggcacagguaacaagggagaccagacacaguccacuuuuaaacccguacaaccuucgaagaagaccauucguaaguagccccccguuuuuuuucugguguccguguggcuguggcuggcagaugcaugguugaaacugucacaggggcuacugaagcuucuagauggucacagaccaucucaguuuuucacacguguguguuugugugugugugugugugugugugugugugugcaugcacugugauacacauguggaaaucgggagucaaccuugggugucaguccuuacccuccacuuuauuugaggcagggccucuuacgugccaugguauaagucaggcuuucuggccuggaggcuucuggggauccugugauagacagccaucgucuugcuguauguaagacuucugggauuucagacgcaugcuagccuaucuaaccuuaucuggggucugaagaucugaacucagguucucaggcuugcauggcaucugcuucacccacugagccaucuucccagccccguguuucucucucuuucccccuauugcccucucccagugagcuauagaaaauguuucccuaauuaucccuaccagugagaauuugauucuacacacgcacaguguauauugguuuauuuauaaaacggguaagcagacugguggcgcacaccuuugaucccagcacuugggaggcagaggcagguggaucucuauggguuugaggccagcuugguuuacauagugacuucuaggacagccagggcuauguagagagacccugccucagaaaaagaagagaagagaagacuuuuuacaucccacaccucaagcauuggauuuuaccccuguucccauccccucaacaacaauggugucccugucauugagaaugugguuauggaguuaggagugugagucuccuugucauucacauuuggaaaacagugacauuggagcccaugggauuuuaagaaaauaagugauguucccauggggacauaccgguugugagagcucuccauaacccuuaagggaagcugugacuguuuccccaaggucaguaugaaauggcaucagggugcccuggugccagugagugucgggaggaugagaggacuccgugcguugcauuguugcuugugccuugucuaacgugugggcugucgguaucgguuccucugagggcuggaacaccuggugaccuugugcuuuuuuuuuggauggagaagaggagcccuugggaaagaaagcaggguguucuuaaagcccuauugugauacuuaaccagcucuauuuauuuucugacuuucucuuuuuuugcuugcuuuuuuuucuuucuuucuuuuguagggcucucaucuaccaguaguaaaaugcacagacccuaaauguacagucaaauacauucugacaaaugaguuccaugucaccauuacccaaaucaacagaaacacuucagagaaaauuccuuccucuuuccuaacagacaguguauacccacccaccaugacccuggugaggguuccuacacuuguugauguguguuaucagccacugccuuauaguuuaaguuaauccauccuucuuuaacugguaugagucagauguaugcuggugagugcuacuauggucucuugugugugugacaacaugcuuuaaaauauccuaaucugaaaaucuuuccuuuucagaagaaaagaagaccaagaaaacccguaaguugugcaucuguguaucuuuuuguucucgugacuugugugagucuagagcuaacauugauagcaacaauugaccugcuuuaacaaggguccugcgaugcaccuguucuuacaaaugugugcccgugaggauggccaugggggugcguggguagauaguugaauggguggaugguaaauggguagggcagauaaagagcccucgucuggacucacuuguguggcccuggcuggucagaugugucuguggaaguugagagucaucuuggaagggaagagaagucaucuaguccucuggguuguauugcuauuccaugguuguccuuccucaccucccagcuguugcucccggcccucccucccacuucucaccuaacaaguugcccaccuuuggagcuccuggccaaucacuggauucaaaagcaacuuccccugauggugaguggugugcacaggcgccagggaauuagguaccauuuguccugaguucccaucuugauuacuauucucuguuuugucuucuagccgcacccaaagccagugcugcacagccagacucuguaggagucaaggcuaaggugcuagaaaacuucuuaaccaaguccagaacggagcuucuggagugugaguagcuuggcucugugggugccuucaugcauaccuggguggauggauggauggauggaugggcagguagguggguggaugaauagguagaugaauggguggucaaugcacccauuggggaguagguagcuaggugauguguguaucugaguaaguguucugauagaugaaugguuaguuggaugggaggguagguggguagauggauggguaguuagaugauugggugaaugggagaguagauggauggauggaugggcauguggauguguggauggagaaaaauaaauguuaacagacgagaaaagcuuuaaaagugcaggcaccuugggucccuugucaaaauucccuggggggggggaaugucuucucagauuucgugaaagucaucuucgacuacaauaccgcccacaacaaagugucucugucaaacaaguacaccaccgccucuguguccgaugggcuccagcacuaccggucccauccccagagguucaccuacugcucucagguccuggggcugcacugcuacaagaacggcauucacuacugggagguggaacuacagaagaacaacuucugcggcguaggcaucugcuacggcagcauggaacggcagggccccgagagccggcugggccgcaaccccaacucaugguguguggagugguucaauaacaagaucucugccuggcacaacaacguggagaagacucugcccuccaccaaggccacucgagucggcgugcugcucaacugugaccacggcuucgucauuuucuuugcggucaccgaaaaggugcaccugauguacaaguucaagguggacuucaccgaagcucuguacccagccuucuggguguucucggccgguaccacccucucuaucugcuccaaauagccaggucccuaggcuagccacagacacuugggcuugcuggggaacauccaagacuggagggaacucugaacuugugagucccuaucagauaagaaauugggaggggagcuggggaaggggugggaagaaucaaaggggagguuuaggcucagaaagggguggggugauugucuuguggauggagaagcauaucuaccuccucaugcccccgagggcagggugaccuccugccaguguucugggaaaucucuccaggcugcuaguuacuugggcagagccucagagaguaaaauuauuaguguuccuguugucuuacagaaaaaucuauagcuguuagucauguucuuucucaggugacagauguccacccuauucuacucucugggguagccuucagaucuuuguguuuugauuauggccuagauuuuuguuuguuuuaaagccagcuguaguggugcgugcacuuaauccgagccuuugggaaauagaagcagacgcagcuugaugaguucgaggacagccugauguauauaguggguuuuaggacagcuugucucugaaaaacaaaaauccaguucuugaguucuguauguguauguguguguauauauauauauauauauuaucaucucuuuggugcuggggucugaaucuauggccuuuaccccugagcuacaucccuacucugaauuuccauauaacccuucccccacaaggaaccuuuuguagauaaggcugcagccuguguugauuugugucaagguaacccagaccugguugagacggaagucucucccucuucaaggggcaguucucuggggacauguugacgguggccauggaguuagaggccuuucgucccauagccuaggccagggguggagguugaggaacagaacccuggcuggauugugggagcccugauggcuuugcucuuacuguuaucuugccuugacagcuguucccaacaguaauguccccauccucuggauuguagauacugggcugauggcuauaaaugccgccauuugccuuuuguggcuucugucacaguuaaguggacagccacaccacauucccaaagccuaccaucauggagacuggcugugugugguugcuucaggaaccuugcuagaucaccuauugguggacagccuguggccugaagcgagagacgagcgggagauagcuggaauccuguuuaucucuagccacagauuacaggcccagugaugagucagacccgucaccugcccgacccuuucugcucucuuccucauuuuugagccaauuccagauguucauguagaccaaacuacagguuaggaagacuuugaaggaugaggaaacaguaaauaaauaacaaggagaguccaggcaguggcuguuuucucugcugucuuucacacagugaaaauggcccgggccauaaagggcaaggauggauggcugacugggaucuccccaccuccugucgugaugccaaauccagaagaugugaggauuugaccucuugugacaggaguccagcucucucuuuccuaagcggggagcuccugcuugcaagcauucuuaugaagagaggucaccauagggaagguaggcccuagaccuuuucauuugauggauauuugagaacacaucucaggucuuuauggaauuccaggcucuuaguauuggcauucccgacagacgugugaucugugucuucucccagaggaauauucuauucccuuuaagcaucuuuacagggaacaugucccuguagaugguaugugggcuuugaaagauuucuuccuuugccacacaaauucuuggcgauacuucuccaacuuugaaggugcccaaaaagcuucuuugcuggucuuguuuugagccuuguuugaggccagaucagacuugggaaacaacuagguucagagaaguggaacaccaaggauuaacucaggaguccugcaugggcucuucugcagaaaaggagccggacagucaggacucuuuccccaggcagugugcagcucaggcuaggaaggcaugcgucccucuguuuaugagagacccaagcaggcaaccaaagcccagagcugugcaagaugcuuuggaguugugaguggagggguguacccuugcugucugguacuuuucuguuugcagugauaagaccuuaccuuaaccauaagcauuucuggguagauggacuaagaguucaucagagugcacaucucacuuggcucuuugcagagucaggcaggugggaaggugggggauggcucugcucaaguccucuugucauuccaacauggaagagacuccuaacgugggugaccaagaaaaccccagggcccuguagacauacagaaauuuccagaaauguugauguaaaauccugucguugaucaagauacuggggacugucucagucacuguggugugauaaacuaaagguggaaucuuuguauuuuucugaucacucagaaauugauuuuuuuuaccuauuacuaauagcgauauuuuauauuuucuacuauugauuauuaauuaauuacuaauguuuucacuaugacuucuugaaccuaguguuuuuagagguaauucauuaagauaaucaaucauucauuguacagggcaaggcuggcugcuguaccuuacuuuguaugcaaacagcauccagcauccucucuggauugaggugugggugaaagaugucacucaagcugaaauccacugucgagguacccacccccuaagagcuacugcccagggccacugggugcucaggcccugcuccggaagccugcuauagcguagcucagaucacaugaaacuggauaaagaacacucaagagagagaacuuagcuucaagacagugccagggugggacacugaugagggauaagccugcuugaguaaccggcaagcugcagugggaacccagagcuugcuugaauauuuuucuugcgguugcauagacuugaccauuucuaucguaaguuaaauggugaaauggaaaagucuugaccagagauaaacccuauucaugaucuucucuacauaggacucuuuggcuguuaaagaauuacgcuugccuuugucgcuggugugggugugugugugugugugugugugugugugugugugugugugugugugugugcgcacgcgcuugugcuugcaugagugcguguuuaaguucucggaauuuccugagaggauggagugccauuguuauuugucugccuugugccugacacagcggaauuuaugucaagagaugacccagcaugguagcuagccacuaccagcuuggugauugauuacaggguugaggucagcccaagacuucugugaauccugucuacagaugaugguucaauuccagcuccaguugagaccuagugcaauuucccugcagaugaacacauagcugugcuuuaggcugaugcacccguguccugugacggcaggacagggaggcugugugcucgagacccaucuagaccuugcccuguuugugucuuuauuugacugcuucugauucuuuuucuuuugaauaaaguucaaaucauaagugcgac

SEQ ID NO: 6282 - RNA, 759 nt, Mus musculus
uaguauugacagauccuccaggcagggcucugagcacaguccuugguuagucuuccugauugucccuguagcugcuuaaccaaaccagugguuucuguucauggccaaagaaagagacagaagacauauggcugggaacaggcuuucaaacaaacagggucauuuugguuccaagucuuuuuuuuuuuuuuuuuuuuuuuuugguuuuucgagacagggucucucuauauagcuucggcuguccuggaacucacucuguagaccaggcuggccucaaacucagaaauccaccugccucugccuccaaagugcuaggauuaaaggugugggccaccacgcccagcugguuccaagucuuguauugucuuccugaaggggcagcggaguuagggagggaaugguccucaaugugggggaggggcuaggacauaggcuaaggaggggcucucucacccuauguguuuucucuacaguacaaacugaggaauaaacucacuaucaugcacagccacaucaauggggcaaccaaagcauuggaggaugugagauccaagcaacagugugugcaggugagugacccucccccacucuaacuccaaacccccucauucuucugggaggacuuggccugggcgugccugggaaucggguggucagcagagugcuuagguagcucacuugaagccuuggguuccauccugauaccacagaaacugugguagaaucggggcaugguggcgcaugccuuuaaucccagca

SEQ ID NO: 6283 - RNA, 6275 nt, Mus musculus
accccagcacagccucacaggaauauacauaauucaaauaaaauaaaucugaaaauaauaaggacagcagaaacuagcauuuaaguuucagcagccaugagcauuuauuauuuugagugaaaugcacacugaacuuuuguauaaaagccaucaaaggugcuagauuggauuauuucaauauuaauuuaacugucccugugucaucuguguuaccuacauuucuguuuucuucugacauaucauuacaaccaucuacaauuguccauuguuaaaauauaaaaaauauuagucuauucuucaaaauaaaguaccucuagugauguuacugaaagugaaaauucuuuuaaaaaggggggggcaaagaaucaacuuauuggaaaaaauauauauguauauauauaacagaacuucuuagguacgugggaaugccaagccaauguaggcuuuugguggaacguuuuuauaacaccacuugccagggcucucauuauuuguccauucuucccuuggguacuuucuaaauggaaccaacuguuauuuaaugcugugcaucucccacacucccuaaacguuuaacaggaaaagcaagcugauuccucugucuguguuagaaauagcccuuaggguuaaguuugucguuaaagaugaguuauucccuaccaagggggaaccgucuugaccccucauuuucaguccucucuaugcccuauuuuucauuuugguaguucauucgaaaguugagcucauccgguaccgggcugguuuccuaugaaugaguucacugaguuagagcagugugggcgggugagcguucgcguuugcucuuacucagucuuaagcaaacaagcaccucugauuuaccacaagagcggucugacucucgcgucucuugacuuucuuguuccuuugucucaccuuccagcacaaggcacuggaggcuaguaaaaacaguccggaggacagaaggaccaggccgaagauggagaugauggaaccaugggaauugaagcuguaagccacagcggugaccacaaucccagugaugaagaccaccacggcaaaggggaugaugcagcgguagcaggagaguucggcacccccgguggcggccaucagcugaaccucgcugaccaagggucccguggugaccacaacuucccucuugggguuuuucuccauugucacaggugugggagauuuuggagcucccagguucucuuuuguggauucuucggucauuuuuuuuucuucugugggauuuuucuuaucucgcuucacaggcuagauuuggaaagccuggucaggaugcaagcugugaagaagaaggugggagacaucagcuaagauggcagcaccagcccugcaaaugguagcagagagguggagaggccccuccugucccaggucacccaggagcacaagccucacuuauucacauucuccauuuguggggucuuucgcacugagugaaauagagggugaaacagcugugcccagaaaaggagagagauagaaagcaggaagugcucugcaguauuuccucaaccgcgguggucuccaaguauccuuuauaagcguucuucuuuugcggauugccuguguuuucucuaagcccggaaaagcccgaaucuuaauccaaagauggcucauucaagaggagacuaugcuauaaacaguuccacaacucucagcagcgugaacucuugccaguuuugcggggcaugacaugcauucuuuccaagcuaucacccauucacugcucaugagagcaacgucaggaccaacagcaagugcauaaauggcaugcuucuccaucggcugacuccuuaaacagggugaaccguagaguguaugcuugggaccuuuccaaccccacccuaccucaagucccacccguacuucccuaacucuuacucagcucagagacagaugugcaagcuaggggaaaaaaaaacuuaggugccaaacacuucaggacuaaggauuagaaugugucaacagacuacuacccaucuaaaaagggaaaaauaagaaaaagacauuuugaccacuuuauaggcuauagcuauuuuuuucuuuuucaauguuucugacaauaauuaacuauucagcaacucuuagagucucuagcugucauguacaaauuuuccauuuaaaaucaacaaggaauuuuguucuucuguauuuuauaagaggcuuauacaaauaagcauaaauaucacacacacacacacacacacacacacacacauuuggccaauucauuuuuccuuaaugaccuucugcauaaaacuugccccuuucuuagcuguuuugaacuugaagguuuuaguacaaaacucagaucaaaaggcaucugguagaaaccccaguuugagaaaccaggaagaagguuuugucugaaccucagagcugucacagggucacucgcugacuggcacccaggagaggcugcacagucgcaaggacuacagauuugugggacacuuuaagauuguuugauuauauuaauccuuugaauguauuaaacccuaacugacaauaaacacaacacuaaaucgaaacagaccaaaaugccacucaccaggcaaugaaaguacaagagagguccaccugauguaccuugcauauaauuuuuuagucaccaacaaaugaacuauuauccaugauuaauuaauagguaaugauuauuuauuaagcauuauucaauuauccuaaaauuauaguggcuaggucggugaaaggauauuugacauuuuauccggggaaaaaaaaguuaaaauuaaaaucucccuccccucaaagcugagaucaucacaacuuaaaaucaaagaucuguccggaaauucacaacacauaccucacagaaaggcaguccauuaccagagaggccacuugacuugggagagagggaucugccagcguagcuccguucaacuucugggaaagagccugucacccacugggcauugguaaaaggacagaccagggauugccucugggggacagaacagacauacaaauacuuaacugcagacaaggcuuuggauccuggaacucuucuuuccugucaccccggcuccucagggaggcuugcccuccccuccccuccccucucaauuaacucccucuuccucuagcaugucccucccuucuuuuuccuuucuuucuucuuucuuccuucuucuuuuccucaccagcagauucagaguuuuggcaugcuccaacuccgcucggggacaugauaauuccggaucaucaccucagaguccccagagacuggagccagccucggcuuuucuuucucucccagcauuuauugaagcaggcugcucugaguuacucauuuuuuuccccagccuaacucuagaucuuccuccuccuccuccuccuccuccuccuccuccuccucuggcugggcaaucaggcauuuucauaagagaaucccagagucagcacugcagaccuagcugacggacagagccgggggacagacgcuccucagaggcaggaacagcuguggaguugucaaaccuccgagcccagccucuagaccagcagaaagccaaugcucuaugcucacagguuuguuuuuuuuuuuuuuuuuuuuuuuacucauguaugugugagauggccccuccccucguuugauguuccuucauuuacagaagagggcgggaaagacuacauuccugguuaagcugggaaaccccggguuaucuugauuuaagcagggauugcuuacugcuuguucugggcgaugagugguuuuggcaaaccugaaauuggccaccacugucaccagcaacauugccucuauggacaaagcacuuauuaugggugugguaugauauuaaggacugacacacguuaguauucucauucauuuguaaauaaaguuauggagacauacagagguaaauaaaaugacuuaaguucacaaagaaauaaacucucgcuucagaccccaguuuuuccucuauccuggagaucgagcccagagucucauauguacucagcaagaacuuuaccguucagcuauauucccagcccacucuccgccuugaccuuuaaaucccccugucucaguuucuucagucgcuacagucacagaccuucaccaccaggcccacugaaccucagucaugaauaggugcaagcucacccucggagcuuauaaaauguagagucugaauaaaucgguccauaauauaguccgccuaugccaagccuugcuguuucugguccuauuuuaaucaauaauauaucuuaaaucuucaaacacgcaccuggcacaccauucuuucgaauaauauccucaaggcugugccccagcaucaucagugaccugacaggguuaggcugucuuacagaaaugccacuaaaaccuggggugaagcaggucgguggcaaagcaagagcacuauggcaagccugcccauauuucuaaagguuaucccaggauuuccuucaucugugcaagucuuaccaauuccugguccagucuccucauucacaucacugacagaauagcuucgucuucccauccgagggaugcuuagcucucuuuagccacuggcuugcccccuggaccucucacccuccuagcuuccaagggggacacagagagaccaggagucccuuuccuccaaugugagccagagcaagugcuccuugguuccaauugaucacacugagaaguuaccgagaccugagucagagguccaacaugcuggguauaggagguaccucuaggccagcuggaagcccagacugccaucacccacagcuuccaaugugagucuuagagaaauggagucucacguauaacuagugacaucgcuggauggcgagauugggcauauuuggaaccaggguauucagaagauggugaccuagggucuaggcuacaucaaauagaaacccucaaagagagcugcuucccacuugggaacuccugccuuuggggcaagaccucccugauuccuagcacaggccauuuacuguauauuaagcaaauccccaguagcagccaggaaguucugaacaucaccauauccuaguggaagaucauuuucccuugcuuccuaagccgaagguaaagaaaugaaccuacaggggagagaggcauccuuucccauggcgagccccaggaugaaacgguaaggagagacacugaacagagcugugccuccagggugcaaggccacagguuugcugcuacuucuaacuuggaagcuucggcuucucaugguuucagguguggcgcuccgcgccacugucccagcacaguguaaaggcaucugucuagguaagaagaugccagucuccaaaauuagacaacuccugauuugaacugguaaauuuaaagaaauggaaagcucagagauuaaccagaaauugugccaggaagaaaaggguagaagcaccagggcaaccgggggcacaagcaucuuuaaccaacuuuaucucuuaagaagaaauucaaaaagauuuuucacagcaaaacaugcaaaaacgccuuugaauguccagucuuccgcccacagggugccuagcugguauuaaacacccugggaagcgacaccuggccccacgugcaaauuuucaucacaaugcauccagucucuuuuucugcaagcucuuggugcagaaaagugaggaaauuucccugguucuuuuuuuuuuuuuuuuuccuuugagcgcagggcuugggaaggcucaaguuuagaaaacuuuccugaagacuuccgaguguaugaaccguccuccccgggcgaaccccggcaaacaaucuacaagccucucccagaucuuucaaagagcaaggaaaccgagccuuaccuuucucagccagaaguggacugagacagcagcaagcggcggccaacagcgaggccgacagugggaugcaaaucaccaugcuagggaccguacacaaaguacucagcaagauuuacagaccauuaagggaccggagacaauuuggugaaaggaaauuccuuacucgcuguuguauuuuacucuacguuuuccuuuucuuuucuauuuuuuuuuccgugcccacaccauccacuguaauuacaggagugaauccaucauaacccaauuauuuaaaaagucacuaaaaaucucuccuguuuucuuucccccguuuaaaauccuuaugcaagcauucuuuuuuaugguuuucucuaaccuagucuucgauaucacucuuuuguagugugaagcugcagaaaagaacuccuuuucggucuucuacauuagcggug

SEQ ID NO: 6284 - RNA, 3179 nt, Mus musculus
cauguccgaugccucguugccucggaggucuccccucucuuguaucucugcuccucucaccaguggcagaaauggcacuugcggcgaccgcgguggcggcggcggcagccaccugaagccaacagcacugggcuuuuccugcaaaaccgagaccccgauccgccgggcgccccaagaagacauagacaacagccccccgcugggccgagcuguagaguucugggcucuugcucucuuuccguaggcuagcugagcccagguaguccgcgacaaguugcccucgaaguccgccccccuucaccggggcauggucaaagggugacugcugucucugaucaggccaguucuccugcuuccggagggguggggagagaggagcagacaccgcacacagagaaagaaagagaagcggggauuauugcccgcaaacacaggucaccagcugccuccguugacccucccugcuccccaaguccucgagccgccugccgccuccaagcuggcuucaggcgaugcuuccaggacgccgagcccaaggcuaggcucccaggacuggggugcgucgggagucucacugacucccccucguugcacgcgcgcuuuccgcuuuucugcuauuuuccagggcuccccagaccccgcaauugccucgcuuccaucgcccgcaacuagcaccgccgccgagauuuuccgcaaugcaacugcaggggucguuauuuccucgccuacggaucccgacgccuucccacuuggagaggaggagggcaggugggggcgggagcacgaggaggaggggaaggagaaggcucggccaggugagcuuccgugcggccgcccggaguccccacgucagcggggcggccaggcacccgggggcggaggcaaaaaguccgucccggggagggcggcgaggacauaaggagcaguagcugggagucagcacuucaggccacugccucggccgggacccuaggcgccagccuuggaacuccgccccgcccggcugccccgcuuccccuccaggagcuuggaguuucuuuuuucuuuaaaaagaacuucucggcuguucgcucacuacagaaaagccgugcgggacucaucuuggaaggacugcgcugugcucauucccucugcagcggaauuugaaggauuuuuuuucuuucuuucuuucauaauccauucccugcccucuccuuuucgucccucuccugcucccuccuuccccccccccccgcccccauccugcucggaugccagaagaaagcuacuuaccccacaguucucuucgcagauucccugaucaggugcaacucuugcccgcaagucccucaccucccuccucucgcaacggacacucuaaguccggguaccagcggccgccaaccgcaucccuaucagagcagcuacgggagaauccgauaccaucggaaacccaggccucccgggaaacggguuucccuucuuguuuuucuuucaccguuuuucuuuagaaaagcucucaaacgcuuugguggcuuuugauggaccccgggauacucucggucagcgacacucagcagcuuccagggaaggagauuuucccccagcaagccggcgcgcgcgcacucuugcccagcgcgcggcucucucgggccccaggggaaggagggggcggcgagagcaccacccaccacccaggcggagccggagccgccgggucugcagaaggucuagcccuggaagggcggccugggaaugcagugcggaugcaggguaaaugcuaggaaauccugcgcuccggacugcucgccuaaaagggcuaggggugaacagggaaggaaaaacugcagcagauuugugugcgucuaucaaggcaggaguggcuggcggaaagccccagaccuaccucuuuuaagggugcugaagaagaagagggcagggcagagggaaucccuggaaagaucugggguuuguggagaagcuuguccggauacccaagugugacguugggaggcuuugcauaagcgcggauggacacacacaacaaacacacgcacaacccacagggaauauuuuuguacuuuuaaauugcugaugcuuagaagcuguuucacugugagccucgaucuaauaagcauagaaagaguggagaaguggaaaggaagaaggugggaaagaaccauguuuuuugaucugcacaguagaugcagcaaacacagcgaacauccagacuguguggcaucuaagggugcggcauaagagccaaaguaguuacaccagagggcuccccggauucuugaauggagucuaggaagucuagagauucucuguacugggaagucgggcgucaugagacccggaggggagcagugggggugugggggcuggcgcugagagaggaaggaaagcagcuagcugacugcagaaaccagagugugcgguucugcagccuccggggauccuaaaaaagaaccgcuggcagucuugccuacucuuuaagaaggagguguggccgagggaauuuuuuccccccucugagacgacagccaaggacuccagguggccaacgcauuaaaaaucgaggcucggaugaaauaaauccaugcuuuuuagguagagaacuuugagacucagcaggaaagacauugagacuugagaacauuaauagaaucagagacggugagaauuagcccauuugggaaacauagaggggaguguuugucuccgugucuugaaaguagacugcaugaaagggauuuuuuugagcagagagagaagaaagcaguuugccaaaugugaacagagccaucguaggucagcaccacggauagcgaccuaccuucugugauuccaagcugguuuacugacagcaggagagcuuucucucuggaugugcaagcaaagugacuggguuuuauaccacauaaccauucauuuauuaacggauuaugcaaauaucaagugacugacuuauauacaucaagcauuguaguacaguguugugguuuuaaaacugaaaagcacgauggguguuuaucacagagcucagagauugugccuuccuguacauuuugccuuaagaccaaugcuaguaaauaauaguucaucccuuucuuuccugccuagaccugccacugucacuguaaacguuuaauuuaucauuguuuauaauguauuuaaaaaauaaacucaugagauua

SEQ ID NO: 6285 - RNA, 549 nt, Mus musculus
cuuuuauuuuguuuuuuuuuuuguuuuuuuuuuuuuugacacuuguauuuuuuuuuaauuuuuaaugaccaaaacaaaaauauaccuaaaagcgaagcuucuggaaaaaccauuuguucuucccugucuuguaucgcuccucaaacuugaccuuggccucccgccuggccuugcgcuucaaagcugggucccugaacacauccuuguugacaacagucuuguccaaggggauauccacagaguaccuugugggcaugaggugguuguaguuauaaacuuucacaaaggacuugaucuuggaucgcuuggcgaucuucuucuugcccauggcagcugucacuuuccggggauagcggucaauuccagccaccagggcauggcuguaagggcgguccgaggugccaucgucaauguucuucacgaugacggcuuugcguccggaguagcguccggccaggaccagcaccacuuucccggguuucaugaacuugcccaucucgacagcaggcagccggcacccagcagaaaggaaaggagggcacuuccuau

SEQ ID NO: 6286 - RNA, 5401 nt, Mus musculus
gcuacugcuguuuugauuuguaugaaagcuagccucguuguucagcuacacucuaugggaguggccagcuguccgggauuaugaauuauuguggcucauccuagggcaaccuauuguccugacugaaaagccuauaccauagccagagauagaaaaggcagugcaugaagucauaggggaaucaugcugguaauugaguucaucuuggugaugugcccuguucuauuuucuugguucuaggauccaucauuuaccuaccaagauaacuaccuuacuuaccauguaaguuccuggugugaguggaaaaagauaagucguucucaugugugcauaugccauaagagaugucucuaucuuuuagaaacgugaacgaugcaggcggcuagagggcucgcucgguagcuaaaagugauugcuacacaggggcagcaaucugaauucaguccccaggagccauggaaagcaggaaggagaugaccagcugcgugguuagcuucugacuuccccacacgugcugugacccacacccacaccaauaaauauauuucuacuuuaugcguauuaguguuuaccugcuuguaugcuucaguacagcccgcaugccuggugccuucagaaaagcaugucgaauccccuggaauuagaguuacauacagagcugccaucuggguacugggaaucgaaccugggucuccuagaagagcagccauugcccuuaaccacuaagccaacucuccagcuccuaacaaguuuuuuaaagauaaagaugugaagccuuccuucagucaaauacaaggaaacuggguuuucccacggugaaggcgaauaacaauaugggaaaccaucgcaagucauauccauggcuuacggauucuuuuuuagguuuucuugucaugggucuaaaaacuuuuuaagcuggguagagguggcgcaugccuuuaauuccagcacuugggaggcagaggcaggcggguuucugaauuccaggucagccuggucuacagagugaguuccaggauggauggccaggguuacacaaagaaacccugucucaagaaacuaaaaauaaaauauagucaaaucugauggugcaggcucgugaucccagacacuuaggaagaugauguugaaggaccaggaguucaaagcuaaccuaggagcuaugugagucugcacaagagcagaauagauaaugaauaugcaaaauaaaguaaaaggaggaaagggguccuguggagauggcucuguuggcaaaggcuugcccugcgagcaugaaaaccacucaaugcccagaaccuaugugaauaaaggugucaggcuggauguuuccauuuguuaaucccagggcuggugaggaagagauggguagaucccuggggcuuacuaaauaaacagugggaggcuggugagagacccugccuccaaauucacuguggugcuagguugacacauguauuguuauuggagggcaauuuagccauauccacgaacauucaaaccacauuugucauuugagcuauauagcaagguucucuuugaaagcaaacaagcaaauaagagaacuuccagagggagagaaauuccaccauccauaauagcugaccgccuccucagagagacuagcgcgagaggcagcccuuuggaaaaaccugcuuuacagugaucccagcucuuggggcggaagcuggucuccgugggaucuagacuaaguuacgugugaagccucaguuccagaucuugcaaaauggaaaaaccaugauccuaucuccugcucuggcuccuguuugguuaaagacucaaaugcaaggaacguggaagggaaugaaaacccuaagcgccuuaggccuuccuuuggaggcaguauuuugaagauaaccccacauacacuccucaaccccaaaugcaaggcuauaagcagauauuuaccaugaucguccaggucccagugggugcccuuugccuccuacaaggcuuucuccuuauugcuggcaaaacuccauacuucagguaguggccaaaaucucagauagauccccugggaccuucgaaggcgucugugggcagauccagcuggugccaccuucuuugaugccaccuagggucacacaaagggccccagguuuccaccauuaaacucugguuugucccuuugaagaaagagucuacagaaagguucacaacagaaaugcagaggcgugacuucagcaaggccaauguuaacauuuagaugggaaaucgcaacccgcauggagcucauuugaccuccacaggcuuuuuacgcaucggauuccccgccccccccccaaagccacaauccaucuuguuccggcaggcggcugcuuggcuauggcaggacagguuguggcaguuuccauagccugggccccugagggauccucacaagaaagccucaggcuuccagggccggggcucugagcugcagcuuggaucaggaagccuggaaacagagaguuccuucuugcccagauuuuggagacccaggaagauuuuacaccucccauugguguggagaggauucccccagucgguaagagccauggcugggcagucaucugguuuuccaaagcauuguuugcauccccugucuguuuggggcaugauccgauagggacuuaaggggacuuaagccauugaguucccucaacagagccagauguggugguauaugccuauaaucccaucauucaggaggcugaggcgggaggauugaaaguuuauugccagccugggcuacagggugaguucuagauuaauccggguuauauaaugagacccuuuaaaaaagaaaagaaaagaaaagaaaagaaaagaagagaagagaagagaagagaagagaagagaagagaagagaagagaagagaaaagaaaagaaaagaaaagaaaagaaaagaaaagaaaagaaaagaaaagaaaagaaaagaaaagaaaagaaaaaagccaggcagugguggcacacgccuuuaaccccagcacuugggaggcagaggcaggcagauuucugaguucgaggccagccuggucuacagagugaguuccaggacagccagggcuacacagagaaacccugucucgaaaaagcaaaaaccaaaccaaaccaaaaccauaagauaauaaaagauauccucccagcugccugugucuguguaaaaaguaucuuguccccauuuauggaugacuaaacugagguuuggcuaagccagcucacagggcuaccccacccuuguggacaauguguacccucauuucuuccucucaguucuccaggcugcuuguugccccaaagacgaaguucaaaggccuggguaagacugucaucugugaccuuuggucacccuggacuuucucaccgaggucugugucuccagggggugccccugccccccgccaggacuaugagcuuuggcagccucacgggggcacuuuucacugguccugggcaugccccuguggggagggcaggugucgaagccgaccuccgccccagccucccuuccugcugucuagaagccaugugcucucaagcucggugcucgcauuccuugggagucucuguuaccaaaacacggucuuaaaguacaggaaguuuggaaaauggaacaaagguguuugucacagugccacgggcugagcuagcgcugaccaccguugcugauggcaguuuuccucgcugcugugugggcagaaguccuggugagcugccugguuuucauacauuuuuuuuuccuucauccuuuuuggcuuguuugggaccuuuggaagcagggggaaagccuucauagcacaaagcacagaugucaggaaauacuugcuucaggaaagaauggcaggcagaggugggucacgguugguccagaugcugucuggcuguaggcaggcgcacccaguacggccugagaaccccauagccauucaccccacaacccuuucugacaucauaccaugugacuugguagaccuucaacagagacacacgggugacggaggaggagcccaggcucagggcagaaggacauaccgagagucugucuccucccagccugaacaaguagccuagcccacaggauuguagagcaggagcccuccccuucagcccccugggaaguuaaggaagaaggugaccaagaaagcaggaaggcuccgggugaacccaggaacgccauggccuucauucagcucuaagcaugagacucugucauuugccagcaaaggucaugaaguuucuuccuggagguuucuaagaacaggggcacggggaagauuuuaugcaccaugucaagggccugcuagccacaggcacuggcaaggaacaggggccuuuuaaaugaccuaggagcgaagaggccccugcagcuucuaggacaaaagagggugugacuugaagcugggauggagguggccuuguagacauuagccaggacacuggcuuuccuuacuagccaauagcuucuggagccucuguaggcagccaggagggaggggcagacucuguggcaaucccuuggcugagauccggguguuggagggccugguagacagagcaggauuacucuauaaagauagaguaguauucuuucucuaaaaccgauagaucccaggcugcgggggggccaaccuggauugaaaaggccucagcgagggaacuuggaccgcccccauuuugaaucuaaacuguguuaggcacaaacggguaaccaggagaaagcaauaagaaaaacaaagagguaaacaagccagagauagcagcacacaccugcaaucucagugcucuggaggcugagacagggggauuucaaguucaaggacaacgagcuauauaguguuugaaagaaacccaaaucccacgccaccaccagugacagaauuggaaguacagaaggcacccuguuucuucuguccccuuccccggaguugcugggaggauucugagagccaagagggacuaaggcagcuaguguacucccugggggcuucuuucuucagcagugauucucagagugacuuacacucaaacagccaaaccaccaauuccucuucacacccugccgagcuugucugcccuuucacaagauccaggcccugcagauacaggggucagaaucccgcuaaccacgcucaaagguaauuggcaucagggguuuugaacaggucuccauccccucuuaaaugccacaccccucaccgcugccacccccccaccccagcagagauuacagcugcagccccgucucuccugcugugcugugaguggugguuucugggaugcagugugggguuuugucugccuucccugcccugugccaacucacccagcaggccucacugccuuggcaacgcauugcaaaguccacacaaagggaaacugcucaggggagguuggucc

SEQ ID NO: 6287 - RNA, 4073 nt, Mus musculus
cggcagaaggagcgaagcucuggcccggcgcgcagagggcgcuguacggggacgcagggccgggccgccgggcuguguagagaagcgagcgcgcucguguaagcuugccguccccgccaccccugagccagagcagcgagcucccggacccgcccgaggcguccgucgcguguccggcgguggcgacgucuugcaccccgucgccucgccgcucccgacccacccgcgcccccgcccgcugccccuucucccccgcccagccgcggcucggcggcggccgcagcuccggagcagcuuguaaguacggcggggcggcggcuaggggccgagggaguggcugcagcguccugcgagcccggguguggaggggcggccucggggacccaagggaauggaguggcuccggggaccugguccggaggcuugacggccgacgggcaaccgggaggagggagcacccggggugggggcagcggcgcccaggcagggggagggggcgccgggauacagggaucgggcccggaccggugcuccgggaugcuggcuaggucccaggagccucgagcggggagcagagugggggacggcagggucagguuacggcgggggaggggaagacugggcggcccgcgccgcgaccugccggugcccgggccgcgucccugaggcagcuaaagagccugcucuccuuuuccccgggccgagcuccuccucccggagcaagucuaguagucuuccuccucuuccuccuccuccuccuccuccuccuccuccuccuccuccuccuccuccuccuccaccuccaccuccucuggcuguugcugcugcuguagcgcucgggcucccagcgcugugagcagaaaucuaaugagacccaacuggcuguuuauguaauucuucacaguccuguguuaaggcguugcuuuaaaaaccaccuuccacccagccugucugggcucggcugcaccuucaagcaguccagcugaaucugcuuucucugccugcucuuggguuucggcuuggaaaguguaguuugggggcuacacgagagauucuuugcccuuugucaccaagaauauggaaaauggaacagacggauccacaccaguuugauuauuuuaaaugcccuuuuugaucaaccucguuguacaaauagcucucccuuggaaauaccucucuuugcccuugaucuuuucuuauccccacccagugcugauccagcaaacguuuaaaggucgaccuuuucgcuccagccucuccagggacugcccguuuauccgaagagggaaggagauggcuuuuaaaaauaagaauaaaacugagaaacucugcccuuuaagcagaguaaucaauaggaguuuuaagcugcuuguuuuucuuauacuugcagcugagaggaauuucagaauguguguguguggggggggggggcaguacacaauaaaaaagaaaaaggcucccagaagagcaagagugugagagcccuuggcaugguuaaaacuagagaggauaauuugguuucauuuaccaagaugacaacucauuuaguaccuuuaauuuuaguaccagguacuuugaaaauuaaaaauaauuuuguaacuuauaacauuuccgaauauuuaacauaaagcagauuuaaaugugauguuuccaaaaggaacuagggauucacuucuaaaauggugacuagcaaggaaacuaaugaccaacuuguaaaaguggaguguacggguagguggguggaugagugugcaguacaguuaguaaacacugugcgagaagaaacauaaaggauacauguucuggagguccuguaaguccugcugggaagugguauguagaaugcuguuuuaacuauaaaucugucuugaacuuuagcaagaggauuuuuuuuuuuuuuauggucuguuccuuuuauuuuccagcggucauuuccagucuuucuagcccaguagacauuuucaaaaauaaaauugcuucagguagaaagcuuuggagcuguuacauugaucucacuuggauguguuugcuuuuguuuuauuuucuuaaaggaacaagaccacgggaagguugaaggauaaucuucuaauaccagcacuuugaaugagaauuuguuucucugccacaaacugauuuuuuuuuuuaaaaaauuuauuuuucugguggaggaguugaaacaaagcuaacuuuuguggcuucgcagcuaugcagcuugaaauccaaguagcacucaauuuuauuauuucuuacuuguacaauaagcuucccaggagacgugucaacauuuuuggugaagagcuugaaagacuucuuaagaagaaauaugaagggcacugguauccugaaaagccauacaaaggcucaggguuuagauguauacacgugggggagaagguagaccccgugaucgagcaggcauccaaagagagugguuuggacauugacgauguucguggcaaucugccacaggauuugagugucuggaucgacccguuugagguuuccuaccagaucggcgaaaagggaccagugaaggugcuguacguggacgacaguagugaaaccggcugugagcuggauaaggagaucaaaaacagcuuuaacccggaggcccagguguucaugcccauaagcgacccggccuccuccguguccagcucucccucaccucccuucggccacucugcugcugucagcccuaccuucaugccccgguccacgcagccuuuaaccuuuaccacugccacuuuugcugccaccaaguucggcuccaccaaaaugaagaauaguggccguagcagcaagguagcucgcacuucuccgaucaaccugggccugacuguaaaugugaacgaccuccugaagcagaaagccaucucuuccucagugcacucucuguaugggcugggccugggcagccagcagcagccacagccgcagccacagcagcagcagcagcagcagccgucaucaucccagccgccgccuccacuaccgcagcagcagcagcagcagccacagcagcagcagcagcagcagcagcaaaccucugcucuuucucccaaugccaaggaauuuauuuuuccuaacaugcagggucaagguaguaguaccaauggaauguucccaggugacagcccccucaaccucaguccccuccaguacagcaaugccuuugauguguuugcggccuacggaggccucaacgagaagucuuuuguagacggcuugaauuuuagcuuaaauaacaugcaguauucuaaccagcaauuccagccuguuauggcuaacuaaaaaaacaaaacaaaggagaacauguaucguacaaguuaaaaugcaucggcccaagggggaacuuuuuuucuuuuuuuuuuuugccuccuugagauuuuuuuuuuuaaagcuuauaguaaggacacauucaggcuugguuacaaaauaaaacacgcaucauuuuucauuugccaaccaagcacaaaguuauuuucuacugacuguauauuuuaaaguauacuuucagauauggccucuuacaguauuuaagauauagcaaggacauggcugaauuuuuuuuuuauaaaaaauuggcacuaauaaguggguuuauuggucuuuucuaauuguauaauuuaauuuaguacaaaguuuguaaaauaucagaggauauauauauauuguuucuacgacaugguauugcauuucuaucuuuuuacuacagugaucugugacagcuucauguuguauuuuuuuuacugaaauuguaaaauauccaucuuaaagacaucagcuauucugaaaauuguguacaggauauuccuuuagugguggaauuaaaauguacgaauauuugcuuuuucaaaaaaauguauuuucuguuaaagguuuaaagauuuuugcuauauauuauggaagaaaauguaaucguaaauauuaauuuuguaccuauauugugcaauacuugaaaaaacgguauaaaaguauuuugagucagugucuuacauguuaagagggacugaaauaguuuauauuaaguuuguauuaaaauucuuuaaaauuaaaaaugccuauccugu

SEQ ID NO: 6288 - RNA, 2543 nt, Mus musculus
uacagaacaaacugcauuagaaugcaaggcaauaaagcaaaaaacuagaaacauccuggacaaauaaauacuagcaguuuaauuaaaacaaaguaguccaacaugugccucagaaauaguuaaguuuuaaagcauauguuucugccaauguaccaacacaagauggacuuaauaccaaaaagaaaaaaaaaacaguucaaccuuuuuauuaaaaaaaaaaagaaaaagaaaaagaaaugacagcaaaaucccuaaaaaaaggauaauuaacuuuucaauggcgacuauauuacauacguggacaguaauuuccaaagaggcacacuaaugggggcacgaagucugcuacaaaauagcugagacaaaacaauguaccucaaaauguuuugcaggacuacacugucuuuuccuucagaagaggcuuuuguaugucuucuuacucggcuuagcuccaucuucaucugugcauacuuacgcugcacugucaaacaguaacaaaaagcccuaaucaaagugagaaacaauacacuuaccucugucugaucugaggucuuaucagaucaguuuuaauuggacugagugucaccuucagauuuaaugucuucacuggucccauugaccucauucuuagugucacuuuccuucgauucaggguuugugucuucacucugcuuuucucgacuacuggacuucacacuacucuuuuuaucaucagaucccuucuuuucugccauaaaagaagacauugaccauggaauuuacagugaaacacaacaaaucuacuacuauuuaaaacaggaaacauugagagcaaagaaccauuucccacggcugugagacagucugcagagcucagugcugucagcuguagauuacagagggaaagggcaagaagaccaaaaagaaacagaaaauucucucaaaccugcuagagucacccuauaauugacaacuucaguaaauuucauucuagauaaagaccauccaaaggcaacaagaaagacaaaagacaaauacacaaaacgguuaacauggguuaauuaaguugcaaggcaaaauggcacccagaaauuuaacauuuaaaugacacguuuauuaaaagaaaacuuauacauauuuaaauauccaagagggggcacaccuaguaagaaaaugagaucuucaaaaaaaucuaaaaacccaaauuuguguuuucuguaaugaaaucuaagagguuuuuuuccuaaaggaaaaaauuaaagcugaguuuggaggaaaaaaaaggcagcaguuuccagcuuucccuagaguugcauuagaaaggugaaaaagcccaugugaaggaaaagugucgucugccuuccagcuguacauuacauguaccucuacaaaaggauucugcaaaacuauuaaacacaccuuuccauaaaagcuauuuuccccuuaaaacuaagaacaauucauuaguuugacaaaguagcucauaacaggaagaugucugaagagaagcacucuccagacaguuguuacagacacaacaucaaacaccuggaaggaggaugggagcacaaaaaccagugcuguggacuugcaucuacagaaaggaaggagugugcaucagguccagccuuuguaaaccaagcacagcacugucuaagugguuaaccauagacuugcuucccagcugucuguccaccugugggaacuaugcucuaacugaccuugugggaaaguccucccuuugagccuuaugggcuucuccggugcacagguagcuucaaugaggaagagucgucuuguugcuccguagaggacuaguaguccaaaaaucuuaucuucuggccuauguaaauaugguagaucuuaauaguccuaaggauauccauguguguuggauuuuagaguuagggauuaaacagaaacucucugaacagaauauagauaccuauggguagaaaauuacucccccuuuguugaguuccguuaggugcuucuguuaugauuacaucacguggagcagugaacagucuuacucaucugccauuauuagauguuuguuaguacagaugccugaugcccacaggccagaaugcuaucuuuguauauucagaagugucuagaacuucccuaagucaauagacucaucauuucuagaagucuaaaguuuacguuaaugcuauaauggcaggcccaacauaaauaggccugcuaaguuuuuucaguaucuagucuucucuuuucccuagucucaccaggaaacuucagaauuuuacuaaauucaacuugucacaagucaguaaucaggacauguuuuugcuucaacacaaaauuauacaaauguugucuauuuaaguggcaagacuggaaaagaacaauuaauaaaacagaaauauguaaucaaaagcuucauaauacaugggugauugauuugaucugauguaagagucaucagguaacucuucaaaacugaucucacuuaaaauauaccaaagccuuucuaaacaaaacauaguacaagaggagacuucacagaaacaaugucugaauuauaauaagcagaggca

SEQ ID NO: 6289 - RNA, 1950 nt, Mus musculus
uggugguacaugccuuuaauuugagcacuugggaggcagagacagguggauucugaguucaaggccagccuggucuacaaaccgaguuccaggacagccagggcuauacagagaaacccugucucgaaaaacaaaaaaaacaaaaaaacaaaaaacaaacaaauuaaaaaaaaaaaaaaaggacacacaagcucacacccagaauauauacugaagcugucugucuuaugguugaauuauguuguaaguguauaaauacuuggcaaaaucacuuauuuaucaacaagaguuguuaaauaauuacuaugaccuggaacuauuuuagcuaguggacuaacaaaaagccucucucaucacgaagccccaaggcagugucugagcucccuaaaggcauugcuccccuuuggauugccuaggcaaaacgcccuaccuccacccucugagccagcucucaggccuucucuugguuccugacuaaugcuguauauacagccaaccugcaugagcaguccccaagugccgugcccuucgauaaaccaaggacacacauccuuuccuuaauccugugacugguggugcccaugagcuaucuaucaaugauuauuacucuuugacuaugccugccugagguccugcugccaucaagagaguagaauuuaaagucaccuagacucacuucagagccuaaguuuucaggcuauugagcccccuucucuacggucggcaaaggaaaggguuuuuuuuugcuuguguuuuuguuuuuacuuauuguuguuuuguuuuguuuuguuuuguuuuguuugcauugccuagacccauuuccuucuagcuagucuuucaaacccucuccugcucccugcucguccauccagaucucccaccagcacggagaacaggcucucaagggcugcucaaaggagcagauaaccucugggcuuuuccuuuccugcagcagccuugcaaaaugcaaaugaggagguacuccugcucgaagacacacucagcacccacacagaccugacagacaaugagccagccaucuacgagguccgcaagcaguucaugagguagauucccaagaguucucaaguccccagcaggugacaucagggcccccaugcaccggcacggaggccacaaguggacauucucucccuguuacacauguccugggagggcguccguaaucuccugccuaggucugaccguuugccuccacagagagaugagcuccuugucuucugaaggggagguccagaaccggacuaugcccaagaaacacacaaauucauuggagaaggaggcgcuggugacaaagacuaaggagacuggcgcauuaaucaaagaggagauagcagagacaggcaauguaagcaggguggacauggccugggguagaugauuagguuccccgggaucaugaagaugguguggccacuccuuacaggugaagcugaguguguacugggauuaugccaagucuaugggacucuguaccacgcuaucuaucugccuccuguaugguggccaaagcgcagcugcuaucggagccaauguguggcucagcgccuggagcaaugaugcggaggaacauggccagcagaacaagaccuccguaaggcucggugucuacgccgcccuagggauacugcaaggugaacacauuggggugcgccucccuuccucuccucugcccacuccccaagccacaaaaccauaccccugucucagaaccuccauaacuccaccgggccauccccugucuccuucuucccgucugucccagcuuccuccccuggggugagugacucgcucucugucucucccaaucagggcuccuggucaugcugucagcuuucaccaugguggucggcgcgauccaggcugcccgccugcugcacgaagcucugcugcacaacaagauucguuccccucaguccuucuuugaca

SEQ ID NO: 6290 - RNA, 715 nt, Mus musculus
agccccccacaugcucccccaccggggucccccgguugugugaggacaccuccucggaggggcuccgaucgccccucuucggacccccgggaccccagcuggccagaggauggaugaggaagaggauggagcgggcgccgaggagucgggacagccccggagcuucacgcagcucaacgaccugucuggggccgggggccggcaggggccggggucgacggaaaaggacccgggcagcgcggacuccgaggcggaggggcugcccuacccggcgcuggccccggugguuuucuucuacuugagccaggacagccgcccgcggagcuggugucuccgcacggucuguaacccauauccuucggggcacagcgaugggccggacuagggggguccacaggagggcgggccguguugccagaggggaccguaagccaggugaguuggagaagugagccuggacugugaacaguugagugggggacuguuaaggaggggagggggcguccgaguagaagcggagacugguggguaccccagacgagccccaccuccgaauacacacaccucagccuuccuugggcgggggugagggguggaggguugaaauccaagcuaggaaaagagaggagaggugacccucugguaagcaucuggaugcucuacagaugugggcagaggagggucgucauccuccagaugugggcagcuucaggag

SEQ ID NO: 6291 - RNA, 4402 nt, Mus musculus
gugaauguugaacacacauacauuuauguuuauagaaaucuggagcgcaaacaggaaggauaugcagccaagcgcuacugguauccugguagcauguccuggcaggcaggaacuggcagaguuggggcaugggccugaaauucuuucuggcaaucagggugggucaggggccugauguuuguuuccaaauggcagggacagagggaaccgaggaaggugguaauaacguggucaucccaaugaccacugcgcuuuagcuccgauggacagaggguaggagguucuacaauagcuucucucaaaggagccauggcagagcccagacacaguggcuggggagggauucugugucuuuccuaggaccccacuggguggagcugggauggugauagagagcccagugccccugccaggauguaccuaggugggggcgggggcggggcagcgcugugcauccgcagaggcuguaggagaagguguggauaaugggagggaacgucaguagucucuccagcggaaggcagucgccaggacuggcuggaucaggaccuauagugagagaagauggguauuaggauuccagucacccagagucauuaaagggacccauggacguccuaggccaagccaugggagagguuauccuguccucccuccuuuucuuguaagacagggaacugauugcuccuccggagguggugucaugggauauagcagcaccccaucuggaauuuccaaagguagaccgugguggccucccuacccagcccccaccuguuuaauggcggccagcuuucuuggaccucuuggucggggauuugcagcugcgaagggcaucugugucacgaauccgcugacccuugaacuuggcuggcgaggagcagguagcauccggucgagaagccuuggcuuccaaccaccuacagagacaaagaguugcugggcuuggaaaagcugggugggaaggcuugggaaagggacagugaccgggauggacuauggccauagaaauaucuggaguugucaucuucauuugacaaaugagagaagggaaccacucaguacccgacaugcuagguagcugacuaggauguccaggcuguccuacucuaggaccgucugucauguggacggcagucuggggguuauauggaggaauauucucaccgccgaaggccacggagcuggcaggugcauuuccauggguuguuggugagagugagggucuccagguugucaaaggggaaggaggaaggcaguugguucaggcgguuguuguccagauggacguguuucaguguggucacacccgagaaggcagcaucugagaacugugaggugagggaggcagagugagcaccucaacucagucuccuggcucccuucucagaggaccaggguugucuuucccuggacacacgcccuggccuguugaggagccacaaugaugucauccuccacaacaccuuuuuuugagagagagagagagagggaagggguccuucccaauguguaaacggaaaagguucaguccuuuggacagggucaccuagcuaguaaacaguagcugcaggaccacacccugucccccaccuccuaggcagcacccucccugcacaaacacugggucuggggagcaggcagagcuuggcuuugagugcccgggcgggcacacggugaaccuggucaguguuuggugggaugggcagugugccuggggcgggcacacggugaaccuggucaggguuuggugggaugggcagugagcccaggcuccccacagcccccuggucccaggauuucccccagugguguccucauugcucugccuucugcuagaugcuauuuguggagcucucugugggcacuuuggccaggauggauggcuccagaggaaauguauuggugcccuccucugagccuuggugccaguuucucucuggccuccucauucuuuuuuuuuuucuuuuuucuuuuugguuuuugugagacaggguuucucuguguaguccuggcuguccuggaacucacucuguagaccaggcuggccucgaacuuagaaauucgccugccuuugccucccagguacugggauugaaggcgugcgcuaccacgcccggcuuuggccuccucauucuaaaucagccuucguaugcuguucuacuggccacuguuuugucacuaggguggucuacauuuagcuggggugaggccaggcuaaagaagauccacccagaaggcuccaucuaccuagauaagguuggccuucuguccucagcuccguaucugugaccucucacagaccagauugggcugugacguucucuacaaacaaaacuacucuaccucgcucuggucucugcccgaaccuucuggcugaaacuguguuguguaccagggugauucccugaaaaggacuuugcuccuagacagccccgaccaggcuagccugagcaucccaagggaggaagaauugaggagucugggaucuggugacuggggaaagcaaaagucaacaaacugucugcuggacagugagacagucagucugugcucugaggagacacuugggggggcgugugccagggauugcauguguuuauucacgggcugcaagagcaccaagccagcaacucggugaagccaagucaggucuccgugucuugguuucccguccuuauuugaaaucgacccgagguugcaauaaaauugaguguguuucgacccacggagggaaugggacgagggugugggagaguucuccuuaagguaccugcuccccaauucauccucuggccucucacuuuaccuuagcaacacaggccagcacccacugggaacaggcacucuuuguguucucucagcuucuggaaggugccucaguagacaaaccuuccuuuaugaaaugguaggcuugcaggagacugguaagagagggguggaaaguccaacaggaagaggugucugcuguuaaccguggggucuggggcagaugccuccccagaggccauuugugggaccagaacaguuccaucucuuacaaggagucccaagagagcccugcugagaagccucgggaccagguaagggugagaaggauggggaggggugugugucaaugcagagagaaguggcaaaggccccuugcuuuggaggauaaucugagugacaaggaguccaggaggagggaaugcugucccgaugugguccugggguggcauccuagaaagagccgggagaacugcagcuggggcacuuaccuucuccagguugguguuauccagccagagggucuccagauaucuaccgaaggacuggaaggcauugucugggaugcucuucagaggguugugagacagcuucagcuccuccaccacccgaaguuugcucagggcggcugagggguagcuagacagcugguucuuguccagguggaacuuggcuagguucuccacaucauccagggaaccaggcugcagggaacugagggcauuuucugacagguagagccagcgcagguccuuggcccccuggaaagcuccagcacgcagcucucggauuuuguuguuguugaguugcaagaugaagagguugaccagaggagagagcaacccccggggcaguuccgacacuuuguuguggucuagauagagguaagugaguucagucaggucgucgaaggcuccagcucgcaauacccggaugucguugugggacagguacagguagauaagcugcuucaggccucggaaggcaccagccgccaccucgcggauguugcaguguugcaggugcagggagaccagguucggcaugguccgaaacgaguuggcagccagcaccgggaaguuguugcgcuggagauugagcaguuugguugucucugauaccuuggggaucuucugcagccccaccuugucgcagaugacaugcugcagaucuccauggcaguggcaguuuugggggcaggcggcuagcgcaggcaggaggauggcaagaaagaccagacugaauaagagcgcgcgggccaugguuggaacgccuugagccugggcugggggcuaaggcagcgacaaguccucgacucucgggucucccggcccauuuauagggcagccuugaccgcaguuggcagcggagccagcuacuacguggagcaccgaagccacugauuuaaccccuucccgcccagagaugcguccccauccucgauggcugggggccucuuuucacagcaggagaccguguguagggcugagggcccuuccccugaaccccaaccccuugguuccuguuugcaaacauuaugcugcaccuuccccuacccuccucuaucuggaccaacaccccgaggugggguggacggugauaggugugucgaggggccucugaauuuccacug

SEQ ID NO: 6292 - RNA, 1254 nt, Mus musculus
uagaaauguucuccaccuggacugaaacugcucaaauaguagcuaaaaagcucuaucgccagagcgagugaagccuucagggucuccgggcggcgcagagaaggaaggcagcggcucucccccugcaggcgcgcgacccgguccguccugcgagcucgcgcugguuccgcggccugggccgccgccaccaccgccauggccggaccgcuggugcccagcucacagaaggugcugcuacuggaacugaaggggcugcaggaggagccgguggagggcuuccgggugacgcugguggacgagggugaccuguacaacugggagguggccaucuucgggccccccaacaccuacuaugaggguggcuacuucaaggcucaccucaaguuccccaucgacuacccguauuccccaccaaccuucugguuccucaccaagauguggcacccaaacauccaugagacaggguucgugugcaucuccauucuccaucccccagaugacaacccacaggguggggagcugcccucagagcgguggaaccccacacagaaugucagaaccauccuccugaguguaaucucgcugcugaaugagcccaacaccuccucuccugccaacguggacgccucggugauguacagaaaauggaaggagagcaaggggaaggaccacgaguacacggacaucauccggaagcagguccuggggaccaagguggacgcagagcgcgauggcgugaaggugcccacuacgcuggccgaguacugcgugaagaccaaggcgccggcgccggaugagggcucggaccucuucgacuacuacguggacggcgaaguggaggaggccgacagcugcuuuggggaugaagaggaugacuuuggcccgaagaguccugacccacgucccugaaauaaacuuacaaauuuuaccucagcaggacccgugugggccucaggcgacagacuaccucaccgagguuccaugugggcuccuauccuauaauccuuagguccucuuaccccguauuccccaugggguuuccucggcuuuggagaagagcuguggugcagggcagacaccccacucagcuuucagaugaugacaagccugggaggcuggggaccgacugccugguggggagacagagacuccagcccagcccaagggagggccagcaccagagucuccucucugcuuuuagugugugugaaauaaaauaaaauagcuuucugagggggggggggaagcucuucu

SEQ ID NO: 6293 - RNA, 1254 nt, Mus musculus
agaagagcuucccccccccccucagaaagcuauuuuauuuuauuucacacacacuaaaagcagagaggagacucuggugcuggcccucccuugggcugggcuggagucucugucuccccaccaggcagucgguccccagccucccaggcuugucaucaucugaaagcugaguggggugucugcccugcaccacagcucuucuccaaagccgaggaaaccccauggggaauacgggguaagaggaccuaaggauuauaggauaggagcccacauggaaccucggugagguagucugucgccugaggcccacacggguccugcugagguaaaauuuguaaguuuauuucagggacgugggucaggacucuucgggccaaagucauccucuucauccccaaagcagcugucggccuccuccacuucgccguccacguaguagucgaagagguccgagcccucauccggcgccggcgccuuggucuucacgcaguacucggccagcguagugggcaccuucacgccaucgcgcucugcguccaccuugguccccaggaccugcuuccggaugauguccguguacucgugguccuuccccuugcucuccuuccauuuucuguacaucaccgaggcguccacguuggcaggagaggagguguugggcucauucagcagcgagauuacacucaggaggaugguucugacauucugugugggguuccaccgcucugagggcagcuccccacccuguggguugucaucugggggauggagaauggagaugcacacgaacccugucucauggauguuugggugccacaucuuggugaggaaccagaagguugguggggaauacggguagucgauggggaacuugaggugagccuugaaguagccacccucauaguagguguuggggggcccgaagauggccaccucccaguuguacaggucacccucguccaccagcgucacccggaagcccuccaccggcuccuccugcagccccuucaguuccaguagcagcaccuucugugagcugggcaccagcgguccggccauggcggugguggcggcggcccaggccgcggaaccagcgcgagcucgcaggacggaccgggucgcgcgccugcagggggagagccgcugccuuccuucucugcgccgcccggagacccugaaggcuucacucgcucuggcgauagagcuuuuuagcuacuauuugagcaguuucaguccagguggagaacauuucua

SEQ ID NO: 6294 - RNA, 16898 nt, Mus musculus
ugauuggcugggggccgggcugcuggcucccccucuccgagaggcaggguuccucccagcucuccaucaagaugguauaaaaggggcccaggccagucgucggagcagacgggaguuucuccucgggacggagcaggaggcacgcggagugaggccacgcaugagccgaagcuaaccccccaccccagccgcaaagagucuacaugucuagggucuagacauguucagcuuuguggaccuccggcuccugcuccucuuaggggccacugcccuccugacgcauggccaagaagacaguaaguuccaaacucuggggaguuuacuacagcuucuugguauugcguucuguauagagggguccuagcagauaagacuuaaauggaggugcagggcugcuccagaggcagggaugggacggugauggagaggaaacgggaugagagaggucacccuguugagcagaugagggggagcaguucucagaaguggagccuugcaugagauggcccaggaagaaauuucaagcacccaucuguagcacaacaggaaaagugggaaucuggacacggguuggggcagaguacgucgaaaaugaaauaaggccucuggaauagagauucggagcucaagauguaaaagcuaucaaaaaggcugcgggaugauucauaaggaaagauuguuugcccucucugcaggcuagacaguguugcuggggccuccggggugcugggcucucgggggggggggaggggacgcacggagagggcggguugcuggaugagaaaguuuggcuaggacuugacugggcgcggucccugugccuccugcuggccagccgagagcacuacgaguccugguacagcacuuuacagcgcacaggcugagaaggaaaaccuggguuauugcggacccucaucuccagacuaggaaaauaaaagcagggauggaugggguagcucuggucuuugaaagaagugacccaggccgaguaaaagucgguccgccccugcauugcuuaguuuugcccgccaccuagugguugccuugaucagguccuggagcggugggcgugguuaacucaucauuacuauuuguagacuugacuucuuuggcuaaggagauuccaaagcacuacuggcuuugaaggacccggcuugucuaguuagcaaguuuucaagauuccugggagcuggaaauugggauguaucuaacuuuagggauacauuuuacuacacuggacagggcuccacugaaaucagccccuccacauuguagccccgcccauuccgccccaccugccccgggaaaggaggugggaccagggcugaauuuccccuucucuccucccacccccgccuccugucuccgcgcaaaccacgucccacgagcccccaccuacugcguaggagcccuccuacucuccuucagcaggcuuuuuuauuucauuugguucccgcgcgcgugggcugaaguuguuuggaagaaaccccagucuagagcuuuguuuaaauuccugagaacugggacguuauaguccuggccaggcgcccuggugcugucacugaacgucgccgauauggagcagaccugcauuuaaggauuugagggaagaauauagggaguggggggaaagauucaggaagugggaagucuccgugcgccucuuagacagggcaaagagugaguaaggcugggaucccuggugcuccgggguaaggucucugacccgcacacauccugugucucuucccauuugcucagucccugaagucagcugcauacacaauggccuaaggguccccaauggugagacguggaaacccgagguaugcuugaucuguaucugccacaauggcacggcugugugcgaugacgugcaaugcaaugaagaacuggacugucccaacccccaaagacgggagggcgagugcugugcuuucugcccggaagaauacgguacgguucugguccuaggguuaagggagguuggagucccucccucgccuaugucuugaaagccuauaacacccccagguaccuuaguaaauuuacuucuaacugaacguuuuucuccccaguaucaccaaacucagaagauguaggagucgagguaauaaucugcucccuacuuuccucccacccguccacgacccccacuguccuccaauaaacugcaguuuucuuugcuucucuuaacggccuuuuguuucuucauccucaaccccacagggacccaagggagacccuggcccccaaggcccaaggguaagcaucguauucuaaaugagcugggaaacuggagggggcguggcucugauuugugcucauagcagcccccuccgucucuuggugcagggacccguuggccccccuggacgagauggcaucccuggacagccuggacuuccugguccuccuggucccccugggccccccggacccccuggccuuggaggaguaaguagaucuuggagaccccagaggggugugacuucccguuuuguuuguuuguuugucugucuguuuguuuguuuuucuuugcuuugguuuugucagacauaguuuucuauuuuaaaauaauuauaaacuuacagaaaauagaauagaauagaacuucuauacacucuucaacacaaccgcuuugccacuuucugggcacccaguucucuaugucgcuguauguccuggaccauuugagacauaaguugccaagaacgugcccgugacuuacgaucuuaagugcauuuccuaagagcaagggcauucuauggaaccauagcaccaaauuuaauguugaucuagccugauuaauauugccugauaugcaaucucauuugcagauuucaccaaugccucccaaaauguucuuuauagcauuucucccgcccccuuccugucuaagaccgccaauugcauuccauugucucauuccuuugguucccacaaauguagacuguuucugagacucuaugucauccuugacuugggaagguuuugaagagucuggcuguugggcagaggguguuauuuuauagguucuucuguaguuugggauugucugguuagauuaaauucagucgaggugucugguacaggaauaucuuacaggcuauauugcugucucccugaguuaauuacuuccggaagccuacauccguuugucccauuacugcuaaugccuccuggcuuucaauuuaccauccagaguccaauuucucacacauucucucuuguuuuucuagaacuuugcuucccagauguccuauggcuaugaugaaaaaucagcuggaguuuccgugccuggccccauggugagccaccagggggagcagugaccacacagaggauaggcaucccgaagagaaaggccaaugauguccugcaagggggugguacagauagcuugggagguaaaggccaccuuagggacuugagaucuacaguagaugcaagucagacagugauccccacaggaagagguagaaacagauuucugccauacugccuuuauucacagauaucaaaagccccucuuuuuccuucuguaggguccuucugguccucguggucucccuggccccccuggugcaccuguacguaucuaagggucuucauggaucauuuugggcauguacuguugcgggggugggggagauggggaugagggcagaaggcugguagacaucucuuguaagagggagacagcccgggaggaaccugccuuucugagccuauccuucucucguguucuucaggguccacaagguuuccaaggccccccuggugaaccuggcgagccuggcgguucaguaaguuaguccuccaugccgacacaccuccaucuccacaaauucuccuauggaaagucaccuguacugagagagggguagcuugucaccuccucgcuccagucuuccuccuuauugucucucaucuaagaguucuaaaugcuucuccuguccccucuaggguccaauggguccccgaggucccccuggcccuccuggcaagaauggagaugauguaaguaccccuggggaaagacacuaucaaauccuguggccuucucuauguggguccugaaaucuucccagcagggucucagcaccaauaaccaggagaagucaagaugacccuuggcagucaucuuuccacugaauagaauguuuuagugaggcagccuccauccccacuugcauccucacccccauccaucuccaucccuuggaguaauccagguuuaagaguucugggugagcagauguggaaaugaauacaccacuguagauauaaacugaguuuuagguuagaaguuagauuuggucccuuaaacugaauccacccuucaaugggggauagaggagcauugccauaaugggcuuuucucucucuguagggggaagcuggcaagcccggccguccuggugagcguggaccuccuggaccucaggugagcaggaugugagggugggcccagggcuuacugcacuggggauacauuuaggagcaauagucacagagcccuuccuucugacacccuuccaaguccucauuugccuuucucuccagggugcucguggauugccuggaacagcuggccucccuggaaugaagggacaccgaguaagucucuuuggagucacugaagcucccaaagccccaagucaccauucucuccccuucccuaagagauccuguugugaaucauguuagaugguagcuagagauaucucaaaggucauagguuagacaucugaaaggacuuccuuuugugggggaagaagucccaauaaagagacuggcuggaugauaggugaauugggaucuacuuuagcucagagacagagagauggcuggagaucuuccaaaaauuauugucaaauccaugugggugucaaagugguauacucccccaacaggggucuuacuucaucucuuuucccccccauuaagggcuucagugguuuggauggugccaaaggagaugcugguccugcugguccuaagguaagauacugaugagagguccugaaugaccugugcccaacaguccuacuaugaaugcuucacucuguucucuguuccuagggagagcccggcaguccuggugaaaacggagcuccuggccagaugguaaguaggccagcuugagugacagggggcgcuccaagagggaggcugcagaagagggugucuccaucucauucgaccucccuugguuucguuuuuaggguccccgaggucugcccggugagagaggucgcccuggaccuccuggcacugcuguaaguacuccugccccccuuggaugccccgggcucugguugcaguucccuggggacuaaggguacuggccacugcucaggggacauaauugggcuuccccucucucuuacagggugcucgcgguaacgauggugcuguuggugcugcuggacccccuguaaguauggccuugacuuugaguaugggaguagggugagaccucagggucagcucuuggggcugacaucaacuuuugaaacuuagaagcucuuagucuccuccaccuuguagcuaaacuuccauuucauccacagggucccaccggccccacuggcccuccuggcuucccuggugcaguuggugcuaaggugaggcacguucuuucuuugaacaugauugucauaggcaaugggcuaggcaucacccagaucagagaagcccaggguggcaagaaugaagcacacucuacaauccuggacucaauccugguguccccuuccuagcucucaaaguccucguccuugcucccccgcccuccaacaccugacauacagaaguaaugcuggcugccccaaucugauuuguccuuuccuccgaucuagggugaagcugguccccaaggagcuagaggcucugaagguccccagggugugcguggugagcccggacccccuggcccugcuggugcugccggcccugcugugaguguccuuccugcugcugaccccugugcuacccgccaacuucacaguucuaggcuuucacucacccuccuuucucuaugugacagggaaacccuggugcugauggacaaccuggcgcuaaaggugccaauguaagucucuagcagcccuccucccaugagccaccugccaccugccccaugcccuccacccuugggcuaaaaugucuguccugacuccugcagggugcuccugguauugcuggugcuccuggcuucccuggugcccgaggccccucuggaccccagggccccagcggcccuccaggucccaaggguaacaguguaaguauaagacucucccuucugccucgcuuguucaugagcuccagggugcccccuucuggagaaacauacacuugcgagccaacagagcaacuuacccucuuucucucccuacacagggugaaccuggugcuccuggcaacaaaggagacacuggugccaaaggagaacccguaagucacacaucaccccuucucccccucugcccccagggucaggaagccucaacggggagcuccagggaggaagggagcccccuccucauacccagaaguccuauuacuagaggccagcaucauaggcuccugggcuuguacucccucaccaaggcuacucccucucugcccacuccagggugcuacuggaguucaaggucccccaggcccugccggagaagaaggaaaacgaggagcccguggugagccuggaccuuccggacugccuggaccuccuggcgagcguguaaguguccccuguccccugugucucuccucauuugcucuuagugcuugcccagugcugugaugguaauaggcucacuggccuuuuuuccuucucccugcaggguggaccugguagccgugguuucccuggugcugaugguguugcuggccccaagguaaucucucuuccuggcagagaagcugacucccccagcugcccgacgucacuucccugacaguacgguugacauccaccuacgcucauguccgcagcugugcucccugccgccuugcaaccacggcugugucucccuccuccucuuguuuggccucucuuuggcauccccacgaauccaccucaaaguccaagaccuucucccagcaugaagaggaugcuaaacccgugguaauaaggccaaggcuguggcccugaugcgucugugacuucucuccacuuaggguccuuccggugaacguggugcucccggaccugcuggucccaaagguucuccuggugaagcuggucgccccggugaagcuggucucccuggugccaaggugagaagauccucuguccuguaugggacuuggagcagccugcagcuggugcuccagacuccucccccccucccacacuccgaucccccuccuccccuugucaucccccuccuccugcccucguucauggccuucugcuucacccuagggucucacuggcaguccuggcagcccugguccugauggcaaaaccggccccccuguaaguaugccuguucucucaugccucacccuacccuccugugugccuaccuuaguccuuaccacaacucuugugccucccauccucagggucccgcuggucaagauggucgcccuggacccgcagguccuccuggagcccguggccaggcuggugugaugggauucccuggaccuaaggguaccgcugugaguauucagugaggaacacuacagaaccagcaacaggcauacuaacucgacugacacucugugugaccucaggcccuuuacugacccuuucuggacccauuagugaaauaagagaccauugguuggcuccaugaccaucauucuguccuugauaaauaaguauugcuaggcagacuccccugaacacacagauaauauggucuuuuuaugugauagucacacccaagucugguaaggagagccuugagaugacugccauuagucagugaaggugugugucaaggggaagggaaggggaagggugaccaggaaggagucucgggcaggagacugcuuugggugcaggaagagaggcugagcauuagaugccggcaagaccuucccuagacccugaagcuugccagccuccugcagucuucuugaacagaaagccccuugggaaugcucacuguaaugagagguccuuggcuguaacgagucucgaccugugacccucaaucuugcuucccuuucuacacagggagaaccuggaaaggcuggagagcgaggccuucccggacccccuggcgcuguuguaaguaucucuuuggagucucugaccuuucugccccugccugugacauacaccauccucccauggaggaugucugcagccacugucacaacaucggaagucacuagggggcucugcugugucucagagguccagucccuaccugcggcucucaucucccauacugaauuuauugccuucuccccacaggguccugcuggcaaagauggagaagcuggagcucagggagccccuggcccugcuguaaguauuccugucugcgagccuuggggagcaggaaagguggggccuugcuucccuuccccuuggacuauucaugaccacugccucuucucuaccacaggguccugcuggugagagaggugaacaaggucccgcuggcuccccuggauuccaggugaggcuucaugacuuagguuugcagggaagagugcagaacacuccuuuguuaacuguuaaagauucuaaauccuaccucuucuccccuccaccucccaccuuacagggucuuccugguccugccgguccuccuggugaagcaggcaagccuggugaacagguaagagguagcagcaggacagaaggugggagcaugcaagaaauacaaagaaaacagccacccacugcuugcagcugaugggggugggaaucaccagcuagagggauagggauuaaacgcaaagggaggacuuuggauauaccaaaugugugagggcacucacugcaaaugaucuggcacuggcuugguagccucuaggcaaggugacuucucuauacacacuccuggaauaacucuggcuuuaccucaagccuuccuauuguaaugaggaauuucaguucuaagcugaguaugugguccugugggcuccugagguccagcuucuaggaagagggggcagagguucuuucucgggguggggguagguuggauucacugcaguuccucuuucuacacucaggguguuccuggagaccuuggugccccuggacccucuggcgcaagaguaagugagccuucucgugccacuuccguuacgacaucccaagcuugguccugucagagcaucaugugcccuuuccuuccuuucuagggcgagagagguuucccuggugaacgugguguacaaggucccccagguccugcugguccccgaggaaacaauggugcccccggcaacgauggugccaaggugagggcaucguggaaaggucaugacgguugugucccagaucauaggacuuggggacaagaccagagugggggcccaggagucacaaggucgggucugugaguuugucccucugguuggaaccugugaucugggauccacacauaagggauccuaagugggcucauggcucugagacaccucugggcucacuaaucuuguuuccuaaacagggugauacuggugcccccggagcucccgguagccagggugcccccggucuucagggaaugccuggugaacguggugcagcuggucuuccagguccuaagggugacagaguaagucaaccuucccuucccaugagcccuugugguucucauuuaucuucaugcuuuccugguuaaucuaauaccugugacucaggcccuucugauguguuaccauggggaugaaaguuggggcaucucccugauggagguugcuuuauuuaccacucuguagaauucaggggccucuuaacccagguuccaccugaauccccaaguaggccccuuuaaccccugaaagaacuuuacauccuugacagagcuaaggagggccucuuagauauagcugcagaaugcuguagcucaacucuuggccccaaucuggaagucucagggguuguuuugguuuuuuuuuuuccuguuuuuagggugaugcuggucccaaaggugcugaugguucuccugguaaagauggugcccguggucugacuggucccauugguccuccuggcccugcuggugccccuggugacaagguuaguggcuaccucuucaccuucuuucuuaacucaaaaccuccuucgcaagcucagguggggcucugcagggaaggcagguccugccauaugaagcuggugacccaggaaguucaagggaccaggagggagggaaggugucauugguucaucucccaggagaguugagaguuccugucucucccucauagggugaagcuggucccagugguccucccggucccaccggagcccguggugcucccguaaguacagaagacccugaucucuguucaucccuucuccccuaccugcuuucugcccccaccgcaaaccccaccccuuuacucuauccguuccucuccuucccuaauguugagacaucucuccaaagucgucuccuucuucuucuagggagaccguggugaggcuggucccccugguccugcuggcuuugccggccccccugugaguaucaagacccuccucauuuucugucccuagcugagacacgaggcaugggaccuugggguggcugaaugaggacagaaguguuacccugagucagaggagaaggguggggagguacuggugucuccaagugucucugcaucuccaagucccuaucuguggcccuuccucuagcccagaggcccucugcucucaggcugccuccuccacuccuccacucuccauucucccuccugccuagggugcugauggccaaccuggugcgaaaggugaaccuggugauacugguguuaaaggugaugcugguccuccuggcccugcugguccugcuggaccccccggccccauuguaaguaucuugucuucugcaccauaagcuuuggauagccuuggacuuggggcuagccuggaucucauaccuugacacugucuuacaggguaacguuggugcuccuggacccaaagguccucguggugcugcuggucccccugugaguaucauaugcaucucugucgcgacuccccaaaggcagagacuggagaugaggccaggugacaggugacuguucacuucugaccacccaauguucucuccuaccagggugcuacuggcuucccuggugcugcuggccgugucggucccccuggucccucugugaguaucugugguucuggaaugaggauggggugagacauguauugucaggacagcaggccuggcuggggcuugccacuaugaugcuuuggaagccuggacucugacaguccuucuugugcccaucuagggaaaugcuggacccccuggcccucccggucccguuggcaaagaagggggcaaagguccccguggugagacuggcccugcuggacguccuggugaaguuggucccccagguccccccgguccugcuggugagaaaggaucuccuggugcugauggaccugcuguaagugcuaacucacaucucugugauuguggagaguuccagaguuguguauguguuuccugugcuacugugagcccuucucaccccugucugccucccacagggcucuccugguaccccuggaccucaggguauugcuggacaacgugguguggucggucuucccggucagagaggagaaagaggcuucccuggucuuccuggccccucugugaguguucuuuccucuugggguguccaagaagaaucaucuuaggacuugaguacuagaaggggcaggguagcagcaguggagacaaggagagcaaaugugauagaaaugcucucaugguacccagguggugguggugaacaccuuuaaucccagcacuaaggaagcagaggcagguaaauuccugaguucaagaccagccuggucuacagagcgagugccaggacagccagagcuacacagagaaacccugucuugaaaaccaaacuaaacaaacacacaaaagaagucucauggcuugagccaccacaucugaccuccagccuuacucuguucuuuagggugaaccuggcaaacaagguccuucuggaucaaguggugaacgcggucccccuggccccauggggcccccuggauuggcuggucccccuggugaaucuggacgugaggucagcagcccccaccuccuagccaguccccgugcaggaccacuuguccuacgccugaccucuucccuggaguggacacucaucucucccccucccuuuacagggauccccuggugcugaaggcuccccuggaagggauggugcucccggggccaagguaagagaucaugccacauaucaggcuggacucuggugagcccuggccccuccccagacugcacauuucaucugaggcugaccccaugaccucuacccucuguucccagggugaccguggugagacuggccccgcuggccccccuggugccccuggugcucccggugcucccggcccuguuggucccgcuggcaagaauggcgaucguggugagacuguaaguugcugagcucagaucagaccucuucuucagacaugcucaaaggccucgaaauggaugaauuaccucacucaggcuggggaagaagaggguuuugggauaugucuggguccuuagcuuccagggaaaaacagugauuacuuagccuucaucuaggcaggacuccaucuuccccaaggcauggggcuugccccagcuuaucccaugaagccuggcucuggggagguuuaaucgggaaucaggagagguggccacagcagaagagaugugggucaggaggagucuagccaaggggaaggcucacccugaagcccucagccuuggcuuuuccaagucaagaucuaacacacuguuuucucuccaggguccugcugguccugcuggucccauuggcccugcuggugcccguggcccugcuguaagugucccaugcccaccucaugcccucggaacacugacccagaggugaauaccaucccacucaauacucagugugaacuugcaccugacagccugucuuguccccuccucucuuuuagggaccccaaggcccccguggugacaagggugagacaggcgaacaaggugacagaggcauaaagggucaucguggcuucucuggucuccaggguccuccugguucuccugugaguauacucaacuucccaggcccuggcugccaucaggccuuuuccaccauacccugaugcagaucacauggugggagggggacacuugccucagugucuacucuagauagacauucugauuccuuccuagugagggugaggggcaggacacagacagacagacagagggcucaaagaaggauugugggaguggucuaaaaugaggggauauguuacccccauugccccugaacugcuuuucucuguucuucaggguucuccuggugaacaaggccccucuggagcuucagguccugcaggcccccggguaaguugcaucuuccauuacuucuuccuggguuccucccugucuugguuacuuucagauaucccucuguucuccagagaagaguucagagaccagacaggggguggggagaaaaagaagcuuggucuuacagaaccuuugaccuucccacccgugcccccuugcaaaccuggccauaggaacuaguugagggcacccucugagagacagaagcagagacugggcggagccagcaguggggggaggggaaacacuucugagccggaguuugggggcugccuugaguuucuagccacuuuuucuaaccaucucucuaucccuagggucccccuggcucugcugguucuccuggcaaagacggacucaacggucucccuggccccauuggucccccugguccucgaggucgcacuggugacagcggcccugcuguauguagccccacauccucugccucaugacccucccccaagaagacuugaauaccuggaaaccuugaucuccuuccucuacacaggguccccccggcccuccuggacccccuggcccuccuggaccucccaguggcgguuaugacuucagcuuccugccucagccaccucaagagaagucucaagaugguggccgcuacuaccgggccgaugaugcuaacgugguucgugaccgugaccuugagguggacaccacccucaagagccugagucagcagauugagaacauccgcagccccgaaggcagccgcaagaacccugcccgcacaugccgcgaccucaagaugugccacucugacuggaagagcgguaaggauuaaccccagccaccucccccccccccuuuagccuaccaugcugcuucccccauguuuucauacauuccacuuuccauauggugcuggcugccuacuccuccugacugcuuugccuugcccacuucaggagaguacuggaucgacccuaaccaaggcugcaaccuggacgccaucaaggucuacugcaacauggagacaggucagaccuguguguucccuacucagccgucugugccucagaagaacugguacaucagcccgaaccccaaggaaaagaagcacgucugguuuggagagagcaugaccgauggauucccgguacgugagcugaaccccagagcaacucuacaggagauggguuagccucuuauccagaaagcacaggaaguccuggaguggauuuaaucugcuuaguggaagggcagauacagaucuaggauacaggaguucuggguaggaaagccagggacgagaagguccacgugaucgcucauucucuccucucucuggcccgugcaguucgaguacggaagcgagggcuccgaccccgccgaugucgcuauccagcugaccuuccugcgccuaauguccaccgaggccucccagaacaucaccuaucacugcaagaacagcguagccuacauggaccagcagacuggcaaccucaagaaggcccugcuccuccagggauccaacgagaucgagcucagaggcgaaggcaacagucgcuucaccuacagcacccuuguggacggcugcacggugagucccccagacuggguccagccugucucuuugggcaucugguuuagccuucuggcagaacagagugagccucacuucauuccuaccuugguaaugacccucucccgcugucuucauucacaccagagucacaccggaacuuggggcaagacagucaucgaauacaaaaccaccaagaccucccgccugcccaucaucgauguggcucccuuggacauuggugccccagaccaggaauucggacuagacauuggcccugccugcuucguguaaacucccuccaccccaaucugguucccucccacccagcccacuuuuccccaacccuggaaacagacgaacaacccaaacucaauuucccccaaaagccaaaaauaugggagauaauuucacauggacuuuggaaaacauuuuuuuuccuuugcauucaccuuucaaacuuaguuuuuaccuuugaccaacugaacgugaccaaaaaccaaaagugcauucaaccuuaccaaaaaagaaaaaaaaaaaaagaauaaauaaauaacuuuuuaaaaaaggaagcuugguccucuugcuugaagaccuauguggguauaagucccuuccugcccacuuggcuuaugauacccuaaugcugccuuuucugcuccuuucuccacccccucuuggggccucuccuccauugcuccccaaauuuaagucucccccaagacacaggaaauaaugcauugucugcccagcaaacaaaggcaaugcugaaaugucccaccagccccucaaccccgucuacuucccuacccagcacccucaaauccugcugggacaugggguucuuggacuguugaaggaaccuaaccaucuggcaucuccauggccucugcaacaaaccccccacuuuuuucucuccccccccccccagggagggccugugcuuugggcagccaccugccccucucagggguuuggagccaggcagggucacagcagacuggaaacaucggacaugcaugugcaggcugggugggagagaccguucuauuccucagugcaauuguguugcugaaagacuaccucguucuugucuuugugugucaccggggcaacugugugggggcggggaugggggcaggguggcagcacgcccaguuugguaucaaaggugcuacaucucugugaagggguggggugggaaggaauuucuggugcuauagaagcugagaugcucccuagaccagcaaauguuucuuuuguucaaaguauuuuuuauucuuuuuuuuuuuuuuuuuaauggauagggacuugugugaauuguugggguuuuuuuuuuuuuuuuuuuugguuuuguuuuuuuuuguuuuguuuuguuuuuuuuccugaaggugcuauuuaacaagggagaagagagugcggggacuucacccugcccacucucuacucucucuccacucuucuaguuccugggccuaucugaucucucucuuucuucugaaacccuccccucuugcugcugcucccuccccucugccucucucuuggucuguccugcaucaggguuucagagcaccacuuuccaaagcacaaaacaguuuuuaccccugggcugggaggaaacaagagacucuguaccuauuuuguauguguauaauaauuugagauguuuuuaauuauuuugauugcuggaauaaagcauguggaaaugacccaaugca

SEQ ID NO: 6295 - RNA, 16898 nt, Mus musculus
ugcauugggucauuuccacaugcuuuauuccagcaaucaaaauaauuaaaaacaucucaaauuauuauacacauacaaaauagguacagagucucuuguuuccucccagcccagggguaaaaacuguuuugugcuuuggaaaguggugcucugaaacccugaugcaggacagaccaagagagaggcagaggggagggagcagcagcaagaggggaggguuucagaagaaagagagagaucagauaggcccaggaacuagaagaguggagagagaguagagagugggcagggugaaguccccgcacucucuucucccuuguuaaauagcaccuucaggaaaaaaaacaaaacaaaacaaaaaaaaacaaaaccaaaaaaaaaaaaaaaaaaaaccccaacaauucacacaagucccuauccauuaaaaaaaaaaaaaaaaagaauaaaaaauacuuugaacaaaagaaacauuugcuggucuagggagcaucucagcuucuauagcaccagaaauuccuucccaccccaccccuucacagagauguagcaccuuugauaccaaacugggcgugcugccacccugcccccauccccgcccccacacaguugccccggugacacacaaagacaagaacgagguagucuuucagcaacacaauugcacugaggaauagaacggucucucccacccagccugcacaugcauguccgauguuuccagucugcugugacccugccuggcuccaaaccccugagaggggcagguggcugcccaaagcacaggcccucccuggggggggggggagagaaaaaagugggggguuuguugcagaggccauggagaugccagaugguuagguuccuucaacaguccaagaaccccaugucccagcaggauuugagggugcuggguagggaaguagacgggguugaggggcuggugggacauuucagcauugccuuuguuugcugggcagacaaugcauuauuuccugugucuugggggagacuuaaauuuggggagcaauggaggagaggccccaagaggggguggagaaaggagcagaaaaggcagcauuaggguaucauaagccaagugggcaggaagggacuuauacccacauaggucuucaagcaagaggaccaagcuuccuuuuuuaaaaaguuauuuauuuauucuuuuuuuuuuuuucuuuuuugguaagguugaaugcacuuuugguuuuuggucacguucaguuggucaaagguaaaaacuaaguuugaaaggugaaugcaaaggaaaaaaaauguuuuccaaaguccaugugaaauuaucucccauauuuuuggcuuuugggggaaauugaguuuggguuguucgucuguuuccaggguuggggaaaagugggcugggugggagggaaccagauugggguggagggaguuuacacgaagcaggcagggccaaugucuaguccgaauuccuggucuggggcaccaauguccaagggagccacaucgaugaugggcaggcgggaggucuuggugguuuuguauucgaugacugucuugccccaaguuccggugugacucuggugugaaugaagacagcgggagagggucauuaccaagguaggaaugaagugaggcucacucuguucugccagaaggcuaaaccagaugcccaaagagacaggcuggacccagucugggggacucaccgugcagccguccacaagggugcuguaggugaagcgacuguugccuucgccucugagcucgaucucguuggaucccuggaggagcagggccuucuugagguugccagucugcugguccauguaggcuacgcuguucuugcagugauaggugauguucugggaggccucgguggacauuaggcgcaggaaggucagcuggauagcgacaucggcggggucggagcccucgcuuccguacucgaacugcacgggccagagagaggagagaaugagcgaucacguggaccuucucgucccuggcuuuccuacccagaacuccuguauccuagaucuguaucugcccuuccacuaagcagauuaaauccacuccaggacuuccugugcuuucuggauaagaggcuaacccaucuccuguagaguugcucugggguucagcucacguaccgggaauccaucggucaugcucucuccaaaccagacgugcuucuuuuccuugggguucgggcugauguaccaguucuucugaggcacagacggcugaguagggaacacacaggucugaccugucuccauguugcaguagaccuugauggcguccagguugcagccuugguuagggucgauccaguacucuccugaagugggcaaggcaaagcagucaggaggaguaggcagccagcaccauauggaaaguggaauguaugaaaacaugggggaagcagcaugguaggcuaaagggggggggggagguggcugggguuaauccuuaccgcucuuccagucagaguggcacaucuugaggucgcggcaugugcgggcaggguucuugcggcugccuucggggcugcggauguucucaaucugcugacucaggcucuugagggugguguccaccucaaggucacggucacgaaccacguuagcaucaucggcccgguaguagcggccaccaucuugagacuucucuugagguggcugaggcaggaagcugaagucauaaccgccacugggagguccaggagggccaggggguccaggagggccggggggacccuguguagaggaaggagaucaagguuuccagguauucaagucuucuugggggagggucaugaggcagaggauguggggcuacauacagcagggccgcugucaccagugcgaccucgaggaccagggggaccaauggggccagggagaccguugaguccgucuuugccaggagaaccagcagagccagggggacccuagggauagagagaugguuagaaaaaguggcuagaaacucaaggcagcccccaaacuccggcucagaaguguuuccccuccccccacugcuggcuccgcccagucucugcuucugucucucagagggugcccucaacuaguuccuauggccagguuugcaagggggcacgggugggaaggucaaagguucuguaagaccaagcuucuuuuucuccccacccccugucuggucucugaacucuucucuggagaacagagggauaucugaaaguaaccaagacagggaggaacccaggaagaaguaauggaagaugcaacuuacccgggggccugcaggaccugaagcuccagaggggccuuguucaccaggagaacccugaagaacagagaaaagcaguucaggggcaauggggguaacauauccccucauuuuagaccacucccacaauccuucuuugagcccucugucugucugucuguguccugccccucacccucacuaggaaggaaucagaaugucuaucuagaguagacacugaggcaagugucccccucccaccaugugaucugcaucaggguaugguggaaaaggccugauggcagccagggccugggaaguugaguauacucacaggagaaccaggaggacccuggagaccagagaagccacgaugacccuuuaugccucugucaccuuguucgccugucucacccuugucaccacgggggccuuggggucccuaaaagagaggaggggacaagacaggcugucaggugcaaguucacacugaguauugagugggaugguauucaccucugggucaguguuccgagggcaugaggugggcaugggacacuuacagcagggccacgggcaccagcagggccaaugggaccagcaggaccagcaggacccuggagagaaaacaguguguuagaucuugacuuggaaaagccaaggcugagggcuucagggugagccuuccccuuggcuagacuccuccugacccacaucucuucugcuguggccaccucuccugauucccgauuaaaccuccccagagccaggcuucaugggauaagcuggggcaagccccaugccuuggggaagauggaguccugccuagaugaaggcuaaguaaucacuguuuuucccuggaagcuaaggacccagacauaucccaaaacccucuucuuccccagccugagugagguaauucauccauuucgaggccuuugagcaugucugaagaagaggucugaucugagcucagcaacuuacagucucaccacgaucgccauucuugccagcgggaccaacagggccgggagcaccgggagcaccaggggcaccaggggggccagcggggccagucucaccacggucacccugggaacagaggguagaggucauggggucagccucagaugaaaugugcagucuggggaggggccagggcucaccagaguccagccugauauguggcaugaucucuuaccuuggccccgggagcaccaucccuuccaggggagccuucagcaccaggggaucccuguaaagggagggggagagaugaguguccacuccagggaagaggucaggcguaggacaagugguccugcacggggacuggcuaggaggugggggcugcugaccucacguccagauucaccagggggaccagccaauccagggggccccauggggccagggggaccgcguucaccacuugauccagaaggaccuuguuugccagguucacccuaaagaacagaguaaggcuggaggucagaugugguggcucaagccaugagacuucuuuuguguguuuguuuaguuugguuuucaagacaggguuucucuguguagcucuggcuguccuggcacucgcucuguagaccaggcuggucuugaacucaggaauuuaccugccucugcuuccuuagugcugggauuaaagguguucaccaccaccaccuggguaccaugagagcauuucuaucacauuugcucuccuugucuccacugcugcuacccugccccuucuaguacucaaguccuaagaugauucuucuuggacaccccaagaggaaagaacacucacagaggggccaggaagaccagggaagccucuuucuccucucugaccgggaagaccgaccacaccacguuguccagcaauacccugagguccagggguaccaggagagcccugugggaggcagacaggggugagaagggcucacaguagcacaggaaacacauacacaacucuggaacucuccacaaucacagagaugugaguuagcacuuacagcagguccaucagcaccaggagauccuuucucaccagcaggaccggggggaccugggggaccaacuucaccaggacguccagcagggccagucucaccacggggaccuuugcccccuucuuugccaacgggaccgggagggccaggggguccagcauuucccuagaugggcacaagaaggacugucagaguccaggcuuccaaagcaucauaguggcaagccccagccaggccugcuguccugacaauacaugucucaccccauccucauuccagaaccacagauacucacagagggaccagggggaccgacacggccagcagcaccagggaagccaguagcacccugguaggagagaacauuggguggucagaagugaacagucaccugucaccuggccucaucuccagucucugccuuuggggagucgcgacagagaugcauaugauacucacagggggaccagcagcaccacgaggaccuuuggguccaggagcaccaacguuacccuguaagacagugucaagguaugagauccaggcuagccccaaguccaaggcuauccaaagcuuauggugcagaagacaagauacuuacaauggggccgggggguccagcaggaccagcagggccaggaggaccagcaucaccuuuaacaccaguaucaccagguucaccuuucgcaccagguuggccaucagcacccuaggcaggagggagaauggagaguggaggaguggaggaggcagccugagagcagagggccucugggcuagaggaagggccacagauagggacuuggagaugcagagacacuuggagacaccaguaccuccccacccuucuccucugacucaggguaacacuucuguccucauucagccaccccaaggucccaugccucgugucucagcuagggacagaaaaugaggagggucuugauacucacaggggggccggcaaagccagcaggaccagggggaccagccucaccacggucucccuagaagaagaaggagacgacuuuggagagaugucucaacauuagggaaggagaggaacggauagaguaaaggggugggguuugcggugggggcagaaagcagguaggggagaagggaugaacagagaucagggucuucuguacuuacgggagcaccacgggcuccggugggaccgggaggaccacugggaccagcuucacccuaugagggagagacaggaacucucaacucuccugggagaugaaccaaugacaccuucccucccuccuggucccuugaacuuccugggucaccagcuucauauggcaggaccugccuucccugcagagccccaccugagcuugcgaaggagguuuugaguuaagaaagaaggugaagagguagccacuaaccuugucaccaggggcaccagcagggccaggaggaccaaugggaccagucagaccacgggcaccaucuuuaccaggagaaccaucagcaccuuugggaccagcaucacccuaaaaacaggaaaaaaaaaaaccaaaacaaccccugagacuuccagauuggggccaagaguugagcuacagcauucugcagcuauaucuaagaggcccuccuuagcucugucaaggauguaaaguucuuucagggguuaaaggggccuacuuggggauucagguggaaccuggguuaagaggccccugaauucuacagagugguaaauaaagcaaccuccaucagggagaugccccaacuuucauccccaugguaacacaucagaagggccugagucacagguauuagauuaaccaggaaagcaugaagauaaaugagaaccacaagggcucaugggaagggaagguugacuuacucugucacccuuaggaccuggaagaccagcugcaccacguucaccaggcauucccugaagaccgggggcacccuggcuaccgggagcuccgggggcaccaguaucacccuguuuaggaaacaagauuagugagcccagaggugucucagagccaugagcccacuuaggaucccuuauguguggaucccagaucacagguuccaaccagagggacaaacucacagacccgaccuugugacuccugggcccccacucuggucuuguccccaaguccuaugaucugggacacaaccgucaugaccuuuccacgaugcccucaccuuggcaccaucguugccgggggcaccauuguuuccucggggaccagcaggaccugggggaccuuguacaccacguucaccagggaaaccucucucgcccuagaaaggaaggaaagggcacaugaugcucugacaggaccaagcuugggaugucguaacggaaguggcacgagaaggcucacuuacucuugcgccagaggguccaggggcaccaaggucuccaggaacacccugaguguagaaagaggaacugcagugaauccaaccuacccccaccccgagaaagaaccucugcccccucuuccuagaagcuggaccucaggagcccacaggaccacauacucagcuuagaacugaaauuccucauuacaauaggaaggcuugagguaaagccagaguuauuccaggaguguguauagagaagucaccuugccuagaggcuaccaagccagugccagaucauuugcagugagugcccucacacauuugguauauccaaaguccucccuuugcguuuaaucccuaucccucuagcuggugauucccacccccaucagcugcaagcaguggguggcuguuuucuuuguauuucuugcaugcucccaccuucuguccugcugcuaccucuuaccuguucaccaggcuugccugcuucaccaggaggaccggcaggaccaggaagacccuguaaggugggagguggaggggagaagagguaggauuuagaaucuuuaacaguuaacaaaggaguguucugcacucuucccugcaaaccuaagucaugaagccucaccuggaauccaggggagccagcgggaccuuguucaccucucucaccagcaggacccugugguagagaagaggcaguggucaugaauaguccaaggggaagggaagcaaggccccaccuuuccugcuccccaaggcucgcagacaggaauacuuacagcagggccaggggcucccugagcuccagcuucuccaucuuugccagcaggacccuguggggagaaggcaauaaauucaguaugggagaugagagccgcagguagggacuggaccucugagacacagcagagcccccuagugacuuccgauguugugacaguggcugcagacauccuccaugggaggaugguguaugucacaggcaggggcagaaaggucagagacuccaaagagauacuuacaacagcgccaggggguccgggaaggccucgcucuccagccuuuccagguucucccuguguagaaagggaagcaagauugagggucacaggucgagacucguuacagccaaggaccucucauuacagugagcauucccaaggggcuuucuguucaagaagacugcaggaggcuggcaagcuucagggucuagggaaggucuugccggcaucuaaugcucagccucucuuccugcacccaaagcagucuccugcccgagacuccuuccuggucacccuuccccuucccuuccccuugacacacaccuucacugacuaauggcagucaucucaaggcucuccuuaccagacuugggugugacuaucacauaaaaagaccauauuaucuguguguucaggggagucugccuagcaauacuuauuuaucaaggacagaaugauggucauggagccaaccaauggucucuuauuucacuaauggguccagaaagggucaguaaagggccugaggucacacagagugucagucgaguuaguaugccuguugcugguucuguaguguuccucacugaauacucacagcgguacccuuagguccagggaaucccaucacaccagccuggccacgggcuccaggaggaccugcggguccagggcgaccaucuugaccagcgggacccugaggaugggaggcacaagaguugugguaaggacuaagguaggcacacaggaggguagggugaggcaugagagaacaggcauacuuacaggggggccgguuuugccaucaggaccagggcugccaggacugccagugagacccuagggugaagcagaaggccaugaacgagggcaggaggagggggaugacaaggggaggagggggaucggagugugggagggggggaggagucuggagcaccagcugcaggcugcuccaagucccauacaggacagaggaucuucucaccuuggcaccagggagaccagcuucaccggggcgaccagcuucaccaggagaaccuuugggaccagcagguccgggagcaccacguucaccggaaggacccuaaguggagagaagucacagacgcaucagggccacagccuuggccuuauuaccacggguuuagcauccucuucaugcugggagaaggucuuggacuuugagguggauucguggggaugccaaagagaggccaaacaagaggaggagggagacacagccgugguugcaaggcggcagggagcacagcugcggacaugagcguagguggaugucaaccguacugucagggaagugacgucgggcagcugggggagucagcuucucugccaggaagagagauuaccuuggggccagcaacaccaucagcaccagggaaaccacggcuaccagguccacccugcagggagaaggaaaaaaggccagugagccuauuaccaucacagcacugggcaagcacuaagagcaaaugaggagagacacaggggacaggggacacuuacacgcucgccaggagguccaggcaguccggaagguccaggcucaccacgggcuccucguuuuccuucuucuccggcagggccugggggaccuugaacuccaguagcacccuggagugggcagagagggaguagccuuggugagggaguacaagcccaggagccuaugaugcuggccucuaguaauaggacuucuggguaugaggagggggcucccuuccucccuggagcuccccguugaggcuuccugacccugggggcagagggggagaaggggugaugugugacuuacggguucuccuuuggcaccagugucuccuuuguugccaggagcaccagguucacccuguguagggagagaaagaggguaaguugcucuguuggcucgcaaguguauguuucuccagaagggggcacccuggagcucaugaacaagcgaggcagaagggagagucuuauacuuacacuguuacccuugggaccuggagggccgcuggggcccugggguccagaggggccucgggcaccagggaagccaggagcaccagcaauaccaggagcacccugcaggagucaggacagacauuuuagcccaaggguggagggcauggggcagguggcagguggcucaugggaggagggcugcuagagacuuacauuggcaccuuuagcgccagguuguccaucagcaccaggguuucccugucacauagagaaaggagggugagugaaagccuagaacugugaaguuggcggguagcacaggggucagcagcaggaaggacacucacagcagggccggcagcaccagcagggccaggggguccgggcucaccacgcacacccuggggaccuucagagccucuagcuccuuggggaccagcuucacccuagaucggaggaaaggacaaaucagauuggggcagccagcauuacuucuguaugucagguguuggagggcgggggagcaaggacgaggacuuugagagcuaggaaggggacaccaggauugaguccaggauuguagagugugcuucauucuugccacccugggcuucucugaucugggugaugccuagcccauugccuaugacaaucauguucaaagaaagaacgugccucaccuuagcaccaacugcaccagggaagccaggagggccaguggggccggugggacccuguggaugaaauggaaguuuagcuacaagguggaggagacuaagagcuucuaaguuucaaaaguugaugucagccccaagagcugacccugaggucucacccuacucccauacucaaagucaaggccauacuuacaggggguccagcagcaccaacagcaccaucguuaccgcgagcacccuguaagagagaggggaagcccaauuauguccccugagcaguggccaguacccuuaguccccagggaacugcaaccagagcccggggcauccaaggggggcaggaguacuuacagcagugccaggagguccagggcgaccucucucaccgggcagaccucggggacccuaaaaacgaaaccaagggaggucgaaugagauggagacacccucuucugcagccucccucuuggagcgcccccugucacucaagcuggccuacuuaccaucuggccaggagcuccguuuucaccaggacugccgggcucucccuaggaacagagaacagagugaagcauucauaguaggacuguugggcacaggucauucaggaccucucaucaguaucuuaccuuaggaccagcaggaccagcaucuccuuuggcaccauccaaaccacugaagcccuuaaugggggggaaaagagaugaaguaagaccccuguugggggaguauaccacuuugacacccacauggauuugacaauaauuuuuggaagaucuccagccaucucucugucucugagcuaaaguagaucccaauucaccuaucauccagccagucucuuuauugggacuucuucccccacaaaaggaaguccuuucagaugucuaaccuaugaccuuugagauaucucuagcuaccaucuaacaugauucacaacaggaucucuuagggaaggggagagaauggugacuuggggcuuugggagcuucagugacuccaaagagacuuacucggugucccuucauuccagggaggccagcuguuccaggcaauccacgagcacccuggagagaaaggcaaaugaggacuuggaagggugucagaaggaagggcucugugacuauugcuccuaaauguauccccagugcaguaagcccugggcccacccucacauccugcucaccugagguccaggagguccacgcucaccaggacggccgggcuugccagcuucccccuacagagagagaaaagcccauuauggcaaugcuccucuaucccccauugaaggguggauucaguuuaagggaccaaaucuaacuucuaaccuaaaacucaguuuauaucuacagugguguauucauuuccacaucugcucacccagaacucuuaaaccuggauuacuccaagggauggagauggaugggggugaggaugcaaguggggauggaggcugccucacuaaaacauucuauucaguggaaagaugacugccaagggucaucuugacuucuccugguuauuggugcugagacccugcugggaagauuucaggacccacauagagaaggccacaggauuugauagugucuuuccccagggguacuuacaucaucuccauucuugccaggagggccagggggaccucggggacccauuggacccuagaggggacaggagaagcauuuagaacucuuagaugagagacaauaaggaggaagacuggagcgaggaggugacaagcuaccccucucucaguacaggugacuuuccauaggagaauuuguggagauggaggugugucggcauggaggacuaacuuacugaaccgccaggcucgccagguucaccaggggggccuuggaaaccuuguggacccugaagaacacgagagaaggauaggcucagaaaggcagguuccucccgggcugucucccucuuacaagagaugucuaccagccuucugcccucauccccaucucccccacccccgcaacaguacaugcccaaaaugauccaugaagacccuuagauacguacaggugcaccaggggggccagggagaccacgaggaccagaaggacccuacagaaggaaaaagaggggcuuuugauaucugugaauaaaggcaguauggcagaaaucuguuucuaccucuuccuguggggaucacugucugacuugcaucuacuguagaucucaagucccuaagguggccuuuaccucccaagcuaucuguaccacccccuugcaggacaucauuggccuuucucuucgggaugccuauccucuguguggucacugcucccccugguggcucaccauggggccaggcacggaaacuccagcugauuuuucaucauagccauaggacaucugggaagcaaaguucuagaaaaacaagagagaaugugugagaaauuggacucuggaugguaaauugaaagccaggaggcauuagcaguaaugggacaaacggauguaggcuuccggaaguaauuaacucagggagacagcaauauagccuguaagauauuccuguaccagacaccucgacugaauuuaaucuaaccagacaaucccaaacuacagaagaaccuauaaaauaacacccucugcccaacagccagacucuucaaaaccuucccaagucaaggaugacauagagucucagaaacagucuacauuugugggaaccaaaggaaugagacaauggaaugcaauuggcggucuuagacaggaagggggcgggagaaaugcuauaaagaacauuuugggaggcauuggugaaaucugcaaaugagauugcauaucaggcaauauuaaucaggcuagaucaacauuaaauuuggugcuaugguuccauagaaugcccuugcucuuaggaaaugcacuuaagaucguaagucacgggcacguucuuggcaacuuaugucucaaaugguccaggacauacagcgacauagagaacugggugcccagaaaguggcaaagcgguuguguugaagaguguauagaaguucuauucuauucuauuuucuguaaguuuauaauuauuuuaaaauagaaaacuaugucugacaaaaccaaagcaaagaaaaacaaacaaacagacagacaaacaaacaaacaaaacgggaagucacaccccucuggggucuccaagaucuacuuacuccuccaaggccaggggguccggggggcccagggggaccaggaggaccaggaaguccaggcuguccagggaugccaucucguccaggggggccaacgggucccugcaccaagagacggagggggcugcuaugagcacaaaucagagccacgcccccuccaguuucccagcucauuuagaauacgaugcuuacccuugggccuugggggccagggucucccuugggucccugugggguugaggaugaagaaacaaaaggccguuaagagaagcaaagaaaacugcaguuuauuggaggacagugggggucguggacgggugggaggaaaguagggagcagauuauuaccucgacuccuacaucuucugaguuuggugauacuggggagaaaaacguucaguuagaaguaaauuuacuaagguaccuggggguguuauaggcuuucaagacauaggcgagggagggacuccaaccucccuuaacccuaggaccagaaccguaccguauucuuccgggcagaaagcacagcacucgcccucccgucuuuggggguugggacaguccaguucuucauugcauugcacgucaucgcacacagccgugccauuguggcagauacagaucaagcauaccucggguuuccacgucucaccauuggggacccuuaggccauuguguaugcagcugacuucagggacugagcaaaugggaagagacacaggaugugugcgggucagagaccuuaccccggagcaccagggaucccagccuuacucacucuuugcccugucuaagaggcgcacggagacuucccacuuccugaaucuuuccccccacucccuauauucuucccucaaauccuuaaaugcaggucugcuccauaucggcgacguucagugacagcaccagggcgccuggccaggacuauaacgucccaguucucaggaauuuaaacaaagcucuagacugggguuucuuccaaacaacuucagcccacgcgcgcgggaaccaaaugaaauaaaaaagccugcugaaggagaguaggagggcuccuacgcaguaggugggggcucgugggacgugguuugcgcggagacaggaggcgggggugggaggagagaaggggaaauucagcccuggucccaccuccuuucccggggcagguggggcggaaugggcggggcuacaauguggaggggcugauuucaguggagcccuguccaguguaguaaaauguaucccuaaaguuagauacaucccaauuuccagcucccaggaaucuugaaaacuugcuaacuagacaagccggguccuucaaagccaguagugcuuuggaaucuccuuagccaaagaagucaagucuacaaauaguaaugaugaguuaaccacgcccaccgcuccaggaccugaucaaggcaaccacuagguggcgggcaaaacuaagcaaugcaggggcggaccgacuuuuacucggccugggucacuucuuucaaagaccagagcuaccccauccaucccugcuuuuauuuuccuagucuggagaugaggguccgcaauaacccagguuuuccuucucagccugugcgcuguaaagugcuguaccaggacucguagugcucucggcuggccagcaggaggcacagggaccgcgcccagucaaguccuagccaaacuuucucauccagcaacccgcccucuccgugcguccccucccccccccccgagagcccagcaccccggaggccccagcaacacugucuagccugcagagagggcaaacaaucuuuccuuaugaaucaucccgcagccuuuuugauagcuuuuacaucuugagcuccgaaucucuauuccagaggccuuauuucauuuucgacguacucugccccaacccguguccagauucccacuuuuccuguugugcuacagaugggugcuugaaauuucuuccugggccaucucaugcaaggcuccacuucugagaacugcucccccucaucugcucaacagggugaccucucucaucccguuuccucuccaucaccgucccaucccugccucuggagcagcccugcaccuccauuuaagucuuaucugcuaggaccccucuauacagaacgcaauaccaagaagcuguaguaaacuccccagaguuuggaacuuacugucuucuuggccaugcgucaggagggcaguggccccuaagaggagcaggagccggagguccacaaagcugaacaugucuagacccuagacauguagacucuuugcggcuggggugggggguuagcuucggcucaugcguggccucacuccgcgugccuccugcuccgucccgaggagaaacucccgucugcuccgacgacuggccugggccccuuuuauaccaucuugauggagagcugggaggaacccugccucucggagagggggagccagcagcccggcccccagccaauca

SEQ ID NO: 6296 - RNA, 523 nt, Mus musculus
caauugccgcuacuucucggaccgcgggagucucagcgcuagggagucugcgcgcgaauggcagggaagcgaccagggaggcggucccgccuuaggacgcacggggcuuuccaucuccucugcagggucugugagggcuucugauucucuuauucaacaagcauuugccgggcgagcggccagccuggggcgcugaagcagaaggggaccgccguugaacagaacagacgugguccgguguagucuugauucagccaaaugggacuucccaagccugagaacugugggcccaggagcgggaaagacucuuuaaguucuggagggggcgugcacccgaggcacuggagaaggacacagggaagauuccuagagaaguguggcuacuccugcuggccaagcuaugggagacuuacuccugggcauugcaggguggauggaccaguagagaaaauugaggugggaggguugauacuucauucuauuacuuccugccccgccccccaauaaaagguuaaccgaggag

SEQ ID NO: 6297 - RNA, 16693 nt, Mus musculus
uccucgguuaaccuuuuauuggggggcggggcaggaaguaauagaaugaaguaucaacccucccaccucaauuuucucuacugguccauccacccugcaaugcccaggaguaagucucccauagcuuggccagcaggaguagccacacuucucuaggaaucuucccuguguccuucuccagugccucgggugcacgcccccuccagaacuuaaagagucuuucccgcuccugggcccacaguucucaggcuugggaagucccauuuggcugaaucaagacuacaccggaccacgucuguucuguucaacggcgguccccuucugcuucagcgccccaggcuggccgcucgcccggcaaaugcuuguugaauaagagaaucagaagcccucacagacccugcagaggagauggaaagccccgugcguccuaaggcgggaccgccucccuggucgcuucccugccauucgcgcgcagacucccuagcgcugagacucccgcgguccgagaaguagcggcaauugggaucccggggccggccgcgggcacccgccgccuccuccccucgguccuagcugcuuccgccccgcccgcccuccucuucccuccuucccuaccguucuuugucucccgggcgcucggccuccccauaagcguaucgccccccccgccccccccgucgccuuaucccgggcgaccccccacggaccuagccacugcgacgcuacacaaaucggccgguggcgcgaggguucgcgacccccgggguuuggcgggggcggggcgggagguggcguucagguucucucucucucucucucucucucucucucucucucucucucacacacacacacacacacacacacacacacauacacguacacgcacgcacacacggagcauccucccgucagguuuccccguccagccccgcccgcgccuccugcuucccgcagaccuucucccugcaucccuacacaccucgccucuccauucuuuccgggacucuccccgccgaucccccacaacacccuggaauggagcgacuccagccagcccggagccccccgcgaccggggugaaaguccuucgccccucuccugcccggcagucgccccgaacaccaugggccugagggguucccggggcgccggacgcugaaaaugacggaugcuggaggugaggggccggguccccuaggguggaaggggaagcguggcuagcgacuacuggacucaaggugggacccucaguagggcuaaauggauuuaagccacaagggccuuucuuucucuaucccuagggagaccucacuggaggggggagcugggcugucgggagggagcagaaauaggguuugugucccuaaucccauuucucccgccugaggaaauuaauaagagagagaggagagaaagggagagagagagagagagagagagacagagagagagagagagagagagagaagagaagagaagagaagagaagagaagagaagagaagagaagagaagagaagagaagagaagagaagagaagagaagagaagagaagagaagagaagaggagaggaaagaaugaagagaaaaagaaauaagaaaaacuggugugggggcagggggagaggccuuaacuccuuccuaucuggcaguuagaccuauggguugaagaaacuguucuauccucugagauuggggagaggggauucuaugauagguguaggugcacuguccauuaaccccauuuucuaggacgcuuggaagagcugucaaacuccugcggacagcuccaagccuggggcuggcugaagacugggggccugggaggggcucggcuccuuagcugcucuacaacugccucccccaucuccagccugcaugucaaccacuucugggacuugucggcucugugugugugugugugugugugugugugugugugugugugugucugugugucugugugugugugugugugugucugugugucugugugucugugugugugugucucuuuucugacuccaucucucugucucucugucucucugucucucucccuccccuacucaggauccuucucccuucuugcuuguggggcaggcauucuguucuauucucucaccccaugauggggugucagggcuacccagcugcuuucccugagccuccugggucuguucuuucuugaucuuucuucccagcucccaguggacacugccagucucucccucugcaucugcuaguuccuccuucuguuccacccgcagguuguagaccuuuuguuuggcuuucuccuucccuugggcuccagguagcuuggaacucaccugccuuuccuuuuuccagagaaaggucagaggucccuaaugguccuccaggaacuggaagcuguuggggaagggaguggucuguugaccagggagcccagagguuguccaaggggacagguucauuugcauccuuguguaguuaacacuccugaguaagagugugagccaaagagggaagagaggugagguggggauuuaauuuuccuaggguguguuuuagggaggagagaguucagugacaggggcaggugacccgaauacuaugcauccauggaguuuuacaugggacagagcgggaaggcucccugacaguuaugggagcuggcuguuaaagauagagaugaagaaagcaguuugugcugaaucaggaugggcugaaaggcugagcuggaggccccagucuacccaagggggccuaaaauaggccuuagugcacaggcucucaucacuggauugggaccaucaggaaagaacgcaggcuggccugcucuguuuaagagaggaggugucaccacugucuguagagagcagccacucugauaggagaagcagcuacuauccugagucuccagucugaagggagggcacauggcucaucugucagggagagauaaaacccacauaggaaaccaguaaagaaacgacaaggucuucauuucucagaauuggaguagcuuuagacaaauaggggcggcauccuaggacagggaucuggagaagggacagcuggauccuaaucagagaaaguuuugcaauccaaugaugagacacuguuuauguugaggaccgaccuaccuuaaucuggccucucaggccuggagagaauauucuagauauucagggggcuguuaguccccagaguucaaaaacagcaaaggggucccuugcugagacauccuggaccucuccuguauggcauuguuuggcucagcuccaagcaucccucuagccuaguggaggugguuuuaaugcuugccuuaaucccagccggugcaaaccagauccccccucccuuuaccccagcccuccccugagaguacccuuuccucaugagcagcgccagaacugcagaucaugcauucuggauagagcugagaaacaggagacaggggucaaugucagcaucuaccucugagcucuugcauauuaauguucacaccuguaaaguggggauaccaagaugcuaauaagccuagcagcucacagagaaaugucugugcagcgaaaggagagcuaaagggcacguggucugguccagugcccugcccuucucccaggaaccaucguauuagaaguaacuggagauugugucucagccauucagcggcucccuacccuagguugucuucuguaucaggcuucuauccugcuaagaagccugccugccugccuacgguguuucugaugcauucccccugcuucccuuccuuaccugccugcucuucuuugauuccaaccacaaaccaaaccaaaugcccaaaccuaaacauuacaacucugcccaucuacauuccuucccagaaugcuuuagagauguucugcuguggaaacuuaaugucucgauccaucugcaagucaagaacuguggggacuagcugggcgugguggugcaugccuuuaaucccagcacuugggaggcagaggcagguggauuucuggguucaaggccagccugaucuacagagugaguuucaggacagccagggcuauacagagaaacccugucucaaaagaagaagaagaagaagaagaagaagaagaagaagaagaagaagaagaagaagaagaagaagaagaagaagaagaagaagaagaagaagaagaagaggaagaggaagaggaagaggaagaggaagaggaagaggaagaggaagaggaagaggaagaggaagaggaagaggaagagaaagaagaagaagaagaacaacaacaacaacaacaacaaacuguggagacugugguucugugguucuguggaccugcuggugaugcuggcuuccugaauaguucaaaacagcagguggugagggcccuggcaacugaggaagaacugauagauacaaagauggguagagacauggacauaauagauguuggaucgguaggguacacagugggagggaggguggagggaggacaagcagguagauaaaaaagguugguagguaaauggaugcaagagccuggguuuuaaaucuggauuugccauaaauugccucgagaucuugggccauccacucccucuuccguuucuguguaaaaugagagaucuggauuuaaucguuuccaugacuucuagauugaugcgggauacuuagugaugauggaggcuuuuaggaaaugcuagugauuggagggccuuaugcaaugcagggacugauguagcuggucccagcucacagaagcuggcuauggcuugauuggcuuugcuaucuauggcuuuccggauucugucuccugccucugcccccacgggcuucucuuccaagggccagagaaagaggacagugggugggcaggaagcuaaaagcuauugacucuuuacugccacagccaacuggagccauuuauccaagauaaucucucucucucuuucucucucucucucuguccuucccagcucucuugagucauggcuuccucaaagcuccgagaaccuguggaugaaguuuuugguaaguucugugugacucugugucuagcaguagacuuagccguggagccccuccuuugaguguagugggcauugcgcggggaagggcagauagggcacuuaggguucuucaguacaugguguacgagugaucucacaugcagcguaucauuuaauucucaauguuagauguacagagaagggguguaaggugcagaugcugaugugaccugccguaaagaucacagggagguaggcugguaagauggugcagccauuaaaggcauuagcugugcgaccugaguugauucccacucacauaaaggugaaagaaaagacucagcuccacaaaguuacccucugaccuccacauguguguucugacgugcacaccccuauucacacaucauggucacagucacacacaugcgcgcacacacuaauuauaaaaauaauauuuuuaaaaauagcaugaaagugugaagacuugaguucaaucacaaacacccacauaaaaacugggcauaagguguguguggagcaugcuuguaauuccuguacuugggaggcagaggcagccggguuucugaguucgaggccagccuggucuacagagugaguuccaggacagccggggccacacagagaaacccuguccugaccucagguggagagggauugaagccaccaaccucugacuucuaugcacacaugcauagacacucaugcauguauauacaugaauaaauaugaaugaauaaauaaagcacauggcaaauuaguggcagaauugagaacccuagagagccgggcucccagcccuuagucacugggcuaauccucuguauacuccaguucagacacgccuuacguuuucuccaagucacacauauaauaagugccugagaucucauccuucacacacacacacacacacacacacacacacacacacacacacaccccuccaugccuucggcauccacuggggucuguguacacacugucauuuugagagaucaccccaccagggcagagcugucugcagacuguguggcuguguucuggaaaagcugucccuacagcuugauuucagugaaugauuccuggguacaacuccgaggggcuccuacccaugggaugccacaggacccccggcuucugccuucucccaucucugccuuuuccucuucucuucccuccuaucaucaccacugguccuggucccugcuaguaugguuaccucagucccuuugggaacacugcucccuggcacagccucuacccccucccccaacacuuccuuaucucuuaggcuggcucuacacagguccagccuaaccuuggcaggcccauagaggugagcuucucuuguuggggggaaggcuuuucuuucuccuuugacccucaucuccuaccccaggcuccucaccaauccuugcuuguuuuccuccugucugcugagguagcuaggcgcugccuggagugcuuccucuuaggaagauaauuaaguauucaucucucccaccacccaggacucagagggggaggcagggaagggcagagauggaaaagggguuuagggggcccugguuagccuggccccaccuugccuuguacccccaguuccccaggagaccccuugcucuccacacugugggugauacccauuuugccaugugaagcaaggcaucacccugguggaaauggcuggauacuggcuggguuccagaagcggagaggaggucagagcacuggcccaggggccaggagaccuggagaccacguugacucccuccacacagcugaucaaaccucucuucucugaguucaguuucuccacccaguaaaugacggcuuagacuccauguugccuccuucccuguucagaaaggucacagcugaucuguuugcugucuccaaacaagucagacugccugucucugacccuagcuagcucuuaccagcucuaugcucuugggcaaauuaaggcugcccuggggaucccaaaucccaucuuccaagauuguaggagguuucagugaccgguaauugugaagcacuuagagcggugugagcucuuacuggcuccuggcugcuuccaggggcacuaggaaguucuucaucagaagugaauucagggagcuacaucuggauccaaaagagcaguagcuguccccucccaccccucaccacacccuuagacaguugccauggccuccgaguugacuuccaucuucaaccaggcuguucccuaacgccuaacacccagagcuguaccaugcccucuccugagagaaucuccugguucuguuuacagccccagcucuguauggcuaccggaugggaggcaggagcccuggucgauaucguuuccuuguucauucgggauagcuccuuaugugcccuuuucuuuuuucccuucuuucuguuuguuugcuuucauuauuuuuguuguuggguuuuguuuguuuguguuuuugagacagggcuucucucuguagccuuggcuuuccuggaacucacuccauagacaaggcuggccucgaacuuagggauccaccugccucugccuccugagugcugggauuaaaggcgugugugugcugccgccaccaccaccaccaccaccaccaccaccaccaggccccuuucuuccuuuaaaagagaguaugcuaggcaccuguuaugcgcuagucacaaaccgaaaacucgauccuuaaggagccgacaguuuaauagauggaaagaggcaaaagacuuaaaugacaaaggcauucagaaugcuggagagugacacacgguauaagaaacaacaggaacgguccuuuggaguauauggaggggagucgcaugugcaaaggcugggagguacaggcugggaggaggggauggaggcagacgcucagagauauaaguggggcacagacagccacugggggggggggcuggcucugauucugccugagauggcucugagcaggggacugacagcguugacacaucaaaucaggaucacucuggcugcuguguugaaaauccucuaagugggaaaggggagaggaggcaagagaacagcagagaccuaguccccccaucccucgcuccucccuccccuuccucccucccuccccuguccacuaugugcacauguauucauguguauucucacucauaaacaauauuucacugacaaagccuaagagcuugggcuguagagugggcaguuuagagcaggcaaugcucuuguuacaggauccaaauucaguuccuaguacccaccaucuggcaacucacaacagccuguaacuccaccucuaggggauccgagacccuuuucugaaccgugaggcuaucugcagucuaauguauacaugcccccccccccauacacaaagcuuaauaauaacaauacccucggacauucucagaaguagagagaaaagcacagugcaccuuauguaguugcucagggaacaggauuuaggagggcugaagggagaaggguagcucagagcugucuaaccugggcagauagaccauuggucuagggggcaagaugccugaugauuaaagagcaagccaaugagggaaggagggagggagggaaggagagagagagggagagggagagggagagggagagggagagggagagggagagggagagggagaggaagagggagagggagagggagagagucuuggcuguccuagaacuugcucuguagagcaggcugaauuugaacacagagaucuaccugcuucugccuuucugggauuaaaggcaugcaccaccauguagggcucugaugggugguguuuggcugaggcacuggggggcucugguuuggggguuuccuggcggcugcuucugggcuuaggcuuggcauuuaguggagaagucugggcugggaauagacaaaguggccauugaacaagggugccuuugggaugucuacagacgggagaggagcaggcaagacagaggguuggaaggauggaguggggucccagagauauuaagagaggaucgaacaggaaggucuugacccauccugaagccuggggagaccucaaugccgaugucagggccagaccaaggccagugcugccuaacugggcaggugacaaaagugcaugugagcuuuccucacucccagcagggcuccuccuccuccuccuccuccuccucuuccucuuccuccuccuccuccuccuccuccucuuccuccuucucccaguccucgaaggacuuggcacugcgcugcagaguccaggacccaagaaacaaguugcaggggccugugggaacuuugcuccugggucugacacugguguguggucacgaauaacacagcuauccuuaaauacagccuugaguguggcacagcaagacagugucaccaggagggacuguuccuagagucacacuccagaugauacacugucacuagucaguggcuccaguugugacuugccuucuuugauccuaguuggcucagcuaugaaccauggcccagaugcugugacccucacccccaacccagguagcucuaaggaggaaagugagguguauagcauuggguacaugaagaugccucuucauccaccuggucuccacugcuuuuccaauccacuggggaguaccuauuuccacagagcuauuuccugccacccagggguuccaucucuacuucuuacuucccacccauuccaauaguuugccaacucuuacucaaacuuuaggauccaggugggugugccuccucuuaccccuguuucugugagugucugcacauaggccagccaugcccacaggaggaccugggaugauagcaggugggguuaugagcccagcccaacuguggggcacccacauuucaacccacaagcacaguaggugguacucccaagcaccaguuaaaugacugggauguuggcccaucugagguggcucuggucuccguuugcagaccuggacuuggcuguaccagagaccaccagacuggacagcagcuuacacaaagccagggcucaacugcuggccaagggccggagacaccggccuucccguuccaggcuacgagacagugccagcucugccgaggacggugaaggcucugaugggcccggaggcaagguugggguaacauacacacaccaacauccuaccccuggaccauacccccucccucacgcuuccagggaagugugugcccccggagaugcucccaaagaucaguuagcaguucacuucuggcuccuguaccucuguacaggaaaagggauuguuagcccauuuuacagaugaagcugagaccagaagguucgggaagucccauuaacugugggaugugcaaaugaagcaggaugucuucacuucuugugagaauccauuucuccagccccgggucccagaauaccugcucuccagaccccaagaaacagagcuuccuuggcgcuccuguacagccgaugggggaaacuggccuccauccucugggaagucaggggggacgcugaaccgcugccccucuucuaggugaccgacggcugcgguagcccgcugcaccggcugcgcucgccucuacauucggguccaggcuccccagccaguggaucuuucugccuggagcccccgggcuugaggcgcagucuggaugaggacgaaccgccgcccucgccacucgcucgguaccggccccugcacaacgccgccucgcaugagggccuggccgccaccuccggcucgccaccacgcucugcacccuccuccgacagcucccccagcuucgugcgucguuacccucgagcagagccgcacagcgaaggugagcucgguaggcgcggcgcugccugccaacgagcaucgagcaucagaaucgcagcuaggccaggcaguugggguaauacaggggagacagaaggcuggcuggccaucagguucccuucuucauuuacagaagcuuacuauaugccagacaccgcugugcccauacagagaauagagacagcccuuggccucuggggacguguagcuuaggaaagaaacaaccaaaucaccccauaauuaccguauagguacaagcuguaauaaaagcuaugcaggaaauaugcacaguuguuaaguguccucaccugacuggaaaugcuucccugaggaggcaacauuugagccgagauugaaagacugguuagaaaacggucaagauaaagucaguaguaugccuagcaggcaggaaacaugacagaauaccagauauggucauguacccugguuuucaguacucaggaggcgaauacaggagagucagaaguccaaggccacauagggagcuccagagacccugucucaaaaaaagaacuaauuaauacuaauaccuuuggcugggugguagugguacauaucuuuaaucccagcccuuaggaggcaagaggcaaguggaucucugaguuugaggccagccuggucuacagagugaguucuaggacagcuaagguaacacagagaaacccugucucaaaacaacagcaacaaaaccaaaacgguccugccuucucagauguaaagugcuuuuacaguuuguaaaaggcaaaagccuaggcucccauuagauacuguaaaauuggcucaucucugcuugaaauaagacacacagacagugucuuauccugggucacacagcuaaugaagaacccuagggccaaauggccuaauucuacgucaagaaaugucuacccgacacaggcggcggcaggaggccagcagaccauugcguuagcuguuuuccuccccuucucuuucuaaagaugacagccgggaugccagccccccugagccugccagccccaccaucggcuuggacaagaagacucgcaggaaauuccuggaccuggggugaguggggacagauauugcaaguguccuuggagcuguuggggucagagcaucacagugggcagguaugcccuacuucucccccccugccuccuuccagggucacucuccgccgagcauccaccagcaggagcaggaaggagaaggguagcaaccgccuguccaugggcagcaggugagagguccccauggcacccacccgcccacccacagcucccacccacuccuggucacccacaccaugcuggaugcuuucuccacagggagucuguagaagguucuggaaggacaggaagcuccccguuccugcccuuuuccugguucacggacagcggcaagggcucugcuuccucggggaguaccaccuccccgaccuguucccccaaacacgagggcuucagccccaagaagucagcuucccagguaagcccaggucuucauuccuucuuuuucuccuuccuucuucucaucuauccuucccucccuucuuucuuuuucccugcugaggcagucuuacucuguagcccaggcuggccuggaacuacacagccucuugccuuagccuucugugugcugggacuagaagaaugugccauccuucccaguguaaccccgggacguucuugccccacacuggcuucuaggcucaggacaagaacauacuucaucguggcuuggacugggacccagguuuuucugggacccauagugucccucuacagagcugccuggugacucauggcuugcuucuacucucuggcuucauucagucaugccucgugcguucguacccauucguauuucauguguuuauacugcucccuauacucagaacuccugugggaacacugaggcccuccacugcucacucagucugaggagcccuucuucuuacuguucugccugagucaggucuggacugugcagugccaucaagagcuggccaugugcaugaugggaagucuuggagauagcggagaugagcaggacccccacguagucuucugaaagcuccagacccuaggcgauaggaaccaucaacacaaccaauacuaaugucuccuuauguucacaaagaccacuauugucuguggcuuuaacugugacuuaggcaagguagucauuauuaucugcauuguacagauaagcaaaugagguuuggggaaaaggggacucacccacagaugugcacagcuguguauggugcuggggcuuaggggaaucagaaaucgugggauucaggggaaaggcccgucugaugugcagcuuuagucuauaaccaccugauagucuuccucagucccucccuuugugcuggucccaagggacaccaugcugagagagagacagcccaaguccucacagagauucaaggccauuuggggguacccaccagccaggaugcaagaguucuaggagaaggauucuuuuguaaaagacuuauuuacguauuauguaaacaaguguucugccugcguguaugccugcaggccagaagagggcgccagaucuccuuauagacgguucugagccaccauaggguugcugggaauugaacucaagaccucuggaagagcagccagugcucuuaauguaacccgugagccaucccuccagcccaggagaagaauuguuauguaacagggacacaagaccuagccuggggggagggauucugguaagcugccuauagggaacagcaccuagcccccuccauuccucuucauccaucagccuaacuuaaugcuaggacuauguccucuagguaguccgcucccuccuagagggcucagguucugauaugucacuucagucaucacagccugugucuggcugucuaguucugaguuccugguccuggagcauugaacggcugcuggugccuaguguaguauuucagcuugcucuggucaggugaugggcuuggggugggagguggacuuacuucucggcacacgucccuuuccauguaggaaucuacccugagcgaugacuccacaccccccagcagcagccccaagauccccggugguccucgacaggagaccaaguguuccuaucccuaccacacgcugucccagucuucggaugaggugagugaggcuggccuuugugccugcugggggggacccagccgcaggccaggcuuccuguacucuccccaucucuaucaguuccuggaugagucccucccugccguacaacacuggaccagccagcaggugggccaguggcuacacagccucaaccuggagcaguaugcugccgaguuugcugcccggcagguggaugggccgcagcuccugcagcuggacggaagcaaacugaaggugggucagagugcagaggugaugaucuuucagauugagauagcuuuuagggacagaaaucacccuuuguccugacuuuugacccugacuuaccuccuggacugaccuggcauuggcucucccuguguagccucugacccggugucugaccucuaugcaagguacuccuuucgcaguguaguacaacaccuccaucugacuugaaacucaagccuaaucgcuucuaucugaccuucuagcuccagcccgggucuuugggcugaccuugaucuuuggacuaccaucaaggccacuuucuuggccagcuccaucccauauucauucucagauccuggauaccaccaggcucuggcgugcuaaguggacaguguggagagguggccuccaauaucugcagguuccugggacugagggagagagagccccauaggaacucucuuauuuauuuauuuauuuauuuauuuauuuauuuauuuauuuauuuauuauauguaaguacacuguagcugucuucagacacuccagaagagggcaucagauuucguuacggaugguugugagccaccaugugguuguugggauuugaacucagggcguuuggaagaacagucggcgcucuuaacggcugagccaucucaccagccccccauaggaacucuugaaacgggaagggaccuagccgauaagccacuugaccuugaacaagucacucuucacucugaggaccucagagguugagcaggaucauacuaaggcugaaauccuagguuaaggaucuggcgccaaggacggggucgcaaauggccuagugccagagaguugucaucucugaccacuugcaagccauuccuccuaccuugggaccccgaucccuaggcaaaggccagacuuccgagcagacucuagugggucuguggggcagcguucuaggccucuuuccuucauucuggauuucuucccagagccuggggcucagcaauucgcaugaccgagcacuggugaagcggaaguugaaggagcuggcagcggcugcugagaaggaacggaaggcgcaggagaagaccgcaaagcagcgggagaagcugcggcgccgcgagaacgaugccaagaagagcuagggauggcuggcggggcuggcaccccggcgcacuugcagccaccuacaugggccucaccagggaggcaggguccaggcaccaggcucucggagcacgcggccccccucucacccuguuuggacugaguccucuggagggagaccccaggggggagggcccaguaauaaacccaauuucgaggacuuguuuggcgcagacuuccagggggaagcagguggcagaugaagagggcagaggccaggaaugcagcaaacgcggagcccagaggagccugguucagguggaaccuccgcccucugacuagagugguccgagcaggaagaaaucuagcaggagaggcccuaccauggccaggauuccuagguuuagagaguagccugggcaacccgacuggagacaggagacagcugugucuccucaccuuuugaagguggcuguguggugggagaacagaucuccccagagaggccagugggcagugccaguagcacucaggguggauucccagacaccuccucagaggagagagagagcagggcaggauaagcuggccucuguaaggaaggcagagggggagaagggagcucucacucacucucucucucuuccccucccucaccugcagguuccagcacacaggucugcuccucucccauugagucccuuucgcagagcuaaaauccacuucuucggagaguacuugagccuucgagggcaggaaaaauugagagcuguuggggacacgggucacucccccaacuagugucuagauggugaagaggcacacccuaaguguggccugcaugcugccagauugaaaggguccaucagcuucccuggugcccugggugugucaaggccucagaggccuggggcggauggacagacacugcuggcuuagguuugcuaggcuacagagggggacugggccagccccgcgugggacuggcacauguccuuuguagggcguguucagagauagaggguccaggugcaaugcugacccagcuucuugggugcuggucaguuacuacuaggcccagguuuuagaugacaaacccccaccccucccaguuuccuggagaggugaacaggaccugcauguuaacucccucucuccugccugggaaaguggcugaaggccagggcccuauguuugugcucagucaccuucacuggaagagggggccucauagggaaaacuaagguaucggggcacuggcacuuccuagacuggguggggaggguggaggcucuacuguccccgaagccgugaagagccaagugugcccaccugcaugugaagggggaagauggcuaucaacuucuuucaauaaauacuuaccacacaccagu

SEQ ID NO: 6298 - RNA, 16693 nt, Mus musculus
acuggugugugguaaguauuuauugaaagaaguugauagccaucuucccccuucacaugcaggugggcacacuuggcucuucacggcuucggggacaguagagccuccacccuccccacccagucuaggaagugccagugccccgauaccuuaguuuucccuaugaggcccccucuuccagugaaggugacugagcacaaacauagggcccuggccuucagccacuuucccaggcaggagagagggaguuaacaugcagguccuguucaccucuccaggaaacugggagggguggggguuugucaucuaaaaccugggccuaguaguaacugaccagcacccaagaagcugggucagcauugcaccuggacccucuaucucugaacacgcccuacaaaggacaugugccagucccacgcggggcuggcccagucccccucuguagccuagcaaaccuaagccagcagugucuguccauccgccccaggccucugaggccuugacacacccagggcaccagggaagcugauggacccuuucaaucuggcagcaugcaggccacacuuagggugugccucuucaccaucuagacacuaguugggggagugacccguguccccaacagcucucaauuuuuccugcccucgaaggcucaaguacucuccgaagaaguggauuuuagcucugcgaaagggacucaaugggagaggagcagaccugugugcuggaaccugcaggugagggaggggaagagagagagagugagugagagcucccuucucccccucugccuuccuuacagaggccagcuuauccugcccugcucucucucuccucugaggaggugucugggaauccacccugagugcuacuggcacugcccacuggccucucuggggagaucuguucucccaccacacagccaccuucaaaaggugaggagacacagcugucuccugucuccagucggguugcccaggcuacucucuaaaccuaggaauccuggccaugguagggccucuccugcuagauuucuuccugcucggaccacucuagucagagggcggagguuccaccugaaccaggcuccucugggcuccgcguuugcugcauuccuggccucugcccucuucaucugccaccugcuucccccuggaagucugcgccaaacaaguccucgaaauuggguuuauuacugggcccuccccccuggggucucccuccagaggacucaguccaaacagggugagaggggggccgcgugcuccgagagccuggugccuggacccugccucccuggugaggcccauguagguggcugcaagugcgccggggugccagccccgccagccaucccuagcucuucuuggcaucguucucgcggcgccgcagcuucucccgcugcuuugcggucuucuccugcgccuuccguuccuucucagcagccgcugccagcuccuucaacuuccgcuucaccagugcucggucaugcgaauugcugagccccaggcucugggaagaaauccagaaugaaggaaagaggccuagaacgcugccccacagacccacuagagucugcucggaagucuggccuuugccuagggaucggggucccaagguaggaggaauggcuugcaaguggucagagaugacaacucucuggcacuaggccauuugcgaccccguccuuggcgccagauccuuaaccuaggauuucagccuuaguaugauccugcucaaccucugagguccucagagugaagagugacuuguucaaggucaaguggcuuaucggcuaggucccuucccguuucaagaguuccuauggggggcuggugagauggcucagccguuaagagcgccgacuguucuuccaaacgcccugaguucaaaucccaacaaccacaugguggcucacaaccauccguaacgaaaucugaugcccucuucuggagugucugaagacagcuacaguguacuuacauauaauaaauaaauaaauaaauaaauaaauaaauaaauaaauaaauaaauaagagaguuccuauggggcucucucucccucagucccaggaaccugcagauauuggaggccaccucuccacacuguccacuuagcacgccagagccuggugguauccaggaucugagaaugaauaugggauggagcuggccaagaaaguggccuugaugguaguccaaagaucaaggucagcccaaagacccgggcuggagcuagaaggucagauagaagcgauuaggcuugaguuucaagucagauggagguguuguacuacacugcgaaaggaguaccuugcauagaggucagacaccgggucagaggcuacacagggagagccaaugccaggucaguccaggagguaagucagggucaaaagucaggacaaagggugauuucugucccuaaaagcuaucucaaucugaaagaucaucaccucugcacucugacccaccuucaguuugcuuccguccagcugcaggagcugcggcccauccaccugccgggcagcaaacucggcagcauacugcuccagguugaggcuguguagccacuggcccaccugcuggcugguccaguguuguacggcagggagggacucauccaggaacugauagagauggggagaguacaggaagccuggccugcggcugggucccccccagcaggcacaaaggccagccucacucaccucauccgaagacugggacagcgugugguagggauaggaacacuuggucuccugucgaggaccaccggggaucuuggggcugcugcugggggguguggagucaucgcucaggguagauuccuacauggaaagggacgugugccgagaaguaaguccaccucccaccccaagcccaucaccugaccagagcaagcugaaauacuacacuaggcaccagcagccguucaaugcuccaggaccaggaacucagaacuagacagccagacacaggcugugaugacugaagugacauaucagaaccugagcccucuaggagggagcggacuaccuagaggacauaguccuagcauuaaguuaggcugauggaugaagaggaauggagggggcuaggugcuguucccuauaggcagcuuaccagaaucccuccccccaggcuaggucuugugucccuguuacauaacaauucuucuccugggcuggagggauggcucacggguuacauuaagagcacuggcugcucuuccagaggucuugaguucaauucccagcaacccuaugguggcucagaaccgucuauaaggagaucuggcgcccucuucuggccugcaggcauacacgcaggcagaacacuuguuuacauaauacguaaauaagucuuuuacaaaagaauccuucuccuagaacucuugcauccuggcugguggguacccccaaauggccuugaaucucugugaggacuugggcugucucucucucagcauggugucccuugggaccagcacaaagggagggacugaggaagacuaucaggugguuauagacuaaagcugcacaucagacgggccuuuccccugaaucccacgauuucugauuccccuaagccccagcaccauacacagcugugcacaucugugggugaguccccuuuuccccaaaccucauuugcuuaucuguacaaugcagauaauaaugacuaccuugccuaagucacaguuaaagccacagacaauaguggucuuugugaacauaaggagacauuaguauugguuguguugaugguuccuaucgccuagggucuggagcuuucagaagacuacguggggguccugcucaucuccgcuaucuccaagacuucccaucaugcacauggccagcucuugauggcacugcacaguccagaccugacucaggcagaacaguaagaagaagggcuccucagacugagugagcaguggagggccucaguguucccacaggaguucugaguauagggagcaguauaaacacaugaaauacgaauggguacgaacgcacgaggcaugacugaaugaagccagagaguagaagcaagccaugagucaccaggcagcucuguagagggacacuaugggucccagaaaaaccugggucccaguccaagccacgaugaaguauguucuuguccugagccuagaagccaguguggggcaagaacgucccgggguuacacugggaaggauggcacauucuucuagucccagcacacagaaggcuaaggcaagaggcuguguaguuccaggccagccugggcuacagaguaagacugccucagcagggaaaaagaaagaagggagggaaggauagaugagaagaaggaaggagaaaaagaaggaaugaagaccugggcuuaccugggaagcugacuucuuggggcugaagcccucguguuugggggaacaggucggggaggugguacuccccgaggaagcagagcccuugccgcuguccgugaaccaggaaaagggcaggaacggggagcuuccuguccuuccagaaccuucuacagacucccuguggagaaagcauccagcauggugugggugaccaggagugggugggagcugugggugggcgggugggugccauggggaccucucaccugcugcccauggacaggcgguugcuacccuucuccuuccugcuccugcugguggaugcucggcggagagugacccuggaaggaggcagggggggagaaguagggcauaccugcccacugugaugcucugaccccaacagcuccaaggacacuugcaauaucuguccccacucaccccagguccaggaauuuccugcgagucuucuuguccaagccgaugguggggcuggcaggcucaggggggcuggcaucccggcugucaucuuuagaaagagaaggggaggaaaacagcuaacgcaauggucugcuggccuccugccgccgccugugucggguagacauuucuugacguagaauuaggccauuuggcccuaggguucuucauuagcugugugacccaggauaagacacugucugugugucuuauuucaagcagagaugagccaauuuuacaguaucuaaugggagccuaggcuuuugccuuuuacaaacuguaaaagcacuuuacaucugagaaggcaggaccguuuugguuuuguugcuguuguuuugagacaggguuucucuguguuaccuuagcuguccuagaacucacucuguagaccaggcuggccucaaacucagagauccacuugccucuugccuccuaagggcugggauuaaagauauguaccacuaccacccagccaaagguauuaguauuaauuaguucuuuuuuugagacagggucucuggagcucccuauguggccuuggacuucugacucuccuguauucgccuccugaguacugaaaaccaggguacaugaccauaucugguauucugucauguuuccugccugcuaggcauacuacugacuuuaucuugaccguuuucuaaccagucuuucaaucucggcucaaauguugccuccucagggaagcauuuccagucaggugaggacacuuaacaacugugcauauuuccugcauagcuuuuauuacagcuuguaccuauacgguaauuauggggugauuugguuguuucuuuccuaagcuacacguccccagaggccaagggcugucucuauucucuguaugggcacagcggugucuggcauauaguaagcuucuguaaaugaagaagggaaccugauggccagccagccuucugucuccccuguauuaccccaacugccuggccuagcugcgauucugaugcucgaugcucguuggcaggcagcgccgcgccuaccgagcucaccuucgcugugcggcucugcucgaggguaacgacgcacgaagcugggggagcugucggaggagggugcagagcgugguggcgagccggagguggcggccaggcccucaugcgaggcggcguugugcaggggccgguaccgagcgaguggcgagggcggcgguucguccucauccagacugcgccucaagcccgggggcuccaggcagaaagauccacuggcuggggagccuggacccgaauguagaggcgagcgcagccggugcagcgggcuaccgcagccgucggucaccuagaagaggggcagcgguucagcguccccccugacuucccagaggauggaggccaguuucccccaucggcuguacaggagcgccaaggaagcucuguuucuuggggucuggagagcagguauucugggacccggggcuggagaaauggauucucacaagaagugaagacauccugcuucauuugcacaucccacaguuaaugggacuucccgaaccuucuggucucagcuucaucuguaaaaugggcuaacaaucccuuuuccuguacagagguacaggagccagaagugaacugcuaacugaucuuugggagcaucuccgggggcacacacuucccuggaagcgugagggaggggguaugguccagggguaggauguugguguguguauguuaccccaaccuugccuccgggcccaucagagccuucaccguccucggcagagcuggcacugucucguagccuggaacgggaaggccggugucuccggcccuuggccagcaguugagcccuggcuuuguguaagcugcuguccagucugguggucucugguacagccaaguccaggucugcaaacggagaccagagccaccucagaugggccaacaucccagucauuuaacuggugcuugggaguaccaccuacugugcuuguggguugaaaugugggugccccacaguugggcugggcucauaaccccaccugcuaucaucccagguccuccugugggcauggcuggccuaugugcagacacucacagaaacagggguaagaggaggcacacccaccuggauccuaaaguuugaguaagaguuggcaaacuauuggaaugggugggaaguaagaaguagagauggaaccccuggguggcaggaaauagcucuguggaaauagguacuccccaguggauuggaaaagcaguggagaccagguggaugaagaggcaucuucauguacccaaugcuauacaccucacuuuccuccuuagagcuaccuggguugggggugagggucacagcaucugggccaugguucauagcugagccaacuaggaucaaagaaggcaagucacaacuggagccacugacuagugacaguguaucaucuggagugugacucuaggaacagucccuccuggugacacugucuugcugugccacacucaaggcuguauuuaaggauagcuguguuauucgugaccacacaccagugucagacccaggagcaaaguucccacaggccccugcaacuuguuucuuggguccuggacucugcagcgcagugccaaguccuucgaggacugggagaaggaggaagaggaggaggaggaggaggaggaggaagaggaagaggaggaggaggaggaggaggaggagcccugcugggagugaggaaagcucacaugcacuuuugucaccugcccaguuaggcagcacuggccuuggucuggcccugacaucggcauugaggucuccccaggcuucaggaugggucaagaccuuccuguucgauccucucuuaauaucucugggaccccacuccauccuuccaacccucugucuugccugcuccucucccgucuguagacaucccaaaggcacccuuguucaauggccacuuugucuauucccagcccagacuucuccacuaaaugccaagccuaagcccagaagcagccgccaggaaacccccaaaccagagccccccagugccucagccaaacaccacccaucagagcccuacaugguggugcaugccuuuaaucccagaaaggcagaagcagguagaucucuguguucaaauucagccugcucuacagagcaaguucuaggacagccaagacucucucccucucccucucccucuuccucucccucucccucucccucucccucucccucucccucucccucucccucucccucucucucuccuucccucccucccuccuucccucauuggcuugcucuuuaaucaucaggcaucuugcccccuagaccaauggucuaucugcccagguuagacagcucugagcuacccuucucccuucagcccuccuaaauccuguucccugagcaacuacauaaggugcacugugcuuuucucucuacuucugagaauguccgaggguauuguuauuauuaagcuuuguguaugggggggggggcauguauacauuagacugcagauagccucacgguucagaaaagggucucggauccccuagagguggaguuacaggcuguugugaguugccagaugguggguacuaggaacugaauuuggauccuguaacaagagcauugccugcucuaaacugcccacucuacagcccaagcucuuaggcuuugucagugaaauauuguuuaugagugagaauacacaugaauacaugugcacauaguggacaggggagggagggaggaaggggagggaggagcgagggauggggggacuaggucucugcuguucucuugccuccucuccccuuucccacuuagaggauuuucaacacagcagccagagugauccugauuugaugugucaacgcugucaguccccugcucagagccaucucaggcagaaucagagccagcccccccccccaguggcugucugugccccacuuauaucucugagcgucugccuccauccccuccucccagccuguaccucccagccuuugcacaugcgacuccccuccauauacuccaaaggaccguuccuguuguuucuuauaccgugugucacucuccagcauucugaaugccuuugucauuuaagucuuuugccucuuuccaucuauuaaacugucggcuccuuaaggaucgaguuuucgguuugugacuagcgcauaacaggugccuagcauacucucuuuuaaaggaagaaaggggccuggugguggugguggugguggugguggugguggcggcagcacacacacgccuuuaaucccagcacucaggaggcagaggcagguggaucccuaaguucgaggccagccuugucuauggagugaguuccaggaaagccaaggcuacagagagaagcccugucucaaaaacacaaacaaacaaaacccaacaacaaaaauaaugaaagcaaacaaacagaaagaagggaaaaaagaaaagggcacauaaggagcuaucccgaaugaacaaggaaacgauaucgaccagggcuccugccucccauccgguagccauacagagcuggggcuguaaacagaaccaggagauucucucaggagagggcaugguacagcucuggguguuaggcguuagggaacagccugguugaagauggaagucaacucggaggccauggcaacugucuaaggguguggugaggggugggaggggacagcuacugcucuuuuggauccagauguagcucccugaauucacuucugaugaagaacuuccuagugccccuggaagcagccaggagccaguaagagcucacaccgcucuaagugcuucacaauuaccggucacugaaaccuccuacaaucuuggaagaugggauuugggauccccagggcagccuuaauuugcccaagagcauagagcugguaagagcuagcuagggucagagacaggcagucugacuuguuuggagacagcaaacagaucagcugugaccuuucugaacagggaaggaggcaacauggagucuaagccgucauuuacuggguggagaaacugaacucagagaagagagguuugaucagcuguguggagggagucaacguggucuccaggucuccuggccccugggccagugcucugaccuccucuccgcuucuggaacccagccaguauccagccauuuccaccagggugaugccuugcuucacauggcaaaauggguaucacccacaguguggagagcaaggggucuccuggggaacuggggguacaaggcaagguggggccaggcuaaccagggcccccuaaaccccuuuuccaucucugcccuucccugccucccccucugaguccuggguggugggagagaugaauacuuaauuaucuuccuaagaggaagcacuccaggcagcgccuagcuaccucagcagacaggaggaaaacaagcaaggauuggugaggagccugggguaggagaugagggucaaaggagaaagaaaagccuuccccccaacaagagaagcucaccucuaugggccugccaagguuaggcuggaccuguguagagccagccuaagagauaaggaaguguugggggaggggguagaggcugugccagggagcaguguucccaaagggacugagguaaccauacuagcagggaccaggaccaguggugaugauaggagggaagagaagaggaaaaggcagagaugggagaaggcagaagccggggguccuguggcaucccauggguaggagccccucggaguuguacccaggaaucauucacugaaaucaagcuguagggacagcuuuuccagaacacagccacacagucugcagacagcucugcccugguggggugaucucucaaaaugacaguguguacacagaccccaguggaugccgaaggcauggaggggugugugugugugugugugugugugugugugugugugugugugugaaggaugagaucucaggcacuuauuauaugugugacuuggagaaaacguaaggcgugucugaacuggaguauacagaggauuagcccagugacuaagggcugggagcccggcucucuaggguucucaauucugccacuaauuugccaugugcuuuauuuauucauucauauuuauucauguauauacaugcaugagugucuaugcaugugugcauagaagucagagguugguggcuucaaucccucuccaccugaggucaggacaggguuucucuguguggccccggcuguccuggaacucacucuguagaccaggcuggccucgaacucagaaacccggcugccucugccucccaaguacaggaauuacaagcaugcuccacacacaccuuaugcccaguuuuuauguggguguuugugauugaacucaagucuucacacuuucaugcuauuuuuaaaaauauuauuuuuauaauuagugugugcgcgcaugugugugacugugaccaugaugugugaauaggggugugcacgucagaacacacauguggaggucagaggguaacuuuguggagcugagucuuuucuuucaccuuuaugugagugggaaucaacucaggucgcacagcuaaugccuuuaauggcugcaccaucuuaccagccuaccucccugugaucuuuacggcaggucacaucagcaucugcaccuuacaccccuucucuguacaucuaacauugagaauuaaaugauacgcugcaugugagaucacucguacaccauguacugaagaacccuaagugcccuaucugcccuuccccgcgcaaugcccacuacacucaaaggaggggcuccacggcuaagucuacugcuagacacagagucacacagaacuuaccaaaaacuucauccacagguucucggagcuuugaggaagccaugacucaagagagcugggaaggacagagagagagagagaaagagagagagagauuaucuuggauaaauggcuccaguuggcuguggcaguaaagagucaauagcuuuuagcuuccugcccacccacuguccucuuucucuggcccuuggaagagaagcccgugggggcagaggcaggagacagaauccggaaagccauagauagcaaagccaaucaagccauagccagcuucugugagcugggaccagcuacaucagucccugcauugcauaaggcccuccaaucacuagcauuuccuaaaagccuccaucaucacuaaguaucccgcaucaaucuagaagucauggaaacgauuaaauccagaucucucauuuuacacagaaacggaagagggaguggauggcccaagaucucgaggcaauuuauggcaaauccagauuuaaaacccaggcucuugcauccauuuaccuaccaaccuuuuuuaucuaccugcuuguccucccuccacccucccucccacuguguacccuaccgauccaacaucuauuauguccaugucucuacccaucuuuguaucuaucaguucuuccucaguugccagggcccucaccaccugcuguuuugaacuauucaggaagccagcaucaccagcagguccacagaaccacagaaccacagucuccacaguuuguuguuguuguuguuguuguucuucuucuucuucuuucucuuccucuuccucuuccucuuccucuuccucuuccucuuccucuuccucuuccucuuccucuuccucuuccucuuccucuucuucuucuucuucuucuucuucuucuucuucuucuucuucuucuucuucuucuucuucuucuucuucuucuucuucuucuucuucuucuucuuuugagacaggguuucucuguauagcccuggcuguccugaaacucacucuguagaucaggcuggccuugaacccagaaauccaccugccucugccucccaagugcugggauuaaaggcaugcaccaccacgcccagcuaguccccacaguucuugacuugcagauggaucgagacauuaaguuuccacagcagaacaucucuaaagcauucugggaaggaauguagaugggcagaguuguaauguuuagguuugggcauuugguuugguuugugguuggaaucaaagaagagcaggcagguaaggaagggaagcagggggaaugcaucagaaacaccguaggcaggcaggcaggcuucuuagcaggauagaagccugauacagaagacaaccuaggguagggagccgcugaauggcugagacacaaucuccaguuacuucuaauacgaugguuccugggagaagggcagggcacuggaccagaccacgugcccuuuagcucuccuuucgcugcacagacauuucucugugagcugcuaggcuuauuagcaucuugguauccccacuuuacaggugugaacauuaauaugcaagagcucagagguagaugcugacauugaccccugucuccuguuucucagcucuauccagaaugcaugaucugcaguucuggcgcugcucaugaggaaaggguacucucaggggagggcugggguaaagggaggggggaucugguuugcaccggcugggauuaaggcaagcauuaaaaccaccuccacuaggcuagagggaugcuuggagcugagccaaacaaugccauacaggagagguccaggaugucucagcaagggaccccuuugcuguuuuugaacucuggggacuaacagcccccugaauaucuagaauauucucuccaggccugagaggccagauuaagguaggucgguccucaacauaaacagugucucaucauuggauugcaaaacuuucucugauuaggauccagcugucccuucuccagaucccuguccuaggaugccgccccuauuugucuaaagcuacuccaauucugagaaaugaagaccuugucguuucuuuacugguuuccuauguggguuuuaucucucccugacagaugagccaugugcccucccuucagacuggagacucaggauaguagcugcuucuccuaucagaguggcugcucucuacagacaguggugacaccuccucucuuaaacagagcaggccagccugcguucuuuccugauggucccaauccagugaugagagccugugcacuaaggccuauuuuaggcccccuuggguagacuggggccuccagcucagccuuucagcccauccugauucagcacaaacugcuuucuucaucucuaucuuuaacagccagcucccauaacugucagggagccuucccgcucugucccauguaaaacuccauggaugcauaguauucgggucaccugccccugucacugaacucucuccucccuaaaacacacccuaggaaaauuaaauccccaccucaccucucuucccucuuuggcucacacucuuacucaggaguguuaacuacacaaggaugcaaaugaaccuguccccuuggacaaccucugggcucccuggucaacagaccacucccuuccccaacagcuuccaguuccuggaggaccauuagggaccucugaccuuucucuggaaaaaggaaaggcaggugaguuccaagcuaccuggagcccaagggaaggagaaagccaaacaaaaggucuacaaccugcggguggaacagaaggaggaacuagcagaugcagagggagagacuggcaguguccacugggagcugggaagaaagaucaagaaagaacagacccaggaggcucagggaaagcagcuggguagcccugacaccccaucauggggugagagaauagaacagaaugccugccccacaagcaagaagggagaaggauccugaguaggggagggagagagacagagagacagagagacagagagauggagucagaaaagagacacacacacacagacacacagacacacagacacacacacacacacacacagacacacagacacacacacacacacacacacacacacacacacacacacacagagccgacaagucccagaagugguugacaugcaggcuggagaugggggaggcaguuguagagcagcuaaggagccgagccccucccaggcccccagucuucagccagccccaggcuuggagcuguccgcaggaguuugacagcucuuccaagcguccuagaaaaugggguuaauggacagugcaccuacaccuaucauagaauccccucuccccaaucucagaggauagaacaguuucuucaacccauaggucuaacugccagauaggaaggaguuaaggccucucccccugcccccacaccaguuuuucuuauuucuuuuucucuucauucuuuccucuccucuucucuucucuucucuucucuucucuucucuucucuucucuucucuucucuucucuucucuucucuucucuucucuucucuucucuucucuucucuucucucucucucucucucucucucugucucucucucucucucucucucucccuuucucuccucucucucuuauuaauuuccucaggcgggagaaaugggauuagggacacaaacccuauuucugcucccucccgacagcccagcuccccccuccagugaggucucccuagggauagagaaagaaaggcccuuguggcuuaaauccauuuagcccuacugagggucccaccuugaguccaguagucgcuagccacgcuuccccuuccacccuaggggacccggccccucaccuccagcauccgucauuuucagcguccggcgccccgggaaccccucaggcccaugguguucggggcgacugccgggcaggagaggggcgaaggacuuucaccccggucgcggggggcuccgggcuggcuggagucgcuccauuccaggguguugugggggaucggcggggagagucccggaaagaauggagaggcgagguguguagggaugcagggagaaggucugcgggaagcaggaggcgcgggcggggcuggacggggaaaccugacgggaggaugcuccgugugugcgugcguguacguguaugugugugugugugugugugugugugugugugagagagagagagagagagagagagagagagagagagagagaaccugaacgccaccucccgccccgcccccgccaaaccccgggggucgcgaacccucgcgccaccggccgauuuguguagcgucgcaguggcuagguccguggggggucgcccgggauaaggcgacggggggggcggggggggcgauacgcuuauggggaggccgagcgcccgggagacaaagaacgguagggaaggagggaagaggagggcgggcggggcggaagcagcuaggaccgaggggaggaggcggcgggugcccgcggccggccccgggaucccaauugccgcuacuucucggaccgcgggagucucagcgcuagggagucugcgcgcgaauggcagggaagcgaccagggaggcggucccgccuuaggacgcacggggcuuuccaucuccucugcagggucugugagggcuucugauucucuuauucaacaagcauuugccgggcgagcggccagccuggggcgcugaagcagaaggggaccgccguugaacagaacagacgugguccgguguagucuugauucagccaaaugggacuucccaagccugagaacugugggcccaggagcgggaaagacucuuuaaguucuggagggggcgugcacccgaggcacuggagaaggacacagggaagauuccuagagaaguguggcuacuccugcuggccaagcuaugggagacuuacuccugggcauugcaggguggauggaccaguagagaaaauugaggugggaggguugauacuucauucuauuacuuccugccccgccccccaauaaaagguuaaccgagga

SEQ ID NO: 6299 - RNA, 5180 nt, Mus musculus
cagcauuugacuguggcuugggacgcggagagaggcacgcagcgacugaccgacagccggcgauggucuaagcgccccucggccacccccucccccagacgcgaccgcguccugcccucgcccucuggacacacacccccaccugggcuccuccgcccguucggcgcuccucggaggaggcccgggguguugcggcgcucgccagcaugagcggcuccuucgaucgcaagcucagcagcauccucaccgacaucuccagcucgcucagcugccaugcgggcuccaaggacucgcccacccugcccgaaucuacagucacugaccugggcuauuacagcgcuccucagcaugacuacuacucgggccagcccuacggccagacggugaaccccuacaccuaccaccaccaguucaaucucaaugggcucgcaggcaccggcgcuuacucgcccaagucggaauauaccuacgggggauccuauaggcaguacggagcguaccgggagcagccuuugccugcccaggacccaggugaggaugcccggguuguggagagggugcgagggacucuaagguucccaagcaagaggaagucugggaauaggagcugaaaucuagggaaacucgagguuaagaaauggaagcguuggagauuagaggagaccggguuagaugaccuccagaggggugaacgacacuccgaagaggcgcgcacugugcgccgcggucucuuggagauuccagggcagcuggagccaccgggagcuccuucugagugaucaugggggccuucaaugcugccaucccgcuggcacuugagccggagacgaaagacggucgccgagagcuggaggggagucagcgaggacuggagguuccagggcccuucuuuuggaugccgucaggggaaacccggaguagugaaaggcuuguggagaaagacccaaagaagucccagaaauggaggagagacugggaaguagagaugcggagagagaaguggggacggcgagaaagaaauguggggggggcgguaagauaaagcgcacagcagaaagcaacagaggaaaugaagaaagggcggggaggaaagaaagaaaaaggaggaaagaagagggaaggaagaaaaagaaaacagagagaaagggaaaagagacagagaaaacgcuuguacuguccuugcaaauuuuuuccugaaacaaaugauccugaacuagaaagcguauuaaaaggagauggggaggaggggggacaagaagugggagacgccaccgcggcuaggugggucaccagagaagaguggcugagccgggaaggcgucgugagcgagccgcgcgguccucgcccagucgguugcuggcgccggagucggcgcuccgaggccccgggugccgagcugggagcgccgcgucgugggcggccgccgguccggcugggucgcugcgguuccuccccgggcgcgggcggcacuacgcuccuccaagaagucccggggagaucagugggccggagggugcggcguccgacggugggaaaucuuggagaacgcgguggucgcaggcugagacuaaacugguguuuuuccccuacagugucggugaaagaggagccggaagccgagguucgcauggugaacggcaagcccaaaaagguccgaaagccgcgaacgaucuacuccagcuaucagcuggcugcccugcagcgccguuuccagaaagcccaguaucuggccuugccugagcgcgccgagcuagcugcacagcugggccucacacaaacacagguugguacugaacgcuccagggucucaggagggaucugggauucccuagguaccccugagccuggcuggcccaugaagcaccccuuugcccugccccugcccggcagcucgcugcaggaacucuugccugcccuuccagugacuugagucucagcuuucagagaaaggguuacaguagggagcauagaagggugcagugugcaucuuugugaacuuuugcaacuguguauggcgugucacagagagaugcccuccccuguaccccagaacucccagcucccaagacccuuagcaacguuuaggacauaggagauccuguugucucucucccagacuaaguauguacguguggggcaugcaugugacauuccagggaauauucacauaaggaaugagguccuuuaagggucauuuugcaaacagaaggccaguaucugugaugagacacuagacaacgcacgcgugugugaacacacacacaaaguaugcuuguauagaaacaucaugauccugcuucccacccaaaugccuuugccaguagccaaguggauagguucuccacuaaaaggauguagaaaucagaaagugggaguccaucuccacccucuuaccugucccuaaaccccaagcagccuugcugcucuuggggaggaaugucgggugcugagcucccuacagguguugacaggcuggcuuugguuguggcugggcuguguggggccugguccaucgggaaucugggucaccuggugaggcgcugaaucauuguuuguaccagucauggaguggagagaagcaggggagggggagauaccccacgggaaauuuagggacucuggaauugugguucaccugccccugaguuccuaggucacccuucauacccagccagagucuaggagccccuccaugccugaguguuuaugucguggguguuuaucuggguguuaucugcaugcguuuauagcuuuacugucuggcggcugugugaggcugaguggguauguugccgaggaaagagauaccuguguggguguguguuuaucccaguguaucggugaacuuuggcuaagggccucuaacgugggcaaaauaucacaaacugcccgguucccacuuaggacgccuuugauugagcgcuugcuguauaacagaccguuuaaguugucuugugucuuaacuuucuugagcccaauauugacccuuugagacaaaugaugguguuagcauggccuucauuuugcagugagaggaaggugaggccagagagguuaaguaaccggcguaaggucgcacuucagcaguggcaguagaauauucuaagccacagaguuuuuucccaacuggaaagaaagaugcuagcuugggugugagggcccugggguuuugccucguuuuuccccucaggaggcuggguaaugcuuugccuuguccaggcugggcuccccauggggucuccuuuaggcaugcugagaggcugacggggcugcuccuuucuucuucuguccaggugaaaaucugguuccagaaccgccgcuccaaguucaaaaagcucuauaagaauggggaggugccgcuggaacacagccccaacaacagugacuccauggccugcaacucaccgccgucaccagcacucugggacacaucuucccauuccacgccagccccugcccgcaauccgcugcccccaccgcucccauacagugccucccccaacuaccuggacgaccccaccaacuccugguaccacacacagaaccucaguggaccccacuuacagcagcagccuccucagccggcuacccugcaccaugccuccccugggcccccgccuaacccuggggcuguguacugaguacccaccuggccugcgccccuccacgaaggacccccuccaggaccaggcagaaggugcccuguccuagcgacacucaggaaucauugaggggcacagggggaaagacucccuucccucucccuugucccuucuuccagggacccaacaaccuccagaugacaaaugcauggaccgaggaugccccccaaucucccuccccuugcuuagacuggggugcccuccagacggcgaggaguucuaccccaguggggacagcacaugcucucugcuccaggaacccggauugccucuagauggcucaucgcuuuccagcuuuucaaacacaguagagaccuccaaaaugggagccagaguguuugcagguccaccugugcuggggcaccaggcgccacggauuccagcacagccagaccuaaagcaccaaggggcaacuauacauucuugagccacucuuuaaaagacauuggacauuacaucauggcugauccucaagaugggggggggcugaccuaguccccacuguucuccagcccucauuaggauuugaggguccaaaccaaagaaaacucccccaaaugagggaaccuuugauauccagggcuuccaagggaagacuuaaaggagccaucccuccgccccuucccuggggaaaaggauugcccauguccuuuuccaaggaccuguuucuccuuccauguacaggacuuugcacaagucugguuuuaaaagcuguugaaaccuaggacgacaaugggcauuguuaacaguuaggaccaaauccacuccucucugggcgggcagcucugcucugcccugacccugcucaccccuucguuuuguuuuguuuuguuuuucucccaguaaguuugcagucuugggggacgggcucaaaccccaacucucuacagagauagaccaggcaagacaccccccacucagacacccccuucguggcagcuuuggaaacagguuguccguucugcugcaggauucaagugaggauccaggagacaagaggaggccuagaacucagugccuuagggguaaggcugucagcuuggacggcugguaccagugccucucccuggcccaggcaucccccaaagcuaacuuucuucugcccccugaugugguaaaacaucgaagaaaggagaggugacagacuguaguuauauauauauaguaugguuuuuuuuuguuguuguuguuucuuuuuuuuuuuuuuuuuuaagagcaaccaagagaagcagguccccucccuugugguuuccuauuuaugugacccuguuccuccuggaccaaucucccuguguugcaagucgaaagagggaugugggcuccugcuggauuuggguuucgugggaagugaaggaguaagaagagacagacguggugggucuccgagucccaccccaaagggacaggacugaagccagcucccaccccuccccagccuucucauuucugcuuucuuacuggaccagucuuuauauauaauguuaauaaaaauuaaaaaaaaagaagaagaagaaaaua

SEQ ID NO: 6300 - RNA, 5180 nt, Mus musculus
uauuuucuucuucuucuuuuuuuuuaauuuuuauuaacauuauauauaaagacugguccaguaagaaagcagaaaugagaaggcuggggaggggugggagcuggcuucaguccugucccuuuggggugggacucggagacccaccacgucugucucuucuuacuccuucacuucccacgaaacccaaauccagcaggagcccacaucccucuuucgacuugcaacacagggagauugguccaggaggaacagggucacauaaauaggaaaccacaagggaggggaccugcuucucuugguugcucuuaaaaaaaaaaaaaaaaaagaaacaacaacaacaaaaaaaaaccauacuauauauauauaacuacagucugucaccucuccuuucuucgauguuuuaccacaucagggggcagaagaaaguuagcuuugggggaugccugggccagggagaggcacugguaccagccguccaagcugacagccuuaccccuaaggcacugaguucuaggccuccucuugucuccuggauccucacuugaauccugcagcagaacggacaaccuguuuccaaagcugccacgaagggggugucugaguggggggugucuugccuggucuaucucuguagagaguugggguuugagcccgucccccaagacugcaaacuuacugggagaaaaacaaaacaaaacaaaacgaaggggugagcagggucagggcagagcagagcugcccgcccagagaggaguggauuugguccuaacuguuaacaaugcccauugucguccuagguuucaacagcuuuuaaaaccagacuugugcaaaguccuguacauggaaggagaaacagguccuuggaaaaggacaugggcaauccuuuuccccagggaaggggcggagggauggcuccuuuaagucuucccuuggaagcccuggauaucaaagguucccucauuugggggaguuuucuuugguuuggacccucaaauccuaaugagggcuggagaacaguggggacuaggucagcccccccccaucuugaggaucagccaugauguaauguccaaugucuuuuaaagaguggcucaagaauguauaguugccccuuggugcuuuaggucuggcugugcuggaauccguggcgccuggugccccagcacagguggaccugcaaacacucuggcucccauuuuggaggucucuacuguguuugaaaagcuggaaagcgaugagccaucuagaggcaauccggguuccuggagcagagagcaugugcuguccccacugggguagaacuccucgccgucuggagggcaccccagucuaagcaaggggagggagauuggggggcauccucgguccaugcauuugucaucuggagguuguugggucccuggaagaagggacaagggagagggaagggagucuuucccccugugccccucaaugauuccugagugucgcuaggacagggcaccuucugccugguccuggaggggguccuucguggaggggcgcaggccagguggguacucaguacacagccccaggguuaggcgggggcccaggggaggcauggugcaggguagccggcugaggaggcugcugcuguaagugggguccacugagguucugugugugguaccaggaguugguggggucguccagguaguugggggaggcacuguaugggagcggugggggcagcggauugcgggcaggggcuggcguggaaugggaagaugugucccagagugcuggugacggcggugaguugcaggccauggagucacuguuguuggggcuguguuccagcggcaccuccccauucuuauagagcuuuuugaacuuggagcggcgguucuggaaccagauuuucaccuggacagaagaagaaaggagcagccccgucagccucucagcaugccuaaaggagaccccauggggagcccagccuggacaaggcaaagcauuacccagccuccugaggggaaaaacgaggcaaaaccccagggcccucacacccaagcuagcaucuuucuuuccaguugggaaaaaacucuguggcuuagaauauucuacugccacugcugaagugcgaccuuacgccgguuacuuaaccucucuggccucaccuuccucucacugcaaaaugaaggccaugcuaacaccaucauuugucucaaagggucaauauugggcucaagaaaguuaagacacaagacaacuuaaacggucuguuauacagcaagcgcucaaucaaaggcguccuaagugggaaccgggcaguuugugauauuuugcccacguuagaggcccuuagccaaaguucaccgauacacugggauaaacacacacccacacagguaucucuuuccucggcaacauacccacucagccucacacagccgccagacaguaaagcuauaaacgcaugcagauaacacccagauaaacacccacgacauaaacacucaggcauggaggggcuccuagacucuggcuggguaugaagggugaccuaggaacucaggggcaggugaaccacaauuccagagucccuaaauuucccgugggguaucucccccuccccugcuucucuccacuccaugacugguacaaacaaugauucagcgccucaccaggugacccagauucccgauggaccaggccccacacagcccagccacaaccaaagccagccugucaacaccuguagggagcucagcacccgacauuccuccccaagagcagcaaggcugcuugggguuuagggacagguaagaggguggagauggacucccacuuucugauuucuacauccuuuuaguggagaaccuauccacuuggcuacuggcaaaggcauuugggugggaagcaggaucaugauguuucuauacaagcauacuuuguguguguguucacacacgcgugcguugucuagugucucaucacagauacuggccuucuguuugcaaaaugacccuuaaaggaccucauuccuuaugugaauauucccuggaaugucacaugcaugccccacacguacauacuuagucugggagagagacaacaggaucuccuauguccuaaacguugcuaagggucuugggagcugggaguucugggguacaggggagggcaucucucugugacacgccauacacaguugcaaaaguucacaaagaugcacacugcacccuucuaugcucccuacuguaacccuuucucugaaagcugagacucaagucacuggaagggcaggcaagaguuccugcagcgagcugccgggcaggggcagggcaaaggggugcuucaugggccagccaggcucagggguaccuagggaaucccagaucccuccugagacccuggagcguucaguaccaaccuguguuugugugaggcccagcugugcagcuagcucggcgcgcucaggcaaggccagauacugggcuuucuggaaacggcgcugcagggcagccagcugauagcuggaguagaucguucgcggcuuucggaccuuuuugggcuugccguucaccaugcgaaccucggcuuccggcuccucuuucaccgacacuguaggggaaaaacaccaguuuagucucagccugcgaccaccgcguucuccaagauuucccaccgucggacgccgcacccuccggcccacugaucuccccgggacuucuuggaggagcguagugccgcccgcgcccggggaggaaccgcagcgacccagccggaccggcggccgcccacgacgcggcgcucccagcucggcacccggggccucggagcgccgacuccggcgccagcaaccgacugggcgaggaccgcgcggcucgcucacgacgccuucccggcucagccacucuucucuggugacccaccuagccgcgguggcgucucccacuucuuguccccccuccuccccaucuccuuuuaauacgcuuucuaguucaggaucauuuguuucaggaaaaaauuugcaaggacaguacaagcguuuucucugucucuuuucccuuucucucuguuuucuuuuucuuccuucccucuucuuuccuccuuuuucuuucuuuccuccccgcccuuucuucauuuccucuguugcuuucugcugugcgcuuuaucuuaccgccccccccacauuucuuucucgccguccccacuucucucuccgcaucucuacuucccagucucuccuccauuucugggacuucuuugggucuuucuccacaagccuuucacuacuccggguuuccccugacggcauccaaaagaagggcccuggaaccuccaguccucgcugacuccccuccagcucucggcgaccgucuuucgucuccggcucaagugccagcgggauggcagcauugaaggcccccaugaucacucagaaggagcucccgguggcuccagcugcccuggaaucuccaagagaccgcggcgcacagugcgcgccucuucggagugucguucaccccucuggaggucaucuaacccggucuccucuaaucuccaacgcuuccauuucuuaaccucgaguuucccuagauuucagcuccuauucccagacuuccucuugcuugggaaccuuagagucccucgcacccucuccacaacccgggcauccucaccuggguccugggcaggcaaaggcugcucccgguacgcuccguacugccuauaggaucccccguagguauauuccgacuugggcgaguaagcgccggugccugcgagcccauugagauugaacugguggugguagguguagggguucaccgucuggccguagggcuggcccgaguaguagucaugcugaggagcgcuguaauagcccaggucagugacuguagauucgggcagggugggcgaguccuuggagcccgcauggcagcugagcgagcuggagaugucggugaggaugcugcugagcuugcgaucgaaggagccgcucaugcuggcgagcgccgcaacaccccgggccuccuccgaggagcgccgaacgggcggaggagcccagguggggguguguguccagagggcgagggcaggacgcggucgcgucugggggaggggguggccgaggggcgcuuagaccaucgccggcugucggucagucgcugcgugccucucuccgcgucccaagccacagucaaaugcug

SEQ ID NO: 6301 - RNA, 35994 nt, Mus musculus
gccggaaguuaaggaauaggcgcuuccagcccgcggcgcuugcgcagaaggcucuagacgcugagagguaggaggcacuugggaucguccgcaggguuugggacagcuacagaggccgccacggagcccgccggagcccccguuccugcuggugcugccgccgcccgaaucggaaccgucgggcugcagccgccggcaaugccgcgaaggaaggugagaaauggcagagaagggauggcggguuucuaaggggagucgauugaguaacgugacgcgguuggccacgccucgucgugcuuggguuccaacuuucuggucccccgaaccuagccuagcuacucugucuccucucgguaccagacagaaaaaugugggcccgacccuggccucggccuaugccuguaacuauucccgcccucugcuugcccggaucggaggcguucuuguuaauuggucgcggaaaugucuagaagcguauugauuggauggugacgccgccuguuugggcccaacggucaccuccccgcgugcgugggcggugucucggucuggccccggugcucuccgacuggcuguggcgaaugcucucccuucucuuuauuggcccagcuuugcagucuguucuuguggcgggugcggcuuagcaaggccuggauuggggcgaccaacgccccgcccuuccggauagagauggcgauagguguuguaaaggcgaguugggaagaccacuuuccuuuccugguggggggauuacaacaaagccgaggaugggugguuagaaagccagcgcccacccccaagggauagcucgcaggccuguugcgucucagucaccgucuuccaccuauuuguucaguuugacauuuccuggucaguaaauguuuguugaacuguaugacauuugccccauauguucagucguaaaaugcaaagagcaguguuacgugcuaguugcuaggaauucgaaaaguaugcgugaucacuggcuuaaaggguuaucgcuguugagagaagaacacaaagaaccauaguucauacagucucugcuugaaauuguauacacuguaagaaagccguuaacgugggaaauaaguaaagagcugauuuucaggguuaagccaggcagaauugauaggucauggacgggugucagggucuuuggcugagaugacccuaaaguuugccuuuuagugacauucugugccucuauuuacuuguggucagauuuuugaaugaaauauuuggauggauagacgguugguauucauauuucugcagagaucacucuucauggaagcuuuccaaguuaaauauuuacauuaaugucucuugcaaugaccagaguugacagguaguauuuuuuuaaaagauuaauuuauguauuuuauguaugugaguacacuguagcuguacagaugguugugagccuucaugugguuguugggaauugaauuuuuaggaccucugcucacucaggcccaaagauuuauuuauuauuauacaugaguacauuguagcugaguuuagacgcaccagaagagggcacagguguuugugagccaccaugugguugcugggauuugaacucagaacccucgguagagcagucagugcucuuaaccugcugagccaucucaucagcucgacagguaguauuuauauccaggcauaccaaauacaagagacagaccuacugguuuguuggaaugaucuagucuccuuuuagcaguuuccaaauguaaaaguggagaauguaaauucuuccuggauguuaugguacaagccuuuaauuccagcacuugggagguggaucucuauaguuugagguacacauggcugauaugcugggguguccugacucaaaaagaagaagaaaauguaaguucuugcuggguauagugauacacaccuguaguucuggcauccuggaggcugaggcaggaggcucaucuugagcuuaaggcaaaccuggguuauauaauaaauuccaggccagccugagcuaaauagcaagaaccuaucucaaaaccaacaaaacccaaauguaaauauguugguaacuugguugauggccaaucuguccuaaucuauccuuagguuauuuaguuuuuuuauaugccucauguagugugauacuaaauuucuguuugcuagaaaauauuaauguuuuuaguguggguuguuaaucacaggauauauguguccucuguaagaaucuaguaacuccaaacauacuuggccccagggagcuuauucuuugaauaaagcguuggggccugggacuaagcuauagcucaguggggugugguuacugccgggaagcccugaguucaguccuucgucugucccacucccuuuuccugccaaagauaguaggacugaguuugaggaguuguagugauuucagcaaguacucuuuguccagcuuagaaaagagcacgugucagugcuuacuagguaaaguaaucuucauggcucaucacccuuccagaggccgagaguuauggcuaggguguggcaugcguuuuucugagaaccugacacguggggcugcagggauuguucagcuggucagaguacucauugcucuuguagaggacuggguuccaagcaccuuguuucaagccucacaaccgcuuaugacuccagucccaggugacuggacaaccucccuugaccuccgagggcguguaugagaucaauauacaggcaaaacuuucacacauacaguaaaauaaaucuaauuuuuaaaaagcccgguuugaauaccuauuuaguuuuuaguauaaauuccuuuccagcagcacuuauaacauccauguggagaaacuuugaggacugaugguuaagaaaauaauuuguaucuuuuuuuugguuaauuucuuucaguggguaagagcacccgacugcucuuccgaagguccagaguucaaaucccagcaaccacaugguggcuuacaaccauccguaacaagaucugacucccucuucuggugugucugaagacagcuacaguguacuuacauauaauaauaaauaaaucuuaaaaaaaaaaaaaagagcuccuagaacuggagcuccagguaguuguaagcugccauggauguugggaauugaacccagguccucuggaagagcagcaaaugcucuuaaccaccaaaccaucucuccagccccaagaacauacuuugaaaugaccccggucaggguuucucuguagcucuggcuguccuggaacucuguuauguagaccaggcugcccuggacucacagagaucuucuuacuccuaggauuaauggcauacaccaccaugcccagcuaauauaauuuuuauuauauuauaauauauaauauaauuuuuguugauggagaauuugaauaaaauuuaccccaaaguucagugaggccuagcaauaacauuuuauaugccaucuuggacuuuuucuuuuccuuuuuuuuuuuuaagguuuaguuguacuauuuuaauuaucuggauguguguagggaugugugagaacaggugccugcggaggcuggagguauuuggcucccucuggagcgggaguuacagacuucaguugugaacuaccaagugggcaagugcuggcaaaugaacuaggguccuuugccggagcggccugugcugucagccacuggacugugcuuuuucuuucguuuguccuuuuuauuuuuuucuugacuagccagaccauuuugauuuggguguuuuguuguuggguugggugcuuuuauuuccaauuucuagugauucaguccagauuguuucagaauuagugauaauacacgaagaauuacuucucuucucggucugcugaguacaggugguuugguuguaggucauuccacuagcaugucugaaaggaagggcagcgccucugcacagcagggaggggaaaggcuggcuggugguggaguccuuccuuauguuggaacuugguacuucagcaucaugguucauuuuacuuccagugcuaauagaaaacuguaguaaaugcuuuugugcuaaugucuggaucuaugguauugcagagaaaugcaggcaguaguucagauggaaccgaagauuccgauuuuucuacagaucucgagcauacagacaguucagagagugauggcaccucgcgccgaucugcccgagucacccgcuccucagccaggcuaagccagaguucccaagguaaacauguuuuccuuuccccugacuucuucacaguggacaguggugucauucuguugugcugguucauagggauacugcuccugagcuugauggagagcagugguucucagcccuccuaacacugcgacccuuuaguacaauucuucauguuuucgugaccccccuccuuuaaauuauuauuuuuuaaagauuuauugugcguacagcaccugucugugugugugccugcaggccagaagagggcgcuagaucucauuaucgaugguuaugagccaccaugugggugcugagaccucuggaagagcagcugucucuccagccccccauuaaauaaucguuguuacuucauaaccauagcuuuacuaagguuaugcaucauacuguaaauaucugauacgcaggauaccugacauuuggccccugugaaaggaucauuuaauacccuaccuacaaagggguugagacccacagguugaaaaccauugguauaggugguagaauggucaaaguguaaggcagcugcugaaauacucggucuucaaagugguuucugucagauguucuuuuauaggcaguggcuuauauaaaugugagaugcaggugucuugaagacuguauggcguucguuauaggucaucguaaaacgauaaaaugggaauguuaucucaucacuauaaaauggcuuaagaguuaaauugcuuauugagugugucagugagauuuaaugcuucuaaagguacuuuuaauucuagaauauagagucacauuugauagaauaacuuugaauaaauauucagaauguugcuuugguagugaaauaaacaaaaggcuugugguuagaaguacuuggaaggcucucuaauguauuuagucacuugggcuuauguagaaguaggcuuuuccccuccuaguuuuauucagcauggaagaaagguuuuucagcuaauauacaaaggugguuaucagucugcaacaauagaguaaaugggaaauuauaauauggcgucgggugugguguugcacaccuuuagucccagcacuuuggaagcagaggcccgcagaucucugaauucaaggccagccccgucuauauagaguguucgaggcuagccagagauacugagacucuggcuuucaacaaaaaauaaccaaaaaaguaacugugugugcguguuuuauguauguauguauguauguauauauauauauguauguauguauauguauguauacaugucuguacacauacaaauaaauaaaaugauuuguuaacaaauccuuuggucagccgggcaugguggcgcacgccuuuaauuccagaggcaggcggauuuuugaguucaaggacagccagggcuacacagagaaacccucuugaaaaaacaaaaaaacaaaaacaaaaccuuuggaagcccagggguggagcaaccacauucugugagaaggucuccuagaacagucuggaggaguccaguaggacuuugcauauugaagaugagcaaaauauuuuggggcagaaggaaucauauauacaaagagucauaaugguucuuagacacugcaguuagcuaugcccuaaaggugauggauauucaaaacagagcuggggggggggucucuguaguuauuuuauuucauggccacaaagcuacacgaucuuugggagcaucagucacaggguuuccuagugugaaguauagacagacuugugaaaagauauaaagauacccuaaaacuauauagucuuuggacccugccugcauaccaacuuaccucuccugacaguuugacaauuucaacuuagacauugucauagguugucauuuaaaauacucuucaguuuuagcuuuuauuuuauuuccuuuaagaggcaucagacuagagaugugaaaggucucugaaagcuuuagaagaggguucucuaugggaagaacuuaaggggcuggagagauggcucaguaguuaagagcacuuaguuguuuuugcagagaaccuggguuugacucccagcacccacauggcggcucaccccaccgucgguaacuccguaugaguacaaggguagucaaagaacaagcaaccuccucccaaauauaguuuuaggacaucuguauuaugaugggcuauauauagcaagggaagaaacaggcaugucgcuaauauugguaaagaacucuuuucccacuggggguaaggcacacacgccuuuaguccuagcagcucagcagacagguggguggaucacugaguuugaggccaaccuggucuacaaggcgaguuccagggcuacacucagauucuguuuuggaaaacaaaaaaaccaagaccuuacucacaguaaguaagcgugaggaauauacuacuacugucuaucauuuauuuauuuauuuuauuuuccaugcuaaagugaguauuuuucucucucaugggcaaagaagcaagcuuagagacauuagcuugcauaagaugccacagauuguugcuauggugaagugaaaucaaguggagcucagucuuuacuccagauccugaaggaucauccuguaccaccguuaggauauugauguaguccaccugccccuuggcaugcauuauuuaguaagaugcauauaaucuaaggcuguguuggguuugugaaauagaagagaagaaauaguaugcugauuauugugugaauggauauaaaauggucuuucuuuuuuuuuuuauuuuaugaucuuuuaaaaccgguguuagauuccagcccuguucgaaauuugccgucuuucggcacugaggagccugccuauucuaccagaagggugacccguagucagcagcagcccacgccagugacuccaaaaaaguacccucuucgacagacucgcucaucuggcucugaaacggagcaggugguggacuuuucagauagagguaagugggucugugggacuggcucugugcagagggcuuggucaguuuucuuuuuuguuuuuuugagacaggguuucucuguauagcccuggcuguccuggagcucacuuuguagaccaggcuggccucgaacucagaaauccgccagccucugccucccaagugcugggauuaaaggcgugcgccaccacgcccggcuuuggucaguuuucuuaaggaacauuuuggcacugcagagagauugucagaguuuaggucggcagacacuguugacuugauuccuuuugguuuguuugcuuuguuuguuuauaguuuugaaucagaguuugaaaaauauagccucaaauuuggaauccucuugccgugaccuagaguucugggacuacagaugugugccaccgugcucaauuuaucgaauuucuuacuguauauuuugcuugcuagaguauuagguguauucaguuggauguauaauagggagaaggagacagagccuuccgaaccuccacauaaaaccuagauuuuauuagcaccaugacuacuggcccauuuuaccuccagacugcugacuaggagugaccauuaguaauagacagcauuaggauauugaggcuaugaucccauacuuuaagagccuuagagcaagaggcauuaaagcagaucuugcaagcuacugagauucuccaaccaggcaacaugauuaauuuguugguuugcagaguuucauuauuuuuaacuuucgugguagugcuuagaagcacagcaauuuucauauuguuuggacuguauguaagucugugaacuacauuugugccugguacccauggaggccaggagagggcaugagauacccugggacagggguuacaguugugagcugcugugugggugcuuggaagcaaacccggguccucuggaagaaucgccugagcucuuaaccagugagucgacucucagcugguggguugauuggggcuuuuugagauagugucucuuuguucccagguguccugaagcuccuuauccagaucaggcuggcuuugaacucaggggucaacaguuaacuuuugagacaggacagacuggauggccauuuacuuuuuaauuauuaacuggagcugaauaguaguugucaccucuggauagacaaugacguccuuugagcuuguccaagcccuauagguaucugguuuguagaccuugguuuaugaguguguaguuucuguagaacucucggacuccagcuaucagacccuaagugugcugcagagauggcucaguguuuaagagcacguacugcucuuuuucugcagggguaagggagcagagucucacuauagcccugacugucccagaacucacucuguagaccaggcuggccucaaacucagagaucugaaucccucugccucccgagugcugggauuaaaggcgugugccauuacauauagcacauguguugcuugcucuucuagagaaccugaguuaggguccuagcacacaugucugguggcucccagcuccccguaacuccaguucuaggagaucugaccuuugccagcccccacauuauauccacauacacauaauuaaaaauacaucuuuaaaaaggaaaaaaaaagagcauggugcuaaaugucuuuaauccaagcauuuguaagguagagucauuggaucccuuuguguuuagggccguccuacccuacauagaaaguuccaggccagccagggauacauaguaaaggcugucugucugucucucuuuuaauuaaaaagaaaagaaaaaagugaauuucaagauugugagacccuaguaacuucaggcaccaggcguguugauuauacacauacaugcagauaaaacguucauacucauuaaguauuaaaauaauuuuuuaaaauuauguuuggccuacauauaugucuucguaucacuugcaugcugauaccauugacuccccuaaaacuggaaucccuggacugguuauagacaauuaugagccauugggggggggggggcacgaggaguugaacucagguccucugggagaacaagagcagccucuuaacugcugagccauuucuuagacucuuaaaaggaaaaaauuauaucugcuucuuuuuuccucuuucuuaauugggguugguuuugaggcuuggucucuagguagccuugcucugucauccaggcuggccuagagaacacuugccucugccucuucagggcugggauuaagagcacaugcacaccaccacacccagcucagugauuuuuuuucuguccugugagucucuaggaaaggaaaaugggcucauuauuuauuuacuuacuuuuucaauaaagaagauaauagauuuuuggugaauuuuugacauuaguuauaaauuucacuauuaaacaacacucgugauggugagaacacaguuuugucauauuuggcuucuuuugguuauuuuucagacuuuauauuugauuuugauuacucaggauuaagagcuuaggagaaauauggagagguaacauguaguaccugaacuucagauuuacauucagucagaaguuauaccaaagugucuucaaugucuuguagcagauaaguagcuaacaauuacugguuaggucuugaaagacuguagacguagcuugcuugugggcugcuggcauggcaugcacgagccccugcuuuuguuccauagcacugcauaaagcucggcaugguguacaugccuguaaacucagcacuaggacaggagaggcaggauggucauguauucagggucauuccuagcuauauagagaguuugggcucaugacacuaggaagagaacugcaaagcccaccaacucuucuugccuagccagucuuuaaauagagggacccacucaccaguucuaccaauugcuuuuucuuuagaaacuaaaaauacagcugaucaugaugagucaccaccucgaacuccaaccggaaaugcaccuucuucugagucugacauagacaucuccagccccaacgugucucaugaugagagcauugccaaggacaugucccugaaggacucaggcagugaucucucucaccgucccaagcgacgucgauuucacgaaagcuacaauuucaacaugaaguguccuacgccgggcugcaacucucuaggugagugugccccagcuucaugaccguuguggccuggggauccuguugugggguugugaacucagagcaaucgugaacaagagcuguucuuggccuauugucuguaaauauuaacagaucugguugcaggaaauguaacagugaugaaccacucacuuuuuucaacauguuuuucccagugaaaaauucccuccuuuccuaagcaggaacaaaacuggaaaacaaguucucucuggaaugccucguccuauggcgggugguuggugcuuauagguacugauagaguauaagauaaugccugauaauggcuucgaggccacugcuguucaggagacaaggaaaacagaguuguuuuuuuuguuuguuuuugguuuuucaagacaggguuucucuguguagcccuggcuguccuggcacucacuuuguagaccaggcuggccucgaacucagaaauccaccugccucugccucccaagugcugggauuaaaggcgugcgccaccacgcccagcaagaacagaguucuuaagaggcuguaaaucaggagaguuugcaugagaccagaccuaaagaugccuuugaauaugaauuuuuuuguuuccuagugcauauaaaacuuuucuuuauacuuauaaaguaugccaguagcauuguguacuuuuuaaagguaaauucuuuuaaaaauguuuuguuaaagaugcuaauguaggagcaguugggaaauuggugccaguagacuuguuaaacagccauagccuugaguuuguaaggcaugcagucucugagagcaggcuuccacagcggugacggcacucucuacucuguguguggucccacccaacaguuuucucuaagaaauggccuccuguugcuuaauaguaaggacauauuuugagagcauguacugggcuggggagauggcucaauggguaagagcacugacgguccagaguucaaaucccagcaaccacaugguggcuuacaaccacucauaaugagaucugacgcccucuucuggugugucugaagacagcuacaguguauuuacauauaauaaauaaauaaaucuuuuuuaaaaaaagagagagcgcauguacaugacaaacagagaugauauagccuucuauacacuugggcuguuggggguguguuuguauaugacagccuauugcuccuacaccccggugagcaaagcaaacugagauaagucaggaacaagagaacagggugcuuuuagagauuugguaaacucaauguaugugacaguugcuuguguaacuuggaugcuacuuuacucugaacuuuauuguuaaauagaaggauuugaaguaauuuugagcagggcgugguggcaagugccauuaauuuucacacuuaggucuauguagaaggaguuggaguucaaggccagucuggacugucuagugagccugucuccauguaaauagaaaaacaaugaaaaauagaacaaaugcccuaaaccaauuaacauggcugcuuauauugucagucauuauugcuguguagaaugguaugugcugcauuuuuauauagucagcauaguagguuuguuuguaucagugugaccacaaauacaugaauugugcuugcacauagcaacugcaacaccacaaaccuaucgcuagggggagcuucagccccgcagacuucuggggcccuuacuugccugcucuccuaguuuuauguuuagagauccacuguuugcugggcauuaggcaagaugugacucuaaguaugugggucucaaaaguuaaaauguuucuuuuuaucuuuuuuuuuuuuugauagguucuugcuauguggcucugacuggccugauagucacuguguaguccaagcuggccucauauucauagaacuaacuaacuuaauuacuuucuuucucucucucucucucucucucucucucucucuuucucuuucucucuuuccgagacagggucucucugugcaguccuggcuguccuggaacucacuuuguagaccaggcuggccuugaacucagaaauucgccugccucugccucccgagugcugggauuaaaggugugcgccaccacugcccggccaguuuucuguauuuguaagguuuacauguguuuauuacguaugugggaugggugcccuuguuacagcaugcguguggaggacacgcuuuuugaauugauucuuuccuucaccuuuuauguggguuguagggaucaagcucauguugccagacuugagguccaggacagccagugcuacauacauaguaagaccagggcgaucauucgauugguagauagauauagauagauagaucgaucaauagauaaauagauagauuggaugaauggauagauagauagguggauacugcuuaaggggcuaagaagccagcucuguggguaaaagugcuagccuuacaagcaagccugauaauggaacccuuauaaguguaucuguaaaguucccacuacccugaaauaggcagagauagacuuauuguuggaagccagcagagccaggagcacugcuacacagcacccgaaacgagagagauccugucucagcaaggugggaggcaaaagaaaaacagaacagaacauguucccuccaucugcagaucuuauacacacacugcacauguagucagauguacauaugggcacaaaaugacguguagaaaggagagcaagaaaggguaaauacuaugugaagaacggaaugcaaguaauggacacuuaagccaugaaagaaguacaaagcuaauuuuccaguuuuaagugugggguuuuuuguuuguuugucugaagauuuguguauauaucugauagugaaaguguaaaacucauugugaagucccacagcuucagguugguuaguuauucuaacuguucagaaauucauuugacaugucugguuaguccugguauggguuuuguuuuguuuugcgugcagauucuuuauaauaaauuuuaauaaauugcaaacaaacaaaaagguagaaggcaagaaucaauuuccaaauguccucuuuagcauacacauauuaguaaugacaauaaaaacaacaguaauacucagaaauaaugacaaugaugauaggaccuguagccgggcggugguagaacaugccuuuaauugcagcacuugggaggcagaggcagacagcugccagcauggucuacagagugaguuccaggacagccaagucuguguagugaaacccugucucaggagggaagggagggagggagggagggagggagggagggagggagggagggaaaaacuuaaaauggacagagauguagcucugugggacagugcuugucuagcauggcucaggccccggguuccauuuccauucgccaauuuuuuuuuaaaggaaagaaaggaaagagggagagaggaaagacuguucuuuaguuagagcaagcuuccugugucaucccugguguuucccuuaggccuuaugcugauggcccuaucuuagaguuugacugcagaaguacagaucuuuaaauauuuauccuucaggcuggagagaaggcucggagauuaagaggacugacugcucuaccagguguuccugaguucaauucccagcaaccacaugguggcucauaaccaucuauaaggggaucugaugcccucuucuuuuuuuuuuaaaagauuuauuuauugauucuauguaaguacacuguagcugucuucagacacuccagaagagggcgucagaucucguuacggaugguugugagccaccaugugguugcugggauuugaacuccggaccuuuggaagagcagucggguacucuugcccacugagccaucucaccagcccugaugcccucuucugacauguggauguauaugcagccgaggauucuuacauuaaauaaaauuaaaaaaaaaaaaaagugugcugagccgggcagaauuggcgcacaccuuuaguuccagugcuugaggcagagcagagucacguggacucuugaguuugaggauagccuggucuauagaucaaguuccaggaugccaaaguuacauagagaaacccuggggggguggggcgcggggcggagaauaggggacuuucgggauagcauuugaaauguaaaugaaguaaauaccuaauaaaaaauuggagggaagagccgggcgugguggcgcacgccuuuaaucccagcacuugggaggcagaggcaggugaauuucugaguucgaggccagccuggucuacagagcgaguuccaggacagccaggacuacacagagaaacccugucucgaaaaaccaaaaaaaaaaaaaaaaaaaaaaaaaaaaaaaaaaaauuggagggaagaaaaaagguauuaucacuaggaaaguuauaugggaaaucucuguuaaaaaaguauagcuuuuccauaagccugaaauuauuugaaauuaaaauuguauuagaaaaauaaguacaaaauaaaccuuucccaaggaaaagaaaaaaagaaaaagaauaaaaaagaaacccugucuucaaaacaaaacaauggggcuggagagauggaucagugguuuagggaacugccugcucuucuagagguccugaguucaauucccagcagccacaugguggcucacaaccaucuguaaugggaucugaugcccucuuuuguauagcgucugaagacagcuacaguauacuuauauaaauaaaauaaaccugaaaacauagcauguugaaucuuguucaaaauuaucaaaauguguuucuauauuauagaaauuuuuuaaugaauuucuuuugauuauuaaaaggaguuaaauguaugauaguuuugcauagugcgaaagaguaguauccuuguuuucaaauuccuaaaguuggauuaacuuaacaaagguuuuuguuuguuuuuugguuuuuggagauagaauuucuuuguguagcccuggcuguccuggaacuugcucuguagaccaggcuggccuuuaucucagaggaugguaucaguauuaaacuccuuuguuagccaggcagaggugucacacaccuuuaaucccagcacucaggaggcagaggccaguuuugucugcauagugaguuccaagccagccagagcuucucaguaggcccugccucaaaacguaaaccugacuacaucucagauugccugcucuggaggaaaauagugcaugaggguacacaucgggaucuucacggcagcuccauuuggaagcauuuguuuaauaaaaugaaaugguaaagccagacuugucaaaaucucacuuccuaggugugcauguucuuccuggaaauuaaguuuucccuccuuuaacaggacaucuuacaggaaagcacgagagacauuucuccaucucaggaugcccgcuguaucauaaccucucagcugacgaaugcaagguaacgugugcuccuucauucaggguguauucaagugcuugcgacgugacccgcacuuugcuaagcacucuggguacagcguugagccuggggaacaaggucuguucuuacaugucaguggaggaagcaauggaaagaaggguuugguuugguuugguuuuuuuaacuccacgaacaaauaaaaggauuguacuauguagugaguguuggggaaggaguuaauagggagauuuaucuuuagaguaucgggauuuucuccacugccgcauucauuuccuugguaacugaagucauauccugccagggcgcauccuuucagaaugugcguagauaguugagccuaccgcuccaccucaggcuuucuuaacaaauccgugaaguuguuuugcuuuuucauaauuuucugaugucccucuuguuuguuucugcauauccuguuccucuugauuucugucagucacaccuguucuuggcuaguucuuuuaauuuuccuaaauaaccuucgggacuuggaugauguguuugagacuagagccucgggucuucuuuugugcauuccuguguagguuacugcucccaaggauggaaccacagguaauuauggggaagcaagaauugcaaauaguaauuaaguagacucagggagucuuuggacaaguuuuccaaacuaaaugcuuugacugcaccaaaguguuacuugcuuuuuuuguuguucuuuugcucacacacaaggccugggucacagguuuuaugcuuguaugagcaagucucauuuggaaaagaauucaauuuccuguucuccuugcuacaggaacuuguucuaauauacaaggucucugggcggggcugggagacuauuucuucacacguuuaaauuuucaccaaauaaaacgugaaaugcuuacauguauuuuucugccaaagacccugcuuuuugucuucauuccaggucuuuguguaugagacagcuugccuucugugucagcucuuccuguugucuuuuuacugucuuaggcuggaugagugcaagcaugacuguguuagcaccugauucagacgcugaccaaacacuuggacuucuuccccugaaaaauaacugucacgguuauugugacagugguuucagaaugcuccucuaccgcuugucucuaaacaucugauagugcuucgcuuugcaucagucuucuugaaucauggccugaaguaaugucuauaccuuaaguaccuuaagcaguuugagaaauuucagaccaggggaaaaaaauugcgaauaaagaaggcauuucuguuauaaaguuuuacuucugcccuguauggggaagugagacuggugucagccgugcuuuacuacugggccaugugcuugcaggaaagcacuagagaugagagccugagacaagcuagcugccucccuagccucaggaaguucuucaguucuaaacuuccugcgugugaaugaucgcucucauauuucccaguaaaccuuucaauugucuuucauuuuuuuguggaugcaggcaacuuuuuguggauagcaaaggauucagugacuaagauaaaaaucaaaagauaaaagacacuugcaaccaaggaguuuacauucccaugggaaaccuguauauuaauauccauuuauguugugauagacaccaugaaaaaccaauagagaaagagagggacugugcucaaagggaggcuaacauacugcuuuugcuagaggaggucaagaaagccauaugagauugacauaggauuuagauguuuacggugucauaguagcaggggauaaagaaucgaguggggagagcuaaaggagacagaauaguaagugccguggccgugagcuggggaugacaggguuugaagguagacuguaugauuggagcaccaugggaaaugaaggcggaggauugagaucauaaaggaucaaaauguucagcacaggacuauguuuuguuccgauggcaguuggaagcauuuagagggugcaggcagaagaagaaugugucugaagcaacaacuacuuaacuuguagagaacaacugcaggagaaagagaugacacccaauaggugcauuggaaacaugcuuagaaguucuugcuguaaaugauagcuuagaccaguguguuauugguaaaaugucgaagauaagauuaaauucgggauauguucugaaggagaggaagcuacuaggagauaggagaaaaagaaaugaaagauuccaaguuuuugaaugcucaccuguugagauaguaguggagagauguugaguguagcagacgugggagaucuauugguuauuccacuugagccugcucagugaugcaacccaggaggcugauagaugcagggugucaguucccagaaggggaagugacacugaggagagcagugugcuuucucugcggucuugugucugcaguuauauuuccauguagacuuggagucagguuucccucaucccccuucccuuucccagcccucuaggcagggucucgucucccugugcugcgugggcuggucuugaacucuucagcugccuuagccuguauacuacuaaugaggacuacaggcagaugucacugugcccauccugagcccagcguuuuccugaugucuucuucauacuuccuuuccuuacucuuuguguuucuucaguuuccugucagcauaguagaauuccaggccagagucaacauucuuagcaaaagucucagcuuuacaacauuagcugugaucauuucaguucuuugauauuuaguggccaagauagcacuguguggggcuugccucaucuuuuucuaauagagauaagauagcaaugaccaauagcaagaacacuuuuacauucaaaguauagugcaacuacaggggauuaucaaaaauucuuuugcuuuaaguaaauguagucuuagaagcagguggauuuauugacauuguugaugguugcaggugagagcacagagccgggauaagcagauagaagaaaggaugcugucccacaggcaagaugacaacaacaggcaugcaaccaggcaccagguaugggccuugugacagcucuggccagccaguuugagauuugccuugugaaucuccuuugucccauaacugucuucauaggcaaguccaugccuuugguuuccaggacaaaucaaaaucacuggucuuccagacaucaacuugaaaucauguuuggguuuucaacuuguaauuuuucauacagcagacauuuccaucucauaaauagaggaauuaagcuauuugugauaauaauagcaguaguaagcaauaguauaaaauauuuugguuauuuugaaagguuccauugcgcuucuguuuccucauuuggcauccuuauucuaaccugcuguuguuggcuuucaagcaccuuugacuuugcuggcuuauuuuuaguaucaucaguugcauuuccucaguauuugacacuugucagcugggccaguuucuacuucugucuuucugugauuugcagaaagcauccuugcuuuguccuaaucauccuuucugaacuuucagccugcauagauugcacuuaacuccuugcuucuuucuaaauggcuuugaucuuucugagaacucuauaucauuaccaagaagagauuacauacauauccuucaaggccuugagcgagucuuaagcucuuacagguauucuuccaagaccuucucccacaguuaguaaaucuucuguauguauucuucucauguaguuuuccccagacgucggccuuuagucauagcucaucaucaagguaucuguuucuacaguuagauuauaggugacuagcagaggagacacagugguaagcuugccuugagagcugaaucugaaucuauuagcuguguuguccuggggcagccagcugguaaacuacauuucuuuguucuaugaaggaguggagaaugcccaccuguccggguaguuaucuaacgcauauguaauaaaugcauagccucagugcuugacaggcaaaagcaguguguaauugaugcuuuuuuguuuguuuguuuguuuguuuguuuuuggagacaggguuucucuguguagcccuggcuauccuggaacucacucuguagaccagagauccaccugccucugccucccgaguauugggauuaaagucauaugccaccaccacccaccaauuuuuguuuuuuaaugggaaucuuguuauacagcccuuaaaggucuggccugggauuuauagccauucuucugcuucuguugggauuauaaacaagagucacaaugcuccucccuccuccauuaugacuuuugcucuuucauauugauaaaaauaaguucacauuccugaaagggcaguaagaacuguuuuggauauguggcugcacuguuucuguacuguuacgcucaguaugguagccaugcuuauaauucuaucauucuagaaacugagaaaggaggauugucagccagggcuauauagagaagacccguucucuuucucuguaucuuuuaaaaaagacauggcaguuuggauucguaaucucaacacuugggagguagaagcaaggucagaaguuccagguuugaggccagcuuggguuauaggagagcaugucuuuuuuaaaaaaaguuuaaacaauugguauuuugaaaggugaugaguuuucuagcuagaugcucaguuguguuuuucuuucaggcaccaacagagagacagcugcgguauaaggaaaagguggcugaacucaggaagaaaagaaauucuggacugagcaaagagcagaaggagaaauacaugguaaggaaaaauccaagacugaacucccccugacugugacucagaucugagcuucugcugucagaucauagcuguuuacucaggagagcauccagugaacuguggggcucucuucagucgccuagcacccucccacagcugaaguagacuuccguccgcuaggucuagggaugcagcgcaguugguaggaucccuucacuaucauuuuaaauaauuacuuuaagggggccugauggugcugcucuguaaucucugcuacucugaaggcuaaggcgagaggaugaugagauccaggccuaccagacuaccaagcguuguccaggucagccucggcaacuuagcaggacccuguuuccaaaugaaaacuaaacucccagucauaugcaucaguaguagcaugugcaaaggggcuagggucaaucugcaguacuggggcagggagacagauuugcucuuagaacaaauacgaugacauuagaaauggcuucuuaagacauucaggggcucaggauauagaugaacauccgagaacuaacuuugaauauaauauacauuucacaauaauaaggaaaaguuaggaauagaauacagaagauaaaauuaaucugccuuaaaauagccaaaauuagaauuuuaucaaguuuuuagcuguuuauuuuaacuacguaaguuaccuuuuugggaagguggagagauggcucagaaguuaagaauucuggcugcuuuucuugaggacccagguucaauacccagcauccaccuggcagcucacaacugucuuuaacgccaguuccaagggucugacacacauagauauacauucagacaaaacaccagugcacaucuuuuuuuuuuuuuaagaaucaucauuugucauuuucuucacuauaccacaucaccuauuugucugucuucccauuuaaagaucuugaauuacuguccuuauauuaaaauccucaaaccuuuuaugcauaaaauacagcuuuuuauguaaauaauuacuuuuacuagaaguguauuaguacauguuuucuacugaaauguagccagacaugguggucugugccuggaggccacccugggcagcauugcaaagcccuguuucaaaaacaaaacagaaaaaguaaagucagaaguggugacucacaccugcaggccaggaguuuaaggccagcuugagccacaaaguaagaaaccuaagccaucuggacuacagaauuagacccugucaugaaaaaaaaaggacuuuuuuuuuuuuuuuucugagacaggguuucucuguguagcccuggcuguccuggaacucacucuguagaccaggcuggccucgaacacagaaauccgccugccucugccucccaagugcugagauuaaaggcgugcaccaccacugcccggcuauuugagucuuugcuaauuuaaaaagcgcuagauagaaauuuuucuuguugcuuacauuuugccuuuuuuuuuuuuaagauuuauuuauuauuauauguaaguacacuguaguuguccucagacacaccagaagagggcaucagaucccacuacggaugguugugagccaccaugugguugcugggauuugaacucaggaccuucagaagagcaguuagugcucuuaaccacugagccagcucuccagcccacauuuugccuuuugaaauagggucucauauggcagcggcuggccuugagcuugcuaauauauggcuagggcuguccuuaagcugauucuacaccccuaaguguuggaauuucaggggugugacaccagcccuggcuaguuggguuugguuuugggucugaagaaaugauugcauugguugaguguuugccucugugcaggauguguuuguugaguuugauuguccagcgccgcgguuucaggccugccucuaaucccagcacuggcaaguggaggcagagcuacaggagauccuuucucaaaguuggaggaaggggaaggugcauugugauuuucaaacccagaaguagucaagaauaccuagaaccuaaaccuuaagucacagagacuaaauuucaaaaagagcuacaacagauugaaccaugucagccauaagaaaugcuuauagggccgggcgugguggcgcacgccuuuaaucccugcacuugggauguagaggcaguuggauuucuguguucgaggccagccuggucuacaaagugaguuccaggacagccagggcuacagagaaacccuguuucgaaaaaccaaaaaaaaaaaaaaaaaaaguuuauaggguggguguuuucuuuagaugcugacguguguguuagaguauagaauguucuuccugagacaagucuucuaugccuaacaacucccuccucuucuuccuccuccuuguccuccucuuccuccucccuccuucuccuucccugggaaaggagacuuaguaaccagcuugguaagguuugaaaguuaauuuaaaacugaauuccuuuuauguccuuaauuauuuuuaauuuucccugauguuucacaguugguaaacaucccaggagcugcucucccugugcacuugacuugacuuuacaaguugggcagucagugaaguaaugucaggagcaguuuccaggggcccacuuccagaguuuucuuccaggcagcaucuucaagcacuaaugcuucgaguaccugcuuuuuugucagugucguccgugaagaagacccucaugccacauccagagcaaccaggauuaggcacaaacccacccagauaccuguuuucacagagauaucuuuuauuagucggggaauaaacguuaaagugacugcuuucuaacucagcagaagucuaggcagguguaauuuuaagagaacaagguggggcuguguuagaaugggcuaggaugcaguauauuuugacugggcgucaaaauuggguaaaucaaaggggucauaauuaggugaaccaaagggggcuuuugauugcuggacuuacaguacauugauagccagacuuugguagucagccucaggaggaagaaguggccaaauuagggaauagaccuugguagcuagcuuuagaaauguaaucuaaugguuuuuagcaaggcggagggaaugggggagaaggacaaggccugccagagccaugcuugccccacucgagcuggccagcucgaggauucuaggaucuauugugccacauggggguuaccaguuugccugagcucagucccccaaacccagugauagauacuuuguaaguagcaagcaucugguucagcuuggcuuccauuggaauggaauaaaccaaguuccacacagacaguauaaccccugguuguuuuuuucuaggaacacagacagaccuaugggaacacucgggagccucucuuggaaaaccugacaagugaauaugacuuagaucuuuuccgaagagcacaagcccgggcuucugaggauuuggugaguaucaaaacccccgaggugaggggaguacccuugugaaaaaccuuuagaacugccaaggaaagugauuagcaaccagucugaugacaucucuggcugacuuuagagguagucuucucuuuuacacggagagcacaccacucucuucucacccuuccccucucuguuucccucaacuggaagauccaguuuggcuugagguugggguggaggugcuuaaauuaaaacuuaguuuguggugccuuuuauuucuguuggguaaacuguacaaucugagaacccuaacuugggggcuucagcacugcccucuuuguaggguuucuuuuccauuucaauacauucacccuaaaagcauguaaaugauagcaaagaaaaauggugaagaccacaaccagauauguuguugaauuuauugauuuuugacaagagacucuccucuuauugcccaagcaaguuugagacugggaucaugggugcaugagaucuaggcagaaacgcucuucuuuguuugauuuuuuuuuguuuguuuguuuuguuuuuuguuuuuuugagacaggguuucucuguguagcccuggcuguccuggaacucacucuguagaccaggcuggccucgaacucagaaguccgccugccucugccucacaagugcugggauuaaaggcaugcacuaccacaccugucuuauuugauuuugauacaguuccuguggccuagaaaaacaguucuagcaacugauuucaccuaugauaagacaaaugugcucagggaaauuuaguuuguaguguuaauuucauuuccuccucuccuuuuuuuuuuuuuuuuuaaagauuuauuuauuuauuauauguaaguacacuguaguugucuucagacacaccaguagagggcaccagaucucauuacgggugguugugagccaccaugugguugcugggauuugaacuucagaccuucggaagagcagucgggugcccuuacccacugagccaucucaccagccccuccuuuuuuuuuuuuaauugauuuauuuuuacuuacucacuuuacaucccacugcucccucucauuauccuuuccccuucuuccuuuuauuauauggguugcaggaggcaggguuuggcugcucugggcuggaauauuuauugguugccaccuccugcuuuucuuuccaucaagaagaugauugccucggcuggccccaguccucucgccagcuggguacugcagugauugccugucgugcacguguaaucccagcccuagugagcucagggaggagggccaggagggcagccaucaacagcccagagugcaagccugaagagccacaccacagaaaucugcuguguuggcucauaccugugaccacagugucuggaaaugaaggcagagaauucaggaguucaaggucauccucaguacauccucauuugagguucaguuaagaaaagauaccugggcaggagcuggagagauggcucagugguuaagagcacugguuguucuuccagagguccugaguucaauucccagcuaccacaugguagcucauaaccaucuguaaugggaucugaugcccucuucuggugugucugaggacagcuacagugugcuuauaaauaaacauauaaaaugaauagauaaaucuuuaaaagauaccugggcaguacagcuggcaaauuuucugugaaccugccugauuuuccaugcucaaguaauaccuuaguagccauguauggauagaggccaaaucuagcuaaguauuuuuauagcuuaguugcuggccucauaguuuuuaagaauaaagguaauaagggcugaagauagcucagcaguuaaaagcauuugcuguuuuugcaaagaaacuacauucaguucccagaacccaugugguaccuauaacuucaguuuugggacaucugauguccucuucugaccucugcaggcacuaggcaugcaugugagcuauagacacaugcaugcuugcacccaugcuuauacacaaacaaaacauccauguauaucauauagauaaaaaucuaauuauaaaaccaaagauaaagucuucuaauccuuauuuguuuugguuucuuuuugccaacaggagaaguuaaggcuucaaggccaaaucacagagggaagcaacaugauuaaaacaauugcuuuuggccgcuaugaacuggacacuugguaccacucucccuauccugaggaauaugcgaggcugggacgucucuacaugugugaauucugcuuaaaguacaugaagagccagacaauccuccgccgacacaugguaugucugcuugaguucagcucaccagggugauguuacacaguuucccaguuauguucuagaggcaauguaaacguccaaaagaucucccaaguguccacagcagucggguggagacuuaaggaacugaaagucacauuucuggguuaacccucugccagagucagggcuccauagcauccuaacuauauccuguccgagaacgucuuuuuuuuuucuucuucuucuucuucuucuucuuguuuuuuugucuucuguuucuucuucaacauaugaauuaccucucccuaaaguuuguguuuguaccaaacucaaugagaagacauuuuauuacauaggucagggaguggcuuauauauaagauggugggugucugucuugaaugaaugcauguuguauaggauauccaccuuuaauggaugaugaagauaacaguuugccccuuuuuaacauccuguauauuaaaauaggaaaagaugugcauacccgagucuggugacuucuaugaguauagaauucaaguuuggggaugcaagcuucuccuccccauugcuucagggguaaccacugaaauggcuucuuuggcuuggcuaauguuuuaaacaaacagcuguugcauuaguuugguuaucauggacagaaccagcaggaauaaugggagaagauaggaaggguaaugcuaauugggcuaagauaaaggauuaaaauggcuuuuccaaggacaauagcuccucccaggauggaacuuugaagcaauuccaguuaauucauguuuuuaauuagaacaugacaucaugccuugcaugcuguuccccgccucccccaggccccccccaacucccagcuaagcagggaacacucccuaauacuugcuggguaagaauuaaaccacugagcuauaauccuaaacuugaaauagaauucuuagaggguggguaugugauuuuuguuuguuucaaauagguaguuguuuucuuaccucucuugaguggucacguguccaauguggaaccagccacuauguccagugaaacuuuauguuugaguugucaacaagauguaguaaaugauuuaauaagaaauuuccugggcuggagagaugacucagugauuaagagcacugacugcucuuccaaaggucuugaguucaguucccagcaaccacaugguggcucacaaccauggcaaugugaucugaugcccucuucuggugugucugaagacagcuacaguguacucauauacauuaaauaaauaaauaaauaaaucuuuuuuaaagacagaaauuuucuguauaugucaauguaaacuuuguguauguaugugugugaauguuugugcauguaugcacaugcacaacauagcacacgugugaagaugagagaacauucuggaagucaaucaauucucuucuccuauggaggcucccagaauucaauuugagucaucaggcuuggcagcaaacaccuguaccugcugcgacuucucgauuucagggccagggcuuaauucaguggcagagaacuuggacugcugccuaagaugcugggcacaucuuagcaccgugaauuaaacauuuugagaauaaagaaaagaguuuggagccaggccuccuuccuuuuaaaaggagccauagaaggauuuucucuguaucugacauauggagggaggugggcagacagugaguggcucauggcgaucauggugaucccaugaugacgguaggauggcaauaggaagugauuggcgaaggugagcacaacacacuuagcaacacuaagcugcuuaagaacuuccuguuggcaugugguguuuuauuguaagaaaggauauucuuauuuaucuagcuuuuacguaguaugugauuuaauaucuugggcugagauaaugccaaaaauaauccagaaaacuugagccaaacagccauauauauccuuagauauaugcaaccgcuuaagaaagcuuuaacuuuucugaaaacaauugauuucacuguccucaaauguauucagcuguccauuaacucagccacauuucccaaugaagaaacaggguggaaggaaaaucuuacugcuucaugugaacuccauucucuuguaggccaaguguguguggaaacaccccccuggugaugagauuuaucgcaaaggcuccaucucuguguuugaaguagacggcaagaagaacaagguaaagaguggugacuccagagaaagagaugcaucgaugggguccuaaaggaaugauuaucuucacaaacaguugugagggagauaggaauuaguucuauuuccuggauaguauuggugugaucauucuuucuagacuuugguuugggugaguuuggaagucacuggccuccauacaaacucucuuucugcuuccagaucuacugccaaaaccucugccuuuuggcaaagcuuuuucuggaccauaagacgcuauacuaugauguagaaccuuuccuguucuacguuaugacagaagcggacaauacuggcugucaucugauuggauauuuuucuaaggugagcaggaucuggugauuuagaagcuuaacaaccacagcagcauuguggguauuggcguuagagggcucagaucucugaugaggaagccgaggacagugauagccuucgcauaagcaaaguaagaaaggcaaacuuguaucauaggcagcuuccugacaguauucaguucaggaucuucucuguuaucuaggcugaccuggaguccucugcagccuagacuggcaccaaacccagggcagucuuccugccuuaaccuccaaaguccugggauuacagccaugagcuguacuagcugauacuguuacuagaagguucuggcuucugugcuuguggguugaagcuauuacuuacuggcguggaccuuucuaugaacuuaaaauacaucuuauagucaagccaguacuuguggcuuugccuuccuccauguuaguuuaaaaccaugaacauauucugguugcuuguucuccagcuggguucauucugucacagcuagucccuuuguuuuaaaagacgcaagaccaaaucuagcuuaagguuuucuuucauucuguugagguagggucucccaguuaguucuggcuggccuaaaacuuaaagagauccacuugcuuuuaccuccuugguguugggauuaaaaggccaccacagcuauaguuaugagcuuuaaauguaaugugacaacuuaauuaaaacaaaauacaauguaccauauaguucaucacuuuagcucuccaggcaagggcuucuuccaguguauugacagagugugugacuagugcauuccucacuguucuuaaaaagaaacauugguagucgguuccuguuuccucuugacccugccuaugaauuggcuuauucuggauauuuuauagucagauaaugugauuugguuguauuuugaucuuccaggggaauucaguuugguuuuuuuugguuuuuuguuuguuuuuuuuuuuuuuuuaauaauaggcaggccguaccucuuuaucugcuguucuguucuugauuuuuaggagaagaauucauuucucaacuauaaugucucgugcauccucaccaugccucaguacaugcgacagggcuacgggaagaugcugaucgauuucaguaagugguguugccgagcaucggcuccucgggcccuggcccugaggguugggguugcucacuuguguccucugcucuuaacaguuccuaacauguaaucacagguaguuagugaaugaacaaaguggggaaaugagucgcuagggaauuaguaggagaugcagggaacaauacagccgugcuggauuaucccgccugagacugagguagagcagaugcaugccuguggcuuaaauaaagccuggcuuugaugcuuggggucuuauguaagcacuuguggagguaacccagguaccugguuaaggcuuugguguuauagucauucuucauuacucauggguaucgauuugaauuugucuacccucugauguguaacucucagguucauugggugagggugguucuuaguacauuuguuuguuaguuugauggguacgcguggaggucagagggcaacaugcaggaguguucucuguguggguccugggcuuuaacuaaaaucuucagcuugauggcaagaaccuuaaaccauugguuuucaaccuaugggucgcaaccuauggggggucacaugucagacagacauccagcauauccauuaugauucauaauaguggcaaaaauuacuguuacaaaguagcaaaaaagaaaacauaauuuuacggauggaggucgccacaacuugaggauuaaaggguuacagcauuaggaagguugagaaucauugccuuaaacuguugauuuaaaaugauuauaagcauugugcuaauaaguucgaugcagacacgaauuacaaugcugugggcugucagacaguaucuuugaaucaacagaaauacagaaaagcacauuacacauagaagaguuggugacacucuggacaggcuguuaagaagcaagccucacuccugugagcagugguucaguguucaaugcuaagucagcauuuccaguggcucuagagcaaaaccacugugacgaacaagaauuagcugugcccuagucagcagccacugucauugaauuuuagucaaaguaagaauggagaaaugguucagcagcuaagagcacugacucuucuuucugagguccugaguucaauucccagcaaccacaugguggcucacaaccaucuguaauggaucugaugcccucuucuggugggccugaagacagcuacaguguacucauauacauaaaaaaaauaaauaaagaagaauggagguuuggcuggagagauggcucagugguuaagagcacuugcugaucuuagcagaggaccuaaguuccgauuuccaacauguacauggcagcucacaaccaguuuuaucuucaguuucaggggaucugaugcccucuucugucuggguucuacacauagugcacuuacauaaauccauacauacagacagacacucauacacauaaaaugcaaauguuuuuaagucuuuucuuaagaauauguauagugugcauguaucuguaugcuugcaugugaugggcagaaguuaaugucuuccuccauuucugauuuguuuauugacaucaucucucgauaaacugagaacucgccugcuuuggcugcaugucccagagaucccucuaugcuucugaaaggcagccaccaugccugaccuauuuuuaugaggguccuggggauccaaacugguucucaugcuuacauggaaaguacuuucucugcugagccaucucccuagccccaaaguaagaauuuuuaaagccacucauggagguucacacauagaauucuagcacuucuaucccuauagaggauugccacaccuucauggcaagccuggguuaacuuuaggaaaagaaaagguugugguauuguaugauaaaggacuuccacuucugaucuuaacaagcauguccagagaaccaggacuguuaaagcuccuagugacagcuuccaggcuuguuucuaggugccuguucuaaggcucuuagauacacuguagcaggcauuccuccacuccuguuuauacaaagccagugucuuaggguuuuacugcugugaacagacaccauggccaaggcaagucuuauaaagaacaacauuucauuagggcuggcuuacagguucagagguucacucauuaucaucagagugggaaccuggcagcaucuagugagacauagugcaggcagugcugagaguucuacaucuucaucugaaggcugcuagcacuaggguauuaaagccugcacccacagugacauaucuacucuaacaaggccacaccuccuaauagugccacucccugaccuaaacauauagaaaccaucauagccaguuguccucagcagccacacaaaacuugcucuuuugaauggcuggcucucugguacucuaaagcggguauccuucuuaagucuucuguguuugcauacugguuuuugcuauuauggugaggcuuaguguugcuugaaaagucuagcuggauuucccaacacuagggaggcagaauugguggggacauuuucacugcaggcucuuuaugcugcuuuagaggucagcuggcacuacauagugacccccucucagcagagcacccuugccuaagcacgguggggagguaggucaguggauaaauccaggauaaggaccuaauugcaauuuccagaacccauguuguagaaagaacugauuccuccaagugguguuugcacacaaaauaaguaaauaggauuuuuaaggcccccuccccaaauacaaacaacaaaaucuagaucuguguuuuuucuugguagguuauuuacuuuccaaaguagaagagaaagucggcucuccagagcgcccacugucagaccuggggcucauaagcuaccgcagcuacuggaaggagguacugcuccgauaccugcacaacuuccagggcaaggagaucuccaucaaagguagguugugcuccacgacaguggcacccauucuguuuaaugugacugugacuggggagcauuguggagacugucccugcugagcugaagaucccagaacauuagguccugggaaugguucuaaaguguuuucuccugucuggaguuguuagcacuuaauucauauaaaaucgaaaaggaagaccuggagagauggcucagugguucuuccagaggaacuggauucaauucauugcaccccuauuguggcccacaacauauagaucuccaguuccaggcacacauagguucauagacagacauccaggcaaaacugugggcggugcuccccacaguuaccuucccuuagaggaccuaacuacaagcuccuagccaccuuccagcugauacaagguccacauaaaauacacacaugcauacauacacaugcauacauacacaagcauauauaucauuuguuuguuuguuuuuucaagucaggguuccucuuuguaccccuggcuguccuggaguucacuguguagaccaggcuggccucaaacccacagagcucugcccaccucugccuccuaagcacugggauuaaagaugugugccacuauguccagcuccucauuucuuuugaaaaucaggaagaaagaguucauuuaguauuuugaaacaugugaauuuuaggaaagacaucuucccuuuagggcaaauuuagggguuucauauuugaccuuuucuaaggggucaagaguagcuucuuaccacuaaauuggauuuuuguaguuacuugaacuggugagacaugugaacagguuggcccaaguaacacagauuugggcucuggaaaacuguacauuaagggggccuugggagacaugggguaugggagucugcucccacugggaucucaguggcuccucuguuacagaaauuagccaggaaacagcugugaaucccguggacauugucagcacucugcaagcccuucagaugcucaaguauuggaaaggcaagcaccuaguuuuaaagagacaggugagauuuuccucagcugccugugguguccuuaacguauaggagagcucagugggcggcgcuccccacaguuaccuucccuuagagggccuaacugcaagcuccuagccaccuuccagcuggcacaagguccacacggucuuuguuccuaagcuuaucucccugcuuguccauaucagagcuugugguaagcucugucagaucaggaugaaacaagcuaagccgcuuuauguggcauuacacuuccacccaucucggggaguccucauaaguccuaggacugcuguuuugugaaauggcaccucagcuuagguccauuuugaauuuuuuuuuuaguuaccuacacaucauaagcauaaaugaauaaugauuucaguucucauugaagacagaauaggaauauaaagaggaaacuuugcaaaucuaaaaauaauaacaucuuguacuuuaaguauguuauuaggacuuaggugaaucuguugcuagucauuuuggaaucuuuuuuaaagcguauugguugcauguguauaaugguugcuuccuuauucuucacaggaccugauagaugaguggauagccaaagaggccaaaagguccaacuccaacaaaaccauggauccaagcugcuuaaaauggaccccucccaagggcacuuaaagugaccuaucauuccgagccagcgagccccagcaguaggaauccguacccuagggaucugucugucauuucuguugcucuugugauuggcaaguacaguauccuuugggaaggccacccccucagcacuguucuggcuccagccuucguguacacugcagacacuaguucugaggaacuguuguuucggccucagugagguugccuggacggaucuguaugaggcucgaguacagaucccucauagcacugacccaaggaguuguguuaugguacuguaccuguccagucacugguucccaccucaugcuuuuuaacuccgagguuuguuguguccugaccuuugugcuagugcuuuuuccugccuggauagcagaccuccaaacaugguugccaccaaagggcccuuuccaguuacuucuaacacauucuucaugaaggggugggcaagaggcagcgccugugcgugucugcugggaggguccgcucaccauggguuucaucucgcagucacucauuuuucucccuuuuugucaaaagacuuacuaccuuugaucaggaucaggcugcccagagcuaggaacgccuggcauuucccagggguucacaggccugguccaucugcgugagauggugaagccuaagagguggucccaugcuuuccuuuguauuuacuuguggacacuggggcagcauuguguagaaggaaaugaggaauucuuugccacagcagaaaaugcccccacuuuuuuuucugcccccuuuuauguugguaguugccaaaauauuuuaacagucuuuuuucauacauuaaaugaccacccuguggaucuuuccacaccugccucugccagucugguguagggcagcucuacuuuccacacaaguugcacugaucuuguccagagcuuccugggagaaguggaaacugguugaaaugcuuguguuucucagcccaugacucagcaagacaggguggccacucugcuacgguuugcuucgcucucaacagugccucccucccccagcagacugaagugcuucugucuaagaacuaaguccauucccuuucgggacuugccaccaucauccuguucucuggguuccuauuuuuggugguguuaagugaaggaagaaguguucccucuaauuucucccugucccaguauauaaccugcuaucuuggggcagcuuuugaugucugacaugucacccuucccaaguuggucucuuccaacacugcugucuucacguggcacccucuuaccacaacccuaacucuggucauuugugccuuucucuugucaucucuguacacuacuaauauucacuguggguuggggagcugauuuuaagcauguucaguggcuccccuccaguuucaguguaacuguuaaaauguauccaaaagccacuucacuggggguuuucuuaagggguaaaggccuuuuacagaugcugagcccuccccacauguggcagaaugugcucuucuguaucuacucaauaaagcauguucucugcucaugucu

SEQ ID NO: 6302 - RNA, 1301 nt, Mus musculus
ugagaugcauuguuuuaauaguaucuuaaauacugcuuuuucuuuuuuccgaaaauguguucacauauacauagcauauaauuuucacagcuugccaguauucucuuuggggaccaucuggucuuugacuuguaggucagagagcaacugagcuggaaagacaaagauuuccuaguggagucacuaucaaacuugaucagauuuaucauuuacuuuguuuugcuagguacacuuacaauggaugguucugaagggaaauucccagcucccuuuuaaaggcucaaguuaauuuacagacuaacagcuguuuuuauugagauuggaccagcuucaggaagggacuuggaaacguagaagacaaaugagugucaugugaggcgagguagccauuaaauguacgaauuuaaugcaaagcucaugcaaaugauaggcaaaccuucuauaaauuuaucgaaucucaguuuggaguuugucagcugcagugaaaucucaugagaauugaaaacuaauguuuuuuaguuaaacuaaauguaauggcuuuugaaguuaggcauucucagucccauugaaacugcuuagaguuugacacuaccaccuuuaaagauuucaguaguguuugauuccaguccacauccagccccgcccccugcacagccugacaucacauggcauauauuugcauacuaccugggacugggugugacgauccuccccuuugaaccuucucauuggcagugcugaagaaccagcccucuacuggaagguccaaucggcagccuuaaggacauuaaaaaaaaaaaaaaaaaagaaaagaagaaaaucaggagggugggggucuugacuugauggcugagcacauggaccaaucauccucggaaacagaagagccccgccauggauugguugagggggagguccugggacucuguaggccaauuagaacucugggccgagggggccgguccgcgcccguagggcagauaaguagcggccgcggggguugggggcaguguggggcucgccgugggggugaggcggcagguagccgggugggccauguccggggccgcagcgggcggccgaggcggagguuccugggggccggggcgcggaggggcggggggucuccggcggggcugcucuccaccggcgcccgcuggcuccccccgggucggucugcagccacucagggcuacgguccccuuccagcugcagcagccucaccagcgccgggacggggguggccgcgcaggugagccggguccggagcgggugcuggggcgacgggcuggagaguacua

SEQ ID NO: 6303 - RNA, 1301 nt, Mus musculus
uaguacucuccagcccgucgccccagcacccgcuccggacccggcucaccugcgcggccacccccgucccggcgcuggugaggcugcugcagcuggaaggggaccguagcccugaguggcugcagaccgacccggggggagccagcgggcgccgguggagagcagccccgccggagaccccccgccccuccgcgccccggcccccaggaaccuccgccucggccgcccgcugcggccccggacauggcccacccggcuaccugccgccucacccccacggcgagccccacacugcccccaacccccgcggccgcuacuuaucugcccuacgggcgcggaccggcccccucggcccagaguucuaauuggccuacagagucccaggaccucccccucaaccaauccauggcggggcucuucuguuuccgaggaugauugguccaugugcucagccaucaagucaagacccccacccuccugauuuucuucuuuucuuuuuuuuuuuuuuuuuuaauguccuuaaggcugccgauuggaccuuccaguagagggcugguucuucagcacugccaaugagaagguucaaaggggaggaucgucacacccagucccagguaguaugcaaauauaugccaugugaugucaggcugugcagggggcggggcuggauguggacuggaaucaaacacuacugaaaucuuuaaaggugguagugucaaacucuaagcaguuucaaugggacugagaaugccuaacuucaaaagccauuacauuuaguuuaacuaaaaaacauuaguuuucaauucucaugagauuucacugcagcugacaaacuccaaacugagauucgauaaauuuauagaagguuugccuaucauuugcaugagcuuugcauuaaauucguacauuuaauggcuaccucgccucacaugacacucauuugucuucuacguuuccaagucccuuccugaagcugguccaaucucaauaaaaacagcuguuagucuguaaauuaacuugagccuuuaaaagggagcugggaauuucccuucagaaccauccauuguaaguguaccuagcaaaacaaaguaaaugauaaaucugaucaaguuugauagugacuccacuaggaaaucuuugucuuuccagcucaguugcucucugaccuacaagucaaagaccagaugguccccaaagagaauacuggcaagcugugaaaauuauaugcuauguauaugugaacacauuuucggaaaaaagaaaaagcaguauuuaagauacuauuaaaacaaugcaucuca

SEQ ID NO: 6304 - RNA, 7126 nt, Mus musculus
cccaccgagcuccagcuuguagauguccucggcguugccugaucggaaaaaccuaaaagaggagacaauaaccucgauauggcuggcuuuccuggccaccaggaauggagccaagaucuuaaagccuuccuucuuuccuagaacgcuccugccggggcaggaggcauuucccucucggaagcucugagcuggcauaucuggagguagcugcuccggccuacgagccggcggucgcacgcagcuccuaugaggucccugccgccggccggcgauguccgccuggagcuuucgccuucgccgccgguaccgcuaccugcucugaacggaucuucggccgacucguccgugcgucucauggccgcuaguagaucccuggugccugaucggcugcgccugccgcucugcuucuugggugucuuugucugcuauuucuacuaugggauccugcaggagaagaugugagcagacccuugagggggcaggacuccuagcaucccccagccagggccggaauucagucuccaccauccauuuuacggucuagucuucaggcuuccugugucugguacaggguuuucucuucuccggcucggcccucugaccuuuuuuugcacccugcuauuauacauugcuagcugagcauccuuguaauucuaaaauuucagggccggccucuggaguuuuagaacgcgauuuuuuuuuucccuuuagauauuuuuacuuuuguugauuccaagagugcuccgugaccugagccaggucuuauuuuauuuuauuuuuagaaagccccgagguguuugcagaccguuaaucuucuugcucugggucuugccuuuuuuuuuuuuuuuucuccuacgggggauacuuuuguucagcugucuugacuuuuuuuuuuucuccuaccuguguccuuuacggauauuuuuuccuuaggcuaugguagcaguagguuggcgucuacuguuuagacuuaguuuuuaggcuuaaaucaaaucgucuccuuuggguaaaugagcucaguaauccuuccuaacucuaacuacacccacaaaagcaugauacuuccaaagcucucaguggaucugaacauacuugaugccaccgaguagcacacacuaauugcuuuuuuauguguuucgucuuagcacaagagggaaguauggagaaggacccaaacaggagacauucaccuuugccuuaacuuugguuuucauccagugugugaucaaugcuauguuugccaagaucugugaguaccucauaguaauuuguugggcucacucuccuuccucccauauucugggcauagacguggauucaucuuuaaaaaucaaaguuuucccuaccuccacacccuugaguauuuaaacagcuucucuacagacuguaaaaccaauggcugugaaaugagauuaaaauauuaggccucuaaauuauaccaacuuuuuaguuggagacgacugggccgucuauauuccaaauccccauugaaagcccuuagaacauuuuccccuuuaucccuuugacuucgcuuugugugucagcuucaaacaugucuuuguuccugucaguagaguuaagccauccuuucuugaacucagugaaucucucccuccacucagcaugugguuguguuaggcuuaaggggaacugggacgaugaauaauuuucagagauuucccagcuuaagaggauagaaauagcggucuuacuugacaggcaaguuccuuuccuauggccucaacuuuuugcuuagugguccauccuugccccaccggguuucucuuguauguuuuguuuguuuuuguuuuauuuuuugucuucucccagugauccaguuuuuugacacugccaggguggaucgcacucggaccuggcucuaugcugccuguucugucuccuaugugggugccauggucuccagcaacucagcccugcaguuugucaacuauccaacucaggugaaaccucagggugagaugagaguuggcucagaaauuguguggacaggacuaaggggaucuucccuccucuuccccucaggucugugacuuaaaggaaacaauccuagaaggcuagggagugagcucaguuaguagagcuggcuuagcaugcgugaagaccuggguuccauccccaacacugcaugagcgaggcauggugucacaugccugccugcaguccuuguacuugggagguagaggcuggagggucagaaucagaggcucaugaucauguucugcuguagcaguguauccaguucaaagccagccugggcuacuugaaacuauguucaaaacaaaacaaaccuugaaacuauguucaaaauauaaauaaauaauaggaaaaaagaaagaaacacucaaagcagaguaugcuugagaaagaguuuaggaccuagaguuggguacagguuggguuuggccaugauagggcugccuccugagaccaagcugugggguugagggccaauguugucgccucugaauguagcagcgacauccuuccugggaccccacagaugcucagaaguuauuugcucacuuuuauuucagguucucgguaaauccugcaagccaaucccagguaagccgagauggugaacucgggcuuccucuuucuccccaagugacucuggguggcaccaucccgucggaggucucccuagugucuuuccugucgccgguguugcuuccuguggugugcacaggccaagugggagcgagaggcugaccuugccugccuuguguccucaguuacuguagugucccccguguuuucauuaucaucacacacccagaaucccgugcgggccagcuaccucuuccuuucagugucugguguccccucccuuguccuccgcccuucccagguccuuccuggaccuuugacuuuuguccccucccuuccccaccugugcacuacucacacccuguugcucaaccaucuuuaucugggugccagccugacaccccucccaccucacccucgguagggcuucuuucucagacguuucucccucagucuugacauggcucucaggaagagggugcuggggucacugagaccagugggacuugaguuucacugucuuguuugcuugucucucuguaguuaugcuccugggagugacgcucuugaagaagaaguacccgcuggccaaguaccuguguguauugcuaauuguggcuggcguggcucuuuucauguauaagcccaagaaggugguuggaauagaagagcacacuguuggcuuuggagagcuucuucugguaugcaguccuauuuugaaggcagccuuuucuagcagauucuaccaaggacagcccuuaacaaggcaggcagaaagccaagggagggcguguugucccuugacuccuuccuguugcuggucuuuguugaaaggucccuggcucugcuauggccacaacaaggagccugaaauauuuagccauagcuaaggaagcucuccuggagaagagcucucugaggucugugucuagaucccugugugagcucagagauacccgagagcugaggaggaaaggaugcagugugcgucccuggguuuccaggcaacacagaagccagacuugaaugaacgacaguugucauuuaguguuaggcccugucccaagugcuucacaucgucgcugauuuacaacaguauucuaacacaguguuaccuccauuuuauaagugaagaaacugaggggaggcuaacucacuugaucacucacuugaucacuuaaguggcaggguuccaggccaggcagucugaucacagaaccuaggcucuggaguauaguucucgccaucccccuccccccccaaccaccuuuugagacagaauuucuguguauaggccuggcuggccucaaauuuuaaagauccgccugucucugcuucccgagugcugggauuaaaggcgugcgcuacuacuaccgugcuggaacacaguccuuacugagccagaaagcuagccugcggaugaagcagcccuugcccaacucccugguucagucccugugcaccagcuuguaggcuuugacacugagaacuggugggcuuccugcucuacucugaugacagccccauugugaccagucuggugccugccacgaaagaggcuggcacagucuuuuuuuuguuuuauuuuuuuguuuuucgugacaggguuucucuguuuaguccuggcuguccuggaacucacucuguagaccaggcuggccucgaacucagaaaucugccugccucugccuccugggugcugggauuaaaggcgugcaccaccacgcccggcuggcacagucuuucuaccccugcaccugaccguaggcaggguaauucugaggacucuguccagggcuguggaggcacccugcuggccagcucacugccggcugcucuucuuccuuucccagcucaugucucugacccuggauggacugacagguguuucccaggaccauaugcgggcucauuaccaaacagguuccaaccacaugauguugaacaucaaccuuugguccacguucuugcuuggugcugguaaggagccauugugcuguucugugcacagaucaccagagggcagacuccucucauccaguuaucccuagcuuggcuuccaguuguuaacuuccuugcaggccaagagccccacuuaauuccaaaauguccuacugucuaaugccugagagaccuuccuggaaagaccagugcuggcaguaucucuccucucccuauuacuaacacuguagggguagacauguuccagcagucgagaagcacacggugaaacacacagagauaauuaggaacagucuuucucaugagguagacaagacaugaguauagugcucgccgacuuacgagggcacugaauggagguuacagaugacggccuuugcuuuggagacgucugagcacacguagaaaguauuuuucauguaacacacugggauaacggagaagacuguuggugcuagaggugaccgauucccggagcuuccuugagcugcagaccugugggucacugucugcaacaucuaaggaugccugcguuugaucacuauuuaaauugcugguuugguuuuguuuuuaaagauuuauuucuuuuauguacacugucuucagacacagaagaagagggcauuggaucccaugacagaugguugugagccaccaugugguugcugggauuugaacucagagccucuggaaaagcagccagugcucuuaaccacugagccaucucuccagcccacuggcuuucgauuuuacuuucguuuuucugaggcauuuucucacucuaguucaggcuaaccuaaaacucacaauccguacagucucagcuucccagacucugagauuauagacccaagccaaauauacccaccaucagucacuuuggcagaagaaaaccauuaacuucgaagccuuucuuggaaaaucaaguugguuucuguaacuagauaaaaguuugagaaagaugcauaccaggccagaauaaacuccacacaugguuccuccccccagcugcccucaggguguuuaagcagggcugcgugcagugugcggguaagcauaagacacgcaggucaccucuucucuuuuuagggauccuguuuacuggggagcucugggaguucuugagcuucgccgagagguacccgaccaucaucuauaacauccugcucuuuggccugaccagugccuugggucaggugagguccuuggaggaggcagcuuggcuucccuccuaugugguucagaaagaauggcugggagcagaggggagcaguuagcccugguauggguggcgaccucagggcugugcucagucucacucugcuucucuuuuuagagcuuuaucuucaugacagucguguacuucgguccccugaccugcuccaucaucaccacaacccggaaguucuucaccaucuuggcuucugugauccucuuugccaaccccaucagcuccaugcagugggugggcaccgugcugguuuuccugggugaguucuacccagagcaaaugccuguaggggccacagagggaaagcagcagagacuuaccuuguuauuuuagaggaaacuuuccuaaaggagaaaaggaagcauucuuugugaugcggccucccuccugugcauuccaucuuagugaugcccuuuaaugucaugggcauucaggauccugagugggacaaaguaugguauuuacuccccugcuaacgugugugugucugugucugugugucugugucugugugucugucugucugucuguguuuauaggcaagcuauaaacagcuggcgaauuuugauucugauuuuucuuuugguguugguguguguguguguguguguguguguguguguguguguauguauguauaugugucuguguguguguguguuuguaugugucuaugugucuguauaugugugucuauguauaugugugugugucuguguguguucccagugucuuggugacuugucauuuguuggcauucucuugucuuugaggaagcuauauacaacuagucauccaaaguguguuaugcccaaaacugggcacagugaugcccaccuuuaaucccaaaacuugggaagcagaagcagacagaaaggucucuauuuacagagugaguuccaggaagcuaaaucuauguagcgagaccuugucucaaaacaaacaaaaacaaaacaaaguuggcugcaucuaaagccacaccuuagggaagcuaagcugacuuccuuaggccauuggcaggcuucacguccuccuguggaauuuaaguagcuuuucuccuuuccauaggucucggucuugaugccaaguuugggaaaggaacaaagaagaccucccacuaggaagaaagaggcuuccucuacuccagaaacacuuaaauuauuaucucgaacaguggcaucuugggaaaauggacucgggucaugauaagggauuggguuccaaucuuuuuauaaaaaaaaaaaaaaaaaucaaaggaagcaagauggaauauucuaaacaaagugcuuaggguuuaacaagauguguugcuaauuucugauuuugcacaaauaaagagaagaaaggcaagcuggaagugcg

SEQ ID NO: 6305 - RNA, 18920 nt, Mus musculus
cauugccuucacccagcugcucccgcccgcuagcagccagagcgaguggagccuccgccagcuccggcgggcagcgggcgcuggagcgcagcgcagcgcagcucagcucagcgcgcagcaccaucgguccgcagagcggacugagcuagaagcugagcgcugucgccggaggcgagcaaugaggagggcaggugcugccugcagcgccauggaccggcugcgccugcugcugcugcugcugcugcuucuagggguaagugauuaguaggagggaccuccguuaaccuuuucaaagagcugaaccccaaggggaugugggugccaccacccagggaacagaauaagacguuaaggucccagaugcuggcaacggguggcggaggagcugcgggaucaugacccacaggggcgcuccuagcuucuaggacuuucagagcgcagaggcgacccagucccaggauagagaugcagacaggacuguugcaacgacacccguucuugguucugcuugcugcugcugguucuugagcacuacgacgggugcgguguaggagacugggagcagucucgagugggguggagggagguuugggaaucucgggcgccuggguucuuuugacgacagcgugugaauuuugggaucccgaggggaguuuucucuuuagcaucuuagucccuggggaguuguagggcagagagaaggaagggaaagagaucggcacuaaagaugugaggggcuagagacggaacaaugcgggaggcagcuggagggacuggaggcagaggggacccaguauggacaauggggaccggccagacaaugggggggaggggcaucgaaaggagcgauucgggaguggcagagagguugaagagagagaagugggcuuuauggagggcagaaaagagacaaccacaaaagagauagagaaauggaaagaaggugcauacccuaaagugcucggggccccgccugucugucuacucaaggacgaugcgaugaggacagcccagucacagacguuucccgcguggguucuagcgcucuuucuagcggccucgcccaguccgggaauugcgucugggcaucccaggcagggaagagagcgcucacuucacuauggcaaauccgcuucuaggguaguuccuugacaaaccuuucacgugguuugaagcaacucaguggacccggagagacagagccggggcaucccccuacccuauuaaacgccggccagcucucgagaugcggagcgcugggacucucaaggcugugaugguuccggcagcgcacagcuaggggaugcaaaaccccaggcgacccgcagggggcacugcgggcgagggauugcuguugggagcugcgugcgcgccuugggcugcgcacugagucccuucuaaguuaagccgccacgggcccugagcccuccgugcuccuuccgguccagaacuuaauaggaucaucaucccgcccacaccuggccaggcuuucggugaaagucaaugaacgcuucucaaaugagacaggggccacuuggaugccugggauucuugucggauugcuguucggagacaccaacuccggcuaaggucauuagguccuccuucuaugaaccugaguacucuggguauuucugaccagaucuuaaggaagguuggcaaugaaagugacguccucuccucacucuucccuccacccuuuccacauccgagcacuguacaccccccccccccaucuccaucuuacugauaaggaggcagggacuucgaaguuuaagcaaguuggucacgaucucaagccagagucguguggcuggauggucaccucguuccagcucugaacucccugggcgcgcgcagguggggagggggcggcagcugguucgcuucguuucacaguagggauaugggugacaccauuccaaaggauaggcaggaggugagauauggaggcaagcggauggaaaacccuucucaagcccaaacaugguucccuggagcugucaguccuuguggcguccuccggggacuugggagugacugcaagaguguuugcuaacuaacgcuucugguuagaggugcuucuugguccuuguuaugguuggcuagggaagagggccuggggcgcugcguaguucugauccuggaggggugagggcguggccacugaaccuugacagaaccuuuggacuugagccccuauggcucuguuuuccaucucugcuuuccccagguuauucaguuagagccgguucuguguuccgccgcggaccgagccucuuccugcgccgcugcgagaguucugaaaccagagcgcaaccagagucugcuggccggccgcgccgguaauggaggcacuuugucauucagacgucuguaaccggagccgcccggcuggcuaaugcuccuaauagggaugcagcagcguaggcaacaaaugggcagcaugagcgucggggcugcugcggagggugggugggugaugaagcggcugcgggaagggaaagccuccacccuaccuggucagcccagucugcauguagcaccuggcuccucccuagagggaugaguuagaagggaggacacacuaaaaucugugaaguaccuacugugugaccugcacuguguuagguacuuugacguuauauacaccacaggucccagcaacguaaauuuagugauugccaucuuacagucgaggaagcuuaucccccaggaaauugaggcagggcaucaggcuccccaacuuagaaagcagagggggcauguuggaagccgggggucauugacuuaguuuuuccuucucacgcgcgguuccuuucagcuucccaccaacuuagagaucacucgaggggguguggucccaaacugccucuggcuggguaaauuagccgcugccuuguggcucugaaccuagccacuccccuguucuaugugugcagagcccuagccuaucuucaaguccgcauaaggcagcuuccuuaaggaguuaacaccagucucuguacucaugacucaguggcuuuccaaaggggcgaggaguggggcaguaaucaaugccuaguccuggcugaagcucuccagauauuggaaaaccccuaucccauaugguugugaccaggcucuauucucugaggagccuucucugaagcuguuaugaauggucaggacugaaaccauggaagcauccauaugguugcaaacccugguguguguguguguuuucuguuuuauccaauugaaaaaaaaaaagccaauucauccaagcacugacagccagcccugcaaugacauaaauagaucguaaacauuuugaaaaauggagaagucaugcuaucaacuuugaaaugaauaaaugcaguagauauaacuacaggcaaaugggucugucacuuugauaaauugaucaauuuggaucggaguuuggagcaauuagucugaacucuagucacacgcuccugcuuggcugccgccuuccuuucugccuugucuuccuugggcagcagcucauacuuccuaaaacaagcuacuuccucaccaacuaccauugauugaacuccugcuacacucuacccagacggaucugcacacgauuccauucaguucucacggcaacccaguguaggagccacgcuaaguguuuuagaugggagaacugggauucgggaagaauaagaugcucaacaucacagacugcuuaguggcaaaucuaggauuuuaugacagagggaacauuaaccaaguacagaugugaauacugauuauguggccucaacucuaaagaaggggggaagccuaaggagaggggaggagagggaaggauugaagagaaaggaggaguggggaagggaggggaggagugggaaggaaagggggagaagagaggaggaguggggaagaguggggaggagugggaaggaaagggggaggagcagggaggagagaggagggauggggaggaguguggaggggaaggaaggagugggaaagaaugauaggggaggagcagggaggagagaggaggaguggggaggagugggagugaacagguucuuggcagaggugcuugcccaaagcuauuacgucucugacaaggaucauacagccccuggcggucccucaaugcacacccuccaacucucugcugaccuugguuaagaggagugguggugcacaccccagauccacaaagggaacaacacacaguggggggcagaaaagaaagguuauaaagugcaccgagcccauccucacacacucauuuacaagcagcaggcugaggcaggcgcugccaugccuaccuacuggucgagaaauuaaaaaccggccugucacucuggcccucagugaugagggacugaguagugauuacgccaaguguuugacucugggcacuucuucccuccauguaagcuucuacucagucaugccuccaucugucugucugacuguuugucugucugucugucucucccucaucucuacuucucuuuguguaguccuggcuggccuugaacucagauccuucuugcuugaccucccuuaugcugggaucacaggcaugugugcaccuggcucccagccagcuuuuuacccgguccgguggcaucauuuuuuaaagauuccauuagagcugacacuuuaugguucugggagagggacucuuccggucauacugcgauaggagcaagaagugacaacugauacccugacaggaagagaagggacaggaaaacuaucaaaaagcugacaaaaugacaaaaauguguucaucugggauggaagacaugagaacacugcggcacugcaguccugggucaucguuggugcuaacagucgaugccccugugauggagaagcugcagagguggaggagggcgaugcccacccugcaguuuccacccccaacccugccaccuccccucucaguggaggagaaauguacugggggacaauaguauacuuuugccccugaggacacauagccauccagagugagucuuccagguaacugaaggcacauggcaguuuccuguucuuaaauuaacaaauauguacacuugcucccuacuaugugccagagagggcaggagauaccaggacaaccucaguccauagcccugccagucuacucugggagggguaagggugauaggaacacuuucuugaggaaguaauauuuaagccgagcucuaugugaugaaaggaaaucagaacagacccuucugaaaucucagcuccugggagaagccugccucaaguaccucagggcuccuggucugcagauguugccauugccagccagcacucccacugccagcaccugggaggagaugguggcagcuuccggugcugccuggacucucucugcugcccuuauggagaccacucugccccuagggcaucacccaguguuuucuccugccucuguuuacuuuucugucaaacucuggugaaaccacagugguguguguguguguguguguguguguguguguguggugugucuuggcaaagaucgguccagcauggaagcaggagaggaaugcccaaacaaucuuguaaagcucucuggucucacgaccaaagcccaaauugcucagcaucaaaugggguggguggggggugugugcgcaaggucuggagccugcagagaaggcuuuggaguuuuauuagacauuaagauuguucuuuaaggaacagaaacaaagugagccuccaacagccccucccucgggggaaucuggugcuaagucguuccauccaugagcaaagaugcuuuaguggcaggaaucugacuccccccccccccauccagcucuguucccaggggccacaugggaggagaggggaggggauggagucaggcuaggacggggaagucaacucuggaagaauagaguugcuggcuggugaaagccggccacugauaacaggcgucccuuucucugucuuggcuccagacuugcccaucagucuuugcccuggcaccaagcugucccuguguuuaucugcagaggggugaaaacucccaaaggaaacccagggcaggccagacaccuccaguacagagucaauauuugaacccaaguccucacugccuucuguucuuggacauagacaacuccguuuugauauuuaauauguggaaugagaccuggagaagggcccuguucuccuuuuuaggaaagggcccugccucuggguaacugcagcccugcaggugugaaguuuagcaaauggaguuugggccaaauuucaguuccacuggcccccuuggcuaggagcccugugcaagcugcaaccugcccagccauucuggauaucggucucacccuccuccugugguguauccucaggacuccaggagaggcuguaacccuaaggugaacucugcagaagguuagccacugaggcuaugaccucacaccccagcagcagucaagggccccacuccccccacgccccccacugccccccagccuuccuuccugccagcuuugauccuccuaaugccucccgggugagcucaucccagcccaggugguucuaauagaaaguauuaagagggaggcguuugaucccuuggaagacaccaccuuugcuccugccaggcugaccuugugaucuccuuccaccuagguguccuuuggaggugccaaggagacauguuccacaggcauguacacccacaguggagagugcugcaaagccugcaaccugggcgaagguguggcccagccuugcggagccaaccagaccgugugugaacccugccuggacagugagucucuuaggguggcaaaaggggaagguuuagcaugcacagagcagagcuugaaaggguuuugccuccuggcagguucccugccaaccucuguacagguaccagaaaugggugggauacaaagcaggaggagcagggagggacugaauggauaagggaguaugcugagggaggaagggauccagugggggauccccagaggggucccccuucccagcccccucaagcagagaggcugguagaagaguaaagcuaggcagggagaaggaacugaugcucaggccagcuaaaaauaccuucggugcugcaagaucaaugguugcaaccuacccucuguggcuuuggggggaggggaaaaagaaucaaauccuggcugcccuggaaacugaccuugggggauccugggaggguguggcugccucuccuccaggccacuguucuguagcuuucugaugucaagagggacaggggcuguggcacaaggauguccuuacuaugggauggcauggaguggaaacugcagaguggagcugccuggcauuucagaaauagagaggcucaucuuccagcagugguggagggagaggccagaugacagcucuguucucauccccgugugaguucugugcccugugggaccaggagucucaguuucuuccgaggcugccucaggccccaaggcagaagaacucuuucccugucugcugccaggaagaugcuacaucuuccaggcauguaguccccuuaggagggcugcugguaacagaauaaggagcugggaacucugagccuaccagccaguccucucuuaccucuguaugcucccucccgagucugcccagccuucagguaaccggacuccuuaguguucucacacacaugcauuucuaucucugugcuugugacuucuguagcccuguccccagcagugggacaccugggcuggauggaaaggcucugcccucuuggaagguggcaccuuaccuaccucagauucacagagucucuguccuaaggcacugaacaucagccaggaguacugccuccuauugccuggcugucaguguccuaggucauaccccucucucuccuguguacccuucuucaacagcugguggguuggggacucaaggaaagccaugccaggaauuaggaaacacgccaggagccaggggcaacucugagaggggcggggcagccucccugcaucucuccuucccccuuuccucuuccuuggguuuccucugccacacuccccuccagcuguguuaacaggcugcuuuuacaagccuacuuuaugggcuggggaccccagcggacuuucccuccauccucaaaaaaacaaacccguuuccacuaggaagccuguuaagcuccugccuucaugcucugccaacaaaagaccacaguuuucacaccauccacaaccugcucccaggagucauccggcucagcucuguguuuucccaggagccggcuugcucuuuccauccuguccccacccucacucccacacagcacccucucauuuggagagauuguccugccaagugcuuucugccauccgacugugccucaaccaccaacgaucuuuacuaccguucaucauggggucuaucacauucuucaucacaacccugugggugugggugugggugugacuuauuuaguuuuuuuuuuguuguuguuuguuuguuuguuuuggguggugguacacccuuuaaucccagcacuucggaggcaggugucaggagcuagugagucacagaagugaguuggaagucagaucugccugauaccagggaaagggaagcaaguuaccucuguaagaacuaccuggaaguggaccuguuacccaggccccuccccuucuguuuucucuccuguccccacugcgaccccuuucauucuguccuuugcuuccacccaacacacacucucccuuuagacgguaugcuugagaacugacccuuaauacugaaagggccagggcacugugccugcaagugucucccgucuuucuugcuguaccugcgcugucuucccuggagcacuggucugcucuuuagagccauacaugcccuuggacaggcagcaugguaaggugcaggcaguaugguauagcagugugccauucuguugucccuccauuccaggcuuacaugagcugcccucucccacccccugggaagagggccaaaaaggacaacucaggcacaggcucaccucuggccagugugugaggcuggacggaaccauucauauuauauuuuaguugugcugggaacuaggguacagguccgggaacucucugagaacaaggaauuuaccuaaacagcugggaccucaggaugccccagggccgacucuucugggaccuggggaaugggucuccuucccagucagaugccaaaccagcuuucucaggcugagggugagggacuccagcaaagagagugucaauaagaaggugaagcugagacagaggcagcaguccuagcugaggauggggacagagggauuccaguccuguauucacaugcccgugcucaaacaccguccuugugacuaaguucugccgcugaugcuuccccguguguguguuguuguccgcagguguuacguucucugacguggugagcgccaccgagccgugcaagccgugcaccgagugccugggccugcagaguauguccgcucccuguguggaggcagacgaugccgugugccgaugcuccuauggcuacuaccaggacgaggagacuggccgcugcgaggcuugcagcgugugcggggugggcucaggacucguguucuccugccaggacaaacagaacacagugugugaagagugcccagagggcacauacucagaugaagccaaccacguggacccgugccuacccugcacggugugcgaggacacugagcgccaguuacgcgagugcacgcccugggcugacgccgaaugcgagggugagcaugguuccaggcuggguggggugggcgugaagagcuagauucgugaggaagggcgcccucuggaggucguaagggccuaggcuggccuucauccgguaagaaccuacuuugaggcuuaguaacacauucuugauaagagcacugagguggugauucuagauucaaccucgcagcaaaaucuuuuccaccaauuccuucuuuggacugacagugggaagacccggcuuacuguucacuggaagaagucauucuaacuccucucucagcgauuauaugggugacaaacagcaucuggaaggcgccauagaugccagagucugaaucaggcuuccuuccagccuagagcaggcuuucugcucuggagucaggcuggggacucacaggagugaggggccuucagcuaugaggccagauguggguggugaugauggcuauagcaucccaaaucaaauuagccccgagugacaccaggggauuacucccgucucuggaccuaaguguuuucugguagccguagggucacgauaaggcuguuggggugagugacacauucuccucgcggugucuggagaugagguagcauuguggccauuuaaugagacagaguugguugaaaaaaaauggccagauaaugaaggaagugguuccagggaacaaaagagguguggcaagugggggcauggcaaguacgauaaugugggccaugcuuggagggcucuccucuacugagggcuguagacaagagaaagcugugggccugccuuauccagauaacucaccugaaagagauagagagauccugggacaggaggaggcagcugagagccaggguauaggcaccacggucacugguaguguucuucuccaaggggucaacugguauugguuuguugcuuguuuguuuguuuucauucuguucaucagcggguggccugcccauggaucuauuugucuuugaauuugaaccucagguugcccucacauugagcaggcaagagcauccccuucagggacgucccuaguuuucccggagagggaauggccuuugacacagguccaaugagaggagcaugguaccccagcccguggugaccuggagagagaagacagccgcagcuuuggagauucccgauccugauggaggcaacacaguuucugccuuccauuggccucuuguggaauagaagcuacagaugcccuguccuugggccggggagggguccugacaaccagccagggccuccuccauacccagacuugagcuugcucuaguaguagagcagagaagccuggcaagcuacacagaggcccuaaacaugcuugcaguucuuugaugaauagguggagagggauggggcagaggccccaggguggcugugguggagauuuccacgggucaagacaggcaaauggccucagaggcuaagcugagcggggagagagcuucggcagucaggcagcaggaagcaggaagcucaguucugugggcaagucuagaucagccgguggugcacaaggucgggguugugauuagaggagagggaggaccugguuggaaaaggggcaggcuccgucuugcaaggaaucauuucuucccagacgcgauccuucuuucucagucaucuuggcagaaggcacccccugaccccccaguaacauuuauccuuauauuguucuuucuguuccaacgucugaaggguuaaauguuggcccugaggccaaacaucccuuucaggaaauggaauuugauucuuggguuggcagcccacucuuguccaauguuaaauacucgcccgcauauacauuucaggugucaacauggugacucacccagccuuggggcagacgcccggccuccuuaccgcauugaaguuuaggaggggucaccugcucccucuucuuccugauagcucccauuccggaaauggcugucaggaccugccaaguguuuagcggguuggaacgucagaggacaggcccacaucuggaucucgucuccaacccuaucagagaggcugggggcgggggugaggggagguguccuggacacucgacacugccuuuagcccuucucugaggcuccuucauuucuguaucgcucacccacccacaucaaccucgggggcaggacugucaaucuaaacugagucacaucugcaaccucuggauucaggcuacaccuucaaccuucccuguuccccuagcggaucauaagaagguccucuagggucuaaugcccagacagggcugucucucccacuucccacccucuccuuccagcccugcccgguacugggauggggguggggugggacugggcagcagauggcaaccuuccccacacugccagucaaauggauuccagacucacaucugggguccuuaccccucagaaggugcugaaaauggggccuuugaagcaucucugucccgagccagggagacccagaggacuagugggcagcuuuaacuccagcuugggugggcacacuguagacugggcggggcagagcuggguagcaaaguguccuccccuuaaccuuacaagcauacccugucugcuuucccucccuguuuucccugcgugggaagugagaauggauaggacaggcugcuuugcccagacaaguaucccccaggccaccauccagagccuacaaccccuagcccugccucuggcuggguggcagaauggaaaaucccacccacuagugccaagaggggcuggagccucugccaggaaggcuggcaauguccaaauggcaugagcgggccuagauggguggccaagcacagaauugcuccuucugaggcagggucuaguucguaggcccucccuccgccagcugucugcuuccugcuaacgagggugccagcugucuaacccacucuucucuagaugccagggcuaggcuguuuugggaguggggggugucaggcguuacaagaaacaugcuggccacuguucaaggacuggcugggggugaaguaagccaguuauacaucuagugccagccuaggccuggagcaucugagacaggaaggggcugagugccaccugccgggcagcaucucugaucaggccucugaucagcucuaagugcccuauccuuccugaaggcuguggucacuaagucagagcaauuccauuccucaaagcaauuaagucauugcuccagcuuaaagaugcucuacagcaugcaggcuucuugguguucaugcguggcugcuggcagacacuagaauccugguucugcagccuaagccaaaaaguuguuuaaagaccauuucuuuucagaaagcccauucucuagauggggaagucgaggccccauacugauagaagucuccugucauacagcucuugcucuucuuuucuaaacugcaugugcacagucccagcuuccacccccaugcguaacagccuggcccugugugccuggaggcucaugaugaagcccuggaaagcuggagcuaaggggaaggccuggguagguccuaacuccuguggcccuguuccucagagaucccuggccgauggaucacaaggucuacgcccccggagggcucugacgucacaacacccagcacccaggagccggaggcaccuccagagcgagaccucauagccagcacaguggccgauacggugaccacugugaugggcagcucccagccuguagugacccgaggcaccgcugacaaccucauuccugucuauugcuccaucuuggcugcugugguugugggccuuguggccuauauugcuuucaagagguaagagggggcacacugaggaugacauaggagauguuugcuccgaccuugaccuggaaacauacauacccuuaauucaacccuaaauucauccuccaacacuaucucaugcccucugggguguauccguguguguaugugugugugugcucauauuaguguguguguauguguguaugguguguguauguguguauggugugugugugcucauauaguguguguguauguguguauggugugugugugcucauauaguguguguguauguguaugguguguguguguauguauguguguauguguaugguguguguguguguguauauaugugguaugugagagugucuauguggugugugugugguguaugugcuugcauaauguguguguaugugugguauauguguggugugcauguguauaguguaugagugugugugugugugguguguguguguguguguguguguguggugugugugugguguguccaugugguguaugugguguguguguuugugugugugugugugugugugugugguguaugagugugugugguguguuuguauauaguaugugaguauauguguguguguauauauauauauauauauauauacauauauauacauauacacauauauauacacacacacacacauauggggggugagugugugugguguguaugugugugguaugugugggaguaucugugugugcgugugguauguguguuugugugcguguguauguguacaguauguggggaaguguguaugggagugugugugguguguaugugugggaguguauguguguuauuacaugguuuucuuuucuguccuggcuccagcucuucccuacucccaagcugcuccuccuguuccuuagucccugccaccuccucuggcuacuugcaucccugcccucagucacacucaccccacgguuccugguucugcaugugucucuucucuuccuaagucacccuugcuuuccugucacucccaaacucccuuguuacccuugggcuccugugggacccacaucaaggaauucaagacagaagaacucgcagaaggcauuuucagcuuugagugugcgucccauuccguuuuucuuuucuucuuucuuucuuuucuuuuccuuugguauuuuguuuuuaaaucaucaaagugauccaugcuuuuuaaaagcaaaugcaaacaagacugaauuuguuuugcggugcugaggaauggaacccagaucuuugaacaugccaagccugcuuacuaccacugagcaauagcuccagucccaagacuucuaaacagcuuccaacgcaaaaagcaaaagccucgcuuuaucuccucaaauccugcacaucuugugggaaaucucuuugggauaacacuuucuaagcuguuuagagugcauauauauacacacacacauacauacacacacacguuauaugcauauauacauacacauauacccacacaugaauguuuuauaauuacauguagacaugaagaacuuuucugacgauucggugggaacacaccauucaccgucuacaauguacucuucccucuuacucccccucaggagagcuuuccucagaacacagauuaucugaucauuuacagccucucauucaacagcaccagacaugggcuguaaugugcuuagccaguccgcucuugauggacacuuaucuucagaguuuuuguugcugcugcugcuuauguuugccaaggaaaucuguguguguguaugcgcauguguguguguguguguguguguguaagugagugugugauugcugcucacauaugggaguauuuuaguagggagaaauggaauuucuaggaagucauuuauuuguguaguugguucugugaacauuuacugaauguuuaccaaguuccuccacccuugcagagcuuucagaguguguguguguguguguguguguguguguguguguguguguguuuaugcacccgcacgaguguaccuacgcacccaccugcagaaaugagcaucuuaucgccucucagccuuuuggauaagaucauauacagaaauaagcuccuuagacccuuuggggacauugccacacucccagccucagucggcagcacagcuacguuggcugcacugauagaauccucaccccaagcccuggccuauccccugucccugggcugcagauggaacagcugcaagcaaaauaaacaaggagccaacagccggccggugaaccagacacccccaccagagggagagaaacugcacagcgacagcggcaucucuguggacagccagagccugcacgaccagcagacccacacacagacugccucaggccaaggugagugagaagccaaaagacugagggugcaguuaugauuagacuccaggagggaccggcagguaccaggguaggagaggcuaagucgggugggagacauaggaaaggggaagguuuuuguuuuuuauuuuuguuguuguuuugcauuuuuuguuuuuucuccugggaugacuugggaaaugcaggcuuuuauaaguuggagcauccagacucaucaggcuaauugccccccccugccccgggggguuaauuacugcccaaaguggcugcaauuagccuccugcccuggacuucuaggaaacaagugcuuaaguguguaccuuaauuagcggcccagagccaggcucuaggacacuugcugcaguugucuggagcuggauugcccuguccccucccccuucgccuugaugauugcuggggggaggggacacgcguggaaaggauggugccagcaccgaggguguagggagaacagugagucagcaggacccaggucccucccacccaggccucaucuaggaccucaucuuggcuaucucuccgccucuaacucuagacuuggaggaacgugccuuggcccuucuggggucuuggcccaagcuucuaggcucacggaaggaaccagggcucaggguuagagaacacggaagugagggcucaggguuagggaacauggaaggagagagggcucagguuaggaacugacaccccuuguucucugcagcccucaagggugauggcaaccucuacaguagccugccccugaccaagcgugaggaggucgagaagcugcucaauggugacaccuggcgacaucuggcaggcgagcugggcuaccagccggagcauauagacuccuuuacccacgaggccugcccaguccgagcccugcuggccagcuggggugcccaggacagcgcgacgcucgaugcccuuuuagccgcccugcgacgcauccagagagcugacauuguggagagccugugcagcgaguccacugccacguccccugugugagcucaccgacugggagccccuguccugucccacauuccgaccgcugauguucuagcccccacagagccgccccccucucccuugggguggcccaacagucagaaccgagcaucucuguguagggccucugugucccgcuccccaaaccacagcccuguugcugcuccugaggggaccuuugcuucugaccacacucucucuccggcgagagauaggaccaccccaagccugucuugccccgugaccaucucaggccuuuccuuucuuucuacacauuaacugugucagaucuaggggucugacacuagagaagguaacaggggcaccccuaagacucaggggguacuaaugaaccagagccauggacuccacacugugaacuggagaacagggggggcauugugguaggccagaccuuccucaaccccucccuucucccaucuggccaaagaugaagaggauuacaggccuaucugagcugaaagcagguuuggagcccaguccacacuccuucucuuacacauaggaugguaaagcccagagaggcagggacuaaccuaggccacccaacaacagggagaucaauuguaggcugacacacuccuuucugaaugagggcgucaagugcuuguuggcagggauggagugacuuucagggaaacaucuggaaacgacgucugccccgcccucaaccacuuccaggccccuacccaacccuugugcagaugaacugucuguucaaaaccugguccauuggccuguucugauggagucgggcuaauguccuggggaguggggugcugccuuccucugucugucaggcuuagccacagggcauuuguggagggaugaaucuguuagcacccucauucgugucauaagccugaagccaacaguggcccuuggagucaacccuaggggucagggaccaaggacccaccccauaauccaacaccacacacacacacacacacacacacacacacagagagagagagagagagagagagagagagagagagagagagagaucaugcuuuuccccccauggcucuuuuugggcugagaccagauccugcuggaagucgcuggcugccagagaaagauggaaggggaccgagaugagcuucguggggcugucuuccucaccucccggcucuggcaggccaagaacugcugcaucugagcuggcgugcgugcguccgucccuguccgucggucuccaauggccuguguguggaggaaugcucacaccgcucccucuccuccccuucuugaagcccaacuuuggcugcacccagaaaacagugaagaaaagcaggcugcugugagaacacaagaaaaugcagaugcuggcccgcagucugaggcaacuuucuccucaguuucauggccccugcaaaggaccaauuuccugggcauggccaggaagggacccgagugcucauuggccggcgcuuucaccuggcuccuuggccuguucuguuuugcuugcuguuggaaugagugggcucccccucuauuuagcaugaaggagccccaggcaggguaugcacagacugacugccaucccuccccacccaggguccacccagcccuguaaggagacaaggagccuugugcucggugguauuuuuauggaccucgaucugcaauuaguagaaggaccccaccggcuggcccuccccggacaccugggaagugggacauucuuuguguauuuauuuuccucccccagaagcugggggugggugggugggggaggagcugcaggaccaguuuagcauguguuugguucugggggucucuccagccuuauuuugggucaagauggaaccucuggcccuccagcuggcgacuaugagauccagaccucuucauguucccugacacuuccccuuugcauccuguguaaucauuucuugggcccucccaaaaccuacacauaaaacauacgugaugaccauuaaauagcaaaaaaaaaag

SEQ ID NO: 6306 - RNA, 13819 nt, Mus musculus
gugcagcuggaaggucugggugucauuuauugacagcggcuuacacuguguuuucuccccuugauugcuuccuucggagcgcuggcccacagcccucgggaagaaagggcaaucucugagagagagggagcgggaaggcaggcgcacguguccuuggcaggugugcucauucccugcaggaugcaauccuucaagcuggaaucccauuggguauuugagaggaccgaugugggggguggagaggaagucuuccaugggacucacaucucaguccaggccucuugucccguccaaguccauccagguuuuaggacucuggugggggcagcgacaugaggcccacccaccuugaugggcagauucuucaccccgugcccuggucacacacaccugcuuccgcuggucaugguuaagaggggaugggccuuacaguugagauagaccacuuccucuggcccuccccagcugcaucuguccagguucaaauggcuggaaacacugagggcuugcuuuuguucaagugugugugccacugucuuuaaaucuucaauauacggcagaauggaggcccuaggccuaugcaggcugccagcaggcugcccauccacuacacacugcccugccuuucuucugccaacugcccgcgccuaggguggaaggccagucugcagaggcacuuggcaauuuuggauaugaaagaggguaagaaguguaacaauaaaagcuucgcuugauaauuagagaucugaagugauuuuaccuuuauuuccuucacuuuaagccaaucaugaaauuucacagugauuuucugggguggggcagaaggaaggcgucauucagcaugauggaggccguggcccggcuggccucacuggggaagcuggagaagcacggacuggcccgcuggcagguaggugauguuccgagagcgggagagcugguacgcaauguccucggcggccuccagcuuccgcagcucgaucaggccgucgccugccguggccagcgaguuggcgaucagcucagcggccuuggagucacccucagcagagaugauggcugccuucuucugcugcucagccuacagaagaggaggggagacugagauuacuccauagcguucauaucaagccauggccuaaccaggacaaagccaggccccuucagaggggaccuacuagguccccugggagcguucuucccuuacaauggggucaaaacuguccucccagucuccuucguucccuucauguccacgugucacuauaggacaugcuucucuuggcuauauggacauggucacuuauaugcugauccaaagccacggaaacagaaagggaaagcaggaaucaaaucaaucuuuagguccgucuuuccuuccagugccacgucaaaaugacuuccaucaaagccaggacaucccggugugguggcuaacaacuauguuagcacuaacguggcgauggcagaugggcggcucacugaaagccugaagcaagccuggcuuacacaggacauuuuaggucacccagggcuacaaacaaacaaaacaaacaaacaaacaaacaaacaaacaaacaaacgacccaaaaaccaaacagacaaaaaaaaaaaaaaaaaagcaagcaaaccuccaaaacaacccuagcagagcugggcuggguguagcucagugacacaucuccuagggauugaccucuggggcaccacaaauaaacaaauuaagcacccuaagagcagugacugcccuuugcaguuacccguagaaaacucugacuccggcauguacccaaagaugucucuggcucacccuaccaaagccagcaggacgacaucuaucaggauauaugauuuucagagcaugggaggagaguuuggcuuuaagacucugaacucaacacgcagccuucccucuugucaccgagcugcaucuuuagugcucaguucgaaacauuaagccgucugcucaacaaauguuuauuacacgcccaacaucacccagcagcacuagaccuguuaagguucggagccacaguagacacaaagggaaacauuccugccuacucagggggcgugcuccccacaaccaaaugccuuuucugcauuuuaaggauuaaacauccuuagauuaggagagcuaguggcaggaagaggcagacagcaaaaagccuuuacauucgccaggaagaggaggcuacuaugcacauacacuguguuccgucacucucugaaacaucuggguagauucgacaacaggggaaaaaaaaaaacccccaccaagcacaucuggcauguuugaucuccucugcugucgguuucacuauguaaccucgguguagaaguaacuccucagcgaggcugaaaacaugccagggggaacauguuuauguguaggagaggguuuuugaucuugggaaguaggaaguaagugacccuucagugauuuaggaccauaagcucauaaccccgacagcucccacagacucuggaacugaucggagggguaaggaccccucaauccucuucugcuuaucccagacagaugaccaauuucuaggccacccggcagaugggggagccaagcacuaggagggaaaggcuguuucugccaucugguugaacacucaccuuuuccaccacaaaucuggcucucuccgcuuccugcugagccaccuguuuggcuucuacugccucugugaacuccuucccgaaggucagaugugucuguggggagaaagugaguacaagcugaggcaguaauggcuuagacagcauugcugggagggcuccuggccacugcaaggaauggcgcuagcggcggcuggaggugcaagaagaugcccuuccaucucgguccccucguucacgccauguucacaccucugcacucuuagcccuucacacagugcuuacacagacuucagucacgccaugaggagaguggcaccuggagcuuugauggggcccagggacacuggaagggaucuacgcaaucaaucagcuccccagaggaaggaacucagggguuccaggacccccaucacugacuauugcucuuccaagagcuuuugaugccccguuccaagacuuggguggggggaggcagaugggaagccgagccccugagagcaggggcugcagcugguucccagggaugcgagcccgacggucucugcuuauggauuaaccagccccuuccuucucauagcgcuuccacccuagacaggaagacagaggguggccugcaagucacggcaucccugacacacacguaguucugguaaaggguuuaaaagaaaggcagguaaagccauuggucagggagagagccccagcuugaauguccacagaccuucccuaaucacuuaaguagcugggacuauuuggccgaagcgacucucugaggauaacacagaagagggaacagaccuuggcacucuaaaggucuagccuagagcgagucacuguacccaacuuuuuauugcagaaggcgcaggggcuggagagauggcucagugguuaagaacaccgguugcucuugcagagggcacagguuugacucucagugcacaaccaucuguaacucuagucacaggguaucuggugcaugcauguggcacacuuacauacacagauaaaacauaaaugugagcuaaaaaaaguaagucuaggaaaaaaguucacacggugcuaauuacuuuagguucaagugcgauuugcuucaccccucccccccaaucucugccuuguacaauacaagcaaaaaucuuggccccacaucuuucucacacuacacgucuuugggguuguuucuguucuuuuugugagacagucuuacccuguagcccagguaggcuggaacgcacggcaguuacaggcaugggccaauacgccagcuaaaucuuacccugcagcugcccaacucucccugauccacuccuggacucucaucugaagcuuggauucggaaauacaauccuaagaauugaaaagcuaaauguguaauuaaagaauaaaaugucuuucugaaagggccagcugagggcagcaaauuccccaggaaaucuaauuuucuucucacaccucuuagcuaugguuucuuguggucagcccacauuuccccaggacggagucuguggucagagucuagaaagaugccaaguuucucuuagguuuuuacuaguguguucucacugccaaggugcuuguguuaacugggagagccuggagcaaggcuugcugcagucgggggcugcaaccuggcaugcugccagaagagggagccacaugcccuuccccuaggagagacagaggaaggaggccgugccuggagggggaugcucauucagagaauggcuguuugaacagcugcacggaugcgaggggaagccuggccuuucuuucccaggcuggccacagggagaacaggaagcacucugccucguuaccugacaaaucacuccaagacuuuucccagagacucuagaaacacgaccccuuccccucaccuuggucugaaacacuauacuuccuauauugccuuccguugaaguuaugacacccagcuucacauuaauacagagaguauagucucgggaggugacuguugcuuacgccucggaggugucucccgcccucuccucugcuccaggcgcaggaacagucacucacuggccuucuauugccuuucaccagaggcucccaggacucccuugcugaggaaucccugagccaguccuacucuagacaggaaaacugccagucgcucccaggcugaccagucagccauucccugugcccaacaaagccuauaggaaucacuuucuagggagcgugggagacaguucagugguuagggagcaugggggcaaucagaguuaagaggacaaugugugcggcagacgaaaccuaaagaaugcucaacaaaagagaccugagacgguggcuucagacgcugagacguuuucagauuuucaagcccuacacccaguuaaguggacaugggaccuaacccugugugcccagaaacuaagccagucucugaagcaagagaagcagcccuucccccagugcccccgugaaccuuaccagggacacgucauccaggauaagcccaaauguugccgcucgcucugugaggucaucgcucaccugccuggagaccagcucucgcuggguaaucaauucuccagcaucgaaucgagccuggccacagagggauggacagaaaucuggucagguuacugaggaaggagaaacaagcggcacacucauggcuauaacccuccuacccacuacccccacacucuccugcccacccagccuccuacccaccacccccacgcucuccaccacccccaugcucuccugcccacccagccuccuacccaccacccccacgcucucccagccacccagcuaccuacccaccacuacucccaugcucuccuggccacccagccaccuguagguggcacccuguucacucaccaccaccgacuugaggaucucuguggugauagaaggcaggacccgcucaucauaguccucgccaaugcugguguagauacgaggaagcuggcuggccaccggccggaagaggauucgcagugugauauugacguucugcaagucuuaggguagggaguauaugggaguuagacacaaacacuauaggugggcuuuucuaugacuuuccuacucuaaguccacuauaagccauauucagaauuucaguuagacccuagaggagagagucuaguuccucagcagagcccagcauagcacucagcaccagucaggaaccacugacaggauggggauacauuagcgguucaguacacucugaaugcccucugaugagagcaguuuaggccaugugaccaaagaggguuugggacugugaacaccuuaagaaacauauaagcuaaugccaaggauucuagagugagccuaagggcuggcgugugugcuugcaucagagucaggggcccuggguuacugggaucugguggcaacagcauccagagucacugaccugggaugggguaccauugugcuggcacgaauggcaggacccagucuuagccaaacugaguguauugggcugugagagugaagagcaaucaugacagcaccuucgaguagacagcagacuacggcuagguuaucagacucauccagggccugguuccugacacccgagagaaaguggcaccucagcacacugauguguaaggauuucugauaaagucuaaacaaaggccauuaagccaauggcagggugaauucaaaaggcucgauauccacaugcauccaggagacagucagccccuacccacucccugacagcucaggucggugcagagcuaaagcacagcuaccacuagcaccaccagccccgccaugaguugggaguccugacccagccacucggagaagugggaaauucacaacuacacacaagccugugaucucuggacuugcccgucucuuuaacaagcaaagguacaaauacaacuuagcacaucugugagacaacagggacaggaagcccaagggcggaaaguuuagaagcaggauuuuaaguccagccucacucuuccccaucacccccgucccaccuucuauuuccucuugucaguaggcaagccaggcccagcacucugcaggagcagcagacagacguccuauuccccuccucucuuucugaccuaacuucucauucauaagguucuccaaucaggagguccgaacuggggagagcaggcagaucuccucugugcuccacacgccccuggccaucuccuccuccuccucuucuuccuccucacacuguuacugguucucaugcuugcccuccugaggacugaggucccccccaccuuuuuuuuuuuuugguuuuucgagacaggguuucucuguauagcucuggcuguccuggaacucacucuguagaccaggcuggccuccaacucagaaauccgccugccucugccucccgagcgcugggauuaaaggcgugugccaccacgaccggcagaggacugggguccuuacuaguucauucucuuuuggucauccugguacagagccaucgaccuggcacuagccuugcgcagcacaaggaacagacaugcccaggaacagcccugagggcaucgagugcugcgagucccacagaaucccucuucuucccaccaguuagcucccuuugcugccugcacgcugacugggaggggaaugcuaagggcuggucacuucaggccgaacuagaaauccagcggcguaucucaggcccagggcugcgaggcccagccugcgagagagcagucugaggucugcccugcuggagcagaggccguggaaaacaaggcaaagggaaagcugucagccacagggaaagcaagacaaacugccaaagacugguuuggacagucacucuggggaucaagaacugacgggaagggucaaccacagcagcaaaagacgcaguuagauuuccucaaaguuagaacuuccccccaaagauuuauuuuacuuuuuuuuuuuuuuuuuuuuugguuuuucaagacagggcagggcuucucuguguagcccuggcuguccuggaacucacucuguagaccaggcugcccucgaacucagaaauccgccugccucugcuucccgagugcugggauuaaaggcgugugccaccaugccuggcuuuuauuuuacuuuuuauguaugauguuuugccugcguuuaaguaugagcaccacaugugugcuuucuggaucccccugcagcugggguuagacccaauccccuaaugcugggaucugaacccagguccucugcaagagcaacaagugcucucgaccacugagccauccccccagcgcacaguaggaaacucuuaugcuaacccuuuagucgucucugaauguauccugcugccucuguuuaccuuugauauauuucagucuacacacacacauacacacaccccuccaggagagucacacuaugguuuuuuuuuuuaauuuuugaauacaauuuuuauuauuuuaugugcuuguguaugagugcacaccaucacacaugugggauccgaggacugcuugcaggacucaguucucugcuucuacaauguggguucuggagauuaaacucaggcuugguaccaggaucaauuuaccagccuacaauuuauuuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucuacaauuuauuuuuuuaaauuaaccuuuaaaauuuauugauuuaugcauuguguaugguguguguagguguguacagccaggguguguguagaggucaaagggcaacuugcaguuuucuucucuuaccgcaucugaccuaccagaggccagguugucagcuggccucucuccagucuuaaauuaacuuuuuaaguuaguaugcaaagcagugaguuuuauuacguuucuuuuccuuuccuuccguauuuuuuaaaaacagggacucacauauaagaggucagcgcugaacucgcugagcagccagagaugaccugcaacuuuagggacuggagcaugcuagguguggacucucccaaaugagcuacgccuccuccagauucccagauacccaggauggcguucucaugugggucacugugcuuugcuguacccccacuuccaacgccccagguacuccugccuaucugccuagagauuuucccucucccucccucacccccucuguuuguggagacaggcuguccuggaacucgcucuguaaaccagaccgacauggaacucacagagauccacccgauuaaaggcaagcaucgucacccaacuuuuuuuuaaaagacaggaucucucuacauagccuugcuuggccuggaacucauuaaguagacuaggcuacccugauaagucagagauucaucugccuuugcaaguccuggaauuaaaggcauucaccaacaucacacagcacagauauccuuauauaaggugaaguguaaccucuguauccuagaugucuccagaaugcgcacgacagcacgguauaccuccacaucucccuuauacagccacaggcaagacucaccuuugcuaccagugaugacugguacguuccguggucgagagcggcagucaaagauaauugguuucuguacccaagggaugaggaaaugagucccuuccccgaccacaauguccuguacgccacggaaucggucaaagaugacagcucuguguccagcauccacuagaaaggaauaauaaugacaggucagaaaaacccugucacucucuaacaaaaagaaaccuaucucuucaagauccuugccucuuucuuuucuguacuuuaacauuuguaaaaguucuuuauuuuacucugugugugugugugugcacacgugugugcgugccgugacacucauguggagaucacgggacaacugcagaggucaggcugucauccuugacagccaagugucuuuacccacugagccacccugacaauccucuccuuuacauuuagaaauaauuucauauaacugggggguggggugagguggggcagugugcaugccacgaugcauguguggacgccuagagacaauuuucuggagccuguuuguuucuucugucuuuacacaggcuuugggaauaaaccccaggucaccugguuggugcugugcgugguuucaagcuaagcuggugagauggccagcccccugaagaguucaaacuccugucccuuucucucacguauuagguuuccucuucugugcugucuuccugacagucacuuccugccccguaugucaccccagggacuucaguaacaggcagcccccuaggaaccuuucuccucuaaagagccggccugccuuugaauuucugaucaacuaccccaccccacccccaacucccaccagcacacuuccaggaaucaccuccccagaguucuauaaucggagaucauccugggccaacauguacauaccggcucuaacugaaccugauguucccagaagcaggauccuuauaggaacccuaaaacauagacguucccacugucuggucucuuuccuucuuucuuuuucuuucucuugagacagggucccaggcuaucguucagaucagcccagaacucagccucaucccuccccugccagcacugggaauauaaggaagcaaucacucugccuggcauccuucuguguuuuuguuuuguuuuguucaagauaaguucuuacucuguagcucggacugcccuggaauuuguucuguccaccagguuggccuggagcucaagaaaucugcuuguuucugcuuccugaggauaagggcuuaaaccuaugcacaaaucaccgccuggcuuguuuccuuuuuuuuuuuuuuucaagguagguucuuacuauguagccuuggcuauccuggacucaccauguaaaccaagcuggcuuugaacucaagagauuugccugccuuuaccuuccgagugcugggacuacugguauauaccaccacgggcagcuugcccaggaucuaauagcuguuucucuaacauuuggagguguuguggagaugucuugugcacccagggaagagccucccucccuccuucccucuccucuaacguuuuagagacaaggucuuacuagguagcccaugugggacuggaacucaagauccccagccuugugaacgcuggcauuacaggaguacgccaccaggcccaggcugaaguagucacuuccucucauuuccuguuugaauuuagaguugaucuaaaaaccuucacucugaaaauaacucaucaaaacaucauauagccaaagguccaggaguucaaagccagccugggacuacaggagacacugucuuaaaaacagaacagcugggugugggucugaguuacuuacaacugcuuuaguugagcuagguagacagguguacaccuuuaauuucagcccuugagaaguggaggcagguggaucucugugaguuucaggccagucaagagcuacaugguaaagauucugucucaaacaaaacaaaacaaaacaaaacaaacaaaaccaacccucccaauacaaauaaaacaaaaaccauacaggagguacaucaaaaucuguugcuguuuuaaaagaguaucagacuuagagggaaucuuuuuuuuuguuuuguuuuucuagacaggguuucucuguguaacccuggccguccucgcucuguagaccaggcuggucucuaacucagaaauccaccugccucugccucccaagugcugggauuaaaggggugugccaccacgcccggccuuagagggaaucuuaagagaaaaacuaguucaguccccuuguuugaccaaugagaaagcuggggacuaaaaggagggacucgcaaauaaggccauguaauacagucaaagaaaacccagcuuugcacuguggcaccauucaauaccuggcaaaaacuauucuccugggccggagagauggcucagcgguuaagugcaccgacugcccuuccggagguucugaguucaacucccagcaaccacaugguggcucacaaccaucuguaaugggaucugaugcccucuucuggugugucugaagagagcaauaguauacucauacauagaagaaauaaauaaauccuuaaaaaaaaauuuaaaaacaaaaaccuauucucucugcaaccagcugagcaaaacuuuucucaggacacagucucucaaacuggucuagagauguugccaagauacuucaugcaaauaaggaagagaaccaaugggcuccugucaccuccugucaucuggguaauaccucaucauuucaaaguggcuaaagugcuaaacauuggacaggagggcuccccuugaacaaagccucuaaguuaguggcuuucaaccugugggucagaacccuaugaggggggauguuaaaagacccuauuacaggggcugccuaugaccaucggaaaacaaaauuuacgauucauaaaaguagcaaaucacaguuauaaaucagcaaggaaaagaacuguauggugguggagguguaucaccacaauagugagaaacuacuaaauguuccaagcaucagaaggcugagaaccccugccuaagugaucauaggccucugaugacucacaaccaguaugugggguagcaggugagucccccuuaaccucacacaccuucagacagcagcuagcaucaggaaugucaaaugggcuguagagauggcaaagcgguuaagagcacugacugcucuuccagagguccugauuucaauucccagcaaccacaugguggcucacaaccaucuguaaugggauucaaugcccucugcuggugggucugaagacagcgacaguguacucauauaaauaaaauaaauaaaucuuuuuuuuuuuuuaaaaggaaugacacaugggcuaugcagaucaacagaaacuaugcagaaagcucuuccgcgccucaccauuauacaaagcagaguucaccacgccuccugcaacugccaacgccaggccgaacuuuccaauggacucaaacacuuuggcagccaugacuccuucuguugcuuccacucacaccuaaacacgggguaaacauaaaacacuuugacaccagauucucagagaaagcccgcucugaggcacagaguucaugucucaacauacauuuucauaugucuacaccugugggcccaaacucacucacugaacgccccauaacacugaccaccuugcaaacuguagaucaugucugcguuuguggacguguuucuuuacaaccauucagagaaagagucugcgacacuuggcucagcguaggaacggugcuuuguacccacgaggaacuuaguacacagaaaaaccacacucccuuuuccuagaccaauaggccacaagcgagaccggugcuacacggcugaagccaacaacaaaaagggcaauuucuguuaacauuuaaguuacacggucuccgacagccuuguuuaaccuucaguuacuuuaugaagguuaugacugcugaagugcauagagagguuauacucuuaaguaguagaaccaggguuagaaugagaagaccgaauucuagaagacauuguagaacuccuccccauaccaguuaauaggaaagcaggggcuggcaggggugcagcgaggcagagcggugaaggacuggagguggggcugcggcgggacgggugggggcacguagcugacaaacuagaaaccaguuagccuugaacuuuuuaaugucccgccccugcgucacccuugguacaauccucaaacucgcccuccccuuucucagacuucaacugcuuguguaucgggauuucuccaugcacauuuauccucugucucugacauccagcucuuuuuacuccaccagcuucuggauuuuuccucauccuguccccuccccuugcacauuccuaacuccuucuggaccgagauuucccccuucuccacuaggcguacccacacaugcaucccaugcccucauuguacauaggaaagcagaggcaggcuacagggacauaggaccagaggccucuaccgcuccuaccacgcuuaccugcuuucacucugaccuccacaugaauuccccagcuccggauacugcgcgugcgccaggcagcuccucccccccccccgacccccg

SEQ ID NO: 6307 - RNA, 1017 nt, Mus musculus
auguacaguuaacaagcaucuuuauuuucugguagcgcaagugugccuccucucacgucuugaucuuuuugagguugcgaugguucauucaaacugauccauucagauguuuuaaagagugcguggguugugucugcaagaggcaugcuuagagaauuaaucggagagucgggagaggcuccuuuugguuuccauggcauccucccaagggugagaaccuauagccaccgugccaaucacucuguagggagaccauaaugcgucagcaggcucccucgucauuuaucccacagggacgaacacaaaucccagaucuuaauccaaagaagauacaauacucccuguacauauuuuccacccgcggcgcgaugcagcuaaagaaauccuuagcgauuccugcccuucucucggagaaacaccucauggacggugagaaacuguacugaucgccugccagccugacuaagugacuguugucuaauugaaacacaaccucgcugggugagcaaugcagaaccaaaacacggguuuaugaccccuaaacgcacaagccucggggaaucgcucucuuguacccaaucagagguccccuggcaccacuuacccgccccccggccccguccggccacuucauucgcggcucacaaagcaauccuaccgcgcguucugcacagcagccaaucagaggguagggggcggggacuccgaggcgcggugugugcagcgguacucagacaggaaagccucgggauccuucggguucuuucguuuucccuccuggguaaaguuauguucagucuuccaucaacucguuuauuuuuccgcccgacucggcgcgcgugcgcagugccucccagcccaggcuguuccugaaauguaaucguguugagacacagggagggaagcugaacguccauucuacaggucagugcauucccugcggaggcucggguugguugcuacuuccugcaggccccaaaacagggauucuaaggccaaaaaaagguucagugaggu

SEQ ID NO: 6308 - RNA, 1017 nt, Mus musculus
accucacugaaccuuuuuuuggccuuagaaucccuguuuuggggccugcaggaaguagcaaccaacccgagccuccgcagggaaugcacugaccuguagaauggacguucagcuucccucccugugucucaacacgauuacauuucaggaacagccugggcugggaggcacugcgcacgcgcgccgagucgggcggaaaaauaaacgaguugauggaagacugaacauaacuuuacccaggagggaaaacgaaagaacccgaaggaucccgaggcuuuccugucugaguaccgcugcacacaccgcgccucggaguccccgcccccuacccucugauuggcugcugugcagaacgcgcgguaggauugcuuugugagccgcgaaugaaguggccggacggggccggggggcggguaaguggugccaggggaccucugauuggguacaagagagcgauuccccgaggcuugugcguuuaggggucauaaacccguguuuugguucugcauugcucacccagcgagguuguguuucaauuagacaacagucacuuagucaggcuggcaggcgaucaguacaguuucucaccguccaugagguguuucuccgagagaagggcaggaaucgcuaaggauuucuuuagcugcaucgcgccgcggguggaaaauauguacagggaguauuguaucuucuuuggauuaagaucugggauuuguguucgucccugugggauaaaugacgagggagccugcugacgcauuauggucucccuacagagugauuggcacgguggcuauagguucucacccuugggaggaugccauggaaaccaaaaggagccucucccgacucuccgauuaauucucuaagcaugccucuugcagacacaacccacgcacucuuuaaaacaucugaauggaucaguuugaaugaaccaucgcaaccucaaaaagaucaagacgugagaggaggcacacuugcgcuaccagaaaauaaagaugcuuguuaacuguacau

SEQ ID NO: 6309 - RNA, 1305 nt, Mus musculus
auaaacaaacaaaaaaauaacagagugcgggguguacacaccuguaaccccaaagcuugagagaagaaagggggaaucuggagcucaaggcaagccagccacaaacauguaagagaguuuggaaaauccuggcuuacgcgagagcaucucaagaaacaauaagacuagguauguaacuggcuuggcagcgugguugucuaccacacagaagggccuggauuugauucccagcaccacauaaacuguacuuagagguucauuugacuguuaucccagugcauaggggguagaaacuggagacacacaaguucagagucugaagcuagccugggcuaucuacgagccuguaucaagcaaaacaaaacuccaucaguaacagacagaaugggaugguacugugguuuggaucagugucccuaaaggucgguauaguguaggcauaagccacuguugugacacuaggagguggaucccuuagaaacuaggauaugaugggagguguucaggucccuuugggaaugccuuuaaggugacaguaggaucagccgcuuccuagcuguaaaguaggaagcuuuaccauacuaugcugccucgccacaagggccgagucaccacggaauggagccuccaaggcugugagccagagccuuucuuuuucuaugcugucuuggguauuggccacaguggcaggacacuggcuuuguguucaugugugcaaggugagcagugucagggaucuuucucaagucgcucuggggucaguggcagugggggacucuauugggugcaguaaauaggcagguaauugucgaggcucagaaacuggcacacaggaagcaugcugggggaagguuuugagagggcgcacacaggaagcauccugggggaagguuuugagagggcgcacacaggaagcguccugggggaagguuuugagagggcgcacacaggaagcguccugggggaagguuuugagagggagugaugcucuuuuccagcaguuugugaucagaagacagaccuguguccaccuuguggagauaguacucugugcugguguacgucacaugcugaaggaugaaauucaggaccuuccgaugucugguggaaauggucagcugccucuggccucugcccugaaccucaucaucuggcacaucagcaaggguguucaguguccccagagaagcuuucaggaugaccuagacaugacauuagaagcacacacauauuguuguacagcugucagccaucccuauccaucucuagaagcccuuuauccuacccaauaaaacguuauuccca

SEQ ID NO: 6310 - RNA, 993 nt, Mus musculus
uacgguaauuuuuuuauucguuuuguggagacugggcugcccaccccaccccggcaaacugcuagcgacugacaggcgggggacugccgagacagacaaagagaagcugaggacucuggggucuucaggagggggucgcaggaaccgguuauuuaaaaggaaagacgccuuuccucuacguuucuaaguagggggucacugucuuucccgcuacaccgcuagacuucgcuggccucccggguccugauucaggggacccugagagcgcgggaucgggaagcugcggacacgggacacgagagacagcgccugaaaacgagggacccgcaggaaaucauguuucgggauccccacuggagaaaagcuggcuugcacccaguccagcugcuggaugacaacacuccagcauccuugggggaaagccugcacgacccggcucgagagcauccucgaagaucaacugggugggggaaaaacgacgagggguggucgcaccaccgaucgaccccgaaccggagggguuggcuucagaagggagggaccggguugagcuccgaggucccccucgcccuccccacgcaaggagcggacagguggcgucgcccgccugcguccgcucuacccgcgaugcacugagcgaugguccaugcgcaggcugugggucucagaacuuaguuuuggggugcuggauuuuggaaggccgccgggggagggggugcagaggccccgcccacguccccaggucagcccggggcggggaggggguaauuuccgcuccgcgcuugaggaagcgagcagcgggggagggggcugcggcccuccccccuccccguggggagggggaaguggauccgcccaggucccuucccuccgcuaggaccgacgcguuccggauccucaggcuccgggagcccgagggaaagaccggacugggcgaggggcgacacgugggcggucgcaccccgucugugaggugggggagggggccgcgcg

SEQ ID NO: 6311 - RNA, 18300 nt, Mus musculus
auuuuuuuguucccccaguauuuauuuuuagaagugccuucacauuucaucuguuuuggaggaagccucuuuuauccagugaggauaaccugagcaacauguaaaaugacuuguguaaaacaucuagacucagggcugggccaagauguagcuucuuguggcuagccuuauuauagcugugaaacaagucaccacuucaccaauucaagcucuuccucauuuccuuuccacccuagcagacuuugcucugugacuugucuugcagucuucuaugugaaggaaacugaagucugguguuagguagaggaaagcaagcggugcacuuaacuggaacaguuccacugcaguucaguaauuuguccaaauuccuuacuguuuccugaccaggucaagguggggaauugcugaguaccuacccuguucuuuuauauacacuguccauuuguccuuacagcaaccgucuuaagcaguuaucuggcucaaaggggagugaaugccagaggcagugccaaagcuagagccaggcucuacuagcccacguuacccuaucauugcacucacaguacaggcuggcaggacagaacaugcacugguuauuucuuucugcacucaugaucaaucaagaggaaacaccuucuguuagaaagcaaaauucucucacagcauuugaaugagaugguaauggaaacaaggcuuuuuagaguuuauaacccagucuuacaagcuugucagaucugugcugggucaauaucuggacacaaauacaguggcuuuuccacacugacauccuguagccugggcccaucuugacucccaucugcccucacaggacaugcucacgcccaaucuugaaagcuacuuuugguauccacucaggguuaguuguucugucauugacugcugagaguauagcccugcacuuccaaaugauagggaacccaccacaaguaguucuuuccacagaugcaucuacucagcugccaaaaaacuccuuccugacagguuggcccaggugacuccguuucuuuacacaaacccucccacacccacaggcgcuuccuccuucugccaaaacaaacuuuauugcaccaaaaaggaaaaaaagaaaacuucauuuauguacagucagauauaaagacaucucuuugacuccugugcauauauuuccucaacuuaaaaccagggcauaaaagucaggcugcuaugccggacaugcucugccccauggcagggccaaggagaagauugucacuugaaagugggaacacuuaauggaugacagacaacacuggacccacagaccaaaggcauccucagcccuggacuagcucugggaauggaagagggaaauuggaagcagaguccccuuucaaaccuccacaugacccagccaccauguagccaaaacaaaacugcuccccaagugaccugucccuguccaguucucugcuuucugcccucccaagaggucccucuuugugcccuaucuucucccuaucucugcaagggagucccaugauccacaagucagagaccuuuauagcagcgggcagggcagguggcucucuccauuucucagggcuggacacugaccagaaggccuguaucauguggaucacuaaccauccacuggaagccagaacagcaacccugaaaagugugaacuguaucaaccugggaaggauagguucuucuaacccagagccacugaaaacacauauccuuacucaaccagcugaagggucacuguagcuaaauucaaagaaaggaacagcuccagugacaaagagggaaagauaaagggagaagucuccagagucccagccacaaucccucgagccauuggcuguccaugcucacaaauccccagggauggggguaggacagaagggaggacagggacuacagacguaacagcuaaacaaaauagggacuagcauuagucuuaccgugcuccaccccaagaaaaccacccucauugacuacuauucaggacaaucuguaagagacuauuuuauguaguggcucaaaucccacacaggcugcagcugccugugcugggaaccuuucaaaucagugauuguggggacacagugagcagcuuccugacgcccaugcagacuucacagagaccugggcucaguuccagcuggcuuaccuucuaccuguaaccuaaaauucggaggaaauggugugagggagaaggugcucaggugcuagguaaagcuuacugaucagcagcccagacuccaccacuguuccuugucuuuggucugucuagaacagugacuauauaaauuaggaaaaacaaaguuaugcuggcccaugggaaauaggggaggggaagaaaaggguguugggaagcccugcuucaagacugaagacaaacagauaaccaaccagacugcuuaagugucauggacagcacccccacccaaacucccagauaucccuauaaaccacuugggcaugcucccucuuggguucucauuuucugucuucuccuaucccuaauuagcuggcccugcagagagguguguugguuguuuagcuuugccagaggccaucacuccagguacuuucacaaaaguacccuggcccugauccaggauugacuguugcccuaggugcuccagcaccaaagaggucagacugggaccagccccacccccacccccugggguugagcuugcuugcuucuugccaccuugcggacaccuuugaagggagaugcacagugccucuccgucccuggggcgaggggaggggcucugcugggacucucgaguugggggaggggcaggggagcagggucuagacccucaggcucccaugaaggucugucucugucccagaggagcugcuaucagaguccauuucagcauuuucauuauggagccuuuccagcacuuucugucgaaucaguccgaggcgcaucaagagggacugguagucaaaguggccccgcuucucuccaaaaggguccuguggaagaaacaaauaaaaaauccacaaggggauguaagauuuaagucucuaguauagcuuugaaaugcaugcucaccuucuggcacagaggaaguacaggugguccaaaugguuccaaauaaaauaguguauuacuaguagcuccaaacaggucuagcuugggcuaacacuaaaauagguuugcaauccgaaaagaagccaauaugcaaaagaggauauggggaaauucaaugaaauaucauaaucauugggugagcccgugcuuuccuuuuaauuuuuuuuuuagauuuuauuuaauaccccccacccccaccccagacaggguuuugcuguccugaaaaucauucuguagaccagucuggccucgaacucagaaauccgccugcuucugccucccaagugcugggauuaaaggcaugcaucaccacugcccagcuauuuuauuuaauacguaugaguacauugccuacauguauguauguauguacauguauauauguauguaugcaugcacaggcagcucaugugguaaggugcccauagaugccagaagauagauucagauccccaggaagaaaaguuacagacagcugcuguaucaggcagccugugcuuuuaacugcugagucaucucucuggccugagggccuguguuuucaaccucugaaaacucaagaaaauaaacucccuccauauucugucuacacaaaggauacucugcuuuucuaaggucacagauagguguaaaagucaagaguacggauuucccaaugagcagucagugcucuuaaccgcugagccaucuguccagccccuacucuuucuuauaugaagccagaacacacuuccucaguagggaauaaacuaguuacuaccucuaaagcaggaaucaacaucgcacuaugcacgacugcuacccuaagucaccuuucucuguaagccccuagggucagggacagaaucgcuacagugacuguuuuaccacccuugauguuuugagcaggcuagauauucuuauaagaguuuaaaggacucuccuagaaaggaaaggcuuauaauguauguucuggaacagauaauuccuacuugacucugaguaugacuagaaaccaucucuucauguucuuaagcaaguuagucuuuucucuggccuccucucuacuugugacauuuuaugagauguggguguaaccugugugagggugauuguccaugcucuguguggggcuuagaauuagcaacaagagaaggcaucaccaacccuguuuugaauacaaacaaacaaaaaagagagagagagagagagacaauauuaccugcauaguuuggccuugaagaugcaggcgaucuuugcaggccaccucauagaagucauaauacuccaggaaggacuucuccaucacuccccuggaaauuaaacagagcagugggaaacaugaggcacgggucccuccuucacauccccccucacccccccaagauaauguuucucuguguagcccuggcuggccuuaaacucaagagauccaccugccucugccucccaagugcugggauuaaagguguguggcaccacugaagagugaacauucuuggcuggguggugguggcauugcacuuuuaauccuaguauucaggaggcaaagacaggcagaucugagccaaccucaucuaaggagcacagagaaacucugucucagaaaacaaaugcgcaugugcgcauauacacgcacucgcgcgcacaugcgcgcgcgcgcguacacacacacacacacaaacacacaaacaagugagcauucccagauucagauuuagcuccccacacacacuuuuaaaagguagacaacaggaguccaggacagccaggauucuauggauaaaccuagucuccaaaacaaaacaacaaucaaaggggguuggagagagcucagcaguuaggagcccuggcugcucuuccagagguccugaguucaauucccagcaaccacaugguggcucacaacuaucuauaauaaggucuggugcccucuucuguugugucugaagacagcuacagugucuucagcuacucaucuacauaaaauaaacaauuaaaaaaaagaaauuaaaaagccgggcaugguggcacaugccuuuaaucccggcacucgggaggcagaggcaggcggauuucugaguucgaggccaccccaagaaaaaacaaaaaccaaaaacaaaaaaaccaaacuaaaaaaaccaaaaacaaaaccccaaacaauaaaagaaaaaaccaaccaccaagcaggcgcuaggcaccagaacagauggacagaugacugugaauagcugacgucucugauaauucuauaaucacugaaccagagcacuucagacacuacuugaaucgcagccucauuucacuucaugcucauuguucacuguccucacaaauuucaaaucacaagcaauacugggaaucuuuagaaugucuguggaaauuccagucaucuaagcgccuccuuacaagcagaagacaugagcucagauccccagaguucacaguaaaggugggugugguggcacauaccugcaaccuacacacuggggacacaaacaggacaaugucugaacuugcuggcuagucaaucuaaucacuggaggacucuggguucaguaaaaaacaucccaaauagugagguagugagcuggugugacucagaagguaaaggcacucgcugcacacgccugaggucaauccccagaacccauggaaagguggaaagggaaaaccuacuccacaaagcugaacgaacgcugaccuccacacaugcaucauagcaucucuccccaguacuuguauuacaacaaaaaguggauauagagaaaaaggcaccugacauugaucucuggccuucacaaagcaugcacaaauguguucauacacauuaaaagaaaaaagaagcaaaaaucaaucaaucaaucaaucaaucaaucaaucaaucucgggcuagagagaggucuacuggcacagaagaugaaacuuugguucucagcacccacaucagauggcuuacauugccugugaacucuagcugcagggcaccugacacccccuuuucuagucucccuggauacugcacccauaugaauguauucacacagacacauacauucauguaacuaaaacuaaaauaaaaauaaagauaagcauuuuggcauauaucuuuaaucccagaaucaaggaagccaaaggcaaggauuucugaguucaagacuagccaggucuauaaaauaagauccugucucaaacaaauaaaaauaugaaaagaaaauauccuccuuggggcugaagaaauauuuaaguauuuaagaacacugucugcucuuucuagaagaccuggguuuaugucccagcacacacacagcucacaacugucuguaacucuaguuccagggaaucugacucuggguacccaagcucuggaacucacuuguagaucaggcuggccucgaacucagaaaugugccugccucugccucacaagugcugggauuaaaggcgagcaccaccaccgccuggccauuucauacucuuuuuuuuugguuuguuuaaauuaauaguuuuuuuuuuuuaaagauuuauuuauugauuauauguaaguacacuguagcugucuucagacacuccagaagagggaaucagaucucguuauggaugguugugagccaccaugugguugcugggauuugaacucuggaccuucggaagagcagucaggugcucuuacccacugagccaucucaccagcccccauuucauacucuuaaagaacugagaaagccgggugugguggcguacaccuuugaucccagcacucgggaggcagaggcaggcggauuucugaguuugaggccagacuggucuacagagugaguuccaagacagccaaggcuacacagagaaauccugucuugaaaaaccaaaaccaaaaccaaaaaaaaaaaaaaaaaaaaaacaaaaccaaaaaaacaaaacaaaaaaaccacccaaaagaccugagaggcccaguggcgcacaccuguaaucccagggcuuggcaaguagagguagguggaucucugcgaguucgaggccagccuggucugaacaggagguccaggacagcuacagcuauacaguuagacccugucuggaaaaacaucccucaucuccccaccccccccccaaaaaaaccaacaaacaaacagaaaaauucuagauaacuucuugaguaaccacagccacuugcucuuuaaaagcaugaaccaaaagaacuaaacuagcaugaacuagacugggcacaacauuagaacuacaaaggcagaggcaggcagaucaugaguuccaggccagccuauccugauaguuaaaauccugugugaaaacaaaccaaaagagcugggcagacaguuugguaagcagagugcuugcuaaguaagcauaaagauccaagugaagacucccagcacccauguaaaugcugggcauggcauaaguccauagccauaaugcugccagggaacacacagggggaucccggcaucuugcuggcagccaaucaagcaaaaguggucaacuccagcuucaguaaagaauccccaucucaggccagagagauggcucagccguuaagaacauugacugcucuuccagacauccugacugcuuacaaccaucuguaaugagaucugaugcccucuucuggugugucugaagauaccuacaguguacucauauacauaaaauaaauaaguaaaucuuaaaaaggagaggaaggaaauaaaaaagaaucuuugucucaaaaaauagagaacaagagagggagaccccagugcugaccucugugccuauacaaaugugcaaaacacacaaagcaaggagcagcagauaaaaaaacaagaguuuggggcucagugguaaagugcuugcucagcaagcauaagacuguaggucuguggggcuggugagauggcucaguggguaagaguacccgacugcucuuccgaagguccagaguucaaaucccagcaaccacaugguggcucacagccaucuguaacaagaucugacucccucuucuggagugucugaagacagcuacaguguacuuacauauaauaaauaaaaauaaaucuuuaaaaaaaaaaaaaaagacuguaggucuggagccaggugugguggugccuagcuuuaaucccagaacucagaaggcagaguaaguuccaauuccaggacagccagggguacauacauacugaaacccugucucaaaacaaaacaaaaaacacaagcaaauaaaaaaagaauuaaaaaaaacccaaaucgaucuuucucuuucuguucuaaguuccuugacaacagacugaugcaaaccaagucuucaaaauggauggacacauaccguagggguucagggcaggggcacuugcccuccaucaugucacagacugcaacccugauggucucgugccggauacauucauuauaguuuuugcugucuccuggaugucuuuccuguaauuugacagauggguaguacccuuuuagucaaagagaaaagcuaggcaaagauaccucaggguuaauucagaguacaugacccaaacacauacagugaaagaaugaaagaauaccuuucccacuguaaauccaagacaacuaagccguggaccccugaccucccuauacauaaaaauaccccuucuauuauaggucaaauaacuaaacagcaaacucgauccaucagauuauucugagucucaauaaaaggccuauuaaguaaagauuaauggggaacaaugcuggagcuaccuggcuaauuucuuuucuugucuguagguuccucucucucucugaagugcuauaaacuuaucaaaggaacaaucuuuuuuuuuaauacuuauuuuuuccucuuuuuuuaaagauuuauuuauuauuguauauaaguacacuguaguugucuucagauacaacagaggaaggcgucagaucucauuauggauggucgugagccaccaugugguugcugggauuugaacucaggaccgucagaagagcagucagugcucuuaaccacugagccaucucuccagcccaggaacaaucuuuaauguuccaaguaaagagagucaaaaguugggagauagacagaugcaaauaaguuauaaggcacuuugguccuaggguucuauuccaaauaugcauguucauaacuaacacacacacacauacacacaccaucugggaagaagaaaauguaacaaaaacaaaacaaagaagaagaaaaccucuaucuccgcaccugaaaauuaggacaauauuuaccuuguugucagcacaaauauuaaacaauauacaaauaggacuaacacaaccuggcauacaguggcaaauguguauuuccuacacccuuuucuuugcaguaucaacuggaauauuccugucuuaacuaaugacuagcuccuuuaacuaugcaaauaauuaauuacccaucuuaucuccaaaauaauagauagcucgagugacagaggccugugauccccacuauugggauauaaaguucaaggucuagaaggugggagagauggcucagugguuaagaacacuugcugcucuuccagaagacccauguuuggacccuagccccaauaccuaucagcucacaacccgcugcaacuccagcuccacguuauccuauauccucuuccggcuuccaugccaugugcauaugugcaugcaugcacaccauguaacacacacucaaguacaaguagcaaaaguuuaucuuaacaaaaaaaaaguucaaaggcugcuuggaauauagagaauucaaggccaaccuauauaacuccugagaaccuguuucaacaugaaaaacucaaaggguuagggaaguagcucaugguuacguuccauaaauucaauccuugguauuaugggggcgggggcggggggcuagcucagaagggcagaagucauuacagaucaccuuaaggcuauguucagacugcagacacacucaguaacucauuggcauggagcuauagaaaugcucaucaguuaagggcgccugcugcucuuguagaagaccaggguuugauucucagaacccacauggugguugaugucacuaacuccagucccacagaaccugaugcccucaucugacucccuucgcaucaaguacucacaagguacacaaacacagauacagaaaaaaacuaccuuuauacauagaauaaauuaaaaaacaagacaaaacaaaauccuaaaguaggcucaaaauggauuuccaaaugacauuuaccuuagcuaaguaagcuaacacaugccaaauacuuaaucuuauuguaacauuuguuuguuuccuuucuuccuuuuuuuuugccuuuugagacugggucucacuaugaagucuuagcuggccuggaaaucacuacacagacuuuaaccucaaagagucacuagcuucugccucccuaggacugggauuaaaggugugcaucaccaugcccagcugauauugcaauucuugcaaauaaagacuauuuaugggcuggugagauggcucaguggguaagagcaccugacugcucuuccgaaggucuggaguucaaaucccagcaaccacaugguggcucacaaccaucuguaaugagaucugacuuccagcuacagugcgcuuacauauaguaaacaaauaaaucuuuaaaaaaaaaaaaagaguauuuaugucaguuuccuuucucucuauaccaguaucauaugggagcuauccuagguagaaaaaaagaaaagacuuucugggguagcucagagcaccuauagccccugauauugcaggucucaauaaaauugcacaaggcccaacagucuuuaccuguucaaagccugguucguugugguagggauucucagucaucagggacuggauggagauaagcacagaagagaugcucugggcugggcuccaggcagggccaguccacguacugcaaacacagcagaggaagagggugaugcagagaacagucaaugagcccugacagcagcagcauccuaccauuaacgacucaccguaaguugcucuuucacuauuaacacuugggaaauucccagccucugguuuacccucacucaccagaauagucaaaugccuaaauucucuuaucaaaugagagagaagaaaacagagagcaagcaagaaaaacaacuuugaaaauucuauuugaucuagaaaagaaacaaguggccaaggaaggccauccuaccaaaacaggaacccaaguuagggaaaauaacucuaaaggcugucuaaaugcuagccugugacuucaaagagcuuauaguuaguuauuggugacaggguuggugaaaggagagcagcuaaucaaaggcauaaaggugacugaagcuacugccuaugaggauacacgcugaaguuuauagacucagcuuuguaauaugacaagcagagucaaauucucugaagacacacaacucuacuaagacagaaacgauggcacauuuucagaauguggagggacaauaucuaaaauaacagauagaaaacuuaaacaccagggaaaauaucccacccccacccacucccacuuuuaagacugggucuugguacacaaccuuggcuauucuuaaauuuaaaagcaauccuccugccuccgcccuuacaccacuccuggcuaaaccacuuuagguauuagaguggggcacuugaacgucaaugccuuccuuccucuauuuauuuagagacagggugucacuuacuaauuaauuaauuaauuaauuaaagguagagugucacuaauguaacccuagcugucuuaaaacuugcuaaguagaccaagcuguccuugaacuuacagaaaucuguccuaccaugcaugacagguauuuauuuuagcucaauuaauuaacaagaugguaugagagauggaaacagaacacaaccuuagccacgacuggcuuaaguuaacuaaccacuacccuuucacuuguacacugaaggaagacccaagucuggauuagaaacugcagcgacugcucucuuccagugcuguugcccacuuuccauacagcaauucccaucaacaggguuaguucucacaacauuucagcagcuagucacccugacaguuacuuccagcuaugaagagaggggauuaggccaaaaagcuaauauagccaacuaaaacuacauaagaaccuucuuacuccaggacucugaccuguaaaauuuguuucaggguggaucucuuaauaccgugcaacaaacuucuguggcuuucacucaaauacuaucuuuguaugagcugguauccaggauggcuucauaauagcuuacugagggaaaaccuacuacacacauacuuucaagaacaaacuucauaccaaacccaugacuuaacuuccauacuaucaagggacacauacacacacccaaccccaccagcaaagauacuaauguagccuaguaagaugaaggacuuauuauacauaaucuccuucaauggaacuuuccagcugcuauaaucccagaagaguauaccauaucucuagauuugagaguucuagggaaagagaaagaaagaaagagagagagagagagaaagagagagagagagagagagagagagagagagagagagagagaccccacauuucuaaugugcuucaguugccuuucucauacacaauccuagaaaugugcuggaugcaagaaacaaacagcaucacgaguuacagcaacuuccucacuauucaacccagauuuacucucuaccucaaggaaaccuggacugcaaaaggauccaaagcaggcuacaagacauucuucauucugaauaucuuacaaguaucuugauauggaaugaguaagaacuccacaaaguaacuucccaguaggaccuggaggguauacgugacacccauuucauuucggguauuauuuccaagcacuuaauuuuuuuuuaaucaacuguuaaauucucauaaucauuauuagcaccacugccuccagaggcgcccacuaagaggcuccaaucagacacccauugcaugaauacagcagaccuggggucuuucucaagccucuggggaaaauaaggaccuaauguuuccuaagggaguaguucucaaaggggcauagagcauaaccauccguacggccucuaaaaagcagacggcugccacaccccagagcuugagauacacuuguaggaugggaccuucaaaucugcagaugcugcuguggcaggcagcucaaaggcugcacugaguaaaccauuuccuaagacacucuuacauguaauaacgugaucuucuuccuuuccaucuagaugacaccagucacgugccacccagagaacugaauacucaaucacacugugcgguggguucagaagaggaacccuaauugaugaaggcuguccuagagugauuauuugcuaauaccaacuuggccucuuacaagucucuucuuacccuagaauacucaagcagacuuucccauugcgguagaaguugggguuaaaccucacuguguuauugcccguugucaucaguuugacccgagguggguggaugggauagucagguggacaccgaaagacgaacaggaagaaacccccuucauaaggagugucaaaugggccugugaucaaagcaugaaucugcaaaauaaaaccccaucucaaaauugugaggugaugccccaccacaaccccuccuaguuuccaccugcuccccccaccagaagcagucaccaacagcaugcauugccugguguuuauauuccacauccuccccagacacaaugaaccaccugggcucacucauguacauaggucuucaauauaaggaaaucccaucauaguggaguaagcaucacacgccauacucagagguuauauucaaaaguuaauguccaagguaaaaagugacccuugucaauauuaccuuaaaacaaguuuuguuuuguuuuucccaccagaccucccugauugguguuaaggacaacaauuggaaccuaaauauaucaacuauacagugugaaauuaagcuuauucguuuaggaaaucaguacauauuuugacugagaugcuuggauuugccaagguuaaucaugcuuaugaugcaaguccauucucugugugugagugugugugugugugugugugugagugugugugagugugugugagagagagagauaagaaggggaaaaggggagaccagcgccaacaacaaugcagagcugauaauuacauggaugcaaaggcugucugcuugcuuccuccagaggaucaaaacuaccgugucaaagauacaaauaaauaaauaaaauuucauggucuacucauggccaauagaccauccccccaaaaguuucuccaacacuguuauaaaauaaauaaaucaguauuccuuaaaacguaacacuauguucaguucucuucuuccacaagccauaauuauuccauuauugaacacaauuuuucuucaagaacagaagcaaaccugagcugacucaauucuauguuuuuuuuaaaaggcucguaacuaaugauuuaaguaugcucagaauuuaaauagcaagagggaaaaagaccguguacucucaugccucaaaucuauaauccuacucugcccuggcaacacaguagguuauauucuagucugcaaacucuggaaauaguaaagucaacuggcaucaauuucaaggccucagagaugagcauacccuagcauuugaauggagacaguaugucaccggaaaaauauuuccaaccacaugaaaagaaauaauaauaauuuaaaagaaagucuauucaaaauaaaaaagucuguaacaauauauaagcugaguuuuuacuuuaggaaaucugaacucacugguuuuugcuuaaaacccuagauuuagguuaucugaacccccccuccacaucaguuuauguccaaauucacucccaagaguagaacauuuaaugacagagaagccuagguauaaaugccagaggaacacaacuaucauguauaagucuccuauguggaggacaagagaggacaggucucugggguaagagauacuacaaagaccaagaaucggcagcaaacacuucagccaagccggccuccugcuucccugcccugcaccugacuugcuacagucaaaaucaagaugcugagauggaacagagacagggaguacacuggguaggugaccacauguaauaccuagaguggagcagcugagaggaaagaguggucuguuaauagcuaaacuggaacaagagguacagcuugucaaucugaggauuuucuaagccuaacaauaccuguguguacccuaacaacagaccuauuuaaaauucugcacuaacucucaucauauauaaccagccacuuacuuucuuggggguuugauuucuucaucgguaaaaucagagagaagagcugaacuaauauuuuuuaggucuuuucaauuuuaugggcccaauuuuugcauaauuccccugccccuucccccaucaaguuaccuaccuuagucaugucaacagugucgggcacaacgaacauuccuggaggaggcuccuuauaaauggacaugauaucccuguauaacaccaagaggagguaggaggagugaggaagagggaaaucccuugagggggacaacuauuaucaccucagugagcccaggguuugagaaaguggugcuugguacugaaaauguuugcacugucuccuuggcugagaaaucucagcugaauacuugucaggcaggcagagagcaaauuauuaucaaagggucauuguuuccuggggaggggggggggacucagagaggaaaaauaagccaacaucccaaugguaucagaugucacccuggaaaagucacauccuauauacugucacuucuucccacaugaaaacucauuuacuucccaucucccagauucccagguacuacaacugaacacagagauuuucucaauugggagggcuucauuccauucacuacaaaacuuacuccauaaaacauauggguucgcuuugcugguaagguaaggagacagcaugaagccagcgggagcaagucuaccaugaccuguguguccaggaaacuaauaggauaguuguuuugaggaaaagggaauccucugaaauaaccagaaucucaucucugaaagaugacauuuaguaacuaggaugaaugaaacuucugggucaguaaucaacuagaauggaucaguugagaacuggcucagaagaagucaauuaugaggaagucuggggacacagaaggguagccgaacaaagaaguucguccaggccaaacucaaagcuguauccagacuaagagaaucaaacagcuaaggaguuaaguuagggguggcaauaacugugaaguuguucuacguccggcacugugccagguacuuuacgugcaugguguaguuuuuuuuuauuaaaaacuuggaaaauauguagccgggcagacaccugaggggacuuggaauguuugggauaauagccagauaagaggcuaagaugaaaagacuaagucuggucaccaggaaacaaguuucaaaauuaauagcucaacagucuuaucuuuugccaugcaauugguaccauacuaagugagcacuuuugcaaaacauauuuaucuaugaagugauacgaucuaagaucggucacccaagacacaagcacagacaggcccuaggccuuuuguuccuguauuugaagggaguacaucugcuuuacaaaaguaaaccagacaaccuuggggguaaauaauaggaaaaaaguucuugacuaagauguuacaauccagagugauagugagagaugguaggaacgcagaguuucagggacaggugugagggacaguuuuggggugauuggaaaggggguucaagaaaugaucuggaaagucagggaggcucucuagacccguggaaagggccauaugguggggaaacgagguaaggaaagguaaaaaggaagacugacucgagucugcaacugggcaaugcagguagaggauguuccaagcggggacuccagaagagauggagaacugauggguggggccugagggcagccuuuagguaagcuggugggguagguuagaggggaagugcgaagggcgggaccgagcguuacagaagagcaaaagggucagguuucgggugaacgggaggggguagggauaaggcauccggaacggagcugcagggcucaccggaggucgcuaaggggcgggguaggcccgagggcaaucgcggaucuguuugggcuguagggccgggcgcugagagggcgggagggagggaaagggcgacacuuaaggcccccgucaguagagaggcccgcaggguuugggccuggaagacgugaggcgggagagagccccgauggggaaagguggggggcggggaaggucgagcccuggagcuccggggugagggaggaaaaacccccggcucaccgcuuaauccgaaguagacacuguggcgcgguucgcucgccgucccaguccgagcugagcguggggucccaauggcuaagcagcgcggccccgugggcagcggccgagggcgggaguccuggcagcggagccaggccgcuccccggucccccggccccgcccgccgccgccgccgccgcccacacauccggcagaaaaggcggcccgaacccgccgccgcucccgcuaacgccgaccacaccggcaacaccacucgacccugggcccgccgccccggcgccagccgucgccgucgccgccuccucagucggacucuccgccaucgcugcuucgcuuccgggacugcucagcagcacguccgccgaccagagcggccgcugcucccgcaccaccgagagccgggccagaguguccccacccucggcuuccccagcccggguggcgcuggcuccgcccaccuccgcccggaccagcgagaggcgugcugccagagcguccacccacgguccuccagagcggggggcgggggcuagcggacuagcuggcgcuccaggccagcgcagauucugcgccccgcuggagaugcugguagccuuccaugguuaaagguuuuauguugggagaguugaugucggagaagacaguucaaagaagauggagagacccacagcuucucuuuuaaagggagggaccaucgauguucaauccuaggguaggacuaagguccaccuucccuguagggcaaucgaaagaagagcuugaguaguuuagggcccuu

SEQ ID NO: 6312 - RNA, 668 nt, Mus musculus
ccugccucugccuucuuuuuuuuuuuuuuuuuuucacccaauguuuuuuuuauuaacaguuaagauccaggguuaguuuuuguagccucugcuggcccuucggccucuggcgcgcccaaacuuccagcccuuggaacggacauaggguuugguauggcugugugggguuccuggggccuagucaaaaugucgguacaccucucggcccuuccgaggaccagacaggagcacagugccccggcccuugggagacuccagggccagcuggucaaaggugaggaucuuacccccagccuugaggaugcgacuccggggccggcugcucacccgcagugcacacaccuucagcuugggaacuuccagaauccgcacaucaucugugaccguccccacggcagucuuguucucgcagccaggaagcuucaucuuucggaucaugcgggacagggagagguggccgguugguucggcucaugaacaaccugaagcacaaccugauugaagguggaguugguccgucuggccagaaaccuguacagcuugacaagcagccgcagguagauguccuggcucuugggcuccuugcgccgaaccuuucgguccuuguuguggcgaaugucaacacccaugauggcgccuccugcucggccagguccggagaaaccugc

SEQ ID NO: 6313 - RNA, 5272 nt, Mus musculus
caaucauuuugcaaggagcuccgagccgggcugcuccacuguacuuuguuggcugagaaguugagcagggggugggggugggagggugggggucuggggggggucgcguccgaaagcccucugcaccggguccgugugccaccuuuucccugcuugggcgccgcggcgcgagcgcuucccuucccccugcgagcgcgcggauaaugucugagaauguccauuucugggacgcuuagcagcuauuaugucgacucgaucauaagucacgagagcgaggacgcgccuccagccaaguuuccuucgggccaguacgcgaacccgcggcagccgggccacgccgagcaccuggacuuccccucgugcagcuuccagcccaaagcgccgguguucggcgccuccugggcgccgcugagcccgcacgccucggggagccugccgucugucuaccaccccuaccugcagccccagggcgcgccggcggccgaaagcagguaccuccgcaccuggcuagagccggcgccgcgcgccgaggccgccccggggcagggccaggcggccgugaaggcggagccgcugcugggcgcgccgggggagcugcucaaacagggcacgcccgaguacaguuuggaaacuucggcgggcagggaggcuguccugucuaaucaaagagcuggcuacggggacaauaaaauuugcgaaggaagcgaggacaaagagaggccggaucaaaguaaguuauaaaaaaaaaaaaaagugaggaaaucccccccaggcugcaggccaggcccgggggaggggaggggagaggccauaaagcggacaauguaaagggacagagcgccuggggccgcagggcuagaguggguggagggaagaggaaggaaggggcuggcaaagcaaaaagcuggguguccaggagggggacacugaggcuaccccccacuccuccuuguggcgcagggacugagacucagggaccaagucucucuaguccuucauucuuccccaggcucgggcuggaaaaagggagagggaccugcgauagaacuguaggaggccgggccgauggccagcgcggcccggagcccgcgcgggcacggggccgaagagcacucggcagagccgccugcgccacgcgcagaccgucccugccggccaaggggaagggggagggggcucauuaggauuuuauuugcgaugcaacagcuuggcggaggauuguuccuagcagaucucacgcaguagccgcgucgggucggcagcaggcgccgggaggggcgggggaagcccaggaugcggugacggagcccccuccccggugcgccggccccuccccgggagccuucccuccgggggucccccgcccuucuagggcauccucgacaggacggccguuucuccuccugcgguugcacgcugaucuccgcggggcuuccgaucacuuaggccgggcaguucaccucuccgagagucuaggcaucacuugcuaaagacagggccucccucuagaauggaggagaagacacccaaagggaccccgggggagggagggggaggacugcgcaggggcggagaacucuacccuugguggagaguuucuuaccaccucccacuccuaaaagcacccuugcuaaaauaaaaccccaaguggaaacugcugcuggcugagaguagaggaggcuuacuuuuagggguuuguuuuuaaggauggggaagacaaacugguuuggggcucgcucuuggucccaaacaauacgggacaaacugacaggucaacuccucaccucuuccuccucugggcaaauaguuugguccuugcucgcccuauuggaugccccaccaacagagaggccaauggguccucugggggcaugcuugcccucugaaaagcaaggagagacacuauuccccugugacccuugugguccccucauaccuccaacuugccaggcugaguuauuaaggagcucauauccccaaaacagcuccucccaaagcuccagaaaacacccaaacagaccccucaccccauggccccagacuaggccugaguugcccaucauugcaaggcagccauuuggcuaggcucaauuauuaacaguuuuuuuuuuuguuuccucuuucauauuuaaugaaagaggaaaaggcugcgggucccaucccagacaaucacauuaagggaauagcgcugcaaauuggcaggacacgcuacuuaguguaggaugaagugaauuuuaaaauauacauagauauucagagcuuuucacuugggggcuaagcugguggaguggaucuugcuuguaauuggcucugcuuugggaggcagguaacuuuucugagucccgaggucuaaggagggaugcuggacagaaaaagaaaaaaaaacuguauauguuauuugcucuuugugccccucuuccacucaauuacaccuuucucugccucuccauuggguccguuaaaaggauugguaugcugggaagggcuuucugucgucccccccgccccccgccccccccaccucaucucugcuucucuaucuuagagcuguagcaauuuugcuucccaguuucccugaacuuguguuaaccaaacugugagcugaguagcagaaaagaagaggcuauugccaccauaaguuaucuggaagcccuggggcuccccguccacgggcugcaauugauaaaugguugcaauuggguugcuugugagucggagugugcaggguguucauggcuguaaaugcagacucuuauuuguggugugugauggggagggcugcuacccagacucacaugucugcugcuuaggccuagggcugaaaaauggcuuccuaggcaggguucacugggacuggacuggagcaccaggagaucucuuggcuauggcugaacagaacuccacuccuuacccauuucuuuccccuuuccccugaaaccuagagccaaggcacccuucaggucagccaccuuuagcugguagugugguuccagcuauacugagcucuucugaccuggguccaggucuauuuggauacaaauagaggaagacugagauuccuagagcagucaaagcuuuggagaugcuugggugguuuggcugcaucuccuccaaugcacuguucccuuggagcuguccauauucacuccuggcccaguuagagaugcuuucugagaucuuggaggccuggguguguuucuccaaugccaggggaguagagaugugagcgcaccuucuuggucuggggaccuccauucccuuucucucuuugauucuaucgcuacuucucuuucagccaaccccucugccaacuggcugcacgcccgcucuucccggaaaaagcgcugucccuacaccaaauaccagacgcuggagcuagagaaggaguuucuguucaauauguaccucaccagggaccgcaggcaugaaguggccagacuccucaaucugagugagagacaagucaaaaucugguuucagaaccggcggaugaaaaugaagaagaugaauaaggagcagggcaaagaguaaagaugaccacccccccuuccccagcucacucuuauuauuuaugugauggucaaaaagccacugcugucuggguuguacccaagugaguggggaagaguaucuccucuuuaaaaucccucaucugcaccuggagccugucuccucuccuuugcgccucucucucucucucucucucucucucucucucucucucucucucucuccacucuccugguguuaagaggaaauuuuauuaaguuagaagcuagcuauacuugguuccuagaaaagugaugagccucgcuccgaggaaagagacccuagucgagcuccuagcaucccugcuaauuuuucuggaaaaccccagccccucucuuccagucugccuguucccucccuguaaccuagccagacgccacccagguacaguuuaacugcacacagcccaguggaugcccacagacauagaguuuggagucuaugcuaaucaucguggagaaaggacaucaagacguuguucaucaaaccaagcagggcagcucucagaucagguucauuuugguugugcccugauccaaacacacacuaggaagaugucuagagaugcccucaaugaggcacugcagucccaaagucucaacaucccaauauguauccuauggaauugccagcuagaccccauaucuggggaggccugugggcagauguggccauuccuguccccaagcuguugugagcuagaaagggcaagaaaaagcagggagugguuuuaugaagguaccauuaguggaguccccucguauuuucccugcaggaaguguuuaauucugcauguuuuccuuuccuuccaacuaaaggaggucaaauuguggguuguagagcccugacagugcuguuuccccauucauacauuccuauccccauuugacagaauguaacuuuucuugcugaccacagucucagauuccucucuauccuccaacuuugaaaucaacucuccuuuccaccaaacccaucuugcaccagcaagacaagucucccauuguaggaaaaaaaaaaaagucccuuuccucucugcuaggucaaccccaccauagagaaggcugggucagaagagucugaaaauuuauugugaaucaauuccccagcucccuuccagaguaggcagucagggccgggaggagcaauggccucagcaagcagggcuaguggguaucuuuccauuucaccaguuuccugacccaggaagaagagagccccuuggcauccagccagagguccaaaagaagacucagaguggggacuucaccuccugcaaaguccacugcuguauccauccuguugcugcugcaugcauacgcuucuggcaaacaguccagugugcacaggaaagaggcaaacaucgcaccuccccaucgugcagagggggguccucucugccucucugccucucugcucucccugcuucucaaucccuuccacccguggacuuuuguucccgcuucuccugacugcaaagaggucauuccaguagaacuuugaauuuuauuuuauuaauuuuuuuuugcuuuugucgguggcuguggugacauugugcuuguguuuugugauuucuuuggcagugauuuucaguuguugcuuauaagggaggguugagggugggaguggggagggcaaggggccuagagcucuaauuguuuguuuuggaagaaaaaggggaaaaaaagaacaaaaaauauacauaucacucuagaaaacaaac

SEQ ID NO: 6314 - RNA, 8428 nt, Mus musculus
aaagcuuuaaauaugacuaccucguuuguuugaaaauauguuuaggagaggaagcuguaugauuugauaacuuguauuaaaauaccaauuacauuuauaggaccuuuuaaaacucggugcaauuaaaccguguucuuuuacauuuuuccgaagcgacccugacauuuagaaagacuccaauugccucguuaaaaucgcgaaauuaacagcgugccuacgccaggcucagcguuguggauguguguguaugguguuuuuccgugacucccccacaucagucuuuggggguggucugcgaagguauuugauuuguugugaggcaagagauaucucauuaauguagguaguuaaacagauuuaauccguauucguucucucucucuccccccucccucucccccccucucccccucuuucucccuggguguuuuuuucucuuccccuccuuuuuuucugcccucuccucacucccuggcgcucucucgcucuagcucucucucgcacucgcucucucucgcucucacccucgcucugcguucuguccgggaggaguacccagaagccaauaggaugcggggucucuaauggaugcaaaugauggugaaaagacggggcaaaauaugaaacaacucauuuggagggaaguaaaucaccgaaaacuguuuaugaacuggcaucccuucuucgaaauguaaagcgaggaccucuuuaaguggcgguauauuuuuguuuggggggugggggguggggggagggcgagcgagccgcggcugccaugcaggcuuagacuuuugcaggcuucgcucuucuauuccuggaaaucacaaaaaguguggcggcuuugagaucuucuucgucuuuucuuucuuuuccuuccuuccuucuuuuuuuuccccuccucccuuuuccucuccuuuccuggcgagggugacuaggagccggcgaauccgcguuuuuuuuucucucucucucccucccuuuucccccuccccacccccuccccaacagcccccaacuacagccugcgccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccuucgcaaauccaggaguucuaccacgggccaucgucgcuguccacagcucccuaccagcagaacccgugcgccguggcgugccacggcgaccccggcaacuucuacggcuacgacccucugcagcgccagagccuguucggugcgcaggauccagaccuggugcaguacgcagacugcaagcucgcggcagccagcggccugggcgaggaggccgaggggucugagcagagcccgucgcccacacagcucuuucccuggaugcgcccucaaggugagcucccguccgaccuggaccugacagggugggaaggggccaggggggcccccaugccggugggggggggagggcuggugggcaguccgggaguaucuucugcuccuagaggacuugugggcuccguuccaaacaccuaccuccucucccuucugucccacuuucuuuucuucuuuuuccccuuuucuuuuugcuuccuuugaaggaggggggggugucucuaagcgaauuuccugaauccauaaaccccucacccuccuuaacuuuucuucuucuccuccuuuccccuuuuacuguuuuaugggggcuguggagaaagacuggugggugugggggcgcucaacguuugcacuucucaauugcuuuauaguuuaauuacccugaagaaacuuuucuucuggggcagaggcucugggggcuuuucaagguggguucgagguccccacucuggcuuuuuagucuuacuccccccuccacauccacccucuuaaacuuuauggcacuuuuaauguaucugaacccccuauucugguucuaguuaccagagaaggggcuccuccuuuauggccccugcagauucagggcugucuaguccccccucgcccccccccccgcugaccgcgucuuccgcgcucccccucccgcccccgcauaaggguccccugcccuuauuauccuggucuccuaggcugguucacgaaucuuccaaccuucucugucucuucccccucccccacccuccccucugucucgcccuuuucccccauucccagcagccgccggacgcaggcgaggccgccagaccuacagucgcuaccagacccuggagcuggagaaggaguuccuauuuaaucccuaucugacucgcaagcggaggaucgagguaucgcacgcgcugggacugacagagagacaggucaaaaucugguuccagaaucggagaaugaaguggaaaaaggagaacaacaaagacaaguuucccagcaguaaaugcgagcaggaggagcuggagaaagagaagcuggagcgggcaccagagaccgccgagcagggcgaugcgcagaagggugacaagaaguaggcuccagcugggacugcucgggcccggacuagcccgcacguccgccggucccccccgcgaccacgccgccgccgcccgccccccgccuccgagagcuccggccccgcgagcggagccaggagcugggccucccacagcagcgucccccgccgcgccaguccccgcuagugguaguaucucguaauagcuucugugugugagcuaccguggaucuccuucccuucucuuggggguccggggggaaaaaaagaaaaggauuuuaagcaaggacucccucguccugcgagggugaucgacugcggccuggcagaacccccucgcccccgccccauguaaaaaagccuccuugugcaauggucuguuuccuuugaacgugcuucuuuguaaugaccgagguaccgauuucugcuaaguuuucccaacaacaugaaacugccuauucacgccguaauucuuucugucucccgcucacuuucucucuuucucucgcucucuuucucucaccgcguccccaucuuuccucgcaacccccucuccccgcugcccucccuagcuggcuuucucucuugcuucucucuuuuccuccuguccccccacccccacccccuuugguuugacaauuuugucuuaaguguuucucaaaagagauuacuuuaguuagcaugcgcgcugugagcauuguuaaaaguguucuuagguuuacugugaagagaauguauccuguaucugugaauugcuuuaugggggggagggagggcuaauuauauauuuuguuguuccucuauacuuuguucuguugucugcgccugaaaagggcggaagaguuacaauaaaguuuacaagcgagaacccgagacuggcccgggccgccgcuccucauucgcuccuaggcgccuugcagggcugggggugggggggagcuggucagcaggcuccugggcuggccuaggcuaggucgcugagaggagggggcgggggcgggggcuggaagcagguggugcgagucccugggcccaggggcgcagggggugagggaggcggcugaacgugauuggaggagagaggaucgagggaggggagccaagagaaacccccuccccuugcauucugaggcugaaggaccagggagacuccagcgcccaggccgcucuugggaagagaucuacccaggcugguggcuagugucccccgccgcuuuucucuuuguuuccguguguguguguguguguguguguguguguguguguguguguguguguuuggggggggggguacgggggggugagaaagaugcagcgcaagacuucugaguuucuauuuccauuuuuuccuuggacucagguuggggaaacaggagcagagggaagcgguuccucccuaccuccccucucugggacgucgucacuuucucccaguuucuaggccucggcuugccgcagccuuccuuccuucguugcuucugccuuccuggcagccacgcuccagugagugaggcauccgccuuccggaaccgggaaagcagcgagccggacccaagccuccuuccucccuuccuuuuucucccagcccccauuccauucuuuuuaaauuuuguauaucuuuuuauugucaucagaaaucucagcguccaacgccuuauuggguuggaucucugccuuagggacgccuuggucacaucuaguuacuacaacuggggcacuaagacaaccgggaggccaggcucgccuccucuugggagaagagcagcagcucggaugaauuaacccaaauuaauaaauauucggccagcacccacccaccaaguugcgaacauucaaucccugcgucucucucgcucuguaaccggcugggggaaaugggugggggaugacaacacgguucccucagagguuauuuauuuucucuuccacucaauuccuucuuccccaaaucucgccugcaagcugccuccagcccgcgggggucgacagcggcccuuaagcccccagccccaauccgcagagcucggccuucccauucauuauugaucauauuuuauaaauccaacgccacacaauuuuuuccacauuacugggagccuccgggaggccgucauaccauuggccgaggggauaucacgugggccggggucacguggucagaagaggaaaaaggggguccuuuugguguaaaucuggacucuaauucuguaauauaucaaggaaucucguaaaaccgacacuaaaacguccccgacuacaaaucauccggccaaauuaugaguucauuguauuaugcgaaugcuuuauuuucuaaauauccagccgcaaguucgguuuucgcuccaggagccuuccccgaacaaacuucuugcgccuuugcuuccaacccccagcgcccgggcuauggagcagguccgggcgcuccuuucuccgccucggugcagggucuguacuccggcgggggggccauggcgggccagagcgcggcuggcgucuaugcggccggcuacgggcucgaaccgaguuccuucaacaugcacugcgcgcccuuugagcagaaccucuccgggguguguccgggcgaccccgccaaggcggcuggcgccaaggagcagagggacucggacuuggcggccgagaguaacuuccggaucuaccccuggaugcgaagcucagguaaagccgcgcucugagcggucccgagccgcaguguccgggccacgguccccagaagggcucccuuccggccagggcacccuucucuguguccagguuauucccggcugcagaucggccauugccacgccguuuaagucugggcugggaccacgcgcgccacccccacucccaguuuugcucagugcucucaggcccuagcggaucucuuuuugccgacgccacagagcucaaagcccccagcccgcccccaacccuuccucccggccuuuuagcuuuaaauauuuaucagcagcgccggcacgggcuggagacgaggccguuugucuugccuagaaaggcugggguuugcagagaauagccauuagggucuuucucuucucucuccccccuucccugccugagagcucaguucuggguguguccccccagcccuagcuugggcaagauauggaggagggggccauggcgcuaagcgauucuccccucccccuuccuuucuagccaaccccgcucccccauuauucccaucaggacaauuagaggugggcucuagaggccuggugggaugggggagaggaaacagaagagaugaggacccagacagggacacagagucaaagaguggugaaggaguuagucugagacccagagcgaugagucuacugacccccaccuccugauggacuuagaaggcccgucagcuccccaggagagcauagguuguuuguuauuuuuuuuuuccaggugucuuuccaagggcucugugggccccugaggaacagccaaguuuggugguaucacuccagaaagaugacucuccucuuggggagggcuaggacucuucagaaccaaaucaagauuuagggagugcacgaugcuuuaagaaccauagguuuucuucccucaggucuccuucacagcuuccucgcacaccuuuuacauuuccccgaggcaggugggcuugggagccaacuccaaggcucagaagacccaaccgggccagagacuccuauacucaugggcuugggggccacgaggaaaccauuucuugacuauuguucuucacgguuccuguuaccuacccuguaauugaacugaccuuccaguugguuuaucaaagucccuccccccccccaccucguaaauauuucagcuuggcuuauagcugacuugaaauuaagguccuuagccucucuccccucuccugucuccuucccaagagggcggauaccagcaucuccccagucuccuugggguucugagccuaugcugggaguucucagauacccuuuugccccaccauaggaaucuucaccuugcucucucucguagacucuggucauucuuuucuuccuugcaguccuggaggcccaaauauugcuucagacaaguagguuucaugugcaggaaggcaggcaguagucagaccuugcuugauacuuacugggaaggaaucaucagagccaaguucugucagucuacuaaugccaagguccaaggaaauaauguccuugucucuuccccauuccacaacaaguuuggguggggacugggccuauggcuccuuuuauuucuguucuucucagacuaggccuggagccccacucuagggacacuaauaugguuuccagagcccuguaccucaaaggccaccugaauggggaaaggguagacuuggugccccugaccuuagagagugacugaugacagaauuugcucucuuucuguguuagccccuuuggaauagagucucagggagccagcagcugagaacuaccugguuuucagaagcuccuggcagagcaaaaccacccuucauggaugacaggacuaccuggugugcuggggcuggccugggaacccagcacuuaguacuuggggcugaaucaggaggauggcugcuagugugaaaccagccagaggcuccauagcaugacccagcuugaaaaacagaacaacucuuauggacacacacacacucucucucucucucucucucucucucucucucucucucucucucacacacacacacacacacacacacacacacaaagaaaagaaaauguuuucugcaccuaguagugaaaggggauuaauguaguuccagcaagguaaccaccuaggaagggggucagaauucuguugguguuuuucacacagucucucucucucucucucucucucucucucucucucucucucucucucucucucucucucucucucucuaauccuguguguagggccugaccgaaagcgaggccgccagaccuacacgcgcuaccagacccuggagcuggagaaagaauuucacuacaaucgcuaccugacucggcggaggcgcaucgagaucgcgcacacgcucugccucaccgaaagacagaucaagaucugguuucagaaccggcgcaugaaguggaaaaaggagaacaaaaccucaggaccgggaaccaccggccaggacaaggcggaagcggaggaggaggaggaagagugagggacagagaaagccaagaggaggaaagcgaagagagggagaacccaauuaugggaacugaagcaugaaacucaaauaaaggggcaaacuauuuaaaugaagaggucuaaaaauaauaaggaaagagaagggugaaauuuggguuucuuaacacuguaaaaaaauauacuaccuaugggaaaguguguugucuguuuuuguacaguaucggaaggacauuaucuaccuguucuguggcuuucuggaaugugccuccccuuuucuauguugcuaguaaggucuuuguaaaaucuugcuguuuuguaagcccucuuugaagcugucuuugugaacugugguuccagaugaacagauuagugcgguuccuuaccuaccccauacuucccaguagcaguacuagagggguuguauggagcccugaggauccacuagcuucugcgucuggugcauuuuggcugcuguuucuagguccuauucacgagccucuuucuguauaucugaaggauggaaaauaaaacaggauuaaauaucaacagacacgcuguguuuucugucucccucuggcugggggagguguaaggguugguagugggcgagugucccagagccccucugcuggucuuuuucugucggugcuggguuugcuuuuauuuuccagaugccucugcuauagagacugccagcuagugaaccccaacauc

SEQ ID NO: 6315 - RNA, 8428 nt, Mus musculus
gauguugggguucacuagcuggcagucucuauagcagaggcaucuggaaaauaaaagcaaacccagcaccgacagaaaaagaccagcagaggggcucugggacacucgcccacuaccaacccuuacaccucccccagccagagggagacagaaaacacagcgugucuguugauauuuaauccuguuuuauuuuccauccuucagauauacagaaagaggcucgugaauaggaccuagaaacagcagccaaaaugcaccagacgcagaagcuaguggauccucagggcuccauacaaccccucuaguacugcuacugggaaguaugggguagguaaggaaccgcacuaaucuguucaucuggaaccacaguucacaaagacagcuucaaagagggcuuacaaaacagcaagauuuuacaaagaccuuacuagcaacauagaaaaggggaggcacauuccagaaagccacagaacagguagauaauguccuuccgauacuguacaaaaacagacaacacacuuucccauagguaguauauuuuuuuacaguguuaagaaacccaaauuucacccuucucuuuccuuauuauuuuuagaccucuucauuuaaauaguuugccccuuuauuugaguuucaugcuucaguucccauaauuggguucucccucucuucgcuuuccuccucuuggcuuucucugucccucacucuuccuccuccuccuccgcuuccgccuuguccuggccggugguucccgguccugagguuuuguucuccuuuuuccacuucaugcgccgguucugaaaccagaucuugaucugucuuucggugaggcagagcgugugcgcgaucucgaugcgccuccgccgagucagguagcgauuguagugaaauucuuucuccagcuccagggucugguagcgcguguaggucuggcggccucgcuuucggucaggcccuacacacaggauuagagagagagagagagagagagagagagagagagagagagagagagagagagagagagagagagagagacugugugaaaaacaccaacagaauucugacccccuuccuaggugguuaccuugcuggaacuacauuaauccccuuucacuacuaggugcagaaaacauuuucuuuucuuugugugugugugugugugugugugugugugugagagagagagagagagagagagagagagagagagagagagagaguguguguguguccauaagaguuguucuguuuuucaagcugggucaugcuauggagccucuggcugguuucacacuagcagccauccuccugauucagccccaaguacuaagugcuggguucccaggccagccccagcacaccagguaguccugucauccaugaagggugguuuugcucugccaggagcuucugaaaaccagguaguucucagcugcuggcucccugagacucuauuccaaaggggcuaacacagaaagagagcaaauucugucaucagucacucucuaaggucaggggcaccaagucuacccuuuccccauucagguggccuuugagguacagggcucuggaaaccauauuagugucccuagaguggggcuccaggccuagucugagaagaacagaaauaaaaggagccauaggcccaguccccacccaaacuuguuguggaauggggaagagacaaggacauuauuuccuuggaccuuggcauuaguagacugacagaacuuggcucugaugauuccuucccaguaaguaucaagcaaggucugacuacugccugccuuccugcacaugaaaccuacuugucugaagcaauauuugggccuccaggacugcaaggaagaaaagaaugaccagagucuacgagagagagcaaggugaagauuccuaugguggggcaaaaggguaucugagaacucccagcauaggcucagaaccccaaggagacuggggagaugcugguauccgcccucuugggaaggagacaggagaggggagagaggcuaaggaccuuaauuucaagucagcuauaagccaagcugaaauauuuacgagguggggggggggagggacuuugauaaaccaacuggaaggucaguucaauuacaggguagguaacaggaaccgugaagaacaauagucaagaaaugguuuccucguggcccccaagcccaugaguauaggagucucuggcccgguugggucuucugagccuuggaguuggcucccaagcccaccugccucggggaaauguaaaaggugugcgaggaagcugugaaggagaccugagggaagaaaaccuaugguucuuaaagcaucgugcacucccuaaaucuugauuugguucugaagaguccuagcccuccccaagaggagagucaucuuucuggagugauaccaccaaacuuggcuguuccucaggggcccacagagcccuuggaaagacaccuggaaaaaaaaaauaacaaacaaccuaugcucuccuggggagcugacgggccuucuaaguccaucaggaggugggggucaguagacucaucgcucugggucucagacuaacuccuucaccacucuuugacucugugucccugucuggguccucaucucuucuguuuccucucccccaucccaccaggccucuagagcccaccucuaauuguccugaugggaauaaugggggagcgggguuggcuagaaaggaagggggaggggagaaucgcuuagcgccauggcccccuccuccauaucuugcccaagcuagggcuggggggacacacccagaacugagcucucaggcagggaaggggggagagagaagagaaagacccuaauggcuauucucugcaaaccccagccuuucuaggcaagacaaacggccucgucuccagcccgugccggcgcugcugauaaauauuuaaagcuaaaaggccgggaggaaggguugggggcgggcugggggcuuugagcucuguggcgucggcaaaaagagauccgcuagggccugagagcacugagcaaaacugggaguggggguggcgcgcguggucccagcccagacuuaaacggcguggcaauggccgaucugcagccgggaauaaccuggacacagagaagggugcccuggccggaagggagcccuucuggggaccguggcccggacacugcggcucgggaccgcucagagcgcggcuuuaccugagcuucgcauccagggguagauccggaaguuacucucggccgccaaguccgagucccucugcuccuuggcgccagccgccuuggcggggucgcccggacacaccccggagagguucugcucaaagggcgcgcagugcauguugaaggaacucgguucgagcccguagccggccgcauagacgccagccgcgcucuggcccgccauggcccccccgccggaguacagacccugcaccgaggcggagaaaggagcgcccggaccugcuccauagcccgggcgcuggggguuggaagcaaaggcgcaagaaguuuguucggggaaggcuccuggagcgaaaaccgaacuugcggcuggauauuuagaaaauaaagcauucgcauaauacaaugaacucauaauuuggccggaugauuuguagucggggacguuuuagugucgguuuuacgagauuccuugauauauuacagaauuagaguccagauuuacaccaaaaggacccccuuuuuccucuucugaccacgugaccccggcccacgugauauccccucggccaaugguaugacggccucccggaggcucccaguaauguggaaaaaauuguguggcguuggauuuauaaaauaugaucaauaaugaaugggaaggccgagcucugcggauuggggcugggggcuuaagggccgcugucgacccccgcgggcuggaggcagcuugcaggcgagauuuggggaagaaggaauugaguggaagagaaaauaaauaaccucugagggaaccguguugucaucccccacccauuucccccagccgguuacagagcgagagagacgcagggauugaauguucgcaacuuggugggugggugcuggccgaauauuuauuaauuuggguuaauucauccgagcugcugcucuucucccaagaggaggcgagccuggccucccgguugucuuagugccccaguuguaguaacuagaugugaccaaggcgucccuaaggcagagauccaacccaauaaggcguuggacgcugagauuucugaugacaauaaaaagauauacaaaauuuaaaaagaauggaaugggggcugggagaaaaaggaagggaggaaggaggcuuggguccggcucgcugcuuucccgguuccggaaggcggaugccucacucacuggagcguggcugccaggaaggcagaagcaacgaaggaaggaaggcugcggcaagccgaggccuagaaacugggagaaagugacgacgucccagagaggggagguagggaggaaccgcuucccucugcuccuguuuccccaaccugaguccaaggaaaaaauggaaauagaaacucagaagucuugcgcugcaucuuucucacccccccguacccccccccccaaacacacacacacacacacacacacacacacacacacacacacacacacggaaacaaagagaaaagcggcgggggacacuagccaccagccuggguagaucucuucccaagagcggccugggcgcuggagucucccugguccuucagccucagaaugcaaggggaggggguuucucuuggcuccccucccucgauccucucuccuccaaucacguucagccgccucccucacccccugcgccccugggcccagggacucgcaccaccugcuuccagcccccgcccccgcccccuccucucagcgaccuagccuaggccagcccaggagccugcugaccagcucccccccacccccagcccugcaaggcgccuaggagcgaaugaggagcggcggcccgggccagucucggguucucgcuuguaaacuuuauuguaacucuuccgcccuuuucaggcgcagacaacagaacaaaguauagaggaacaacaaaauauauaauuagcccucccucccccccauaaagcaauucacagauacaggauacauucucuucacaguaaaccuaagaacacuuuuaacaaugcucacagcgcgcaugcuaacuaaaguaaucucuuuugagaaacacuuaagacaaaauugucaaaccaaaggggguggggguggggggacaggaggaaaagagagaagcaagagagaaagccagcuagggagggcagcggggagaggggguugcgaggaaagauggggacgcggugagagaaagagagcgagagaaagagagaaagugagcgggagacagaaagaauuacggcgugaauaggcaguuucauguuguugggaaaacuuagcagaaaucgguaccucggucauuacaaagaagcacguucaaaggaaacagaccauugcacaaggaggcuuuuuuacauggggcgggggcgaggggguucugccaggccgcagucgaucacccucgcaggacgagggaguccuugcuuaaaauccuuuucuuuuuuuccccccggacccccaagagaagggaaggagauccacgguagcucacacacagaagcuauuacgagauacuaccacuagcggggacuggcgcggcgggggacgcugcugugggaggcccagcuccuggcuccgcucgcggggccggagcucucggaggcggggggcgggcggcggcggcguggucgcgggggggaccggcggacgugcgggcuaguccgggcccgagcagucccagcuggagccuacuucuugucacccuucugcgcaucgcccugcucggcggucucuggugcccgcuccagcuucucuuucuccagcuccuccugcucgcauuuacugcugggaaacuugucuuuguuguucuccuuuuuccacuucauucuccgauucuggaaccagauuuugaccugucucucugucagucccagcgcgugcgauaccucgauccuccgcuugcgagucagauagggauuaaauaggaacuccuucuccagcuccagggucugguagcgacuguaggucuggcggccucgccugcguccggcggcugcugggaaugggggaaaagggcgagacagaggggagggugggggagggggaagagacagagaagguuggaagauucgugaaccagccuaggagaccaggauaauaagggcaggggacccuuaugcgggggcgggagggggagcgcggaagacgcggucagcgggggggggggcgaggggggacuagacagcccugaaucugcaggggccauaaaggaggagccccuucucugguaacuagaaccagaauaggggguucagauacauuaaaagugccauaaaguuuaagaggguggauguggaggggggaguaagacuaaaaagccagaguggggaccucgaacccaccuugaaaagcccccagagccucugccccagaagaaaaguuucuucaggguaauuaaacuauaaagcaauugagaagugcaaacguugagcgcccccacacccaccagucuuucuccacagcccccauaaaacaguaaaaggggaaaggaggagaagaagaaaaguuaaggagggugagggguuuauggauucaggaaauucgcuuagagacaccccccccuccuucaaaggaagcaaaaagaaaaggggaaaaagaagaaaagaaagugggacagaagggagaggagguagguguuuggaacggagcccacaaguccucuaggagcagaagauacucccggacugcccaccagcccucccccccccaccggcaugggggccccccuggccccuucccacccugucagguccaggucggacgggagcucaccuugagggcgcauccagggaaagagcugugugggcgacgggcucugcucagaccccucggccuccucgcccaggccgcuggcugccgcgagcuugcagucugcguacugcaccaggucuggauccugcgcaccgaacaggcucuggcgcugcagagggucguagccguagaaguugccggggucgccguggcacgccacggcgcacggguucugcugguagggagcuguggacagcgacgauggcccgugguagaacuccuggauuugcgaagggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggcgcaggcuguaguugggggcuguuggggaggggguggggagggggaaaagggagggagagagagagaaaaaaaaacgcggauucgccggcuccuagucacccucgccaggaaaggagaggaaaagggaggaggggaaaaaaaagaaggaaggaaggaaaagaaagaaaagacgaagaagaucucaaagccgccacacuuuuugugauuuccaggaauagaagagcgaagccugcaaaagucuaagccugcauggcagccgcggcucgcucgcccuccccccaccccccaccccccaaacaaaaauauaccgccacuuaaagagguccucgcuuuacauuucgaagaagggaugccaguucauaaacaguuuucggugauuuacuucccuccaaaugaguuguuucauauuuugccccgucuuuucaccaucauuugcauccauuagagaccccgcauccuauuggcuucuggguacuccucccggacagaacgcagagcgagggugagagcgagagagagcgagugcgagagagagcuagagcgagagagcgccagggagugaggagagggcagaaaaaaaggaggggaagagaaaaaaacacccagggagaaagagggggagagggggggagagggaggggggagagagagagaacgaauacggauuaaaucuguuuaacuaccuacauuaaugagauaucucuugccucacaacaaaucaaauaccuucgcagaccacccccaaagacugaugugggggagucacggaaaaacaccauacacacacauccacaacgcugagccuggcguaggcacgcuguuaauuucgcgauuuuaacgaggcaauuggagucuuucuaaaugucagggucgcuucggaaaaauguaaaagaacacgguuuaauugcaccgaguuuuaaaagguccuauaaauguaauugguauuuuaauacaaguuaucaaaucauacagcuuccucuccuaaacauauuuucaaacaaacgagguagucauauuuaaagcuuu

SEQ ID NO: 6316 - RNA, 15916 nt, Mus musculus
auuuuucaucagaugccuugcuuuuauuucaauuuauuuuuacuuuauguauuuaaaucuauuucauucuaaauuggcaugggcgauccacaugaaauuuuuaaauugaagggaaaccagucccggcgagcgacagugaguuuaccgggcuggggugcguccgcagugagccuggcagcaccggacgccagggcuuccucugggccguucggccugcuccugaguacggccaaccuggaaccuucugaggggcacacacacacacaggagggggagggagagaaaaauauguuuuuuuuaaaggggauuauuucguuuucugcguuugguuaccagaaacucaaccuaaaauguaguuuuuguuuuuuuaaagaaagccuaggaaaacggagugaguuauuguuaaaauaaaaucaaggauuucguaaauccuucaucgcugaaaaaccuaaacgacagugucuuuucaccuagacaugggguacugguuuuuaauauuuauucguuuacaaacccucaguugucuaaagaagguuaucuuaaacuaaaagggcuugaaaaaggugauugguuuccggaaaaaaucugcuuaauuugaauuucuaagagacagcccuuaaaacccgcagcuucaauuuguaagaaaaagcccuuaaaaccugcggcuuccccagaacugaccgcugcaaccccuggcgagcacaggggaaccuggucccgaaagcaggcguuggggcgggagugaucugucuucucccucccccccaccccaguuucugaggugcugagguggagaaucugcuuguuagaguaucgagcuuggccccuauccaggacaccuucccucccgaggcaaaaacuagacccuguggacugacgcccaccacccccacaccacaccugcaaugcugcaaaccgcacaggugggggaaccccacagucucuagggcuaggaaugugggguauucagaugaagagaggggguacaggagcuuucuuuuugucacaaagcagauagcagcuccuaacacaggcugcugcuuuggccucaccucucagaacauucccuuguggaggacuggggguggggguggggacuuuuacuauaaaagacagacagagcucuugagaaaaaauguggagguuccagagaaaaccccgguucuagcugaaccauuauggcuucuccacccugaauucuugcaccccaaaucucagcugucucagauugggguuucccuaaaaagagaaggggaagaaaagaagauggcgacggagaaaaggguugcugguggagcagccaugaagaaaugcaauaaauuccuuguuguuuuaugaaaauuuacaacuuugugauagaaguuuaugagugguugaauccagcgauuggccggcgccggucauguggccgggcgaucgugaacaugaacuuuuuaucauuucccuggugguuauaaugcagcauucuuuuggacaccacaccuaggucggagcacuaccguccuucagggcuccagccucuugauauuuuuauacuucaauaucagcucgauagagcgagagagagagagagagagagagagagagagagagagagagagagagagagagagagaaggagaggggggagaggagagaaggcugagagagggaaggaggggugggaauuacacaaaagagagaaccuaaaauaauuuugauucuuaauuuacuugcugaucugggauuuuuagucaucaugaaggcuaaauggacaaucugcccaggacugcagccugauaucauuuuucaaagccagaacuuacuccauuuucuaugcaaauaucagaaaagcgaaacaaccucucucucaagucugagaaggggaaacgacggcucucagguugggacaauauuaucuggaagcugaagaagauaccgaacgcuccuuuaucccucccuccacauccuuuugaauccggaggagggcaaaaucccccaaguucugcaaagguaaggaagauucuacaauucuuauucuuuugcauccuuuucuugcaggggguggggcuuagauuuuucucccuccuccuccccccauuucaagacaggguugaaccccaccucugggcgcugcugggagaggcuucccaggaaauucuguaguagagacagggguggcugcuuccuggagggggaccggcugcagggaagauggggaggagggauggaaaggggccuaugaggccgguuuuauguugcuuuuuuagcugggagagaucuccagcgaggggucugcaaaagcgaggguggggggugucugggcuacagccacgcuggccagucgcucuggcccuuguggguuugugcucaccucccuccaucucucccuuuuccuggccucuccgauugcccccgugcgguuucucuugcccaguguggguaauggcgauuucccggcugcauuggcacgaggggcgguggcgcugagggaaguccuggucucuguggggccuggaaucuccgcagaggccagccuagggcgaagaggcgucuagagugauauaaaaagaacaauucacagagaaauguucgcuaucuuccuucggagacauuucugaaaauaaaggguugugggugaaggaacccaaagcaagggaagcuagccgaagaccucccagcucuuuugccaccggucucuugccacucccgccagccggagggagccugcagggagagaguuuugugguuuuaaugcgguagguuaaagucuguuggucucugugugauuugaucuuguuacuuguguuuuauugguauaagauguauggauuuugguggagaaaauuguauaucugcuaugggcacauuucaaacuuuuccuggauuuuaaugcgguugggaagagacuuuuagcauguuguuucaggcuuguacacacaaauccauuugguguguaugucugggaggaugggaguggguggguugggauacaaaauguaaugguauguaugaucugggaaaaccuccuggagucugaguucaaaguuaaguccugucuuucgccgcccaauuuuuguucccuggcuuccugggggugggggaggggauggggggggggaaagaucucuuggguaugagacagauuccuaaagugguugauaggcuucaggcugacuggugaggacuauaaaaugggacgaaagguccccagagaagcuaucagugacagagagauaagugacuguggguaugaaugaaggacaggaggcguugugguuucguuugguuugcaugaauaaggauugucuucuuguuucuuaaggagccugugcagauagaugguucaggcucaggucucagguuauccgauuuuagugucuugggagaguguguagguacauuggucuccugggcuauuaggagagggaaacguagccacuuguggcacaagacugggguucccugggggcccagauaaaaagcucuagacacaggccugaaagggccucacugagagaccuugguuucuuagcaagcgaaauuaaucgccaacaucuaggacgcucggauccuauuugcggcgggaaauacccuccaaacccacucaaacuaaaggucuuuuccccuuguagucuugguggguuauaaaucgucccuuagacaguuuccucugacccaaauuaugcaguuugcugccaucuaccguccguucggggacaggcggcuuugguacagcaaaucgcucgacacuccccgagcccugcggguuugcuuugagccccugucgcgcaguucggugggauaccggcccacgcugauguccucuuaguccccgagugcagauuagaaagcggaaugagucucuugucacauuauccucaaccuucucccgucuccugcauacccuuccacacucaucccagccacaaaccugaaggcugguagugggaaagggagucuagaggaguaacacuguaacccacggacaggggguacugagccaaagggcugaggguucagaccuacgaccuuccucaccaccuaagacacgagacacgacuggggaccgcuggagagaugugaggccaaaucuguucaagguuuauuuaguuuucuucucugccaagggagggagggggucccguuaagggaggcgccggccaggcaguuccacucgguugucaaaagacaaacccagucuguauucuuccaguugguuuguggguuuugccaauuccuaagcuggcgaguccguggugaaggaguugaacugaauuuucuggaaacuguuggugucugcaagugaguguugguccccucccccauucucgaccguuucaagcgaaaucgcgcaaaaaaaaaaaaaaaagcuuugguagaacaucaugagugaggagaaaucguaaaaaaaaaaaaaaaaaaaaaaaaacaaaacacuguaauuuccuguccugccggaccccucacacccgguuaacggaaccgcuuucccaaaaggggguggcgagggcggggugcgcgccuccgcagaggcguuggagucuuggccccugucucaccgguuacugauuagcucggucuuucaagcugcuggaggaagcucuggccgccccuuucaaggugcugugcccccccccguucuugggcggggggagggcugcuccaggaaauugcuugcggugccaggcugggcaagguguuacuaaggucuggcugggagcugagggccuaggggcuguguagugcugggggcacacaccauugcugcuuccaggagccuuagaggucucuagagcaaaucuuuaagcuuuuuuuuuccuuccgugcguuaagagugacuuucuggcggcuagaaggccagacccagcuuagugaguugcucgcucugcaggaggccccaagggaucuagcaggaaggucugggggcccuccuaauuuuuuuucuuuuggcaaccagaaggaaacauagggagggggaagucagguuaguacagggcuugaaccaccucggagcucuuaggguaagggugaagcagaggagggagagaaggauugcccacuccuccuagaagaucagagaggaugccgaucauuugcauaauggaaaugaggucuuuguaccucgcgauuuggacuagucgauuuuagggccgaguguccacguaaagagucuaucuccaaucuauaggcgccaucacauugcacuacuggggaacauuucagacgaucagaaggggggggggauuggguuugagagauuuuuucauuccccccauccuaaguaaaguugaggauggaacaggagaagguacccacuacccaaggaucuggcggggggggggucaucucagagaaauaggaagcuuagauauugucucaccaccuccucauacaggcaaaaggcauuccuaagauuaccuuccagagauuuucucuccugagcugaaaaugacuuaagcaacauuucucugggagcuggaauguacaugcuuacccacgggacugcagacucaaagcacagaaaaucacaauuauaaauccugccugugggguaucaggacagucccaaugcuguguacucaagacuugguauauauuuacaucccuccuucugugagugagggggcggcaacccuaauggagaacuggcuggugccugcugugugucuacuuauuucccagugaagacagacaaacugagguggacagaaccacaggcagauccuuagagaucuggcuccagaaaccaggcagucucuggcucagcucugccugccugcuccuuuucccaaacaaacggaucagaugaauaaacgcucauaaauaccucugggcuuagauaagagcgaugaggcgcuauuuccuuucaugcccgacuccaggcgcccuggcccuggccguuguggcuccaucuucagacaagcaaccugcggaggugagguuaauucagggguugcugcucuaaaggauaaagcaauuauuuucccgccucuauuacaggagaaagccuccucuuacuugggccauacuuuacauggacagcuauacaguauuuccuaugaugaggacauugugaccagggagaaaggcugaggcccaaggcccagccucaguggcaagaaagggggaggguccucccgugccuuguugccuugaugaaauagcuccuauuccucucucagcaugggcccagcauuucuagacuggagagcaaugcuuucuucaccacuaggagguuugagcuucuuuuuaugccccaccaccuccaccacuggauugaggcuaagagagauacccgggaauggucauuuugccacaaagggacagccuagcaguugcuaugaguucaaagaacuucagaggccacauugcagccaaauaaauccucccucuugaucagccauccucagcccuuuccuauuaaccgugggcagagcuggcucacaaaaaggaacccaaagaacaaggcagaggugggucagccuggccugaccccaggcaccgucuuacaaccaauccucccugucuucagguuggauacacuguuugucuugggugugcauuuuagaaugucagaaauaccuugugucccccagguugggaucuguccuuauuuucuuuggaugagagaggaagagagcauagcuauuuucuuccacucccaaguccuuacagcagcuaagaaggugauauaaacaugagacgugggagguggucuguagaguggcugagagacaggaguguugugagugucuagaacuagagcaagcaugccaguuugaugguuggaaggugguuacuaagucccuaggaggaccuagcagccuucucuccuuauaaaaucaaauccaaaccaagucuugggaugcgaauuucaaagggaaccaccaguuuauaaagagaguaggaaaaagaggagacucucggucuccaauacugaagacucaacauuucuaagacaauuccccccaguaucuagauuuacagggaacaucuuugguucuaaaaaucuguagccagggauucuugcuacaucauuuggccugagagauaaggauagaugaggagagaccaagcaaggguugcaggaagaauagagaugaaaacaaguaaaguuaccuaggcugggguuuccccuucaucaccaaguuuaaggacuacuaguuucuuucuccagggcccagucucagucaagacugcagccaggacggcugagcugugcugggcauacggauggucggcuugccaaauagcaauagcaaauagcuucggggagcagccagagggagaaacugggcucacacaccccugacauuuccuucuuuugggucuucuaggcagaaggaacuggcuugcccuccucuaagcuggggaauuggguugaagucgggauacaauaaaaccuaaacuuaaaagggggaaacaggccugauaaacaauaaacgauuuuccaaaccuucaaaggaggguguuucuucuuuucuuguuucuaaaaugaagcaaauaagcggacaaguccguucucguuccaccccccaccaccaccacaccaguacaaaacccuagaaacagaccuucccccuuuauucucucucaacgagauucgaggauauuuacccagcccucccuugagggaacgggcccaugcaacgcagggguuaacuuuucugaaaacacaauuaacuuuucccuauuccugcguggggugggguggggggggagguuguauuuauuucaucacuggggaaugggaugaucuucaucuaacugcuuccuccucccucaaaagcacagacgucucuuucgcagaucauacguagguggaucagggcgcguuguggagagagagagagagagagagagagagagagagagagagagagagagagagagagagaggaaggagggggaaaagguugauagguuugugcgcgggucccucgugcaggcugcgcuccuccugggugcuauuugacaauuccugccucugccauuggucaguguuggaucagaugguuguauuuccuucuggcccucacuggcaccucgccauccccccucagcuaaaacccaaucucggcuauacuacuaauaggcgcggcgcucggacuauaaaacacaacaaaucauaaacccggcggagcagcagcggccucgcgcgccuccccucccgaugaguuccuauuucgugaacuccaccuuccccgucacucuggccagcgggcaggaguccuuccugggccagcugccgcucuacucgucuggcuaugcggacccgcugcggcacuaccccgcgccuuaugggccgggacccggccaggacaagggcuuugcggcguccuccuauuacccaccagccggcggcggcuacggccgggcggcgcccugugauuaugggccggcgccugccuucuaccgggagaaggacgcggccugcgcucucuccggcgccgacgagccgcccccguuccaccccgagccgcgcaaguccgacugcgcacaggacaagagcguguucggagagaccgaggagcagaagugcuccacgcccgucuacccguggaugcagcgcaugaauucgugcaacagugagugagacuucccgcugucccgugucugugugugugugugugugggggggggucggcaagcagaaagacugaaagugucagcaucccccaaccccaauucucccauugggaacuaggugggcaucucagcagauagagcaagauugcccccccccccgaccuccagaucaguccucuugcccgcagaaguugcaaaguuugcaaagucccagcugcacaguaaggcagggggaauaagugggcucucccuacuuaagucaggcuaggauuguugauccggaagagguuaggggacucagucucugguccuguauuccuuuauguucucccuagcucuuguccggaucugagggguggggggugccccgcacccaaagaccacuccauuaaaaacaagagugcgucaugaaaggggagggguggcaugacgccggcaagggcgaguuuacuuggguccuggauuguguuucccuggggcugggggaggagaacuggggaagggggaccagggagcugugagacacuaccauagggucguauagucugaggaaggaagaagagaggacaggcggagggagugagaagaacaaacuggcuccugggucucagguuggauuauuugugggcuucaagucccaauugauguccauuagcaggacacgaaagugaggggcuguuaaugcggacuaugaaucgauccacgucauuagggauuaagggccagaaucuaucaucgaguaggguagggagggcuggauggauggaaaggaagggaaagaaaagauacagcucguaggaggcacaccuggccagccccucccccaagcucaggugagaguccaagugccccuccucuccccccacugaaagucuaggcagaaagaaagcacaggccucggaguccaggagggaaucuggagggggcgcuggaggaguaggaaacggggaccagggaaugggagggggaaagacuacucccgacaggcuagcuuuacguuugagggccgagugggggaggggcuaugggcuuggugugaugaccccaggccucaguuucuccucucugcguaacagguuccucuuuugggcccagcggucggcgaggccgccagaccuacacacgcuaccagacccuggagcuggagaaggaauuucacuauaaucgcuaccugacccgccggcggcgcauagagaucgcgcacgcccugugccugaccgagcggcagaucaagauuugguuucagaaccggcgcaugaaguggaaaaaggagagcaaacugcucagugcgucucagcucagugcggaggaggaggaggaaaagccagccgagugaaggugcugcaaagggaggggggacgcgaagggagaggucugugggggaaccuagggcacccgaaagccccagaaggcucugcggucgggggagucuggggacuugcuguccagagcacgacgggcagggcccagugcuugccuggaugcccccuucugcagagcucuuccugggcgcuuggcggaugcccacccagcacccccagcgccuccucccucccccgaagaacccaccuuggccucaucaggcucucuggugagaacugagaaucggacucacuugaugucuccuggaagcagagcagaaugcucauguccuugucgagucucauuucguccaugucccccgugcacgguucaaugguagauucgcuguccccucagcagggaccugaaagacucccugaccccagacuugucucuccuacccccuccccaaagccacuggaaggagcacauacuaccuagaaggaagaagaggagccucagaagaaaacaaaguucuauuuuauuaauuuucuauguguuguguuuguagucuugucuuagcuccggacgugaaauacuucgguaauaauauuaauauuauuaauaaugauuaugaugaugaugauaauaauaauaaagaugugaaaacucgcagcucagucacauccaaucuuucccugucaucucccccauagcccccagccacccugucaccccugagccugaacagcaaaggcaagagccauggucugccccagggccuucccagccuccagccucaauucggaaguuacaguugagauaaaagcaaggagccaaaagcagaggccagggaucgguccucccaggccccagcguugguugugucucucugaugcuaaauucacaauugccucucccauucagacacgagauggagaaagccuuuuucccucuuguucucuaagcuugccucgguugugagacucuggagggaugccacuugaggccuccuugcccagagcucuggagagacggagcugggcgggucuaggcgcucugcaguguuuuuuucuguccucuucgagccaagggcccuggccuuuggcccgcccacauggcugucucugccggccuuggcccucggauccccggccuauugcuccggagacugaaaaaugaggccacugggcaucucuccacaacucgucuacaggcuccagggugccucuucucauauuaaguaggagcucgguggccaggaagagaaugggaagccggcagcagaaggcugcaagggcccgacuuuaucuugcucuuuggagacccgagggcagggguccaggugauggcgccuuuagucucaccuucucaacccaaaauggcucauuuucucuuuacugccacccacacccgagcagcaagcuucaggccccguuuucuuuucuuccuucucccucuccccccuccuuuuuuuauuuuuaaagaaaauagccgucuggcagaaggggcccagcugcggagaucucuggccgcccagcgagcucagcaaggggccgccggucuuccgaacaccuucccagggaaggcgguaaggccaugagcaaauucuccaauuauuggccaccagcaacacaaggcuuuggauuuggucucugaaugagauagcuggcaucuggcgagcuuguuaaaggggaucuguuuaaaccccaaacucccgcagaagaguuaccaccaaaccuuaaccgcucagacgguugucucucuagucuuuggccgaccgaccaucuuucucuucuagggucccuguuuaccucgguuccuaggccuaggcuaaggaugagaggucagaaggaaaaauccaaacuucccaggggcccaggagaacgaagagcuucccugccuuuuccagccucccuccagccuaguccugcggcucucucucguguuguggacccgccgcugaagccuagccaagaagcagaccuggcugagcuaacaaaauucuuauaauuguuuuucacacacaacuuauaauccuuccccccauuuccuuacccaaguuggggacuggcaaagccuaaggagggaagaucaagcaacuucauuuugauuauauuacccagaguuaaaauaauaauggugaugauaaugucagagaggccacaaauagaggggauagccgcacccuaacgaaguaggcaaaagacucaaauccaucuuccuaaagguucaagccugugagugagcugcgggccggguuucuuucuuggcuuggcgguugcacagagccagcaaagagguugccgaagccgccauggcggccugcggcccgcgcucccgucaaucgccgggagguggcgcgcucugcucagaggccaacgucaaccuucucccuguuuuucccccuucucacuuucucccccccucucggaggcucgcauugaaucggcccuaacgauucuccgaucgucauuauuuguaaccauagagcaugaauuaccucuugaggucaucagugagaauuuacgacuggucaacaaaagcacgugauucccuaacgcccccccaucccccuucuaaccccccccauauuuggccgcauacauagcaaaacgaaguacagugcaucgcuauaauucauuaauacaucauaaaucgugaagcacaggguuauaacgaccacgauccacaaaucaagcccuccaaaaucacccaaaugagcucguacuuuguaaacuccuucucggggcguuauccaaauggcccggacuaucaguugcuaaauuauggcaguggcagcucucugagcggcucuuacagggaucccgcugccaugcacaccggcucuuacggcuacaauuacaaugggauggaucucagcgucaaccgcuccucggccuccuccagccacuuuggggcggugggcgagagcucgcgcgccuuccccgcguccgcccaggaaccccgcuucaggcaggcgacguccagcugcucccuguccucgcccgagucccugcccugcacuaacggcgacagccacggcgccaagcccucugcuucguccccuuccgaccaggcgaccccagccagcuccagcgccaauuucaccgaaauagacgaggccagcgcguccucugagcccgaggaagcggcgagccagcuaagcagccccagcuuggcucgagcacagccagagcccauggccaccucuacggccgcgcccgaggggcagacuccacagauauuccccuggaugaggaagcuucacaucagccacgguaauucuccaucucuuuuuuguccucuccgcauuccugcccuguguugggggugggggcgagcaaagcuuggcuuugccucaaauauagaucccuuuuuucuuuucuuuuuuucuuuuucuuucuuucuuuuuuuuugccaucaagagggaaaagugucagaaaggguccccacagcuccauagauagagccaaacaguguuguuuucugggcguaggcauuuaaaaaaaaaaaaaaaaggccaguuuguugccacguucagcuuagguuuuguuuaccuagccagucaccggcuuuaggaugaaagaugggauuuguguauugugaggaaggguccugauuauuacagaaauuuugagacugcugcuagcaaagggggaaugggcuauaaacggagcuuucuagggcaaaagugcaguggcucucuucccucccgggcgagcugccgccugaacccagccuagggugaggcacugggaaggagccagagacaaagccgggagcauucacuaccaucagaagugggggcugcuggagaaggggggguaugaagaaauagaggcuggaugcaggcaucuggggugaggaggaugggagcugcggugagcugggugcuggggacgccuggguccugcuccccgcccccucccacucagugcccccuccuuuaaccggaauaacguugccucggggcucuccucuaacugcucuagauaugacugggccagacggaaaaagggcccggaccgccuauacucgcuaccagacccuggagcuggaaaaggaauuccacuucaaucgcuaccugacccggcggcgacguaucgagaucgcccacgcgcuuugccuguccgagcgucagaucaaaaucugguuccagaaccgucgcaugaaguggaagaaagacaacaaacugaaaaguaugagucuggcuacagccggcagcgccuuccaaccuugagcccauccggaggagcccugggcggcccgagagcccgcaccaaccccagcucgacccuuccaaucuucccugcacugccgcugcccgcuggggaccaguucccacgagccugucacaccccaguccuguguuacaauuuuucguuuggucuuaggucuucccauggcucccucucuccuggacugguuaucuuguuauuauuguuaauaauaauuauuauuauuauuucccccuccgugcuccccacuucucuuggcucgcccccccccaaguugccaguguuucugaauguccucgugucugugguugcgcuccuuuccccaggaaaaagaaaagaaaaagaaauucgcauguuuaaugugacuuccccuccccgucuguguucuaacuuauuuauaaaaggaugauggcuguauuuugaguuucugcuggaaacuuccauaaggggcagcaguugagguuggguagugcugggcccagcugagcuggccugggaaauggagcccacugucugugucucuuuucucccaccucauccuucuucagccccacccagcccccacucccuaggcucagguagcuuguuccuuggggugggaagggagcuagggaagggucaaaguguggacauugagaagaggagaggaaaggagcaagagcugaacuccugcugccugguaggccccacaaggccuagucuggaagcguauggaaucagaaauaauccucaguguaaaaugucuugugauuuuucucugugaauccgugggucuggcuagaaggcccaaugcuguaaauauggggauagucugggucaggccaaucacuuccucucucacccauuucgcuuccaagaccauuuguagugagcggguggaugcugugcuacgugugaaaucugucuuugccaggccugucucagugauuagcuuuugguaugucuguagcuuuccuugaaguugaauaaauguuucccccacuccagugcccucuacuugucuuuucucagagggucugacucuuucaccauccagcacaaccuggucuaagaccaucuucaauaaaucuagggcauagggaagcccaccagaaaucccucaaagccaccucacucccaggcuuggcccacugaggcuugaugaggggacugagaggcccaggaacuucacguggccuucagcuggaccccauccugauacucagcggguauggaaagccuuuggaaaaugcuccaggaagaguaauuugggccuaaauucugagcaagaaggccucugguccuuugagucugguaaaggccugcccagaugcccugucuccuguuccaaaagcucaaauguucagcucugccacccacuaagggggaggaaaucugcuuagcuucaaagguuuuuuuuuuuuuuggucacacuuggccuucucuauacuuuucaagggguucuccuauccaggggucccgacugaccuuccccucuugguuaggguuucuucugaaagaccccuggcucccccuccagccugguccaaaaccagggcccaguuuuccuccauccaguugagcuuccacccugagcauaagagucaagucuggacacuuaccggucaaucccuuccagcugggcccaacuucuuacaggaccuguggggggggagggggagccggugaagagauggugagggucuuggaggcuguuuuggguccuccuucccucucaccccaugacuuugucccccuuugccgaaagcaaacuaccccaaaagucgcuaugacauuuagaugucaaauggauagggguuuua

SEQ ID NO: 6317 - RNA, 2625 nt, Mus musculus
ugcgcuccuccugggugcuauuugacaauuccugccucugccauuggucaguguuggaucagaugguuguauuuccuucuggcccucacuggcaccucgccauccccccucagcuaaaacccaaucucggcuauacuacuaauaggcgcggcgcucggacuauaaaacacaacaaaucauaaacccggcggagcagcagcggccucgcgcgccuccccucccgaugaguuccuauuucgugaacuccaccuuccccgucacucuggccagcgggcaggaguccuuccugggccagcugccgcucuacucgucuggcuaugcggacccgcugcggcacuaccccgcgccuuaugggccgggacccggccaggacaagggcuuugcggcguccuccuauuacccaccagccggcggcggcuacggccgggcggcgcccugugauuaugggccggcgccugccuucuaccgggagaaggacgcggccugcgcucucuccggcgccgacgagccgcccccguuccaccccgagccgcgcaaguccgacugcgcacaggacaagagcguguucggagagaccgaggagcagaagugcuccacgcccgucuacccguggaugcagcgcaugaauucgugcaacagugagugagacuucccgcugucccgugucugugugugugugugugugggggggggucggcaagcagaaagacugaaagugucagcaucccccaaccccaauucucccauugggaacuaggugggcaucucagcagauagagcaagauugcccccccccccgaccuccagaucaguccucuugcccgcagaaguugcaaaguuugcaaagucccagcugcacaguaaggcagggggaauaagugggcucucccuacuuaagucaggcuaggauuguugauccggaagagguuaggggacucagucucugguccuguauuccuuuauguucucccuagcucuuguccggaucugagggguggggggugccccgcacccaaagaccacuccauuaaaaacaagagugcgucaugaaaggggagggguggcaugacgccggcaagggcgaguuuacuuggguccuggauuguguuucccuggggcugggggaggagaacuggggaagggggaccagggagcugugagacacuaccauagggucguauagucugaggaaggaagaagagaggacaggcggagggagugagaagaacaaacuggcuccugggucucagguuggauuauuugugggcuucaagucccaauugauguccauuagcaggacacgaaagugaggggcuguuaaugcggacuaugaaucgauccacgucauuagggauuaagggccagaaucuaucaucgaguaggguagggagggcuggauggauggaaaggaagggaaagaaaagauacagcucguaggaggcacaccuggccagccccucccccaagcucaggugagaguccaagugccccuccucuccccccacugaaagucuaggcagaaagaaagcacaggccucggaguccaggagggaaucuggagggggcgcuggaggaguaggaaacggggaccagggaaugggagggggaaagacuacucccgacaggcuagcuuuacguuugagggccgagugggggaggggcuaugggcuuggugugaugaccccaggccucaguuucuccucucugcguaacagguuccucuuuugggcccagcggucggcgaggccgccagaccuacacacgcuaccagacccuggagcuggagaaggaauuucacuauaaucgcuaccugacccgccggcggcgcauagagaucgcgcacgcccugugccugaccgagcggcagaucaagauuugguuucagaaccggcgcaugaaguggaaaaaggagagcaaacugcucagugcgucucagcucagugcggaggaggaggaggaaaagccagccgagugaaggugcugcaaagggaggggggacgcgaagggagaggucugugggggaaccuagggcacccgaaagccccagaaggcucugcggucgggggagucuggggacuugcuguccagagcacgacgggcagggcccagugcuugccuggaugcccccuucugcagagcucuuccugggcgcuuggcggaugcccacccagcacccccagcgccuccucccucccccgaagaacccaccuuggccucaucaggcucucuggugagaacugagaaucggacucacuugaugucuccuggaagcagagcagaaugcucauguccuugucgagucucauuucguccaugucccccgugcacgguucaaugguagauucgcuguccccucagcagggaccugaaagacucccugaccccagacuugucucuccuacccccuccccaaagccacuggaaggagcacauacuaccuagaaggaagaagaggagccucagaagaaaacaaaguucuauuuuauuaauuuucuauguguuguguuuguagucuugucuuagcuccggacgugaaauacuucgguaauaauauuaauauuauuaauaaugauuaugaugaugaugauaauaauaauaaagaugugaaaacucgcagcucaguca

SEQ ID NO: 6318 - RNA, 3530 nt, Mus musculus
acuggagugggggaaacauuuauucaacuucaaggaaagcuacagacauaccaaaagcuaaucacugagacaggccuggcaaagacagauuucacacguagcacagcauccacccgcucacuacaaauggucuuggaagcgaaaugggugagagaggaagugauuggccugacccagacuauccccauauuuacagcauugggccuucuagccagacccacggauucacagagaaaaaucacaagacauuuuacacugaggauuauuucugauuccauacgcuuccagacuaggccuuguggggccuaccaggcagcaggaguucagcucuugcuccuuuccucuccucuucucaauguccacacuuugacccuucccuagcucccuucccaccccaaggaacaagcuaccugagccuagggagugggggcuggguggggcugaagaaggaugaggugggagaaaagagacacagacagugggcuccauuucccaggccagcucagcugggcccagcacuacccaaccucaacugcugccccuuauggaaguuuccagcagaaacucaaaauacagccaucauccuuuuauaaauaaguuagaacacagacggggaggggaagucacauuaaacaugcgaauuucuuuuucuuuucuuuuuccuggggaaaggagcgcaaccacagacacgaggacauucagaaacacuggcaacuugggggggggcgagccaagagaaguggggagcacggagggggaaauaauaauaauaauuauuauuaacaauaauaacaagauaaccaguccaggagagagggagccaugggaagaccuaagaccaaacgaaaaauuguaacacaggacuggggugugacaggcucgugggaacugguccccagcgggcagcggcagugcagggaagauuggaagggucgagcugggguuggugcgggcucucgggccgcccagggcuccuccggaugggcucaagguuggaaggcgcugccggcuguagccagacucauacuuuucaguuuguugucuuucuuccacuucaugcgacgguucuggaaccagauuuugaucugacgcucggacaggcaaagcgcgugggcgaucucgauacgucgccgccgggucagguagcgauugaaguggaauuccuuuuccagcuccagggucugguagcgaguauaggcgguccgggcccuuuuuccgucuggcccagucauaucuagagcaguuagaggagagccccgaggcaacguuauuccgguuaaaggagggggcacugagugggagggggcggggagcaggacccaggcguccccagcacccagcucaccgcagcucccauccuccucaccccagaugccugcauccagccucuauuucuucauacccccccuucuccagcagcccccacuucugaugguagugaaugcucccggcuuugucucuggcuccuucccagugccucacccuaggcuggguucaggcggcagcucgcccgggagggaagagagccacugcacuuuugcccuagaaagcuccguuuauagcccauucccccuuugcuagcagcagucucaaaauuucuguaauaaucaggacccuuccucacaauacacaaaucccaucuuucauccuaaagccggugacuggcuagguaaacaaaaccuaagcugaacguggcaacaaacuggccuuuuuuuuuuuuuuuuaaaugccuacgcccagaaaacaacacuguuuggcucuaucuauggagcuguggggacccuuucugacacuuuucccucuugauggcaaaaaaaaagaaagaaagaaaaagaaaaaaagaaaagaaaaaagggaucuauauuugaggcaaagccaagcuuugcucgcccccacccccaacacagggcaggaaugcggagaggacaaaaaagagauggagaauuaccguggcugaugugaagcuuccucauccaggggaauaucuguggagucugccccucgggcgcggccguagagguggccaugggcucuggcugugcucgagccaagcuggggcugcuuagcuggcucgccgcuuccucgggcucagaggacgcgcuggccucgucuauuucggugaaauuggcgcuggagcuggcuggggucgccuggucggaaggggacgaagcagagggcuuggcgccguggcugucgccguuagugcagggcagggacucgggcgaggacagggagcagcuggacgucgccugccugaagcgggguuccugggcggacgcggggaaggcgcgcgagcucucgcccaccgccccaaaguggcuggaggaggccgaggagcgguugacgcugagauccaucccauuguaauuguagccguaagagccggugugcauggcagcgggaucccuguaagagccgcucagagagcugccacugccauaauuuagcaacugauaguccgggccauuuggauaacgccccgagaaggaguuuacaaaguacgagcucauuugggugauuuuggagggcuugauuuguggaucguggucguuauaacccugugcuucacgauuuaugauguauuaaugaauuauagcgaugcacuguacuucguuuugcuauguaugcggccaaauaugggggggguuagaagggggaugggggggcguuagggaaucacgugcuuuuguugaccagucguaaauucucacugaugaccucaagagguaauucaugcucuaugguuacaaauaaugacgaucggagaaucguuagggccgauucaaugcgagccuccgagagggggggagaaagugagaagggggaaaaacagggagaagguugacguuggccucugagcagagcgcgccaccucccggcgauugacgggagcgcgggccgcaggccgccauggcggcuucggcaaccucuuugcuggcucugugcaaccgccaagccaagaaagaaacccggcccgcagcucacucacaggcuugaaccuuuaggaagauggauuugagucuuuugccuacuucguuagggugcggcuauccccucuauuuguggccucucugacauuaucaucaccauuauuauuuuaacucuggguaauauaaucaaaaugaaguugcuugaucuucccuccuuaggcuuugccaguccccaacuuggguaaggaaauggggggaaggauuauaaguugugugugaaaaacaauuauaagaauuuuguuagcucagccaggucugcuucuuggcuaggcuucagcggcggguccacaacacgagagagagccgcaggacuaggcuggagggaggcuggaaaaggcagggaagcucuucguucuccugggccccugggaaguuuggauuuuuccuucugaccucucauccuuagccuaggccuaggaaccgagguaaacagggacccuagaagagaaagauggucggucggccaaagacuagagagacaaccgucugagcgguuaagguuuggugguaacucuucugcgggaguuugggguuuaaaca

SEQ ID NO: 6319 - RNA, 2507 nt, Mus musculus
cugugacauacugccgaaagguuguagggcaagagggugucucccccaaacggcccgacccuccuucggccucuacauggacuauaauaggaugaguuccuuuuuagaguacccacuuuguaaccggggacccagcgccuacagcgccccaaccucuuuuccccccugcucagcuccggccguugacagcuacgcaggggagagccgcuaugguggagggcugccuagcucagcgcuccaacaaaacucgggguauccuguccagcagccgccgucaucccuggggguguccuuucccagccccgcucccucgggguacgccccagccgccugcaaccccagcuaugggccuucucaguauuauucugugggucagucggaaggagauggaagcuauuuucauccgucgagcuacggagcccagcuagggggguugcccgacagcuauggagcggguggagucggcucagggccauauccuccgccgcagcccccauacggaacugagcagaccgcaaccuuugcaucagccuacgaccuccucucugaggacaaggaaucgccuugcucgucagaacccagcacucucacuccccggaccuucgacuggaugaaggucaagagaaacccaccuaagacagguagggcucagaggagccacuuccucuccuuggcucgggcauacacagaggggccugagccagggcuucauucauuccuucagcugcuuuuacuggcagguaaguacuuuccggguucaagucagcagauauuuucccacgggcuaaguucggggcuaccuccucccgaaggaggucuccgcagucuugucugugcgcccaguuuggaaccaguauuucacguuucuugucugaaggugaguaugggcggaaggcugguucuagauuuuguaauuacuaauggagggggugugugaugccacauaggaucugcauuggguagaugaugaaugaggaccaagccugaacuaggaggaguggacgggagggagaaagaggugagagaacugacguggcuuuucucccugccccgccccuagcgaagguguccgagcugggacugggcgcucccggcggucuccgcacaaacuucaccacgcgccagcugacggagcuggagaaggaauuucauuucaacaaauaccugagccgugcccggaggguggagaucgccgccacccuggagcucaaugaaacgcaggugaagaucugguuccagaaccggcgcaugaagcagaagaaacgcgagcgagaggggggcaggaugccugcaggccccccagguugcccaaaggaagccgcuggagaugccucugaccaguccgcgugcaccuccccagaagccucgcccaguuccaucaccucuugaauugaacuuccuaaguaacugggcuuccaacgcuugaccaguucucucgaagacuuucccaaacuucacagccuuggugacccuccucaaggccgaggcaccaguuuagagcugcccaggaaacugggcaggaguugggaaauguauuuuucucucucucagaucuagggguggagggaugauugauggcuggggauccuacaggucuugggaccuggggaacacucaacucaucagaggucgaaggaaggccuuuuggcuuugaucuggagucagcccauccuuucgggcuucuccuuucccuuccaacucaguucagugccuuugagcuuagagaguucuucuuucgaauucuuagcccaacucuucuuucuaggucugggaugucuaggcugggaguccuugggguuuuucugggggaggaugcguuugagugugagcccaaucgccaccaacccuuaaucuuaauccagccaacucaccgcagaccuuacaauagcagaccuuacaauagcaccgacugccuugugacauaccaaaaaaaaaaaaaaacaaaaaaaacaaaaaaaaacaaaacaaaacaaaaaaaaacaaaaaaaaccccacaaaaacaaaaacaaaaaaaaaaaacaaccuuacucccaaguaaucccacaacccuuuuccuggcacaugucuuuugcacuaaugcagcccucagaggcuggcuuacgagacucuccccuucccacuggcaucacaaaaucaccaaaguguuuuggaacuuggcacuauggagauuuccagagcaucauugcaaggacugccucaagcaagccucaaccaagaaggggcgaauacccccucccaacucccuauuuauuaccuccggaaaagcccaccccccaaaccucccuccccagcccauucuccuuuccauaaaaccacccuaccccuggggcagucuggggaggcccaggaauggugacagaguuuccagucucuucagacauuucuccaaaccccggagacagcagagaggccacuugaguuucuagaaaaccaagcuccaagcaagccagguucucuuuguaucugcaacuaccucauugcaauaaagucuguuuuucucccucucu

SEQ ID NO: 6320 - RNA, 628 nt, Mus musculus
aguggccagaggucaccugccaagaugguucgcuacucucuugacccagaaaaccccacaaaaucaugcaaaucaagagggucaaaccuuccuguucacuuuaagaacacccggaaaacugcccaggccaucaaggguaugcauauccguaaagccaccaaguaucugaaggaugucacuuuaaagaagcaaugugugccauuccggcgguauaaugguggagucaguaggugcgcccaggccaaacaguggggcuggacacagggucgguggccaaaaaagagugcugaauuucugcugcacaugcuuaaaaaugccgagaguaacgcugaacuuaaggguuuacauguagauucucuagucauugaacacauccaggugaacaaggcaccuaagaugcgccgacgaaccuacagagcucauggcuggauuaacccauacaugagcucccccugccacagugagaugauccucacugagaaggaacagaucguuccaaagccagaagaggagauugcacagaagaaaaagauaucccagaagaaacugaagaaacaaaaacucauggccggggaauaaauucagcauaaaauaaaggcagauaaaguuaaaaaaaaaaaaaaaaaac

SEQ ID NO: 6321 - RNA, 628 nt, Mus musculus
guuuuuuuuuuuuuuuuuuaacuuuaucugccuuuauuuuaugcugaauuuauuccccggccaugaguuuuuguuucuucaguuucuucugggauaucuuuuucuucugugcaaucuccucuucuggcuuuggaacgaucuguuccuucucagugaggaucaucucacuguggcagggggagcucauguauggguuaauccagccaugagcucuguagguucgucggcgcaucuuaggugccuuguucaccuggauguguucaaugacuagagaaucuacauguaaacccuuaaguucagcguuacucucggcauuuuuaagcaugugcagcagaaauucagcacucuuuuuuggccaccgacccuguguccagccccacuguuuggccugggcgcaccuacugacuccaccauuauaccgccggaauggcacacauugcuucuuuaaagugacauccuucagauacuugguggcuuuacggauaugcauacccuugauggccugggcaguuuuccggguguucuuaaagugaacaggaagguuugacccucuugauuugcaugauuuugugggguuuucugggucaagagaguagcgaaccaucuuggcaggugaccucuggccacu

SEQ ID NO: 6322 - RNA, 1470 nt, Mus musculus
gggcucuggcugccagggccuacugcugcuuuccugggaagccgcaaguucagucaguggggcacacaggcuuuguuucagccuggaagugagggcucuggagauggagauaggagccauaagcucuccuucagacggugaggcggcuccugccuccugcuacugaaaucugcagacagcaggggcggcugccuggggggcugggcaggcugggugccgggcccaccuuggugcugccgcgcugcucuuagguuuguguguguuucucuccuggccauccaccccggcuguggguccaccccagccgagggacuccuggccugcauugcgggauugucaguggcauuuaguugagaguugaggggcuuuggccugaaauaaacugcaaguauuuaagacuguuguugcaauuugugucuaacaagcuguagcaggguaggagggagugagagcuggcaggaguuacuuucauaaaucaugaauuuaucagcguggaaauaacgccauagaacugugcgcuggagcucucuugcauugugugugagacucaaguucaccaccgcaggagggacgguuuuccagagagcuaggauguggcucuucucacagagcugggcaugaaccuuguuagguauaauuuaccugaugcugcuuccgucuucgaagccugucugaggugccaggugcuaaaagagaaauaaaguuuguuaacaggcagaugcaaagcccuggcugcuguucaucccuccuuccugcccgccuccccugggucuuuccuuuauaugaugcaucagagcgaagcgaggagagaaaaccuacagaggcaaauccaaaaugucagaagaaguucauuuaaaaggggggaaaaaccuccauacacaacccucacaaaacccgacagaugcuaggcuaauggcauccacucugccgauugguggggauggcucaugaauauuaaugaguccaaugcuccaaauggugcagcugugaacccagcugugccugaagcucucugaucucaaaacuuccagacaggagccggagguggucugugucaauucccuacucagccaaaaaccagcaagcuggguuggccuucuucuguucuccccucuugcuggaguuggugcucgcucggcagccagcucugcugggcugcugggacagcaggcacucuucagacauggcugugcuuucucagacucccagcuuuuuuaaugauccauuagcagcagugcacacaagagcaccucaguuaaugugaggccaggcgccuucucaucucagucuugugcugaguuagguguuggcugcagaagauguccgagggagagagcguuccuaauagcaugggcccacguaccagaaaaacagcaagcaucguugaaaauuccuuuucauccaggcagugcuggaguccuuucguauuuuucucugcccagugugugcccaaguccagccacuccagcu

SEQ ID NO: 6323 - RNA, 12986 nt, Mus musculus
cuaccaccucucccuacugucuuaggugaguggguaaauggcaccagcccucuuaaaggccuaauuucugcaagcagcagcccagaggcaaaggccagcccuuccuaccuagaaauugaggauguuaaguugaagcaggcagugugaguucucaacacacaggacaucuguagcauggcgcacuucacggcuaacaggucccauuuccaggccaugacugcaguccagcagugcucugugccucuccagcacagcaccgacagucaagccucugagaaggcuccccugauccagcaggaagagauggcaugggcuucacugcagaguucuuuugucagugcuccccgccuucccaccuaagcacacaauggccagucucccagcuuccgugacucucaucugaauucagaagggagaggggggagaaagugcacuuaagcugaaucauccauuuuauuugauuuuauuuugucaugugcucacagcauuucuuucucuccucucccuggcaggucacagagauaaauuaaaaauaaaaucuacaaggaaaauaauuuauaaaaagcacucccaggcucacgcuuucuaucccuacugcucgguuaggaaagcccucugcccugcccagggaggaggaucagugcucccccccaaccccugcucgucuggggcaggcaguacuccagagcugaccaagauugggggucagggggcggcaguggcaguuaaaaaacaaacaaacaaacaacaacaacaaaaaaccaacaacaaaaaaaagacacugugguccuggaaccaaccaccuggcuaucuuggcgcugccccucacugccucccccagggcuguccuccaggagcccaggcugaacaggcugugaagaagcugccugaagcugaaagccuaggggagggucaucuccugccccuugcaugcacuucucauuuuccuagaaagaaacccaaaaaagaaaucaagaccagaccucgggacauaggagaaaaaucccaaguguuuacacaguuaacacggagucuuuauggcaaagagaacauuuagcagcuuugaauauuggggcaucuccuuuuuacucaacacaagcauccuaggcccuauaaguguaacagggcacacgcccuaaaaaaaucaaagcgcaagaacgucuaagaggacuagguuuuguugcugggguuuauaggcuuuuguuucccccagugaggagcccagguguugguaggcagaggggccugagggaagaaucacuucccaguguugugcugaauggugccuggaugucacugggaccacuccuccacacgugccuucccuguuuagacccugcagaggaagcuguaggccaaguuccagauacugccagaauagcaccccacuccagagcuggaggcagcuagugaggguggguaucaaaaagaggaggagaguggaagaggacagcauuuccaugcaggcucucugaggacagugggagccucggcucugggauggccagggagggagguggcuguggcagggcagugugugacaugcuugaugcugggcugcugcgacacaggccucguucucacuuccuauacccucugcccuccucggccccuacagcuucccauucaguaacuaagauauuacaggugcauccaagagcaucuucccuucagggaugcaagaguugaagaaacaguuacaaaggccuucuggggccccgccaugucuguguuccauaccaguaacucucccuagaccaccguugucaccugcacucgcugccuagaaagcuggccaaagcccuuaacagucgcucugguuuuucugacugcuuugauuuucgggggauuccuuccuuuucuccuuccagcaaugagaucucccacacuuucucuccuucacuccacacagcuccucuacuuccagcaugccgacacuacccuccccucaagagaaagggaauaggcuggggaccccaaucacccaagcagucugguccucccugcccaccccaagggggcagcugagccagacagcgccugcgcccgccucuucggugcacugacccgcagucaucccaucugagaagauauauuggauaagaaggcauuuaaguccccaauguuagguccaggcccagcccuucuccaguuucggucuuagugagcguccacccccugccuccccaggcucacuuccuccgguccuuuggcuuucucuccugucgccgagccugcuggucagccaucgugcgaggaaugaggaggacacugccauccccagcauacugaagggcauacugacugggugaguagggccucccaugcucaucccgcagccgcccaaacaccuccugguauaagcuuuggaccuucugcuucaucugucgcagagaccgaaggaacucuaccuuuucucgaagcaaucgggccuuaucucgcugcaaguccuccacaucacguucuagguuuaggaugguguccaacuugcgcuugcggcaguucugugcagccaucuuguuuuugccccggcgccggauaucccggaugaggcugagcugggccucgcucagcugguauuuggacagcagcucauugaauucuucuacaggcagguugaugaucuugucauuggugaaugggaucuucauggcucgggcucugugcucaucucggcucaucugcuuguccaggaagucagccugcuuuuccuugcuaccuuucuugagggugcuggguggugguagaucagcagagucaagggcacugggugccauauuguauguaugauuguggcccacaugcucuaaguagggaaggcaagagagcugagaaggauccugauagcucaugcggcagaacuuggaguauuccggcugguagcccacugcacccucagccucuucuaggucuagggucucagagucagagcuguaaccaacagcacccuccucagagaaggaagaagaggcagaggaggaagcagaagaggaagaggaggaggaggaagaagaagagcucccuucagagcugcucagagaggaagggcuauggcuggaguccaaggagaggccugagucagagucaaacuccucuucgagcugggaagccugcaccggguugaagcccuccucaauggccagguccaucaggcugaucucauccagcauagcuucgucuaacaggcccccaagggggucagguagcucagggccugaugugucauuggcugugccauugagcugggauggaaagaaaagcccugcuagguugguagagccaaagguggaguugagacugguggaguugcuggggacgaguggaagcaguguggagcugcuagccacaggcaggcucuccaccucggggcugaagagggagaaguccugacugcagccccccagggacgccugaugcaggcugacauucugauugaugggaguguugggugcaaggcuguaguuggugcuaagagggucuccaggaggggcauuguacagaaucucacuugcugauguauuuacuuccauagccuagaagagagaauuguaccagcauucaaaaggagcagacuaacaccaaguaggccccccaaaugaagaauagcucccugagcauaagagcaaaccucaacaguaaagcccccagcuuagaccaacaggccugccacaagggguuccuaacuauggguuucaccccaauggagaacugaccagguacuggguguguggcuagauccccuuaucuugaaguggaauggaguacacaaacugaaauauccaagcagaguucugaaaaccugcuacaaagcuugcugugugaucguaagcgcaucaucaaacguuuccgaccuuccacugcccacauuuuaacaacugagggcuaaagguagcucaaugguagaacacgggccuggcaaguacccugggcuccauccccagcagugcaaaaaauuaauccuacagcaaagggguacuagauggcagcaggccaaaggaagaugcccauggccaugaagcacuaugucagagugucagcagcugauuaucugcuacaggaaagcaaggugcaacuccaugucagcccaugcuuugcaaggcuccauaccaaguuagaacucaaucccacccugcagucauccuucaggugucccuacuuugcuacugacuagccagagcaaauugguacccucuccuggagggcacguaacuacaagcugggacacccuacgcagagcccugcaggugcacuuuucugacaauccuaccugcauuuccaugauggacaugagaucuugccacugcuguuccaaaucaaauggugauucuguccccgucagaagaggagauagaaggcuguucugaagggcgggggacucacucucacuaggcacugcuucugggaugcuggaaacgucagcugggaacuaaggcacaacacagaguugaaugugaggguacuaacuaccuugggcuuucuccuagugacuaccaucuggcuccacaucuuucucuaauuagcaaccaggcuaaggccagaaccaagaacuggcccuguagcuaggggcuguguguugugcagguugcucagugggcucucugguccuccucaccucaguauucucucuaaagggcuggugaccuccagcagccuaagacacuuuuccaaugacaaggcugucauuggaaacugucaccaggcaucuguggcaauagcaacuguaaaucugacuggccuaggcccuggcuaucuauaacuacuguugacuggccugggccuuagcuaucuauaacaaacaccccuuuuccagaacagguuugcagugucccagccauucugaaugucagacccgaguacccuauucccaggacaaucaaagggauggagaaguauucuaagaugcuagacacuuugccugucugcaguaucuacugucaagaccuagugcuucugaguccauuguccacugugccuuuauagacccuaagccaaaacacaaucagguccacugcaaagacacaacucugauccagagcaaguguucuggaaguguuccagcauggugagucuggggagcagggagagcagcgaccagugucggagacaguaaggggcaguaccugugcagggaagcucuccccagucucuccaucuacuagcaggucucgggccagagcuuccgcacccucgccugaccagguguccucucguucucguccaucuugcaguuccuuauccacauccugcuccuucuggcgaugacuguagucaaaaaccucacgcccagcccccagaucaauauccugucgccaaaggaugucaaucagaucuauauccugaaagacagaccaagaugacuuuagcuuucaaguagucccccaucccagggagaaagcucccgguccuaccccuucacaggucccaccuacugacgcuccaaugaguccuggguggggucauacucaggccugugccuuuuagcccuccuuuccugcucccucugcaccagcaaggcaucauucauucccaggcaaccuuccaccaaaauaagaggcauugcuaaaaacuacuaaugugucuagcaucacacaggcuuucagguuuagacugugggccagagucacacccaagcuaaaggucagggcuguaucaccucuaaaaagacagaggaggaagcaagagaccccucuccuuuuaagauuuggagacucugaaaacacagacugucugaccauggcaagcaagggcaaacugcccuguggaauugcuuagcagugaccagacuugcaucagccuguggugccacugcauuugcauaaaggggugggguagccuagagaggaaaaucccugcauuuccaaccaccugaugcaaccaaugacaacgacaggcugucuucagcccuucuacagucauucccccuucauuggcucacagcuggaguaagcuugaacauccacaacuauuaaaggcccagccucaccucaugaccccugacagaauucaacugaucccagcaagcugccucaaccccaagggaaccucagacaguuagaugcuccccaggacauacauaccccacccuugcuuaggccaaucucucgcuacccccuuacaccagcgcuagcuaccucaccccucccacaccacaccccagcacucaccagcuccccaucagucaacccacucaaggacauaacucucaucacugcugagcugacugcaaccuuggacguuaaaaugccuccuuccacuuuguucuguggcuccuagacaguuccugcaccaacugccacccccacugacaucagcacagaaccccaauagagccauuucaacuuccuauauauaccccucccuuuaggagucuucucagcaaaccugaagggacccuuaaguguugccuuccuuccaaaaauuuaaaagcacacacuuuccacugaaaaguaucuuuaaaccaaccccaccacucuaccccaaagcagggacuaccaccuaccccauccuaagacacccccuccccgccagaccucccacauguuccucucccuugagucucccaccauacaccaaccugaacagaagcccuggacccaggagcagaggggggcugggccacccggugaccagccagccaagaguuaaggggccugucuuuggcauggcccccaccacugugagagcugcgguccaggcgggucauggucugcgagaggagccccagagcagccggugccgguaagccggacagggggcugcaaggagcucguggcuugcaggaagcacaccaggcuggaaggguggccccuugguagcuccgaggggcccgaggaaggugccccgcccgugcugcugccugggcggcccagcccagcccccuuccuccauccuggagcagcccccucccaccucacaaccccaguuccacucaggcgcccagcagcccccacccugagcucaccgcagaagcugcagugagucgggacucccaccccaugcuccgcgcucacgcugcagaggaaagcaacucccuccugagccuauccucccgcuccucccucucccccuccccacgccccccaaacuuguuaccuaggcugccgcaaggagccaauccccucccccucccaccccgcaggucacugcugaggcugcagagaaccaauccccucccccaggucagcagcuggggcugcggaaagagccaauccccucccacugucguuaccuaggcugcgccgcgagccaaucuccucccccaagucuccgcuggagaugcggaaggagccaauccccucccaccgccuguuaccuagcugcagaagggagccaaucucugcaccagggcagcuggagaagcugccgcaaggaaccggcccaucccugggccgccuccgucuccuugaggagaugcacccaggggcgggcagccccacccagcccagucagucagcugggguggugcagugagaguccugggggaaggggugccacuuuccucccuccugucgcaucuugcucugccagcccacuccugugacugggcagacacuccuccagaagcuucccugagaaacucaauucuuugcugggaaguggaaggaguuucccauuccuuaagaagacgauggcuaguccucaaggcuagggaucacaagccaggcugggcaggaacccagggcaacccaagccaaaaaaaaaaaaagcccaggagcuuugucacccuacaacaagccagacuggaggaaagggaaaagccauuauuacauacacacggcauguuagugcaggccaggccuauccccuaucaaaaacaaaaaacaaaacaaaacaaaaaaaaaaccagaaaguggagagacaauccugaagccagcacuagggagacaggugcugagcaccguccuggccgcagauaugccaguuacccacuuccauuuuagcuuuuuaaagaacuugggggaggggcuggggggucaggaggagaaaaggagagcauuuggugcccaacccgggcuagcaccucuccuagcaggccggccaggaggugcgagugggggaaacccgacagaauuggaauuuaaaaaucccacuucugccuuccuggauugcuuucucaggggaaauagaaauuucuccucacuacuacucccccagagccuaaggucaggccagagagacaguguguucucccuugguuacagccugcuucuaacccaggaagagcuguaaacaggccaccccuugcucugggcagggugccaaccuggaggggaauccuaucccugacaugggccuaagcuauggcugcccauggaacaggccuggcagcagggagcacuaccaccccagggauaauaccggcuccagcagugccugucacaugcucuggaccuggguauuuuuaucccugaguugcugaggaaauguuguucuaggcacaucauaauccucccuucccuccuccccagccugggucccucaggcaugacccacccagcuucccagagggaguggagugguagggccugggucagagaaaacacaccuucuuuacggccaugagaaggaaggcagauaccaaguuccauccuauucugcuccaacacacccaguuacauccaaaaauuucuauauuccccaaaaagcucccugaaggacaguaucagugcugacccuguaggguucucaggagaagaccuacccaugccacuugggggcaggaacaggauucuucagaucucaggacuucagaaguccauuuaaaucacagagugaggagaagcagaaaaaaggugagaugccaagcgacacuacaagaaucuaauacaaagccagacagcagaacaugccucaugauaaucccagcauuuagggagaggcaaagguaguagggcaagagaaguucugcaaguucaaggcuacccuuaccuacauaaagcaagauucaggccagccagaccaucucaaaaauaacacaauuuuaaagagagauagauauaagaccaaaaucucugauaggcaaaaaaugcuccggaccuccauggucagacaaucccagccucucgcacacagauccaggauagcuagcugaucugagugagcggcuuucccaaucacaaugaccaacaauucagggugagauaaacuguuuaagacaacacugcuggucuugccuaucagguguaccaguagcauccuuccccacagcugugacaaagaucaccccuagaugaggaccacggaucgaauauaagcauccucucuaccagucacuaaugaucaagacaacugagauaaugaguagaccuaaugcaggaagggagacaaacguggucugagauggugggcagagagaaccaagcucugcagcagcucuauccuccacacuaaccaggccagugcagagagcagugggucuuuugggggcuccuagggcuaguagcagaucagaccuguuucaccacuuagguagucagacagggcagcaguagcuauuugcaucacuaaagaaaaggaacugcauccuucucuguacccacagguuugccagcccugggccaggagcuaaagaucaccucuuaagcucagaucaagcugagcugagcacaguacaguucucuucuagcuuccagccuuuccugcucuacucccugcagcaggccuuuagcaaagaaugggagcuuuggccucugcuggccaaaaauaacuaccaaagucuaccccuuggcucaggcccaggagcuaaagggaguuuacaacaacaagccugaccuguagaacuuuaggauacaguaguaggauacaguguuuuagggugggggcgggggcggggcuaacaagucaagagaggccacacaguauuucuuagcaacaaugugcacucaaagccuaucauaacauaacccuguccccagcuaaggccucuagcagucauaccaaaaucuaagcaguaaaaacccugguauguucuaggaaccaccccacccugacaguacccucagaggugggucaauggaucaaaacaaaaauuuucccagcucccaacccugaagucagacaauuuaggccauuccuacccaaacagguccacagguccaaacccaaccccaaccuauuugguucuucagaggacucagugcagagccaacaacccuucagaaccagcccauuccucccccuuguccaggcccgcccaccgccauagggccacuaaccucuuugguuaagucuccacugacaggaggggcuacagcccccagguccuccaaaucuucaccgaaucccugcuccguuucgcuuucucucaccccguugucugggccugucacaucuuggaggccacuggaacucucgagggcgaggccugaguugggcuggcugccagagacagaccccuccgggucucgguggaccagccaagcauugaccucagugguaggcaccuggaaccuauccagggcccucaccugacuaaggagccgccgggcagugaaguaauuguccaggucuaugcucuugggguggaucccauagccauccaagguauuccucagguuguggaacugggucuggguauaggcagagcugggccccaggaugaucucccggagaggggggagcugugaggucagguaaguauccacguccacccgaaccccaaucagacucagcaggauggugaacuggagaaguccuuccguuaaauauuucuucagagaaagcauugcugaaggaccagaauauuuaugcuuuuuuguuuuuaaaucuuccacaagacaaaucaaggccacugcucugccacuucagccagcaggcuacccuccucagugccagacccuggaccccacccuggcacaacacaagggcugagcucccugacggccccagacgacagcacaccccguggagcgaaagccacauucacuuuucccuuuuugacaccucaccucgcaaaguugagccguucgaucguuccuaacacaguccaggcgcucagggcccucaacuuacuucaccacagcccauacacagucacuuucggauucacauuaguuguccucuauggagauccacugcaggcugcucacaccaacagcugauggagucuuucuuuccuccuuuuuuuuuucccccccuucuccuuccuaagguuuauuuucuuuggcuggagcuacaggucuuugucuugggucagagugucccgccuccucugcacuuaccagggggguuuccagagaacccugaaaugggaaucacagaacaacaagauaagauuccacacucuucacuucauggucaggguaagaagcucgggcagagaguaggaaacacguguaaagguuacuuuuacacggaaaagccaagccaaaccugcugugccaacuaugaaaggaaaaggaaggaaagaagcacccuaaauacuaaauauuaaaucugccacacuuccuaaaaggucuuauuugaagcagacugugcgugcaaggcauucaaaacuuucuuacacuuugucucauuuaccaacacucuuaauagaacacauuacccaguuucuaauuuuagcacaagaaguccauuuccuauccuuaaaaaaauuugguuucccaugucauuguccuuuccaacucuaaagagaagacagagauuauuacugagagacugugaaaaaauacaugaaaauguucaggccuccauuucauaugccuuuuuguuauuccaacuuuugaaaucucauuuccccuuuccuaucauucuuucauucguuaauuaauuaauuuauuuuuuuaaauaaaagaccagccuaauagcacaggccacucagaacguugaaacguuaagaucagggguuuaagaccagccugguuucaauaguaaaauaaaagaauguccaggacaaggauacagaucacgggugccugguuagaggcccuagguccaauccccaguauggcaaaauaaaagaacaggguaggguacaggaggacaguggaagauuguggagccgugcuccaccuggaauuugaauucacagguuuuagcuuuauucacaugaccuucugagccaaagcagaaggauauggccaaguucucgaucucacuugccaaguggggagaagguaaauuugccuucccauuucugauuucuacuuuugagcuuccauuaaauuccuaaacuccucuacuguggcccacuaucaacuucgcucuaaaggugaagugggagcgacacguaggagacacacacacccacgaauacccucauucgguugaguaaacaucccugcuuuugaaacccgcccguccucgcgcaauuuacuacuaaaacuucccaagagccacuuaaaguuugagagagcagacaaaguucuucaaagcccacaaggccaaagagagagcgcuccggccccaguccggucccacccugccguacccgagucuggaugagaccaagcugccaugcccacucucgccgacgcgccuccaagcuuucugggacacggagcgacaagugcuacuuugcuggccuugacccacccuuaaaagcgagccucaccccgcccuccguuccccaggccccaccccgcucgcgagcccagccucaccacgcccucccaugcccucggcccuucucaguccagcccacccaggaacacgcuuucuggucggccccgcguuucuuuccggccguguccagggcccgagcccgaucaagaccccucucggccucccgggucccgccuccugcuccucaaccacaucucgccgccccuuaucccacaagcuuucggcccuguugcaccgcggcuaucucguuggggaagggaauuagagcagguacccgcugcugaggucacagucugucgcugccgccacagcaggcccucagcccaagucccggccucgccaccgccgccgucgccgccaccuccggccggccuggagcgcccagccucggcuucccuccccgcccccuccuuccacugcacucg

SEQ ID NO: 6324 - RNA, 11367 nt, Mus musculus
cgucgcggggggcgggcacggggcggggcggcgcugucagugcaggcagcgagcggaaugcagcggccggaggccuggccacguccgcacccgggggagggggccucagccgcccaagccgggggcgcagcgccgcccacccgagccacggaacagcggguagggagcacggagugugggguccaggggcagcaggaucgguggucgggggcaacugauuuaccucgggcuucuaagcugggaacuuugugccaccacugcccagccccggagagggagcccgggcccaggaaggggagaaaaaguuuguccuggagcgcacgggcgaggaggccuugccugaguggagugucgcaggaggggcugaaguucuggggaacucgccgcaguuauaaccgacuuggguggccgggauggaagcgagauucuggcgggacgagggaggagugggaguggcgagguggucugguuggguucccuugcuccagaaugauggccgcgcgcaucuggaacugggggucagcuggacauaaggaggcucgucgccgcuguuccccgggccuagguucugugauacacuccgacucgggcucuggagcagucagugcaugacagaacuugggcccgguaggaccuucugcacccagcggacucagcgcccacuccucggaccugcagugaaacaucugucugggaguggagugggcaccggaaaugguccauguggcacgggguugggcuggaaccagcuauggguuggggauuagcuggcuccauagagcccugacucgguguccacuuugagucagggguuccuuucccuugucacuuucaggaaccuucucucuacaccaucaaggcugucuucaucuuagauaaugacgggcgaaggcugcuggccaagguaaccccuccccgcuggaaccucgaagacagugccauauguccaagacaagcgguccccacccagcccuuuuaacuccaccuauaggagaaacucugcauuuuggguggcagaacagcccagcuuagauucucuagaggucacuuuguccacacuaugcuuuaucagucuaacagcgaggggcugggugcgugaguggggaucccuucgguuucuuucucauguucccuggcgagucuucuccuuguccuuguccuggccagcugcauccuuggcgugggacgcuccaccaaagggaucaguggauaguugagccugcguccuagggaucugaguuccuaauccgaguagacaaagucgccuauguguauuucagcuagguaaacacgaaggacuuagcauaauaauguaguagaaucaggugcgauuggggagaccaucuagucucccucuuucacuucacagauguagacaaugaagucuagugacgcuaaguaaguugccuaaggucacaggguuagucucacgauugccaccaggacucaggauuuagaugugaggcucagguaguuuuccucgaacucccauucaguuauccgguauccauucuacauggccugggugagaugagcuaaaacuacauuuaaagcuaaguuucaggguagaucagauggcucaguggguaaggcugccaagcagccugacagcuugaguuggguccugaguucacauaguugaaagaggagcaaauuccucagguuguccucugaccucuauucuugucccucuacaaaacacacacacacuaaauaaauaaauaaauaaauaaauaaauaaauaaauaaauguuaaaaaaaagaaaaagaaaagacuauagaaaggaagaaaaaugcccuaaaauucugcuaccuugaaggccaggcaauggugcuugcuuugaauuccagcauucgggagacagaggcaggugaaucucugugaguuugaggccagccugggauacauaauaagaccuguuucaaaaacaaaugcaaaaacucaauaguaaauaaauaaauaaauaaauaaacaaacaagggcuggcgagauggcucagcugguaagagcacugacugcucuuccaaagguccugaguucaaaucccaaaaaacacaugguggcucacaacuaccacuaaugagaucugauguccucuucuguugcaucugaaaucagcuacagugcacuuauguauaauaauaaauaaaucuuuuuaaaaaauaaauaaauaaauaaacaaaauuccugccaucaauguaauuaacuguaacagaaauuuaguacuacuuaaguuuugauuuguguuguguuuuguuuuguuguggaccagguccuguuuuuccugcuucugccucuugagugcugaaaucacuggcaaguguggaacaccauccccuaguuuuuuguuuguuuguuuguuuguuuguuugggguguguguguguaugugugugugugugguuuuugagacaggguuucucugugucaccuuggccauccuggaacucagucugucgaccuggaacucagagaguagccugccucugcuuccugagugcugguguugacagaugccaccacaaccagcccacaaccagauuaauuuuguuugccuguuuuguguuuuugaaacaggggguuacuuuguuggccuggaacuuacuguguagcccagguuagccuggaagucacacagugauccuaccucagccucccaagugcugagauugcauuugugagccauacuauucgguuuuuuucuuuuugagacggggucucguguagucaagguuggccuagaaccccugaucuuccugcuucuuccucccaagugcugggauugcaggcaugugacaccacccccagcuauaacaucuaaauuaguuauuaaauauguuaaagccuuuucggucuucuuuagcauucaaaugaguuuguucaccauuguaggagacagcagagagacuacuaacuugccugcagaauugacugugggaugcaaaguucacaugcagaaauuugagcugaccacaccuugcuucagccaaugggcagagguggauuggcccugccaaaguuucuggggccuccuucuagaagguccuauccuuguuauauauuaaauugcagaugaagcaguggugaggcacgccuuuaaucccagcacuugggaggcagaggcgggcgaauuucugaguuugaggucagccuggucuacaaagugaguuccagcacagccagggcuauacagagaaacccugucucgaaaaacaaaaacaaaaacaaaaaacaaaaaaaagagauuuauuuauugauuuuaugcauaugaauacacuauagcuaucuucagacacaccagaagagggcaucggauuccaugacagaugguugugagucaccaugugguugcuggaaauugaacucaagaucucuggaagagcagucagugcucuuaaccacugagccaucucuccagcccauuucucuacuuucauuucucuucccuuggaauuuguuuauggggaccaaggagaagauagugcugggagggaggugacaaggaggugcagccuggccccugaugcucccugcuaagcccucuccugaggcaggagcuagcuccaugcaauggcuauugucuucucuuucucauaguauuaugacgacacauuucccuccgugaaggagcagaugguuuucgagaaaaaugucuucaacaagaccagccgcaccgaaaguaaggcccacccauccuccacggaagcucucagaugacugaccaccagugucugucaucuucuccauccggacacgucuguccacaucuguucuuguuggccuuccacacccacaagccauugccuucuccucggaggcucuuugucucucuuccccagcugcguuucgcucccuucuuucaaucaucccggaaaccuucgcuccccauccuguucauccgcaccccuccucucagcugaggaggccgacugugugcccccuacacacacuuggaucuggucccagggcauugcauggauggaggguggagggguggggcagggggaggucagccuuaggcuggguuuguugacucuucaacaggaggucucuucucaagacauaccacaaggaugagcagccuccugguaaugguagucuggccagagguccuugagaaaggaaguagaaaacaaaggaagaggccuggggaagcagagaccaggcuagccccagguugggguuggcgugugcugaucugagagccuucccccuuccaggugaaauugcauuuuuggggggcaugacuaucgucuacaagagcagcauugacaucuuccuguauguggugggaucuuccuccgagaaugaggugaauuucagagauugggugacaagaagggucuguccugggcuggagguggguuaugaaggcucacuguugguacuagcaauaggucuggggguagaaggacauccagaacgggucucucuguaaucauacacauccguaauguuccuuaggucccuugggacccagaaaugaaaucuucacaccuucuguagggagcuguugcuucuugcugagcguauuuugagaaggagacacccaagggaucacuccagugucccgcagcccaaacacuaguuucccccucucaaaucaaagagucauuagccuccagccaagcccucucugacuuagggaaugcuucccgucuggcccacacagggagcucagaggcccacuuuggaccucucagccucagcucucuucuuaucguccucccacucucuccuccucagcugaugcucaugucugugcuugccugccuguuugacucucugagccacaucuuaagguaagugagacccuccgaaccccagggccccagcccccggggccuuucccuuugucucagaggagaggcuguuuugcccugcuguccugcuggaaccccugcaagucuuagaaccagaauaacuuccuucaaggccccugacacccaugaugcccccaggcagacccaugcccaggguaugaucagauaucaaaucucaagacacugacuuagcugagguuacaaguauucgugucaacaaaaguccccaacacagggagaggaaggucuuguuacacauggcccacacugaccuccucucagucccucacagucuccugugugcuggaauuacagguguguaccaacaugccccacuguaaacaguauuuuuaacuuuaaacucagaguugguuuuucccaaauccccaguuacugauaccuaccuaggaacauagucuagacaaaccaaucuaggaugaccuuagccuacucuggcaccucucuguuccuacugccuuuuauccuccugaacaggccuuguucggaagggaugcuggagaggagcugccucccuuagagggggcgugguuccucuuggcuaccagaaagcuuaggcucuugugucugcccucaggaagaacguggagaaacgcugguugcuggagaacauggacggagccuucuuggugcuggaugaaacugucgauggagggugaggaggggacugggagaagagauguugggagcacccugguccaacucuaucuggccaacucaucuucccuucuucuaccuauuccuagugagccucuaaccucauuccucccuacucgugagggcagagggugaaaucauuauuaguccaagucaagucaaaugggagaguagccugagagucaccuaccgugugcagccaaauaggucaaguauggggaaaguucagguugaucuccaaugcugacgaggaauacggacaccugucccuuucugagaggaccucagagaauccucccccaacaccagcaagauacauggcauugacucucugugagucuauuuuccuugucacuaaaaugggaaagaaaaugggaaagaagccaacaggauggugaagguccuacaaaaugguguguauaguauaaagcccauaguuuuccuugguaguugggggauuuuuuuuucucuccuugguaaauauugucucucauuaauaugcuagcagacuucuaaaugauugggagccuuuaugagaaugguugguuaguagaaucucuuggaagaggggacaauaaucaggggagaggaaaguucugacucuggucacagaaacuucgagagugccuuucccccaccuggccuucuaaccucagugcuggaggcacagggauuacagcauccuugaaacaccugcccauuuuauggaggaggaaauagaggcucagagauucuaguaacuuauggaagagcacacagcaagggaauuagcagggucaagucuaaaaccgugugugugugugugugugugugugugugugugugugugugugagagagagagagagagagagagagagagagagagaugguucagaggcuacgugcuccauggcacgcaaccugagagcaggggcuucugggaggcuggggucggcgaaugccucgcucucuuucuguuuguauuuacugccugcugcugcuugagguaauacugaugccuggauucuaaacggaaggaagaccuggucccugcucaagcucagucuugguuuguuagguugguggcaaguaccuguaaugguugugccgucucacaagccccuccucgguugagcauuacccaaagcuagucauggcggugaacaugguauaaaguguagaaggagcagagcugagaguccccaugggaagggacagaugugaccucaggaccaucuaugggaaagguuccccggaggagagacacuacaggguauauuaaaaaacugaaaguggcuuguggggggggggaaucacaucaccaacucacccccaaauuuucucuuaucuuguagugugauucuggagagcgacccccagcaagugauccagaaagugaauuuuaggguaagccuuuguguuccccuucgccaucuuucccagacugucuuuccugccuucccuacucuugaccuuccagggcaccaggcugucagggcucagcugaugggagcccagcuacucagacgucuaagaggaaagcuuccaguucauucuccauagaaacaaaaccaaaauagccccuucucauccucuagugagaggcuuggauggacgaguaacugagcucucaaaaugacuccagcggggcuggagagauggcucagugguuaagagcaccgacugcucuuccaaaugguccugaguucaaauccuagcaaccacaugguggcucacaaccaccaauaaugauaucugaugcccccuucuggugugucugaagacagcuacaguguacuuacauauaauaauaaauaaaucuuuaaaaaaaaugacuccagggacagccuugggaccugggcugugcugaggcugugguacacucuuccgguuggccuuuuuaugucugcaaucugggugacaccuuuucccuacuuuauuucccuucgugcaaacagaagggucccagcuuuguuaagggugccacucagugguaaaacacuuagcuagcaugugagacccuggguuuaauucccagcaauggaggaugggugggggugggggguccuggcuuccaaaugacaggcugcaggaccucugucuacuaggcagcgauaaccgugcaguucuggaucauguuaacuaccacacccucgcccugcaaggcaaggucacgucucuaguucaacagcuccuuucugcucugacuugacuuugugauucuccuuucccgcagacugaugacaguggccuaacagaacagaguguggcccagguaagccucaugcaucugcuuuggccagaaacaggcuaaaggucagggagagcccagugccccaggggagagagucagaguuaggaaaccagagguguggggcaagggaugaacuggugacucagagccagccauuggaggcugcugagcucuuggcaacugggcagugagagaugggugggcaaauucccgccugcucaccucaucuccuacccuaaacgagcuacccuggugaugccagguuacuuguuacccaaggcaacguggaggcucagaucccucauauucccuccaaccuggacggguaauccauguggggccaugcugggauaguuaagggccuuaucaccuuaucauaagauccgaacucaucacaucugcccuugguagcuuggcuguugaaaagaagccgaccacacggcugcacagccuugagaugcaugcagaauacagcggcgcagugugugugugugugaguguguguguguccguccguccguccugguuacuguuagcagauugauuccccagcuucacagacuuccugacagucaagccuaaugguuugaccuccuaugcucugucagacuuacuccguuucuaagaaguuuucuucccuggcauaagcuaguccuaacaugguagcccugcagagaugggccuuugucaucaguggggaacaccagaugugagacccacuucccuacgcuguccucagcaccccaccugcccuguggccccccauguuuccucauguucugcuggaaaagaauguggcugcgugcuggcuuucagaguggaaguagauugagaagagccaggaguaguggcucacgccuucagucucagcacuugggagguugaggccacaugauuucagguucaagggcagccugagcuacacugugaguuucuguguaggcagggauguagcaggagacuuuauguaaaaucaaauagcauaaaauaaaccaaccugggcauggugaugcacaccuguaaucucagcacuugggagguguacaggaggauuaauaguucaaagucauaacaaguuugaagccagagugaucuacaugagagcuugucuuaaagcaacaguaauaagcgguccauugagaugucucagcaaguagaggcaccugccuccgagccugaugggcugagucugaccgagauaagagagcugacccccuaaaaguguuugcugaccuccacauaaacacacaaaaguaaauacaugaaauacauauuaaacauuauuuuuuuuaaaauauucauuuauuuuauuuauaugaguacacugaagcugucuucagacacaccagaagcaucagauccuauuacagaugguugugagccgccaugugguugcugggaauugaacucaggaccucuggaagagcagccagugcucuuaaccacugagccaccucuccagccccauauuaaacauucuauaaggggaguguugaugagcagagaagagaagaacagcuggggagggcuaacugcauggcucagugguuacgagcacucacugcucuugcagaggacccggguucaauuccaagcauacacaugguggcucacaaccauuuguaacacuaguucuagggaauacuggugucuucugcaggcaccaggcacacaugugguaagcagacauacagacagacaaaacaccuaugcacauacaaaguuaaaagagaagaauacaagccgggcgggguggcgcacgccuuuaaucccagcacucgggaggcagaggcaggcggauuucugaguucuaggccagccuggucuacagagugaguuccaggacagccagggcuacacagaaacccugucucgggaaaaagagagagagagagagagagagagagagagagagagagagagagagagagagagagagaacacagcuggaaugggaggcgaagcccuggguguggcuccaggcacuucaccgcaugguggggcagugcaugcuccugaugcagcgcuuccaguuuggaggcuggggcaucaaagaacgagacuguuucaaaaccaaacacaagccagacagugguagaacacuuuaauuccagcacucgagaggcagaggcaggugaauuucuaaguucgaggccagccugggcuacagagcgaguuccaggacagccaaggcuacacagagaaacccugucucgaaaaaccaaaaccaaaaccaaaacaaaaccaaaccacuacugcuacucccacccccuaguauucauuugagucauccuaagcuuuuacuuugccaacaaaaacugaauggcaaguuacucagcaccucuagggcucuagaauagaauuuaccugguagaguuauauuaauuacaugauuggccaugcugccaaaccuggaaaauuaaguuguacauccucaggaaacaauuccucucuuucuaaaugagcaagcaacaaauaaagacugguagggccuuguuauguagcccaggcuggccuugaagcccuuaucucuccugccucauauucccagggccugaaauuauaggcaccacacaugaggauuaguggaaaucuuaaagaaacacaaaaguuauagggacacaaaaugaaacguggagagagagagguuccuuagcagagauucaagaacuucacuguccccagcaaagagggagauuccaagagaggaggacauacacagugcgggguggacauuuuggaggaggcuuuaugcccagagagacagucugaguaucccgaguccccccucauguguuggcaucacgugugcacauuggcacagauacgggcacacacuggacugagauguuuuuucuugguaguaggagcacacacacauacacacaccugacagcuuugucacaucagcaaaugggauggggugcugagaacacaccccaucaaaaccagcaucacaaguuuauuacggugucaagugucugagcacaggcgugguugagccugggcccagucucugccugccugauggcgcggugaggaggcacuauuacuguggccugauauggcuuaggggaggcaggggcuaccgccucacccacaguuggacaggcuugggaggcagccagcuggguugcagcccucuggaccugcccuagccuccaaaaccucaucucauuaaagaagaggcaagcugcugccaucuaguggccagggcuggagaggcgcccuugucgaccuccaaucacugacauucucaaauauuucucccaaccuccuacucucacuucagguucuucagucagccaaggaacagauuaaauggucgcuauugaaaugaagaccuuggaaucaaggcuccuuccccagagaacuuuugccaguccccgcguaagccccaagaucucaagacgcaagagagaccacucugccuucucaggccucucucagaacugaucccugaggucuccugccagggauucugagacgcaaaagcuugaccccagcucccucaccccuacucagcauccuaaccuggccuuggggccaugggaaccagcaaaguugccuccccucggaccucugacauccucaguccuaggccuuaauaaacuuacauuuuucccccccaaag

SEQ ID NO: 6325 - RNA, 11367 nt, Mus musculus
cuuugggggggaaaaauguaaguuuauuaaggccuaggacugaggaugucagagguccgaggggaggcaacuuugcugguucccauggccccaaggccagguuaggaugcugaguaggggugagggagcuggggucaagcuuuugcgucucagaaucccuggcaggagaccucagggaucaguucugagagaggccugagaaggcagaguggucucucuugcgucuugagaucuuggggcuuacgcggggacuggcaaaaguucucuggggaaggagccuugauuccaaggucuucauuucaauagcgaccauuuaaucuguuccuuggcugacugaagaaccugaagugagaguaggagguugggagaaauauuugagaaugucagugauuggaggucgacaagggcgccucuccagcccuggccacuagauggcagcagcuugccucuucuuuaaugagaugagguuuuggaggcuagggcagguccagagggcugcaacccagcuggcugccucccaagccuguccaacugugggugaggcgguagccccugccuccccuaagccauaucaggccacaguaauagugccuccucaccgcgccaucaggcaggcagagacugggcccaggcucaaccacgccugugcucagacacuugacaccguaauaaacuugugaugcugguuuugaugggguguguucucagcaccccaucccauuugcugaugugacaaagcugucagguguguguaugugugugugcuccuacuaccaagaaaaaacaucucaguccagugugugcccguaucugugccaaugugcacacgugaugccaacacaugaggggggacucgggauacucagacugucucucugggcauaaagccuccuccaaaauguccaccccgcacuguguauguccuccucucuuggaaucucccucuuugcuggggacagugaaguucuugaaucucugcuaaggaaccucucucucuccacguuucauuuugugucccuauaacuuuuguguuucuuuaagauuuccacuaauccucauguguggugccuauaauuucaggcccugggaauaugaggcaggagagauaagggcuucaaggccagccugggcuacauaacaaggcccuaccagucuuuauuuguugcuugcucauuuagaaagagaggaauuguuuccugaggauguacaacuuaauuuuccagguuuggcagcauggccaaucauguaauuaauauaacucuaccagguaaauucuauucuagagcccuagaggugcugaguaacuugccauucaguuuuuguuggcaaaguaaaagcuuaggaugacucaaaugaauacuagggggugggaguagcaguagugguuugguuuuguuuugguuuugguuuugguuuuucgagacaggguuucucuguguagccuuggcuguccuggaacucgcucuguagcccaggcuggccucgaacuuagaaauucaccugccucugccucucgagugcuggaauuaaaguguucuaccacugucuggcuuguguuugguuuugaaacagucucguucuuugaugccccagccuccaaacuggaagcgcugcaucaggagcaugcacugccccaccaugcggugaagugccuggagccacacccagggcuucgccucccauuccagcuguguucucucucucucucucucucucucucucucucucucucucucucucucucucucucucuuuuucccgagacaggguuucuguguagcccuggcuguccuggaacucacucuguagaccaggcuggccuagaacucagaaauccgccugccucugccucccgagugcugggauuaaaggcgugcgccaccccgcccggcuuguauucuucucuuuuaacuuuguaugugcauagguguuuugucugucuguaugucugcuuaccacaugugugccuggugccugcagaagacaccaguauucccuagaacuaguguuacaaaugguugugagccaccauguguaugcuuggaauugaacccggguccucugcaagagcagugagugcucguaaccacugagccaugcaguuagcccuccccagcuguucuucucuucucugcucaucaacacuccccuuauagaauguuuaauauggggcuggagagguggcucagugguuaagagcacuggcugcucuuccagagguccugaguucaauucccagcaaccacauggcggcucacaaccaucuguaauaggaucugaugcuucuggugugucugaagacagcuucaguguacucauauaaauaaaauaaaugaauauuuuaaaaaaaauaauguuuaauauguauuucauguauuuacuuuuguguguuuauguggaggucagcaaacacuuuuagggggucagcucucuuaucucggucagacucagcccaucaggcucggaggcaggugccucuacuugcugagacaucucaauggaccgcuuauuacuguugcuuuaagacaagcucucauguagaucacucuggcuucaaacuuguuaugacuuugaacuauuaauccuccuguacaccucccaagugcugagauuacaggugugcaucaccaugcccagguugguuuauuuuaugcuauuugauuuuacauaaagucuccugcuacaucccugccuacacagaaacucacaguguagcucaggcugcccuugaaccugaaaucauguggccucaaccucccaagugcugagacugaaggcgugagccacuacuccuggcucuucucaaucuacuuccacucugaaagccagcacgcagccacauucuuuuccagcagaacaugaggaaacauggggggccacagggcagguggggugcugaggacagcguagggaagugggucucacaucugguguuccccacugaugacaaaggcccaucucugcagggcuaccauguuaggacuagcuuaugccagggaagaaaacuucuuagaaacggaguaagucugacagagcauaggaggucaaaccauuaggcuugacugucaggaagucugugaagcuggggaaucaaucugcuaacaguaaccaggacggacggacggacacacacacacucacacacacacacacugcgccgcuguauucugcaugcaucucaaggcugugcagccguguggucggcuucuuuucaacagccaagcuaccaagggcagaugugaugaguucggaucuuaugauaaggugauaaggcccuuaacuaucccagcauggccccacauggauuacccguccagguuggagggaauaugagggaucugagccuccacguugccuuggguaacaaguaaccuggcaucaccaggguagcucguuuaggguaggagaugaggugagcaggcgggaauuugcccacccaucucucacugcccaguugccaagagcucagcagccuccaauggcuggcucugagucaccaguucaucccuugccccacaccucugguuuccuaacucugacucucuccccuggggcacugggcucucccugaccuuuagccuguuucuggccaaagcagaugcaugaggcuuaccugggccacacucuguucuguuaggccacugucaucagucugcgggaaaggagaaucacaaagucaagucagagcagaaaggagcuguugaacuagagacgugaccuugccuugcagggcgagggugugguaguuaacaugauccagaacugcacgguuaucgcugccuaguagacagagguccugcagccugucauuuggaagccaggaccccccacccccacccauccuccauugcugggaauuaaacccagggucucacaugcuagcuaaguguuuuaccacugaguggcacccuuaacaaagcugggacccuucuguuugcacgaagggaaauaaaguagggaaaaggugucacccagauugcagacauaaaaaggccaaccggaagaguguaccacagccucagcacagcccaggucccaaggcugucccuggagucauuuuuuuuaaagauuuauuuauuauuauauguaaguacacuguagcugucuucagacacaccagaagggggcaucagauaucauuauuggugguugugagccaccaugugguugcuaggauuugaacucaggaccauuuggaagagcagucggugcucuuaaccacugagccaucucuccagccccgcuggagucauuuugagagcucaguuacucguccauccaagccucucacuagaggaugagaaggggcuauuuugguuuuguuucuauggagaaugaacuggaagcuuuccucuuagacgucugaguagcugggcucccaucagcugagcccugacagccuggugcccuggaaggucaagaguagggaaggcaggaaagacagucugggaaagauggcgaaggggaacacaaaggcuuacccuaaaauucacuuucuggaucacuugcugggggucgcucuccagaaucacacuacaagauaagagaaaauuugggggugaguuggugaugugauuccccccccccacaagccacuuucaguuuuuuaauauacccuguagugucucuccuccggggaaccuuucccauagaugguccugaggucacaucugucccuucccauggggacucucagcucugcuccuucuacacuuuauaccauguucaccgccaugacuagcuuuggguaaugcucaaccgaggaggggcuugugagacggcacaaccauuacagguacuugccaccaaccuaacaaaccaagacugagcuugagcagggaccaggucuuccuuccguuuagaauccaggcaucaguauuaccucaagcagcagcaggcaguaaauacaaacagaaagagagcgaggcauucgccgaccccagccucccagaagccccugcucucagguugcgugccauggagcacguagccucugaaccaucucucucucucucucucucucucucucucucucucacacacacacacacacacacacacacacacacacacacacacgguuuuagacuugacccugcuaauucccuugcugugugcucuuccauaaguuacuagaaucucugagccucuauuuccuccuccauaaaaugggcagguguuucaaggaugcuguaaucccugugccuccagcacugagguuagaaggccaggugggggaaaggcacucucgaaguuucugugaccagagucagaacuuuccucuccccugauuauuguccccucuuccaagagauucuacuaaccaaccauucucauaaaggcucccaaucauuuagaagucugcuagcauauuaaugagagacaauauuuaccaaggagagaaaaaaaaaucccccaacuaccaaggaaaacuaugggcuuuauacuauacacaccauuuuguaggaccuucaccauccuguuggcuucuuucccauuuucuuucccauuuuagugacaaggaaaauagacucacagagagucaaugccauguaucuugcugguguugggggaggauucucugagguccucucagaaagggacagguguccguauuccucgucagcauuggagaucaaccugaacuuuccccauacuugaccuauuuggcugcacacgguaggugacucucaggcuacucucccauuugacuugacuuggacuaauaaugauuucacccucugcccucacgaguagggaggaaugagguuagaggcucacuaggaauagguagaagaagggaagaugaguuggccagauagaguuggaccagggugcucccaacaucucuucucccaguccccuccucacccuccaucgacaguuucauccagcaccaagaaggcuccguccauguucuccagcaaccagcguuucuccacguucuuccugagggcagacacaagagccuaagcuuucugguagccaagaggaaccacgcccccucuaagggaggcagcuccucuccagcaucccuuccgaacaaggccuguucaggaggauaaaaggcaguaggaacagagaggugccagaguaggcuaaggucauccuagauugguuugucuagacuauguuccuagguagguaucaguaacuggggauuugggaaaaaccaacucugaguuuaaaguuaaaaauacuguuuacaguggggcauguugguacacaccuguaauuccagcacacaggagacugugagggacugagaggaggucagugugggccauguguaacaagaccuuccucucccuguguuggggacuuuuguugacacgaauacuuguaaccucagcuaagucagugucuugagauuugauaucugaucauacccugggcaugggucugccugggggcaucaugggugucaggggccuugaaggaaguuauucugguucuaagacuugcagggguuccagcaggacagcagggcaaaacagccucuccucugagacaaagggaaaggccccgggggcuggggcccugggguucggagggucucacuuaccuuaagauguggcucagagagucaaacaggcaggcaagcacagacaugagcaucagcugaggaggagagagugggaggacgauaagaagagagcugaggcugagagguccaaagugggccucugagcucccugugugggccagacgggaagcauucccuaagucagagagggcuuggcuggaggcuaaugacucuuugauuugagagggggaaacuaguguuugggcugcgggacacuggagugaucccuugggugucuccuucucaaaauacgcucagcaagaagcaacagcucccuacagaaggugugaagauuucauuucugggucccaagggaccuaaggaacauuacggauguguaugauuacagagagacccguucuggauguccuucuacccccagaccuauugcuaguaccaacagugagccuucauaacccaccuccagcccaggacagacccuucuugucacccaaucucugaaauucaccucauucucggaggaagaucccaccacauacaggaagaugucaaugcugcucuuguagacgauagucaugccccccaaaaaugcaauuucaccuggaagggggaaggcucucagaucagcacacgccaaccccaaccuggggcuagccuggucucugcuuccccaggccucuuccuuuguuuucuacuuccuuucucaaggaccucuggccagacuaccauuaccaggaggcugcucauccuugugguaugucuugagaagagaccuccuguugaagagucaacaaacccagccuaaggcugaccucccccugccccaccccuccacccuccauccaugcaaugcccugggaccagauccaaguguguguagggggcacacagucggccuccucagcugagaggaggggugcggaugaacaggauggggagcgaagguuuccgggaugauugaaagaagggagcgaaacgcagcuggggaagagagacaaagagccuccgaggagaaggcaauggcuuguggguguggaaggccaacaagaacagauguggacagacguguccggauggagaagaugacagacacugguggucagucaucugagagcuuccguggaggaugggugggccuuacuuucggugcggcuggucuuguugaagacauuuuucucgaaaaccaucugcuccuucacggagggaaaugugucgucauaauacuaugagaaagagaagacaauagccauugcauggagcuagcuccugccucaggagagggcuuagcagggagcaucaggggccaggcugcaccuccuugucaccucccucccagcacuaucuucuccuugguccccauaaacaaauuccaagggaagagaaaugaaaguagagaaaugggcuggagagauggcucagugguuaagagcacugacugcucuuccagagaucuugaguucaauuuccagcaaccacauggugacucacaaccaucugucauggaauccgaugcccucuucuggugugucugaagauagcuauaguguauucauaugcauaaaaucaauaaauaaaucucuuuuuuuuguuuuuuguuuuuguuuuuguuuuucgagacaggguuucucuguauagcccuggcugugcuggaacucacuuuguagaccaggcugaccucaaacucagaaauucgcccgccucugccucccaagugcugggauuaaaggcgugccucaccacugcuucaucugcaauuuaauauauaacaaggauaggaccuucuagaaggaggccccagaaacuuuggcagggccaauccaccucugcccauuggcugaagcaagguguggucagcucaaauuucugcaugugaacuuugcaucccacagucaauucugcaggcaaguuaguagucucucugcugucuccuacaauggugaacaaacucauuugaaugcuaaagaagaccgaaaaggcuuuaacauauuuaauaacuaauuuagauguuauagcuggggguggugucacaugccugcaaucccagcacuugggaggaagaagcaggaagaucagggguucuaggccaaccuugacuacacgagaccccgucucaaaaagaaaaaaaccgaauaguauggcucacaaaugcaaucucagcacuugggaggcugagguaggaucacugugugacuuccaggcuaaccugggcuacacaguaaguuccaggccaacaaaguaacccccuguuucaaaaacacaaaacaggcaaacaaaauuaaucugguugugggcugguugugguggcaucugucaacaccagcacucaggaagcagaggcaggcuacucucugaguuccaggucgacagacugaguuccaggauggccaaggugacacagagaaacccugucucaaaaaccacacacacacacauacacacacacaccccaaacaaacaaacaaacaaacaaacaaaaaacuaggggaugguguuccacacuugccagugauuucagcacucaagaggcagaagcaggaaaaacaggaccugguccacaacaaaacaaaacacaacacaaaucaaaacuuaaguaguacuaaauuucuguuacaguuaauuacauugauggcaggaauuuuguuuauuuauuuauuuauuuuuuaaaaagauuuauuuauuauuauacauaagugcacuguagcugauuucagaugcaacagaagaggacaucagaucucauuagugguaguugugagccaccauguguuuuuugggauuugaacucaggaccuuuggaagagcagucagugcucuuaccagcugagccaucucgccagcccuuguuuguuuauuuauuuauuuauuuauuuacuauugaguuuuugcauuuguuuuugaaacaggucuuauuauguaucccaggcuggccucaaacucacagagauucaccugccucugucucccgaaugcuggaauucaaagcaagcaccauugccuggccuucaagguagcagaauuuuagggcauuuuucuuccuuucuauagucuuuucuuuuucuuuuuuuuaacauuuauuuauuuauuuauuuauuuauuuauuuauuuauuuaguguguguguguuuuguagagggacaagaauagaggucagaggacaaccugaggaauuugcuccucuuucaacuaugugaacucaggacccaacucaagcugucaggcugcuuggcagccuuacccacugagccaucugaucuacccugaaacuuagcuuuaaauguaguuuuagcucaucucacccaggccauguagaauggauaccggauaacugaaugggaguucgaggaaaacuaccugagccucacaucuaaauccugaguccugguggcaaucgugagacuaacccugugaccuuaggcaacuuacuuagcgucacuagacuucauugucuacaucugugaagugaaagagggagacuagauggucuccccaaucgcaccugauucuacuacauuauuaugcuaaguccuucguguuuaccuagcugaaauacacauaggcgacuuugucuacucggauuaggaacucagaucccuaggacgcaggcucaacuauccacugaucccuuugguggagcgucccacgccaaggaugcagcuggccaggacaaggacaaggagaagacucgccagggaacaugagaaagaaaccgaagggauccccacucacgcacccagccccucgcuguuagacugauaaagcauaguguggacaaagugaccucuagagaaucuaagcugggcuguucugccacccaaaaugcagaguuucuccuauagguggaguuaaaagggcuggguggggaccgcuugucuuggacauauggcacugucuucgagguuccagcggggagggguuaccuuggccagcagccuucgcccgucauuaucuaagaugaagacagccuugaugguguagagagaagguuccugaaagugacaagggaaaggaaccccugacucaaaguggacaccgagucagggcucuauggagccagcuaauccccaacccauagcugguuccagcccaaccccgugccacauggaccauuuccggugcccacuccacucccagacagauguuucacugcagguccgaggagugggcgcugaguccgcugggugcagaagguccuaccgggcccaaguucugucaugcacugacugcuccagagcccgagucggaguguaucacagaaccuaggcccggggaacagcggcgacgagccuccuuauguccagcugacccccaguuccagaugcgcgcggccaucauucuggagcaagggaacccaaccagaccaccucgccacucccacuccucccucgucccgccagaaucucgcuuccaucccggccacccaagucgguuauaacugcggcgaguuccccagaacuucagccccuccugcgacacuccacucaggcaaggccuccucgcccgugcgcuccaggacaaacuuuuucuccccuuccugggcccgggcucccucuccggggcugggcagugguggcacaaaguucccagcuuagaagcccgagguaaaucaguugcccccgaccaccgauccugcugccccuggaccccacacuccgugcucccuacccgcuguuccguggcucgggugggcggcgcugcgcccccggcuugggcggcugaggcccccucccccgggugcggacguggccaggccuccggccgcugcauuccgcucgcugccugcacugacagcgccgccccgccccgugcccgccccccgcgacg

SEQ ID NO: 6326 - RNA, 9092 nt, Mus musculus
ccgcugaagacggcgacguggcugaaggaggccgguuuguuucggaacugaggcucaagcacagccgcucaggauuggugcuaggcugggccggggucuuuggccggaagcggaaguggagaaaggaugcagguguggggaccagggcuggagaaacugggucuucucugggauuccuguccugccuccucaaguccucccguccucugucgggugcucugccccugcaggguggcgguuggacucguggaaugagcgcgcgcgaggcgcaucgccuucccgcguucacgcccucccucccggucguauuucccaccaggaccaucagcacgugcccaucgacauccagaccagcaagcugcucgguaggagagggcgcccccgcgcggucggcucucgggggaggucugcuaguugcccccugucaccaaccagcagccaggagcugugaaagucccagcugaggugcuuuacuccagcgaacuguuugcucugcaaggaaggaagcauggaaagucuguacuggcuccguguuuucuacuuuuaacguuucucacguaguaucaaaucguauucaggcacacaggacaaauggauaguguuaaagauggacaguuaagcaaauggcugauccauuugaaaccuaagucuguuugguucugucuucaugcauuuugcauuauuugggguggguaauccucucccaucuauuuaaaaaguuucucuccuuggauuuagggagaagagggcccuaagacucacauacagaccuuuuaugccaaccauggugguucacacugguaaccauaauacuugggaggccgaggcaggaggauugguggcaguucucagacagccuggcuugcauagcaaguaccagccuaguacuccccgccccccacccccacccccccaaaaaaccuuuagucuuagcacucagaaggcagaggcaggccuuggccacauagcaagcaccagggcagccaggacuacauggagagacacuauuucaaaagaaaaugacagagagacaagaagaccuuuuagugaccaggcagucucugcaucuggcuuacaucccucauucugucacuucuggggguguguacagccccuggcccuuguguucaccagauacgccaguccacugguaacacguccuuaagaggguguuugccgaccucagccccuggaggaauucuggugucugcuguuuuccuuucugacaacuugagaagaacucagagucagaauuucugauacuguuguugcuugagagaaauuaagcgguugaaagauuuguuuuaaaggagagggaguauucaguccuuugauggacacuggugaguccucccaagugccugccaggcacgggccaccauguauucauaguguaugggcacccgcugcaucuaccugggugugccaguuuguccucgaguccugagaagaaccaguaggacaccgcucaccauggagcauuuguuccauccccgcugcuauuuuauacuugucuuuguuaagaugaaaucacuaagguuuugugagccacugcgaggcacaaggcucggugcauagggccucaucugauguguggggaaacugagguacagagagauggaaaggaacugagagccagcaggauggcucaguagguaaauguucuuaccggcaagucugaugaccugaggucagcaucaggaccccugugauggaaggagaggcuuagaucucaaaaguugucgucugaccuccacuugugagcuguggcacaugugcauacauacauuuaugugcauacagaguaaauaaaguuaaaaacagacgagcggggcuggugagauggcucaguggguaagagcacccgacugcucuuccaaagguccggaguucaaaucccagcaaccacaugguggcucacaaccaucuguaacaagaucugacuccacucuucuggagugucugaagacagcuacaguguacuuacauauaauaaauaaauaaaucuuuaaaaaaaaaaaaaacagacgagcgacuagguugggccaugauagugcacaccuuuaaucccagcacuggggaaacaggcuuucugugaguucgaggacaaccuggucuauguagugaauuccagagggcaaccuggucuacauagugaauuccagaacagccagggcuauguagaaagaaccugccuuaaauaaauaaauaaauaaauaaauaaaccgucagcacccuccagccuucggggcgcgguagguguuaggggcuuugcaguuguucguucauccgguacuuggcauaaccaccuuguguuuuccauuguggcgguuaaucccagccccgaggaaauggaaguugagcagcacccucugucaacacgaaagauauaauuacacacagaagcaaaauauuauggagacuuuagaauggucaaaaguggcacuuucauguugggaccaauuuaaaguuuuccuuuaucccuguguuaaggcgguugcucuguaaaacucauacggggauaaagccggggcgccagggacuguuuagcccaagcgacucucugcgucugucugucuuuucaucucuucccauuccucucucuuagcuaauacaaagacuuuuguucaauauccaguauguggcacuugaaccagugaauucccagugggcaguuagugguauggcgggcuguggugaccggcugguucucgugcagacuggcugguggacagaagacacuguaaccuaaaauggcagagccuggugcugaccauccgggaaaaaaucaacacugccauccaggacaugccagagagccaggagauugcccagcugcucucuggauccugugagugaucuggaacccccccccccccuuccuggagucaccaggguggcccccagagugagaauuuuuuuucugaaucgcagaugcugguuggcagcagaguacaggggucagccaccugcaguagccaaggggagaggaagggagguggaauucugagaguccucauucuuacuuucuagacauucauuacuuccacugccuaagaauaguggaccuucuuaaaggcaccgaggcguccaccaaaaauauuuuuggccgguacucuucacaacggaugaaagugaguauggccaaggacugguagugugcagguggggacauccacggccucugcagucucacuggugaacaagccaagaugccugaucuuugucccuauaauauauaccaaaguggaccuguccacugggcuuacacauccugaccgucggggaucacugucacagucucaucauuaugugggugguccagccaagguuaaagcuggaggaaguugaggaguuugugucugguaugcuaggaggcccggggcagccuucucugcagguuuuggcugggaggaagcuguggcugcuccccuggcugauguccucgcucuccuucucaggauuggcaggagaucguaagccuguaugagaaggacaacaccuauuuagguaaaguugcccuaaaggggccaagcauccaugagggggcgggcacgaugcuguggcucugaaacagccagcugauagagagcuuggaaggaaguggggugcggcgcagauguugccugauuguaggugugaaaaacgguuuugcacgugcuccaugagagggagaaucaggcaggaagugaaccuucgugugcccuacugaacagucaucuggccugucucucucccuuggggagguagugcguacugcccccacccucgcugugugugggggccauccugugaugugugggccauauugggagccugagaggaagcaacuaaugguugauuauaguuuggaucaugacucugaauaguaaauaauuguaauuauuaauguauaccaaacacucuggguuuuguuuuauauggauccacagagaaaacacaauagucccuguucggcagcuaaagauugaagcagagaggguacacaacuugucuugggucccauagcuaggaauggagaggcugagaagccagcccccgucuccuccaccaugcuagggcaucugugugcaccucagggcaaggguauccuacagucaauuuccugggccuuccucaguggaacucuguagccuccugguucggaaugucagcuaugagauccccucgcugaagaagcagauugccaagugccagcaacugcagcaagaauacagccgcaaggaggaggagggccaggcuggggccgcugagaugcgagagcaauucuaccacuccugcaaacaguauggcaucacggugagcagcacuucauugcagccagacagucuugggacuggcucucuccgggcucaacuccacugcagcuggcgggcuucuuucucaguuggauugugcccggccugggucucucucaccuuccuacagucuuugaauguuuuguuugacucgauaguuuccaucucccaccaugugugaccaaacccuucccuucucucaaccuagggagacaauguccgaagagaacuucuggcccuggugaaggaccugccaagucagcuggcugagauaggggcaggggcucagucccugggggaggccauugaccuguaccaggccuguguggaguuugugugugacagguaaggagaacuucuccacccugagcaaggggugccuucccgggucuuucuggcuccucuccacucggauuaucccacauggcacgccaccuguguugguaacucguggaccagugauuaggguggagccugugccggcuucccaagagaggcuccgugaccaugcucuguugaagccccacagagcaagugcugcccaugcugcgguaugugcagaagaagggaaacucgacgguguaugaguggaggacggggacagagcccucugugguggagcgaccacagcuggaggagccuccugagcaggugcaagaggaugagguaagacagggccucugaggagccgcgugggagcuguuucccauccacacggagcccgagcccugaccugacuucccauagugaagaguaagggaagcugggugagcgaggcucggguaggcggacccaaaggcccuuugauuuuccuggcuuuccugagaccagagugcagacaaaugguagacaccucagcccacuggcuccugcugaccuggggaguccuucggugaaacugcccuuucucgugggagccuggagguccgugcaguugacugcaugacucugcacggcacugagaccuaagaaaggcaaacuccucucccucucucugcccaccuuguuugcacugacuuauuuuuuugcucuuuagaucgacuggggugacuuugggguggaagcuguuuccgacucuggcaucguugcugagacuccuggaauagacugggguaucucccuggagucagaggccaagguuagagcuuucuuucuaagcgguccugcuucaaccauagaaaaacaucugugcgugggaccguucccaguuguaaggccaggcgcauccugagggaaacagagucacagaagugaggcguuagcguaggcucuuuuccccugggacuugggguguaugaaugcaagcccuugaccagucaggagggaggguggcgucaucaaagcccacgcccuccgccaugcuugccacugcaucagacuggacggugcagucacugaacccuucagggccucuagucugcucugggucccugcacuggggaaccgguuccaacuugcugagucuuugcuguuccucaggaugcuggggcugacaagauagacuggggugacgaugcugcugcugcuucagagaucaccgugcuggagacaggaacugaggguaggugcccuguccccuacaguccuggagaauggaggagcccaaguucaagggcaucuguagcuacagugaauuugaacaaccugugagaccgagucucaaaaacuaaaaguacaucuuguuuaggaugugaauggagagggaugggaucuaaaaacucccugcuuccccccaccccccuuucuuuuuugagacaguaucacuguaggcuggccugaaacucucuauguagaccaggcuggccucaaacucacucccaguguugggauuaaaggcccacaccaccaauuucuguauguuuuagagacugaaugugggccagucauuuugguagauuguuuaagagacugguugggcuccaggucugaaguggacuccucccucucccaaaucuucagagaggcuguagcagucacuugugucacuagagggcagugcaggaugacacuuuaccugccucgccaccagccgccucuggcucugccugugcauuuaucggccagacccaaguagaaccgagaggugugaacaagggggaaaggcuggguagggcugagaagagucuguccacaguaacccacaggcuucucagacccauccucgugucucugccucucuuucugacagcuccggaggguguagcucggggcucagacgcucugacucuucuggaauacccugaaacucggaaucaguucauugaugagcucauggagguacugccuucugggagauguggcuucauuucugaugccuccugcugaugggagggaagggcccggacugauuucaguacccuggagcagagccuaacaaguuaggauuccccccaacacccuuguucuucucauaguuaugagacaucucuaaaguuccuggcuccaucuugggcaguagcaauggagcagugacaaagacguucagaggccuagccucggcggagcuuguauucuagcgggaagagcagauaagaaccgaguagcuacauggcaaaccuccugaaaauucugugccuaucugguuuccucuacuuuccccuugaagagacauuuuguagccaugaggggagagggggacaaaagauacccaguguucauaauacagcaagauuuguuuuuuccuuuuuaaggcuuguacuuauugauuugugagugcacauaugcacauguguaccgcagcccacagguagagaucaaauugggacaacuguaggugucauuacugucgccuuucaccauguggguuuugaggaucaacccuaaguucucaggcuuggcaucaggcccucuaaccagcccaagaugaacuuacucauaaagacuacaucuuagauguggcugcagcucauacucuuucuagacuuugaauccaaaguuucucaagcacucucauugcucccauggagagaacauuaguaccugcccuaggaaucucaguguguucccauaggcuggagaaaaggauggagggcugggcuaggcuagcacaggucagcauggggucuagaggaacagggcggccaccugcucccguguuguagguguccaugccagaggugcucgccgaaaggagcccaugcuguaggagcagggucuccagcaguagagugaugcacaggagacagccuuucuccucuggacucuagcucuucacaucagggcgggggggggguggggggggggggcucagcuucugaguuccuuucuuggucugaacgaagucccuuucccuccucagcuugagaucuucuugucucagagagcaguagagaugagcgaggaggccgacauccuguccgugagccaguuccagcuggcuccugccauccuccagggccagaccaaagagaagaugcucagccugguguccacgcugcagcagcugaucggccggcucaccagucugcggaugcagcaccuguuuaugauucuggccucgccaagguuggcuuuccaugauuccguguuucuccaucucgaauggagcuuccuccccuugucuucuuccucuuccaugauuccuccuuccuguguacauggcuuucuccugggaguagcgcaggguaggguugauuaaugucuguagacagaaccugguuccuaaguugagaggaaucuggaguggcuuauauuccuuaccagaaaaaggagggaggccaugaggggaggggaggccaaggagggaauuagcuuccugagccucaccggcccagcaguuaagugcagacagccucccaggcuucuccaucugcacagguauguggaccgagugacagaguuccuccagcagaagcugaagcagucgcagcuguuggcuuugaagaaggagcugaugguggagaagcagcaggaggcgcuucaggagcaggcagcucuggagcccaagcuggaccugcugcuggagaagaccagagagcugcagaaacuggugagccgugccgggagccugccccgggggagaaccccuccgcuuccacagaccgagaaaccugccggccugucugcucccugcccacuccgcucucuuucucucagauugaagccgacaucuccaagagauacaguggccguccugugaaccugauggggaccucucugugacgcgcucccucuguguccuccacccuccuucccagcuaccaggaggaggugggacagcccaggcugaugcuacugggccucaccagcaagaagucaggcggacuuggagacagagccaugaggaagggucacaccaugaucucugcaagcaguugucuugaguggcucuggccugucagccuuaaggcacacuugcugcuucuaguugucaagugaggcuuaauaaaaggaagugacucuccuucguggcuggcagucacuugcaccaccacgcugagccugcuugaaguugaagcugugcacauguuuucuuaauucuugauccaaggaggccuugagcaauuguagagccccagguuagaggcuuuucuuccuggcuuuuggugguaccugaccccauaagcauuuauaaaugguucagcaugugguuuggggcuggccaguacagcuuugcccccuucugucaccaggcucaugcuguccugccccagucggcagcccagggggagcagucagccugcccugugagacccugcagagguguauuuuuccucuuaaucacugcuuacuggcuagucagggggaaaugugguuuggggaggcagggucugauaaacaagguggagacaagag

SEQ ID NO: 6327 - RNA, 6206 nt, Mus musculus
guuaaacauuaauaucacacacggcugacaaguuuuuauuacacccuugugcacuggcacugacaguugggaucacacuaaagcccgggggagggagcacacacaacccccuaacagccaugggguauaacacuucucaacaacucaucggcuuauacuaauaaagucacaguccauggcacaucagcaaaaggggugagguagguaaagguaccuggccgauggccacagggucaauguccuuccuggacccaggcugaagugggggaucaacacaggacaagguugccucgggaggagccuuuguuagugacagaggcugaagcacacagccacaaagucaaaacaaggcaaguguguccagggugauaaguucaaggccaaccagaacauauaaugauuugucugagucacagcaaacauggccugggcuggcuccuuuccauggcugggaagccuuuugucuaucugcagccugauuaauuuauuacuggaaacagcucccaagccaggcuucccccaaacccaggagcaaagucaagggaacacuuaggagauccuuugcuauuugugauucucuacaacccuacggcacuuuguuccagccacuaacugauucggaguucagagaacuuggagggugagucccggagagacguagguagaagggcuaagaaaggaaauggcuuagcuuaaaaacaagaacuggagcugggccugguggcacaagccaagaaucaacuacuccagggacugaggcaagaggaacucaaggccaacgcuugccugggauauaaacacagugaguucagggcuaaccuaggggaagcagagacagggccccccacggcagcuccuggagccaaucaggcacuucuccaaacagcucaggggccagcaacuuagucuuaaaauaaaagguaaagagagagaaaugcugggacucucacucagugguacagaguugccgagccugagcaagguuuaaacccagcgccacacacagagaagguagaccgggcuuccauucccuuauucccauaacugcuuuuccccacucucugcccccuggugauuccccaacauucuuggguccaguguuaaggugcaagucucucauacacccagucuuccuccccguggugggucaugggucccaaaggggagucuccuguugccaggccucggcggaagacaauacggucauggaggcgguugguuuggccuugccaaaacuccaucacuuggggguacaggauguagccaccccugcgggaagaagcagagguuuacugcucccaccucucucucaucccaagcucuuuugcaagacguuccugggaugcagcugagggcuucucagagaaggcuauccaugauuucacagacagggccccagggucccuuucugaauggccugcaagcauagguaucgcuuaccaguauucuggcuuggguaccucuugguccugguagagcugccccaguuccucauuuuucuuucucagguacuauuuaaagaagaagacagaggaagagccgggcacaggaaaugaugcacuuaaggacuuacaaaccuaggcucuggggcaggagccaggccagguguuggggacagaggugagggaaguagaccccccccacccccacggcacuggucaagaggagagccagagagaggagguccguuucccaucauccccugcucuucucuccuagggacaucauccuuuucugcuaguuugacaagacccuggcaucuccuggagacagccucuggggaugaacucagggccuggcucaugaagaggauuauacagagguccuacuuaccucccggucagggaucacagaacucuggcgacugaccacagccccaaucuggcugcucuuggggcgggaauggaaguaguucucggccuccuucucugggaguuucuucacagggccuuccacacgcaccuguugguggaugaaccuggcuaggugaugcuugacacuacuaaaccuuucugcuagcccaggcccaguuuuucccuguuccaucagcugccccaacacucccaggcccaucuagacugagagcugggugugaaaggcagaguggccaggcccaggcagaacaugauuccuacauucauuuauaaauucaccccugcucacccagcccaccagaagugguuguggggacgaccacucaccugacgguucaggggcucccaguagaagacaagagaggcaaagggauuagaauccuggaaagaagagaaaagguacuaucgaaacaggaaaucgguacuuccugcauguagggggaaggcagaagauggaguaggauaccaucaacaggugcauucacgguuacaucgcauuuaaacucucaaaggugagccuccgguggcauagcugaagacaggcccucagggguagagcugggugugagccagguuaacuccaguuagaggcucggccauuccaaucaccaucguuguaguuuugaauauuucuguucuuguuuuugacacagggucccauucugugcucauuugugcuaauccuccugccucagcuuccugaauacuggagaggugugaacuaccacacccagcucacucagggaguuuugacagucaaugugacaugcacuccgacuggcuuaacaaaugcauaugaaaugccaacuccuguguaccuuagaacaggugcugggaacaaaacagaugaaauaaaaguggcaaccuuugcuccacagagcuuacaguguagcaggggagacaagugucaaucaugugaucauauaaacaaaugcauggccagaagcaaaaaaauuacauauauacauauauauguguauauguagguuaccagguggaugagaccagaaggaacgggugcugcugaguagcagauguggagguggguguggcuuauucauucacagugcccaggccuggaagcaggagggagcccgagcaggggugguguaagccagggcuuaggcuagcccuguccguccuggaaggauucacccugacccucaccagcucuuuucccuuccggcucucguaguuagugaagaagcggaagccgucuuugccaaagcccuucagcagcagcauccgggcagaggguuuuccgucucuagggggcacacagcagagcaccaggucagaacccaacccacuguucucaccccggagcaaccccucuagccaugcccagccacgccccagccaugccccccuuauggaggcaaaugucaaugguguaaaucauauagacaaaugcauagacauaaacugaaagagaaagacggcagagagucaaguugugggcuccgaugccaucaaacagugcccuuaggaaccuguccaggagguauaagugugauuccacugucugggggcucuuuguggcucaaucaguaccccccuuaagggauguauggcacacugcccuaaccaccgugugacuguuuuuggaagauaagagguuuuaggaaggcaauuaagauuaaauguaguccaugggguaggacucucucgaauccaguaagacuggugucuuuguaagaagagagagaaagagagacaagacagagugggggcucucucaaaggucacaugaagacacgguaaggggguggcuagcuucagaggcaucaccagacaccgccccugacaaccacuugcucucagacuucuagccuccagaaguauaaacaguaaaccccuguugccuauaguacuuugcuccgacauugaugaaaaccgugcacugcugggagagacuggaccgccaacacacugaacuaaugcaucacgcagagaagcaaugguggacggcccucugcucagagcucugaguaacacugagggugucaaagccccaucuugaugccuggugcuuuagugagaagggacaagaggagcugaauaaggaggcugaccuuagagauuucucacaggguaugacugcuugguaauucccaugcuggguuucaagagagggaauaagggggcuggagagauggcucagcgguuaagagugccaacugcucuucugaagguugugaguucaaaucccagcaaccacaugguggcucacaaccaucuguaaugagaucugaugcccucuucuggggugucugaagacagcuacaguguacuuacauauaauaaauaaauaaauccuuaaaagagagagagagagagagagagagagagagagagagagagagagagagagagagaauagggccucagggccagucccagcagauauagcuccaaaagucagggcuugagcagauaggagccugagggaggccaagggccaugaggggugagcagauaggagccugagggaggccaagggccgugaggggauacauuagggauggagauguauaaggaacugcauuuuaucacuagagaguauucagugaucuggcuuugguuuaccaguuaaggacugguuuacuggggcucagagaaggcuggcuuuaauagcggaacuaaagauauaauaauguugagagcacuuccuaaucuccaucuggacccacccacacagaggccccaggcuguguguaccuggugcagguagccacacacauagcauuggcuucuccuauguccggacacugaacagccucgucaaaccaggaagcaaacugcuucaugggauccagagaggucagaugagucuccucgaaugccuagaaagagagguugaugucagcgaaugaacaauguuuacucugugccuggcaaugggcugagauguuuuucaaauguaaaugcauuuagccaucauaaugaugaccaugagagaaagaaaaaaacaccaaccaaacaaaacacuacucaggaaguagguucuauguccauuuacagauggugaaacaggcauaaaacggcccaguaagucccugagucuccuaaggaggaagggaugaaccagggcuggagugugcugaaguuccugugggucaccucauucuuuuucaugaaguaguucuaagguuucacaagagccuacaucucagucaagcacuccugcagauguucacggauaagcacacuuggccacuguagcucuggaucccaaucccagaacugaucucuuggucccugaccugaguggggagaagaucaugaugagggagguuaaaacgaagagcuuccagguuagccuugaacucacuguguagccggacccugaacucuggauccacugugccuaguucauuuggugccaaagguggaacccagaacccucauacacaccaggcaagacuccacaacacucagcuacaagcccagcuuccgcuccuuuauaaauuuauaucacguuuaugacuguuuuaagcauuuuacaaaugccuaaauauagacugguaaagacaucuaccacgaaaccugacaaccugaguucauuccuggugaccuacgacauggugggaaaaaaaaaaaaacaaaaacaaaaaccaaaaaacuccugaaaguugucgccugucauacauguauaaacacauguacacucuaaauguauaaaaauguaaaaaaugagaaaacccccaaacccacagcauccuugugaaguagguaucaccacuuuacagguggauaaacugaggcccaaagagcauaaauuguccacagcgagacagucagaaaagggcuggguuccaacacagguggguucugaugucaaggggucuaugaguacacguuaauccacgguuccccugaggcccuccccaguagcugucucugaaacccucuucucccaucagggugaccccuaaaucccguugccuuguaaguggccccugaaagcacaaggcgcuccuccaacccuuugcuaauuuagggacacccccuuuccgugucccggcggcagcggcagcaccucucgauccccgcgguaacucuugcgcauuggucccagguccaugacugcaccccgacagcacaggugacggagguagcccguccacuucgcaggucuccugaacgucacagugacgcucagcagcccgcacgucauguaagcagucggccacgugacccagcgucgccuggcccuggguucggaaccaauugcucagccugugugucuagccugggaaggaagaauuuacuagagccccagacaagcuaguaaguccuaaguucucggaaccaaggugccuaggauca

SEQ ID NO: 6328 - RNA, 6206 nt, Mus musculus
ugauccuaggcaccuugguuccgagaacuuaggacuuacuagcuugucuggggcucuaguaaauucuuccuucccaggcuagacacacaggcugagcaauugguuccgaacccagggccaggcgacgcugggucacguggccgacugcuuacaugacgugcgggcugcugagcgucacugugacguucaggagaccugcgaaguggacgggcuaccuccgucaccugugcugucggggugcagucauggaccugggaccaaugcgcaagaguuaccgcggggaucgagaggugcugccgcugccgccgggacacggaaagggggugucccuaaauuagcaaaggguuggaggagcgccuugugcuuucaggggccacuuacaaggcaacgggauuuaggggucacccugaugggagaagaggguuucagagacagcuacuggggagggccucaggggaaccguggauuaacguguacucauagaccccuugacaucagaacccaccuguguuggaacccagcccuuuucugacugucucgcuguggacaauuuaugcucuuugggccucaguuuauccaccuguaaaguggugauaccuacuucacaaggaugcuguggguuuggggguuuucucauuuuuuacauuuuuauacauuuagaguguacauguguuuauacauguaugacaggcgacaacuuucaggaguuuuuugguuuuuguuuuuguuuuuuuuuuuuucccaccaugucguaggucaccaggaaugaacucagguugucagguuucgugguagaugucuuuaccagucuauauuuaggcauuuguaaaaugcuuaaaacagucauaaacgugauauaaauuuauaaaggagcggaagcugggcuuguagcugaguguuguggagucuugccugguguguaugaggguucuggguuccaccuuuggcaccaaaugaacuaggcacaguggauccagaguucaggguccggcuacacagugaguucaaggcuaaccuggaagcucuucguuuuaaccucccucaucaugaucuucuccccacucaggucagggaccaagagaucaguucugggauugggauccagagcuacaguggccaagugugcuuauccgugaacaucugcaggagugcuugacugagauguaggcucuugugaaaccuuagaacuacuucaugaaaaagaaugaggugacccacaggaacuucagcacacuccagcccugguucaucccuuccuccuuaggagacucagggacuuacugggccguuuuaugccuguuucaccaucuguaaauggacauagaaccuacuuccugaguaguguuuuguuugguugguguuuuuuucuuucucucauggucaucauuaugauggcuaaaugcauuuacauuugaaaaacaucucagcccauugccaggcacagaguaaacauuguucauucgcugacaucaaccucucuuucuaggcauucgaggagacucaucugaccucucuggaucccaugaagcaguuugcuuccugguuugacgaggcuguucaguguccggacauaggagaagccaaugcuauguguguggcuaccugcaccagguacacacagccuggggccucuguguggguggguccagauggagauuaggaagugcucucaacauuauuauaucuuuaguuccgcuauuaaagccagccuucucugagccccaguaaaccaguccuuaacugguaaaccaaagccagaucacugaauacucucuagugauaaaaugcaguuccuuauacaucuccaucccuaauguauccccucacggcccuuggccucccucaggcuccuaucugcucaccccucauggcccuuggccucccucaggcuccuaucugcucaagcccugacuuuuggagcuauaucugcugggacuggcccugaggcccuauucucucucucucucucucucucucucucucucucucucucucucucucucucucuuuuaaggauuuauuuauuuauuauauguaaguacacuguagcugucuucagacaccccagaagagggcaucagaucucauuacagaugguugugagccaccaugugguugcugggauuugaacucacaaccuucagaagagcaguuggcacucuuaaccgcugagccaucucuccagcccccuuauucccucucuugaaacccagcaugggaauuaccaagcagucauacccugugagaaaucucuaaggucagccuccuuauucagcuccucuugucccuucucacuaaagcaccaggcaucaagauggggcuuugacacccucaguguuacucagagcucugagcagagggccguccaccauugcuucucugcgugaugcauuaguucaguguguuggcgguccagucucucccagcagugcacgguuuucaucaaugucggagcaaaguacuauaggcaacagggguuuacuguuuauacuucuggaggcuagaagucugagagcaagugguugucaggggcggugucuggugaugccucugaagcuagccacccccuuaccgugucuucaugugaccuuugagagagcccccacucugucuugucucucuuucucucucuucuuacaaagacaccagucuuacuggauucgagagaguccuaccccauggacuacauuuaaucuuaauugccuuccuaaaaccucuuaucuuccaaaaacagucacacggugguuagggcagugugccauacaucccuuaagggggguacugauugagccacaaagagcccccagacaguggaaucacacuuauaccuccuggacagguuccuaagggcacuguuugauggcaucggagcccacaacuugacucucugccgucuuucucuuucaguuuaugucuaugcauuugucuauaugauuuacaccauugacauuugccuccauaaggggggcauggcuggggcguggcugggcauggcuagagggguugcuccggggugagaacaguggguuggguucugaccuggugcucugcugugugcccccuagagacggaaaacccucugcccggaugcugcugcugaagggcuuuggcaaagacggcuuccgcuucuucacuaacuacgagagccggaagggaaaagagcuggugagggucagggugaauccuuccaggacggacagggcuagccuaagcccuggcuuacaccaccccugcucgggcucccuccugcuuccaggccugggcacugugaaugaauaagccacacccaccuccacaucugcuacucagcagcacccguuccuucuggucucauccaccugguaaccuacauauacacauauauauguauauauguaauuuuuuugcuucuggccaugcauuuguuuauaugaucacaugauugacacuugucuccccugcuacacuguaagcucuguggagcaaagguugccacuuuuauuucaucuguuuuguucccagcaccuguucuaagguacacaggaguuggcauuucauaugcauuuguuaagccagucggagugcaugucacauugacugucaaaacucccugagugagcugggugugguaguucacaccucuccaguauucaggaagcugaggcaggaggauuagcacaaaugagcacagaaugggacccugugucaaaaacaagaacagaaauauucaaaacuacaacgauggugauuggaauggccgagccucuaacuggaguuaaccuggcucacacccagcucuaccccugagggccugucuucagcuaugccaccggaggcucaccuuugagaguuuaaaugcgauguaaccgugaaugcaccuguugaugguauccuacuccaucuucugccuucccccuacaugcaggaaguaccgauuuccuguuucgauaguaccuuuucucuucuuuccaggauucuaaucccuuugccucucuugucuucuacugggagccccugaaccgucaggugaguggucguccccacaaccacuucuggugggcugggugagcaggggugaauuuauaaaugaauguaggaaucauguucugccugggccuggccacucugccuuucacacccagcucucagucuagaugggccugggaguguuggggcagcugauggaacagggaaaaacugggccugggcuagcagaaagguuuaguagugucaagcaucaccuagccagguucauccaccaacaggugcguguggaaggcccugugaagaaacucccagagaaggaggccgagaacuacuuccauucccgccccaagagcagccagauuggggcuguggucagucgccagaguucugugaucccugaccgggagguaaguaggaccucuguauaauccucuucaugagccaggcccugaguucauccccagaggcugucuccaggagaugccagggucuugucaaacuagcagaaaaggaugaugucccuaggagagaagagcaggggaugaugggaaacggaccuccucucucuggcucuccucuugaccagugccguggggguggggggggucuacuucccucaccucuguccccaacaccuggccuggcuccugccccagagccuagguuuguaaguccuuaagugcaucauuuccugugcccggcucuuccucugucuucuucuuuaaauaguaccugagaaagaaaaaugaggaacuggggcagcucuaccaggaccaagagguacccaagccagaauacugguaagcgauaccuaugcuugcaggccauucagaaagggacccuggggcccugucugugaaaucauggauagccuucucugagaagcccucagcugcaucccaggaacgucuugcaaaagagcuugggaugagagagaggugggagcaguaaaccucugcuucuucccgcagggguggcuacauccuguacccccaagugauggaguuuuggcaaggccaaaccaaccgccuccaugaccguauugucuuccgccgaggccuggcaacaggagacuccccuuugggacccaugacccaccacggggaggaagacuggguguaugagagacuugcaccuuaacacuggacccaagaauguuggggaaucaccagggggcagagaguggggaaaagcaguuaugggaauaagggaauggaagcccggucuaccuucucuguguguggcgcuggguuuaaaccuugcucaggcucggcaacucuguaccacugagugagagucccagcauuucucucucuuuaccuuuuauuuuaagacuaaguugcuggccccugagcuguuuggagaagugccugauuggcuccaggagcugccguggggggcccugucucugcuuccccuagguuagcccugaacucacuguguuuauaucccaggcaagcguuggccuugaguuccucuugccucagucccuggaguaguugauucuuggcuugugccaccaggcccagcuccaguucuuguuuuuaagcuaagccauuuccuuucuuagcccuucuaccuacgucucuccgggacucacccuccaaguucucugaacuccgaaucaguuaguggcuggaacaaagugccguaggguuguagagaaucacaaauagcaaaggaucuccuaaguguucccuugacuuugcuccuggguuugggggaagccuggcuugggagcuguuuccaguaauaaauuaaucaggcugcagauagacaaaaggcuucccagccauggaaaggagccagcccaggccauguuugcugugacucagacaaaucauuauauguucugguuggccuugaacuuaucacccuggacacacuugccuuguuuugacuuuguggcugugugcuucagccucugucacuaacaaaggcuccucccgaggcaaccuuguccuguguugaucccccacuucagccuggguccaggaaggacauugacccuguggccaucggccagguaccuuuaccuaccucaccccuuuugcugaugugccauggacugugacuuuauuaguauaagccgaugaguuguugagaaguguuauaccccauggcuguuaggggguugugugugcucccucccccgggcuuuagugugaucccaacugucagugccagugcacaaggguguaauaaaaacuugucagccgugugugauauuaauguuuaac

SEQ ID NO: 6329 - RNA, 29625 nt, Mus musculus
caugcuugcuuagugagggcuaaaggcuuuuaguccagggaugacccuggucugcugugggaagccuggacucgagaagccugauggcuccauggaaaugugcucauggugaggagagggccagcaggaguuugagguggaugguguuuucugggacgcugagggacgggcagauggggaugugcucucuugaggaggcaaauggcucuucuuaaaggaaucucuuuguagggguccuaggauucuuaaggcccagggaugaaggacggccuaggcuggccaauaauaggcccagaauauccaccagguuaucuguguuuccuccuuugggcauguaaaaccacggucaggggcuucugaaaugccuugggugcccucuggcggcaacacgugagugcuacagaggaccaacaccugcccagagagcacuuccuccugcccucggcaagaaggaagaaccuaccggagggagggauggcuggaauguccuugcugggagauucuguggcaguuggccagcagccauccaccuggccaggaaggccaaggguagagggagcuguggggucacagcaagggacggaagugguaucccuggguuugcaacacgggcaguugguggcuguaugugugcaccaggaugcacacuguggggagcuagaacauacgagggaauccaccuuuggcguuccuggaugguucacccaaaccaaggguuuucccaucaagccacugucgggguuuaugcaucagggcgucagggauguaugggagggucuucuccauagguggagagagaaugaagaaagaaaaccagaggaggaaaaggaagaggcagaggccauggggagauccuaaggcaaaagugagcauccucagaaggcugagggggcuguaaugguuugaagaauuagccugucaaacuugggccauaggagggagugugacccgguguggaggccaaggcugccugcccuuagacaaaggcagucaggacaugcuucuagaccaagagcaauguugagccuuguggaucuuucuauaucuuccuggggacagagaccaugacuccgugugucuccuucagugugcucagcacccuuggggacucuggauagacaagggcagccacaugcagaagagaacagagagggcugggaagcagggagagcccagaagggcuucacaggaagcugaagccagggaagcaauagagcggacauggagcaagcugagcccgagugagaagugcucaaaggaccgccaacagcugugcgccugccagcggcacugugccgguaguggagggcgcgcgguggaggucaagguaaacauggaccauacgugguggagaacgaguaacuuugcacacuagaaauggggacagaguggaaacguggacuaggaggaggcucaaagcagcuggaggcagcaccgacagaacuugcuuccagacccaccagggacaagauggcgcugugacgugggugaugugggcagacacagcuggaaccgccuagccaccuuugcucuucaaacaccacugcagguaggguggaacaaggagcucuucagggauggagaggcaggaguggguuggcucagggccuuuggugaaggaaugcuuuguuuacaucugccuugcuuacacauggauuaccugagggucuucuucauauaggugcucggcuccauccuagggacugacauccugggaugagacaggagcccaacuucagaacugcugagucugacguauagucaggacucugaugugguuagagcacuugcuuuuugugcacgaggcucuggguucaauccccaguauaggaaucaggcauaguggaaccugcugccuagucucuuggaaauggagaccugugagaaaaaaacaguugugcgguggucugagggggcuuaugaaugaacuugaaagacucaucgguaggguagggaaugugguucaguggacccugguucagcaagcaugaggccccagauucaaugcccaguacaaggggcaaacaagcaaacacaaagggucccuguuuuugucugugccuuuaauaaccuaaaaacaaaacaaacguacaccccuuuaaucccagcacucagaaggcagaggcagguggauuucugugacuaugagaccagcuugguguacagagugagucuacagggcuacacagagaaacccugccuggagaaacgaaaaaaaaaaccagauagccaaaacccaaaaacaaacaaacaaacugacaggcuuuaaaagggcugaaccauucauuuuaaaacuauugguaccaguugggucugguggcccaugccugagagccuagcacuugggagguagaggcaggaagaucaugaguucugggcaagccugggcuauuugagacccuguccuaaaaacaacuaaccacccaaucacuacuacuggugaauccuagguuuucucacugucccccacccacacuuuucauguguucuucaugagagggccucugggaaggacagaguuagcuaccuccagcuuuguccuagaagagguuuccacccagcaggauagucagccccaccuccccaccaaaaccccugcacccuaauguaccugagucacugaauccgggcggagcccuuggcuacacagcaaagcaagccaaacuggaaacuggcccugggaacagaauguaugggcuaaacaagucuuaugcagauguaggaguaugcaaagucauucuugaacuccgaauccauuuccugaucaucucggauagaaggcccaguucuuccacuguagcucagucccuuagggcagccaugagggagaauggggcucagugguagagacugccuccgaugugggagguccuggccuugauucccuagcccugaaacaaacagaagugaaagagugggagaagggaguccuucauguaagccagugacagaccagggcagccagcacaagcaaggcgaagcuugacugggcaggagugaagagaacagauuuuguaggacaaaggaaaggcuuaccuaagaagaaagggaacuccuauguguuuagggacugugacaccuuuccuugagagaaaagacuagggaagcaaagaaagguggggaaaggcaugaaagacaagagcauggaggguaugugugcguguguguguguguguguguguguguguguguguguguguguuuguguguguaagggugaaggacccaguuuaagcagaaagcuuugauuuuauaaaggacauagagucccaaugaaggaacggugcgugggcacacaugugcacacggacgccagagcaggacauacacuggguccugcucuguugcugugucucacaaagccuggagcuagguuggccacuggcagacuccagccauccuccggucuccgcccugaccucacaugugagaggugggguuacagaggcugaacuccagcuuuucacacgggcucugaacucaggccucuuguguuugaacagcaagugacaucuucccagccccaagugaaggauucuagcuccagaacugauagcaucugauguuugguguuucaaaaccuaaccagagagagguagacugguaauuccaaauuacuacacucuaagcauuuggcucuuuauuguuuauuuauuuauuuuuuuguuugugguuuguggugugugugugugugugugugugugguuuuuguuuuagacaggguuucucuguguaguccuggcuguccuggaacuuucacuguagaccaggcuggacucaaagucagagaucugccagccucugccucccugcugcugggauugaaggccugggccacugccacccagcuuggcucuauauuuuguuaucacuuuaucucagcaaccuuuucuucgaagugacaggaagaaggaggaggaagauagaagaggcgaagagaaaauguaaugagagcuggggaacagcucgacgauacaguucaugcuuaguguuuauacaguucaugcuuaguguuggggacuugauccucagcaaauaagaccccagcagggauguaugugucucaucuaccugcgaucaaugucucucaaauguugauuugggaagcuuuguuacauguucuuauaaguuaauuuacuggauguaaaacauuuuuuucucacuguggguuaaaacaacaaaacaaaaccaaccaggaagggugguacuaugagguggaugugugagugcucuggcuucaacaagagucuaaggguccacugcagauggggugugggguuuccuacccacgcaggucucaagccagcgugaauucccucugagugcuacguacagcuugccuaaguuagucguucgcagagggccuggaagagaaagcuaaaccuaccuguggugccugucaagcacggccccucauacaggaggagaugaagcagagaccaagcagggucgcuaggaugccagcgugcaauucugcccaccugaggcgcaggcuaaaaugcagauucuaggcacacacaccccgccccccgggaaauagcaaauguaacuagggacgacccuagggaucugcuuuugauaaaggcucaaacacgccugucugaagcugagaggaucagggaagcucugcgaaacauuggugaagauuaacaggggcuugagaugacauaaugacaauucccucuaggaagugccagguaacccaacuccugccaggucgucgacucucgagaggcgauggauggcgggcgagggccugaggugaaggcgaugcgcucacugggggccgggcaccgcguauccgacagcuacacuugagacucaccaugccagacuguauugagagauguauaagcucuuuacggggcauuucacaguagcacuucugauuggcuuuagggcagaucuaucacuuaucugcuggguuagagguggguggaaggucaauuacgaccaauacaaaaacacuucucggcuaagccccuccucacccagcuuccuguugcuguccaucaaccuccuagcaggcgggacuuugccucccgccaguuggcuaaaggauacgucguucauucccccguugauuuccgguuggcgacuccuaccgucuaucaaugacacuucacaguucuauuggccagaccaacgucacucuagaugcuucccaaugauugguugaaaaugcugucgguccccaauguaccaagcguucauugguaaaagcugccgucgcucgggcgguggcgggcuccgggauuggcgggugcuaggcgggcggugucaggcucucgguggcggcggaggcggcggaggccagggaggaagaugucguaaugagcgguggguccuggcgucugccggcggcgucuucccggcccucaagggucgggaagacggacagaggccucggggaggggaggccggaaccgggggugccccccugggacugggacuggcgccggggcccggcuacgggaggggcgggggaggaaggauucccgcccggaggaggagcgcggcuggccggccgggcggaggcacccggaagggggcguuagacuccccgccccucggagccccgggcgggagggcggcgcuuccggggcuggcaggcggcgggggcagcagggcgagccugauaacccccuucgcccccucagcuugggucgcgccgggccuucagccugcgcccgaguuugcuccacgcaggcggccgacgcccccucgggcucguccugugggcagcccaggcuugggacccagguggugccagucagaugggcccugcuggucugaacugcagccugcuggccgggccaccgcagucccagaggguggcaggauuggagggaacgcccuaggcagaugacugcugaacgaaaaaccgacuuuuaauguuuauaccuggauccuugagccugcggcuaguaucugcaagcucuuggaauuuuagaaguuuggagaacuuguggacagagcucccaggcuauggcccgaugccccuugcgggggguggggggguugggcaaaaaugcacuggaauuccaaaaaagcguaggcgcuaucgcucguaacagaugaccuaagaaauaaaauagaugcuuuucuucauccgcguugcuggcuuaagggugcucagaaucuucccuuccuucuuagguuucuuucccagugccuuauucuaguuuuaguagaaaaggaacugucuuuugcgcugggcgacugagaaaccuguccucucuacauuccuugguuuugauucuaauagccugucauguuuaaucguuucauaacuaacaugauccagggggacucuguuugguuuuuucuccugaacuuuccccauuuuuaggagguuacaggauuauuacauaucaaaauaaaaguuugggccuguagaggccugucaacgaggagagaggcagaccauagccaguggucugugagccaggaauuggcccaaggguccccuuuauacagauuucauuguagaaaggcgauuaacuuuucaguguguacuggcaggaacaggcuacagcuguuccaugcugugcccuagaaggcccuuggcauuacagaggacaaaacccugaguugagacaccccccccccaccccccuguggugaugaagguugaauccacaaauguuggacaagcaccucuacggcugagcugucuuggagggcuagaaagguuagggugagccagcucacagugaacuggcacaggggaugacaagagcccagaccacacaguagcauuuuccauuauugacacaaagaaguccauugucuguagcgaugaguauaacugcagugucuuguuuucuuuuaaauucuuaaggacaaugaacagcgcggaucucagaaccucccaauagggcuuaugucaguguugcagugguuucuuauuuaggugguaggguguuggagccuggucuugcugugaagcccuggcuggcguguguuuguccugugaucuguguaggccuugaacuugagaucucuaugcuccagccucagccucccaagugccgagguuauggguguguaccaauuugcuugguuucuagugaccaggcagacgucaaucaauaccagugaccaugaguuaucuuuggcugaagugacggaugagcugucuaguuccaguccuccuacuugccucuuugaguaaaaucaacagccauugggaaaaauaagcugcucugacaccauugugagcuccgcaagcuaggcugcuaaagacacaggcucuuugccaaagaaaacuaacuaggauuuguccauaaccggaucuuccccugggcacccagcugcucugaggggaagaguuugacaucccugcugauacuacauagaugaccucuacuuagauuugauuuaaacauugggccaggaucacugagaaggcccaguggguaaagacacuuguugccaagucugauuaccugaggccuugugucucaccuggaaggaaagaaacaacuucaauacuuuuguacacaaagacacauacacacagggagggagggagcacaaaaccaauacaugaauuagaagauaucaaaaaaugugggccuguggaggccugucaaagggaagagaagcaguaaaaaagauuacacggcagauguuuggguaaaaagcccauccaugccgggcgugguggcgcacgccuuuaaucccaggaggcagaggcagguggauuucugaguuggaggccagcuuggucuauaaaaugaguuccaggacagccagggcuacagagaaacccugucucgaaaaaccaaaaaaaaaaaaaaagccuauccauuccagcagguagagaaguuaguauuuuggucuugacuaucuuaguucuucuaagugguuaaguguuuuggagaaguuauaaucccuuguagcaagcagugucaagucugaccguugacgcauauguggcaauccccaagcuuucuuuaagcaaguguugcccaaccauggcccuuagaacgacuuuuaaaguuucuugcagccagcuaguagacucuagcaguuuucuagacccugagcacuccacugcuguaaaaaugggacuuuuuuuuuuucuaaguuuccuucaguccgucucuucuuuguucuaucuacacuccaacuggaagcuuugcuugcagauauugaaaguaucagucauuauuuuggaacaaguggauaaugggcacagagagaaagaggcagagagaccuuauugugaagguguuguggaguguugugagagccucuggguugacagcauuauguagccucauuuuaagccuugugggcugugaauuuggaguaaucuguuaggagaucauauacuuccuuauauguuuacuggguggcaugucuggacuguacuuuugggugauuuaaaggguguguaaacuucuucccaggauguucuaaaccaggggcccaggcuggggaugguugaugcacguaauccuaacauauucaagguuaaggcaggaagauugagaguuugagucuacccuagguuacuuaucgaguugcaggcuagccugggcauagcaagaccuugucucaaaugaacaaacacaaggaaauuauacccacaggauggcccaaaugagugguucugcugggagcuucagucacccgagccguuggugcuucucuguacugcugugcagacucaggcauggcccaucucccuccuguccuucuuucuccuuuccuuccacagccaacucucaggucuuuguuucugaaauguagaugcaguucugucucuuagggagcuuucuucauuaccaaccaauguuuucaugagcagcuuuuccgaagaccccagggcagaagguucuuuuggagccuggugggaagguaaaagugguugaaaguauggggcacgccaggcuaagcaagaaugaggcuggaggaggggcuggaggagggggugggggugucacucucgagaagcucccuggugucagugguggacuuguuccaguugacaaauggugaaguagaaaacuuuuucuacugcuucaugggacucugaagguaaaaacaaaacacaggcgcaaguucagaauuggcaccagcagccagaccucucaguaugcuucuggacugcucucugucccuggcacaagcaucacugugccuuuccucggggugcacuccagacuggcaugcucuaagcugagacauugcccaguacagggcugagggugggcagaguaucccaucuugcuguuucucugugugcccagagggagcuccuggcagcauggagacaugaagcugucacaucacuguacaagcuagcugaagcccagcuguuggagucggaugaugggcaucucaucccucagcuaccucucuuucugcaucaagacugcuugcugggaccggccagcagcugcugaguuacagugcagagauuuagcuuggguggcgaaggcuaaguccuuugagaggccaguuucccucuguguggugauuuaggcccuucaggugccauucaugucagccacagggcaaaauugggaagaauuagcagucauugcacguuucuaaaugucucucuagaacuuguuuguugggguugucaucucuccugugggauuugguaaaaaucacaaaguggcucuugagacugggaacgggaauuaggaaauagcuaguaggucaugcgauuagaagugaaauaauucugccucugguuuauguuuaauuggaaauuggaggaggaaaacaaccaagaaacagacaaaggcuuuucccggguuuuagaagaguaaauggaagccagccuuccucucuucuccagggaaaugaagucacuauucauuucagaagcugauccuagccugggggagcucaaagagugacucacgaagacauugccuaagcaaaaaaggcagcauguuuguguagaaggagauucuugggggggacuccugcuuuucucuaugacggaauucugaguuccaguguucuuuuuuuuuuuuucuuuuuuaagauuuauuuauuuauuuuacauauaugaguacucuagcugucuucagauacaccagaagagggcauugaaucucaucacagaugguuguuccuaauuggaaaggccuugcaugguuuccuggggcuggucccaucaugcuuaagaguucccaucaucccggggcccccacauugaugcccugugacucaggccacaagcaaacuaggacugacagcagucaugcuuggacgaaaauaguccagaaugagacagaccaaguguucacauuuagacgcucuaguguauggucugaccuaaugucccccauucucaugcuaacuggaaaugguaagaguguagccuggagcuguagugccgucuguggguugacgugcuugcaaugaagugucugcccugcuacagcucacaggcauggccacacuuaauggauuggguacuggggaugggacccgggcuuggugcucgauaggaaagcaugccagcaauugagccacaccccagcccuccuuggucucuaaacuccauuuagcaucacucccucuuuguuccuucaggauucauuuauucacaaguguauuaagcaaauauagaaggcuccaacugugugcuaaguucuagagguacaagagaaacccuugccuuuaggaaauuugcauucuuaauaagacaguaauuaaguaacuaaugaguacuugcugggaagugguaagugcuaaggauaaaaauagggagggagggaggggaaaugugugggagaggcaguuacacaggguguucagggacauagugagauggggacuucauggaacccugaaagugacgggcauugaaccaguucugucuagagugaggggaggaggcugaaccaugcagaugugggagcaacagaaggaccuggcacaagagcccagaagcucuggggaggacaggaagucagaucacauaggccugugcgugaugguuggagcgucggcugucugaugggaugcuauugaccccucaacagagugaugauguggcuucauuuauguuugauguguugagaauaaacugacagaucagugccugucucagcugcccaggaacagacauggauuaggugauggcgucagggugaacgccucauguuuggaauguguuuugaaguuagagcuagaaguguuugcuuccacauguggaaaaaaaaaaaaaaaacaaaaaucaaagacaauuccaaggucuuagggccgagcagcuggguggaugugguuagccuucgcugcaguggggaauaccugaaaaagcauggaaucaggagccaucggaaacgugauucagggcugcuuacauucaaggugcccacugcuguaaaagagaagaugccggcaggagguggucuggagauagaaacucagguccucuuuauucaguaucugugaagcauuggcuuugaaagccaugagagcuggcaaaaucaccagaaagcagagaagacagaaauguagguccugaaauggauucuggagcuuagaguuuaacugccuagaauuugacaagaggggaaaaaccaccagagauuuagaagaaaccugcagagcaggaggcugucuugggcacauaaaauaacuguuuccaggaccaagaacagucagcucucagaucacaagacgagggcucaggucucggaguuagcaguuagauucagaaacaugaggccugguagcauuggcaguuuggggaggaugaaugacguguacagccugauuggagccacgcucaggaaugauuguggagaguaaugaggagcagcaagugcacagccugcugggcuuaggguagagcuguccuuugcacaauuguuuguuuguuuguuuguuguguuuuucaagaaaggauuuccuagcuguccuggacuugcuuuguaggccaggcuggccuccaacucauagaaaucugccugccucugccuccugagugcugggauuaaaggcgugcgccaccacugcucagcaaacugcucagcaaacaugcauuuuaauauaccuagccuucccaauauuacagcaaauguuacacugguuuaaaaaacagguguagugaugcacaucuguauucacagcacuccagagguggaggcuggaggaccaggaguuaaaggccaugcuuggauccauagugaauuugaggccagcuugaacuccaugagacccuaucucagaaaccaaagacuacuuagguuugcugagagucagacaaagucauuugccacaacguguuuuauaacaaaguguauaucauguaacuuacuggauacuguacuaaacuuagaaaacauaauuaugagugugcuuucauguacuaugacauugaaaaaugaaguuggaagccugccggguagcucagugcuucaagguguuagccugucaugucaggcugagucugacaccacggauucaaccccagcacccacaugggggaaggggagaaacaacuuguaaaaguuguccucugaccucauguuggccauggcauguguguagccauacacagauguccacacauauacacacaaauaaaauauguuuaaggugagaaaaaaagaaaguuaaguugaaccagaggaguaaggagucuccuuggugacugaggaguuagagagguuaggaaucccggcucagaaaggaaggguaacugcuugauaaaguccuguguguaucucagggucauggcggagcgguggggucaggcuugggcuggagaggggaucugcucucuccucuuggccuguggcguuagcagccucugcucaagaguucugcaaugaaaggcaugaacuaaaucuuccugugugugguugcuggguucaguuuucgggacaguuuggagccugucccagcucagcuugcucccuccacccuccauccaggcugauucauucacuaguuucccuagagguccaguuuuguucuuuaaaaccagcuguagcuugcuuuuuccucaccagcucugaguucuuccaggcuaggcaacugggaaagccuggccuuagaaacugcuuuacuggcuucuggcccagccagacugaccaaaauagccaccagaaggacuguuugugcagagugaaauuccugcuggggaaauaccauaguggagggcuaaggaagccauaguugggaaggguuuaaaaaaaaaaaaaaagcccaguagccuagggucuaaguguggacuuugagccccguuccauccuaggauaaccugauaaucagggcucaggguccuuccuauuauguucucccaacccaaucggccagagaaagcccacccccuccagcguagagccaucuaugcucccugcucuguggugaggccagcauugccaagggugcuacaggagugugcacuggcacccaacaaggucaucugcuucuggagaguaagugagaaacaaccucuagggauuauaaguggccaaagggagagcgcuggcuucaggcucccaggagagagaauggcaggcgaggagggaggaggcugggugcuuggucccucuaagcuuaucagaagagcuuccgaagaaaacuaugggggagguguggucaggggagaggguagaaggguucuggguuugcaaagauagucuuccaaaagugaacuggcuggauaaagggaagugggccagaggcugaaagcugcccuggaggcuguggaugggagcucugccugagccugaggggucauuuaagcaaugccuugggauuacugaacagcaaggagagaaacuuguaccaagaaugaggaggacccaguuacccaccaggagggugaugcucaggguccugcugagauugcaacuacauauuccaaagacucuauucuccccacucuugcggaacuguaccaggaaccagugaagaccaagcagcagcacagcuuacucaaagagcaggcccuuacucccaucccuuaggcugcucucacuguaaugggcacuggaugcuagcaaaaguccugacuucaucucaguccagaaaggacccaaggagacgauauaccuguuacaaaauggcugucaauaaauuuugcuagggaggaaaaugaaaaguggccuaaaggugcaagcaucagcuggaaaagucagaagagcccuaagcaagggaaggguaacagagauaagcuccugggauccaaagggagggcugcggaggcuggggaggggaaagaacaaacaggccaggagggaaugcucuggguugggagugucuggcugacccagugaagggccacagagggcugggcugaacacagcccugggagcgagccuguggaagcagucugaagccacgugaacagacacagucccccaaggaaagaggucuugggugagaagggucguuuguugaagaauaucaguauuucagugauggagugaauuuggagggggcggcagccucgagagaggucuggugaccugguagaagcagcccucugaguguggagggagguguggaggggacggcagcgugaggcaggaggagaaggcuguacuggagggcaagagauggaggcggaugcucuuaagagucuggacauuaggugcuuuucucucugucuuggguucuguucggcccucaguuaccugauacuccuuccucccugcugccuuguucacacccucaggacuuuuccuuaggacagagaugugccggucauuauugcuuguaucaaagaucacugccacacuucagcuuagagacuuggggacguuuuagcugaaaugaaugauaaaauccagauucuacaacugagagacacgcacuuuuuucuuucaagaauauuuaguaagugugugugauauggcucagcagauaaggugauugcugccaaacuugauaaccaggguucagucccuacagaacccacgugguggaaagaacugguuccaaauuguucugugacuuucauauguguucaaacacacacaaaauaaauaaauguaaaaaaggagaaaaaugcaguaauccuuauuacccauauugcuaaguuguagguuucagugaccacauacuacgguacuauuaaaauuugguggcugugcuggagauggcucagggguauagcauuugcugugcgugugugaggcccugagucaaaccccuagaacaggaagaagaccguguagcauaguggaaguggugugaagugauuacagaaucagagcugagccccucuguggcuuucuaucccacucugcagugcucucaguagcguggaggagcaucaagcaugacuuacaucacauuacacacgcuaaacacaggguuccagguggagugaggcugcucggagaaucuguggguacgugucugccucuccuuauccacauccacugccucacaccagccagaagugcuucucucuuucuucuucuuucucuuuccagaguagaauucugcaguggcagggaaauguuucucccauuuuugcccaggggccacacaaagcucucagugacaauaggagacagccauagugguuuuagacuaaagaaguauuucaugagccagcuggggaagaaaaugaaacuaggaugaggugugcagccggaagcagcagcccgcagccuccgcaguaggcucugcuuuacccucugacccaguggcucucaaccuuccuaccacugcgaccagcugauacaguuccucguggagugaccgccaaccauaaaauuauuuuguugccacuucauaauuguaauuuugcuauuaugacucgcaauacaaauaucugauaugcagaauaucucauauguggcuccuacaaaagggccgacugacaucccuucaggggucaugacucacaggcuuaaacucuggaguucaaccagguuuccacaccgaucgauccagggcuacagagggagagcgaagcgguuaggaagugcuggucugucuuuguuccacuuccuuuuacucugcccacugcaagucucuguguuucguaauacaggaaggacaucauucacuaaguuuuguuaaguaaacuugaauccuugagaaccuccuaagagaccuuuguggggcuuuuguuuuguuuuuaaagauuuauuuauuuuauuguaugugaguacacuguagcugucuucagacacaccagaagagggcaucagaucucauuacggauaguugagccaccaugugguugcugggaauugaacucaggaccucuggaagagcaggcagugcucuuaaccgcugagccaucucuccagccccaaccuuuguguuuucaucagcacaaccuggacugaaaauuuuuuguuuguuuuguuuuacugugcuagguauguaaccagggaccuugcacaugugaggcagggucucucccaccugauccacacccuugcgccucaggauaaacauuugaaagaaaauguaguccaacuuuucaccccaccucuaucccaucuccaacaauauacaucuugucucugguuaaacaauuuuagagaaagggagacaucacccccucugagacaacugguucagucuuucaaagguaucuuugaguuaaacagaaaccuggcuucuugaacaucuacacggguggcuugcuuuuguccuuugaacuuacagaguguggucagaagcuugaaagucucucguuggaaauaccccuuagaaugggcccaagacugaauauaacccaguguggggaguaauauauagggaauauuauuuuucuugucuuauaauuguauuuuuuaguuuuuuuaaaaauaguuuuuguuagccaaacaugguggugcaugacuuaaauuccagcagucggaggcaaaggcuagacuaaugugauauucagugaguaaauaguuaauuaauuaaaaugacaauuaccauaaggaaaaaaaugucagucaaaagacccaagaugccuggccaugguggugcacgccuuuaaucccagcacuugggaggcagaggcaggcggauuucugaguucgagccagccuggucuacaaagugaguuccaggacaggacagccagggcuacacagagaaacccugucucaaaaaaccaaaaacaaacaaacaaaaaaagacccaagaugccuguggccccugguccugagccaaaucugaguuggauaccuuggcucguacccaccaacccuuagccccaaaugauaugaucaccuucauuuccuccuccuuguucacaaaaauacuauaagcacuacaaugucaggugaaacagaauguguggugcaugucuuuuacagaugggcccauccagaaccuuuaaaagcaaauggcugugcuuacaggacuaguuuuugcaauugcaugcuuuuuucuguaguuguuccuucauaacugcaaugauuuuacagggauccgugucuguaauauccuagaaucuauguguccacugcgcagaaccauccacuggccucccaguuggcagcaucgcaggaucacccuuguucugcugcaucucauggcuuggggccuggugaccacugaaggcacuguguugcuuccuggccagccagccugccuguuucucuuucuuuaccuucuaccuuucaggggccugaaaaaagccaugaauggugguacuucuguccucaccaaacuauaguucuguuucugccugagcucuguccucauagacuccugacuuggggucaguuccugagcuucugucccuugagucuuccccaucucucuguuuccuggaauuugcuuucuuaaugucuaagauaccagccugacuucccaguugcuuugccuuagugauuuaugacucuuaccauggcagagucuucacccagagcucuuagggcuucauuuuccuuucuuucuucuuuuucuuucuuuuuuuguuuguuuguuuuuuguuuuuuggauuuuuuuuaaugggcucacuauguagaccaggcuggcuucaaacuccuagagauccaguuuccccugccucccaugugcugagauuaaaggcgugugccaccacauccagccucuugcuugcccuuuauuuguuuaaaaugcuauguguauggguuuuccccugcauguacguuuuacaccacuugcauaugugcauccugcacuggaggcuagaggaggccagcccuuggaacuggagauacagaggauugugaugaccaugugggugcugggacuugaacaugggucuucuggaagaauagccaguacucuuaguuucucucuuaucaaaaguaagcggcugggccugguggcacacaccuguaaucccagcccuugagagacuaguaaacgagucccaggccaaccugggauauggugcaagauuccugucucaaauaaaguaaaauuaaaguuuaaaaauuauaggaggauacagugauccuuugguacccacaggagcuccuggagauuccagaacccguagaugcucaagacuuauauauaauguauagaaguuaccuguaaguugcacaucugccgcauaccuuaagucaucugcagauuauguagcaccaacauuucuugaugcaugguugguugaaucuguggcuacagaaccuguugauauggaggucaacuauccaguuguggggaaaugagaagagaaaaauucugccagcuauuacugcauauacacaaaaguggaaaguguucauucuuccauguaguuguuagcccugcugagucuaugaccuacacagucagaucaguuguccuggguaaagggguuaguccacuuaaggcagcgcuucucagccuuccuuacgcagcaacccuuuagugcagucccucauguuguggugacccccaaacauaacauuauuuuuucugccacuucacagccauacuuuugcuacucuuacgaagugucauguaaauacuuuuggagagguuugccaaaugggucacgacccauaggcugagaacugcuggcuuaaaggaguugccgucuucugguuccuggaggcccuugugucucugugugaagguugaugaagguugagcagacagacagccuuuagaguaggacagcuauguccugcugcucaggaaugcuggccuugccuuucuucuuucccagacuggcuugcaucuagcucccgcuggauugagcugguagccugccuuagcacaagccuagaggcucugccccaaugaagagauucagauuuagagggcuaccaguguccaccagggggcacucuggacucagcacagccggaccgacacacgagucucccaguucuccucaucuuagaugguguggggaguguggugaaggcaggccuggccugaaucgaugaguguaagcaaaggaaaagcucacccuggcaagcccggggcugggaugcucgagcggggccuugcaggaaaagcucuuaaccuguuggaaaagcagcaacagaggcaaaaaaaaaaaaaaaaaaauuaauuuaauuuaaaaagcggaggcaaggggccuuggguucuccugugguguguuucuuacaucauuccaucuuucucccagcagauccacagaugagcauggccgccacugcugcugucagucccagugacuaccugcagccugcugcugcuacuacccaggcaagugcacggugcucucugagggcagggccagagcccggcggguugaugaaguggguuuucugccuuacucagacccgcucgcucucacugcagacacccagggagauucacuuguucucauuucugaacuaagacauagacaccugucuaagaugucaaaguugggucaggcaaaaagaguuguguuacccgugaccucuggggcuggggccauggcucuuaguaaaguugcugcacaugcaugaguucuugaguucaauuccaaguucccguguaaaccgcugggcugggcuugguaguacacaccuauaauccuggcauucgagaggcagacagaggggcuccacugggcuuacuggccaacuagucuugcccagucagugaguuucagauucaguaagagacccugucucaaaaaugacggcaaaggagguggagagagccaggcgugguggcgcaugucuuuaaucccagcacucgggaggcagaggcuggcggauuccugaguucgaggccagccuguucuacaaagugaguuccagggcuacacagagaaacccugucuugaaaagccaaaaagaaaaaaagagguagagaggugcucaguggcuuaagagcgcuggcugcuccuccagaggccuggguuugauaugauagcucauacuccaggaucaagugaucugacacccucucuggccucugaaagcaccaaguacaaguacuugaguaaggcauagacauacaugugggaaaaacacccacauacauuaaauaaauaacaauuuaauaaacaagggagagucaaagagugagacuucauuaacauaucuggccucuaccuacuccaccuaugcugauucggcuauacccacacacccuccacaugaacacauacauguauauaauacacacuccagaacaaaaccagaaaccuuuuaccgagagcaaguucaugucaucuucccuccccaucagcucuccucuccuccuuguacugaguugguagaauuccaacugauuccagguaucugauaccuggguguguuguuaucccugccgacacuaggccagcagggcgggugggggggugggggggagaacagccuguguuguugcugugugguguccaaggcugcuucugggguguuuuacacugaguuccuucacuucauggagaaaccagcaggagccaaugcaggacacgcgcacgugugugugugugugugugugugugugugugugagugauagcuugccacagggguggggaagcugcugagaagagaggcucgugagggcagagugucuggcuagucagcccaucucacuccuuucuucuguugauuuuugcaggacucccagccaucucccuuggcccugcuugcugcgacauguagcaaaauuggccccccagcuguugaagcugcagugacaccuccugcucccccccagccuaccccaaggaaacuggucccuaucaaacccgcuccucucccucucagucccugcaagaauagcuuuagcaucuuaucaucuaaaggaaauauacuucagauucagggcucccagcugaguaccuccuacccuggagggcaguuuguguuugcaauccagaaccccacccugaucaacaaagggagccgaucaaaugcaaguauccaguaccaagucccucagauccaagggaacaguucccagaccauccaggugcagcccagucucaccaaccagauccaggucaucccaggcaccaaccaagccaucaccaccccgucaacaucuggucauaagccuguccccaucaagccagcuccuguccagaagucaaguacgacuaccaccccugugcagagcggggccaacguggugaagcugacaggcggggguagcaacaugacgcucacccugccgcucaacaaccuggugaacaccagcgauauugggggcccugcucagcuccucacugagagcccccccaccccacugucuaagacuaacaagaaagcuaggaagaagagccucccugugucacagccauccguagcuguggcugagcagguggagacggugcugauagagaccacggcagacaacaucauccaggcaggaaacaaccugcugaucguccagagcccuggcgggggccagccagcugugguccagcaaguccagguggugccacccaaggcugagcagcagcaggugguccagaucccccagcaggcacugcggguggugcaagcugccucugccacccuccccaccgucccccagaagcccucucagaacuuucagauccagacaacugaaccaacaccaacccagguaccauagucccucugcccugccuccccuccucugcucacccuuuuggcuugcuuuugaaacugaggcagaucaucgucagaucuuacgggaagcuggagucaccaucauuuggggugggcaggaaauggcuucuccccuggagucucuucaggucuuaggccaaguaguccugaccuguagaaaucagauggaacagggauaucuggucuguuuuauucuuuccuuaugggguagcucugggggcauaaugggguagaucuguauacugucauaauaaaguauuuuuaauguaagaguauauauaacagcaagaaugagaauucgaacuagaaccauagaaucugcuguaaaguaggaaaguucaagagaaaaaaaugcuggccucugcuaaagacaagagcaauagcaguggggcagccaggccuuuuccuuucugagacaggucucccugugggucccaggugggccuuuaccucgcugcacagcccaagcuggcuucacucgcugcacagcccaagcuggcuucagacaugggacccuccugcuccagccucagugcagugcuggggucgcaugugugagcuguagccuugcuucuuugcaccccuguuuauccuccccgagaggggguuguccuucugcuuccuucacugugugugcauguggccacugagcguguguuuuccccucuagucuagaucccuccuaagggagaagacauucgucuuccugagccugccauguuccacucaccaugaugaccucuggguucuggagugugcucacggcugcuuuugcuucugcugcugucagggcagcuggccauucugccagcugucaacucuugucuuuuuagcugcccuguggccgccaucuugcugcuuugguagccugcccugccggcugcuuagcucucuggucacuuugcagucucugcugcugcuuuuuucuuccuucccuuuuuuuuuuucuguagcccaggcuggccugagacucagaaaucugccuaccucugccuccugagggcugggauuaaaggcgucaucaccgccacucagcuguugcuccuuuauguuaccagcucagcccacucuaaaagcagacaagaacagacagagcccaguguugcucaagacagacggggcaguaaaggagacuccagcagccaugggagucaaacugcuccauuccccagugucucugcugauuuacagggaaauggccaugagaaggagugcucaaaaugaucguuuaaaacuugagucaggugcucuggugcacaucuguaaacaugcauucagggggcugaggcaggacugacaugcguugucaccaggcccagcaauggggcuugagcgauggguugugguugacucgccgcuuuuuccagagguuccaagguugauucccagcacucacguggcucucaaccagcuguaacuccacucccagaggauuccgaguccuccuguagucuccaucugcacaugauaaacaaaugugauaaagacauuagacaaagcacccccacacagucagguaauaauaaaacaaacagugcuuaacacccacucaguacccaccaagggagcagugggcccucgccugacucagggugucugaggcuagcagaagagaagacagaaggggcagguccucuccuuccugcgccccaguuacucagccagccauuuacuaccucagagaaaaaacaaguacaacauuguaagguuuuuaaaugggguacauauacagaacuggaaagggaccugaggcuucuauauguauuaagggauggcagguucagauguuauccuuuaacuaaaagucuucaguauccaggaauuaaauauaaccccaguuaaaaucagucuuacaaaggauuuuuuucucccuggaucauuuaaacauaaacugccaccaugaucccccucccacuugcaaaugcuuuaauucucccacacaggcacagccccugcgcacaccgcagccuucaagccugaaacucacuagugaacugcuggugucuaucggggagguaccauucaggucucaccacaugcuucggauaguaauuccaacgcugccuaaggacucuguccaccuuacauguaguugucgcaucucucuggucagaucucucuuucagaaagaauuccucgcaucccccaccuccauggagcuggaaauuaaaccagggcuucguggauccuaggcacuuaaguguccuacccugaacuacauccucagccccacuuccucuuuaauguggcagucaaccuugcugcuguugaaggccacaggcuaguuguuuuguagaauguccuuuaguuuguuuaugugaugucccaugaguggauugcauuugccaucccagugcucauacagagagaggugagagcagaaacaggaggaccagacaggaaccagccagccuggcauaugcaguagcgaacaagaagcccuacuuacaggaaggcaagguuguccugugacuuccacaagugugcuguagcacaugcguacccauacucucacacauaaacacauacacacacacacauacacacacaacauaaaauuuuuuccuccuuguauuucauuaguauuuugaagagagacauuuugggauaagauaaauaucgaguuccucuuaaacaauuucuuagauuauuuuauuauauauauauauguauguauauauauauauauauauauauauauauauauauauauacacacacacacacacacacauauaagagguucgcuugcauauauauguacguguacuaugccuaaacauaguaugugaacaugccucaugccugagaaggucggcagagggcaucagcuccccuagaacuggaguuagggaugacuguaagcuacuguguggaugcugggaaaucuggguccucuggaagagcagccaguacucguaaccucaggcccaucucuccagccccugcuguuuaaagauaguuuacugugugguuaagcuggcuccacaucacuuuguagcccaugcugguggugugcuuuuuuauucaucuuccaguuuugagauuuagcaguuaauauuuuuccaugcuaagcagauuaaaaguuugguugcaggucaguaaccagcucaugccgauugagugcagggcagcaucggcccuguuaaacaugaguagugcacaaguguguucuugggcuggaugagaugacagaggugucccaguucucccucggacaaggaaggucaugcugccaucugucuuagagcacucucuuuucucuggccccucagguuuauauccguacaccuucuggugagguacagacaguccuuguccaggacagccccccagcaacagcugcaaccacaucaaccgucaccuguaacagcccugcacuccgagcuccccaucugaguggcaccagcaaaaaacauucagcugccauucuccgaaaagagcggccccugccaaagauugcaccugcugggagcaucaucagccugaacgccgcacagcuggcagcagcugcucaggccaugcagaccaucaacaucaaugguguccaaguccagggugugccugucaccaucaccaacacuggcggugagggaaaggccugaagccaggaggguacugggagcagggcuuugcauucagcauaugggaauccugagccgggccccugggguuuccagggucagccaggaggaugcucagcuugcuccuggucccugccagccucaggucauaucugucuucacacuugguccuuacaguaauacugugagauaggaagucacaugaccacaugauaacugcagauguugaauagagacugagaaaauagauguguccaaguaauauacaaauucacauuaauuuggcuggucacuugcccaggucagguagcuaagggcuguaccuaauguaaaggaagucaaggcuucuuuugggggucagggguaguguuucgagacagugauucuguauaguccuggcuuuccuggaccacuguagaccagaacagcgucugccuccugagcgcuauuauuaaaggcaugugccaccaccguccagcuaaggacggcugcuguugagagugggaggcaggggagggcguccugggcagcaggaccagcuuacacugcaccagagcugaugaugauacauucugcgagugcagcuuugagaaaaagggaaagcgacuugggagauggcucagugcucagcaacaccggcugcucuuccagagccuguguuucauucccagcacccacauggcagcucacaacagucuagucccauaggaucuaaugcccuuuccugguauguagacauacacacagacaaaacauccauauacauaaaauacauaaaaaaaucuuuaaaaaaauaaaaaaaugaagagagagggaaggagggagggagggagagcugaggcugccuagcgaagcaggcugcaucugcaccugggagucugcagcgcccccggcggcggcgagagcucacggcuuuccacaucccuaauaaacgucgagcaucuuaggcauuugcuugguccacagaacaaaaauucuuaggcgaguuuccugcuagcaggggcagaaucucagggaggccucuggcccucacugcccuccaguguauuaggcuccaugagucuuccucagccagagagagggagagggagggagagagggauagccugggcuuccuuuccugaaccacacccuuuucucucccacagggcagcagcagcugaccgugcagaacguuucuggaaacaaccugacuaucagugggcugagccccacccagauccagcugcagauggagcaggcucuagccggagaggcccagccuggggagaaacggcggcgcauggccugcacgugucccaacugcaaggauggggagaagagguaauaugcccgacccuggccauacccacaccccuguuccacaggucacucggggacaagucuuggccugaccucccgugcuucucucccuucccucuucccaacuccucccccuacucugaacccaaccccucaggucuggggagcagggcaagaagaagcacgugugccacaucccggacugcgggaagacuuuccggaagacauccuugcuccgggcccacguccgccugcacacuggcgagcggcccuuugucugcaacugguucuucuguggaaagagauucacucggagcgaugaacuccagcgacaugcucgaacccacacaggucaguucccccaugcccuugucuguccuuuguacacugucacccaugccuguucggggcuucaccauccacacuacccagacccaaaaucaaaaccaaaccaaacccaagcagugauaagaaaugccaaaugcuguguguagcauuuucagauaaguuagucccaggaaggccuuggaggguuaccucagugccagccaccuggcugagguuuggauaaguggcuaguggugggcaagcugggcuccuacccaagcccugggcucucaaggccacauacuuuguaaaugcuuuguuuuaggacuuaaggucccucugucuccaccucuguaaagcccugugaacuaagccaccaagcuggccuccaguauugguuuuggagagagagcgauaacaagauugagccaaguguucaggcugcccuugcagcaguccugccucagacuccagcuguugggauuacaggugugagucaccacacccaacucuuuuuguuuguuuuaagacaacauuuugcuguacagcccagguuuaccuuaaacucguggcacuucuccuaucuccuuaaugcugagauuacaggccugcuccgacaugcauggccuacugcaggccugccuccauggcagccuaaguuuacuauuaagguugcuaucacuauuaugugcuuuaaugcacccgauagaaggugccuuaaagauguccugggcaugcccagugguccacuggcagaugcuguuguagggaaugaugcccugcugagcagacacugaggugggggacaugccucagcuccuggugagucacacccaucgcaagcagaagcauacacacccugauacagggugggucgcugugguccagacucaggggcucagggcugagaugucuuccuguaaggaggaagguguaaagucccugggacacaguccagaaugaagcagguaugcagaggcucaaggacaagcagccugggcaaagaccagaguguacccaagaacggaguguagagagguagauuagacggggcagcuggggcagagaggugcgaccaauagacgacaggaggaggcuguuaguggagugcagagacaaggccaaguuggccuuuccaggggcucucacuuucuggagcuucuccuuucugggacuggggcagugauacugcaugcccucuuugguaaaagauauuucuucuucccaggggacaagcgcuuugagugugcccaaugucagaagcgcuucaugaggagugaccaccucaccaagcauuacaagacccaccuaggcacgaagggcuuguaaggccaacugaggcaggaggcccugaagauggaacaccucccaucugauuggcccuggguccaugauggacaggugcccacgacugcccugggcagcccucaccccacuccuguucuguggcugugucccugcagagagggacucuguuccuguguucuccuccuuccaaaggcucugccccucucaccgugagcuccuggccugcccaggccauggacacuggccaugcccaaugagacguucuaacccaggacgcguggggacccuuauuuccaaaggaaaaacauacauuucacuccgucgaggagcaaagugagcccccauccccaccccauccccuuccucaacacugccggagucccauugugccaugcccccucccccaccgugccuccuugucccccucaauuaaguccuccugggccgcuagggacacccaggggcccuguacccagccucccacugacaccccccaccggggaggugggaggcugccuccacuccacugcccagcccugccacggcucuccuccaaacauuccaacuuccuaugaaaggucagacgccgaggaccugcccucccucuuuucuacggagaacguugccuuauacucacuucagaugaugacacuguggacgugugugcuuuaaccacauuuuauuuaauugcucccuuccucucuuugcuagacgccucccccuugcuugcauucaguuuaggguuuugggggcaaugcugagcauaggagggucuuuuuuuuuuugcuauuuuuuuucucacuuuaacaauucuuuucuaaaugacacauuucaacucaaaucuggacucaccugagaacaccuuccauccugaccccgccacgcccucaucucccccugcccaagcuccacuguguacaguguauauuguauaauagacuauugugucuaagacauguuuuaaaaacauauugcuuguuauuuuugaggcuuuuaaauuaaacagaaauccaacuuuauuuucguuguaacugcuugaggauguuuuauuaauuaagugaagauuuguuauccuuuauuaacgauguauuuuguuggucaguacugggcugacaaaaaguuucuugcuaauaaauuuaguugcccaaggcaaag

SEQ ID NO: 6330 - RNA, 4012 nt, Mus musculus
cuuccaggucaccuaccagagaaccuggguccaggggaacagaucugaccugaagaggaggaaguggcgcccggaaccgagccugggggucuuggaugcagagagggugagagaccgaggcacugaggacuuggaaagggguggacggaagaggcgcgugaaugugggcaugcgcaggagcgugggauucuuggagccagcuuuagugccuagaaacuacccuguaagucagccuggaagggcuaggacuccaaaacagacgcucuuaacuugcagaguuugcucugucgccugacuccaagccaagugcauuguuagugcacaccacgcuuugacaacagugcuguugucccagagcgucaggcuucucagagugcacacguggggaggagagugcccugcaccccaccgguggccaagacuguggagagguuugagggacaugaacaucuccacuucuucgcagauggcgucgucgagccccgaugccccuuguuccugcgacuguuuugucucugugcccccggccucagccaucccagcuguaaucuuugcaaagaacucagaccggccccgagaugaggugcaggaggugguguuuauaccagcaggcacucacgucccugggagccggcuucagguggguuaggacuuagaaggagcuggaagguugagacguuauucccagaccuucguuuucuugcuccugggacgggagcagauggaguggaacgaguacggaguuccaguccaccaaccuggacccuugaguggaguuagcuucugcuaacucgguuuacuuaugugugaccugagaauaagaccuuucucagggccauuuaaaguggcugacaaaggguccgggcaguguaaguucugggucuuuuuuuuuuuuucacugaauucuuccucucucuucuuuaccuccaguguaccuauaucgagguggaacagguggggaagacacacgcugugauucugagccgccccucuuggcuguggggagcugagaugggggccaacgagcuuggugucugcauuggaaacgaagcaguguggaccaaagagccuguggggcagggggaagcccugcuggguauggaccugcucagguagagagcugcucuucagugccccacuuccucccaccuagccugagucuauugggcuugucucuguuggccuugcccuugaggccuuucuaaggcggcugcagucuuauaucuuccuagucugauaaaggaccucccuuggccuagagugcuuuaauuuuuuuuucaguacuuuuuguuuugagacaggguuucucuguguagccuuggcuguccaggaauuugcucuguagaccaggauggccuugaauucacagagauccuccugccugugugccaccacacauaguucaguacaacuuuuguuuguuuguuuuuugguuuuucaagacaggguuucucuguguagcccuggcuguccuggaacucacucuguagaccaggcuggccucgaacucagaaauccaccugccucugucucccaggugcuaggauuaaaggcaugcaccaccacugcccaguacuacuuuuguuaauugaaauauuacauaguugcgguuuauaaaaacugguaaaugugaggcagccccgccugaggagagguucaggcgguuuuuccuuggagagaguguuccagaccuuuccauggaauucacaguccuuagcuuggcaacuauaugguuuauuauuguuuuuucauguuuguuuguuuuuguuuuauuuuauguuuugagacagggucucacugcauaacccugacuggcuuagaauucacuauguagaccaggcuagccucaaacucacagagaucugcccgccucccaagugcugggguugaaaguguguaccacuacuccagcugauuuuucacuuugcuuugguauuuuuguuuguuuguuuuaagagaucauguaguauguagcugaguccagagaugaacuucugaucucccugccuccacuccggaggaaucacaggccuggccugcaugauuguuuaauaccaucauggcugcuggguuugcugugcuacgugggcuuuucaucaaacccguguggaccgcuucuguacucugauuuucuaucaggcuggcuuuggaacggagcagcacugcccaggaggcuguucacgugauugcaggcuugcuggaccgcuaugggcagggaggcagcugccgggaggauccagagccguucugcuaucacaacaccuuuuuacuggcugaucggacagaggcgugggugcuggagacagcugggagccugugggcugcucagcggauccaggguaggagucuagcguagagccugccuccaagagggaaccuagaccuccccagguacugcccuccacuucuggaggcuaccauuuuuguucuuccugacagccuugggcagugggaaagcugaugggucauaaagggacagggagggacacccugggagacuagaaaugaacacacuuaguaacucucuccuucaccugaccaaauguccucaugcuucagccugccccuuccucugggaagccuucuggaucucccugugugguuaggaggucuuauacaagcagcuaccacuuugcugucaagucuguccccuaugauuuaguucugauugcuuugucuccucauuaccacaggccccucaagggcagguuguacuuguuuaaacugucaucuaaguaugucacccagggucuagcacauaguaggugccccauaacagauaaacaaguuccucuucuuauacaggaggugcccggaauauuuccaaccagcugagcauugguacagacaucucagcugaacacccggagcuccgcagccaugccaaggcucaggguugguggacugggcagggccucuuugacuuugcggaggucuucucccugacccagcagccugugcgcauggaggcugccaaggcccgcuuccgggcagggugugagaugcugcagcggcaucaaggucugugaguggugggcaggagggccacagcaccccagcuggagucccugucacacucacguuugcugagucccuccacuccguccugggcagggaacaucacagcagaggugaugaugggcauccucagggacaaggagagcggcaucugcauggacuccggaggcuuccgcaccacagccaguaugguaucgguccugccccaggaucccacaaagcccuguguccacuuccucacugccaccccagacccauccaggugaggggugaaggggacacacugcagugucagggacauggcagcaccuguuccugguuacuucaguccuucaaccugugucuuauuaggucgguauucaagccuuucaucuuugaagugggggugucccaguccccccagguguugucccccacuuuuggagcccaggacccuguucggauccucccacgauuccagacucggguggaccgucggcacucacucuaucguggacaccaggcagcccuggggcugauggaggaugagcagguaaccccggggacugugcugagggcagguaggaaauaucuuuuuggauauucugggaccagaaaagggcuguagaucugaggagaggugggaccuucagcuagucuugggagacccugccugcagggagaggguucacauuuuucaccucugauuuucacaacaggagcaggcacagcaacuccggaaaaagcagcagaggcuggagcaggaaggccuagaggcucucagagggcugcuuacgggugaacagaccccaccagcccagggccugggcagccucuuccaggccuuuguggagagggaagagcaggccuaugcuuaagcaugcaggagcucuggggccggcugcccugagcuguggugggugcgguggugggguugagucacagccaucccuucacccugcucauccagguuuggagugacuuaauaaauguuuuaucuccuucuucagugaac

SEQ ID NO: 6331 - RNA, 4012 nt, Mus musculus
guucacugaagaaggagauaaaacauuuauuaagucacuccaaaccuggaugagcagggugaagggauggcugugacucaaccccaccaccgcacccaccacagcucagggcagccggccccagagcuccugcaugcuuaagcauaggccugcucuucccucuccacaaaggccuggaagaggcugcccaggcccugggcugguggggucuguucacccguaagcagcccucugagagccucuaggccuuccugcuccagccucugcugcuuuuuccggaguugcugugccugcuccuguugugaaaaucagaggugaaaaaugugaacccucucccugcaggcagggucucccaagacuagcugaaggucccaccucuccucagaucuacagcccuuuucuggucccagaauauccaaaaagauauuuccuaccugcccucagcacaguccccgggguuaccugcucauccuccaucagccccagggcugccugguguccacgauagagugagugccgacgguccacccgagucuggaaucgugggaggauccgaacaggguccugggcuccaaaagugggggacaacaccuggggggacugggacacccccacuucaaagaugaaaggcuugaauaccgaccuaauaagacacagguugaaggacugaaguaaccaggaacaggugcugccaugucccugacacugcaguguguccccuucaccccucaccuggaugggucugggguggcagugaggaaguggacacagggcuuugugggauccuggggcaggaccgauaccauacuggcuguggugcggaagccuccggaguccaugcagaugccgcucuccuugucccugaggaugcccaucaucaccucugcugugauguucccugcccaggacggaguggagggacucagcaaacgugagugugacagggacuccagcuggggugcuguggcccuccugcccaccacucacagaccuugaugccgcugcagcaucucacacccugcccggaagcgggccuuggcagccuccaugcgcacaggcugcugggucagggagaagaccuccgcaaagucaaagaggcccugcccaguccaccaacccugagccuuggcauggcugcggagcuccggguguucagcugagaugucuguaccaaugcucagcugguuggaaauauuccgggcaccuccuguauaagaagaggaacuuguuuaucuguuauggggcaccuacuaugugcuagacccugggugacauacuuagaugacaguuuaaacaaguacaaccugcccuugaggggccugugguaaugaggagacaaagcaaucagaacuaaaucauaggggacagacuugacagcaaagugguagcugcuuguauaagaccuccuaaccacacagggagauccagaaggcuucccagaggaaggggcaggcugaagcaugaggacauuuggucaggugaaggagagaguuacuaaguguguucauuucuagucucccagggugucccucccugucccuuuaugacccaucagcuuucccacugcccaaggcugucaggaagaacaaaaaugguagccuccagaaguggagggcaguaccuggggaggucuagguucccucuuggaggcaggcucuacgcuagacuccuacccuggauccgcugagcagcccacaggcucccagcugucuccagcacccacgccucuguccgaucagccaguaaaaagguguugugauagcagaacggcucuggauccucccggcagcugccucccugcccauagcgguccagcaagccugcaaucacgugaacagccuccugggcagugcugcuccguuccaaagccagccugauagaaaaucagaguacagaagcgguccacacggguuugaugaaaagcccacguagcacagcaaacccagcagccaugaugguauuaaacaaucaugcaggccaggccugugauuccuccggaguggaggcagggagaucagaaguucaucucuggacucagcuacauacuacaugaucucuuaaaacaaacaaacaaaaauaccaaagcaaagugaaaaaucagcuggaguagugguacacacuuucaaccccagcacuugggaggcgggcagaucucugugaguuugaggcuagccuggucuacauagugaauucuaagccagucaggguuaugcagugagacccugucucaaaacauaaaauaaaacaaaaacaaacaaacaugaaaaaacaauaauaaaccauauaguugccaagcuaaggacugugaauuccauggaaaggucuggaacacucucuccaaggaaaaaccgccugaaccucuccucaggcggggcugccucacauuuaccaguuuuuauaaaccgcaacuauguaauauuucaauuaacaaaaguaguacugggcagugguggugcaugccuuuaauccuagcaccugggagacagaggcagguggauuucugaguucgaggccagccuggucuacagagugaguuccaggacagccagggcuacacagagaaacccugucuugaaaaaccaaaaaacaaacaaacaaaaguuguacugaacuaugugugguggcacacaggcaggaggaucucugugaauucaaggccauccuggucuacagagcaaauuccuggacagccaaggcuacacagagaaacccugucucaaaacaaaaaguacugaaaaaaaaauuaaagcacucuaggccaagggagguccuuuaucagacuaggaagauauaagacugcagccgccuuagaaaggccucaagggcaaggccaacagagacaagcccaauagacucaggcuaggugggaggaaguggggcacugaagagcagcucucuaccugagcagguccauacccagcagggcuucccccugccccacaggcucuuugguccacacugcuucguuuccaaugcagacaccaagcucguuggcccccaucucagcuccccacagccaagaggggcggcucagaaucacagcgugugucuuccccaccuguuccaccucgauauagguacacuggagguaaagaagagagaggaagaauucagugaaaaaaaaaaaaagacccagaacuuacacugcccggacccuuugucagccacuuuaaauggcccugagaaaggucuuauucucaggucacacauaaguaaaccgaguuagcagaagcuaacuccacucaaggguccagguugguggacuggaacuccguacucguuccacuccaucugcucccgucccaggagcaagaaaacgaaggucugggaauaacgucucaaccuuccagcuccuucuaaguccuaacccaccugaagccggcucccagggacgugagugccugcugguauaaacaccaccuccugcaccucaucucggggccggucugaguucuuugcaaagauuacagcugggauggcugaggccgggggcacagagacaaaacagucgcaggaacaaggggcaucggggcucgacgacgccaucugcgaagaaguggagauguucaugucccucaaaccucuccacagucuuggccaccgguggggugcagggcacucuccuccccacgugugcacucugagaagccugacgcucugggacaacagcacuguugucaaagcguggugugcacuaacaaugcacuuggcuuggagucaggcgacagagcaaacucugcaaguuaagagcgucuguuuuggaguccuagcccuuccaggcugacuuacaggguaguuucuaggcacuaaagcuggcuccaagaaucccacgcuccugcgcaugcccacauucacgcgccucuuccguccaccccuuuccaaguccucagugccucggucucucacccucucugcauccaagacccccaggcucgguuccgggcgccacuuccuccucuucaggucagaucuguuccccuggacccagguucucugguaggugaccuggaag

SEQ ID NO: 6332 - RNA, 15327 nt, Mus musculus
ccggcggcggcggcagggcgcggagcggcgcgcggugccagggggugggggcgcuggggcccgucaggggagggagccggcggaggggugcgcugcgacugcgagcaggagcccgcggcagccgugagugcgggccggggcccgggcugggggagggggaggggcgcggcgggccggggcggcuuggggcgcgggaggccggggcccgggcgcgggugggcgggcgcugcgcccgggagcagaguggggaaggguccugcgccgcugcccgcagccuccggccugcggggcggcugccgcucaguagcccgcccggagcccggccgcggugggggagggggcugcgcggucucggccccacagaggggaggggcgacaguuucuguccgccgagcccgaggggguuuaaagagccgcucuuaaaggggccgccggaggggccaggcggggacgggcgcccccuccccaguagccugcgcgggcgcucggcgcgcggccccaggaugcggaggaaggcagcucgggucgcacggccgggguguguggggacacggaguccucgagagugggggugauggccggagaucgugggcagggaugggggugggguguguagugagcucuggucggcagaguagggggagggguggcgugggcaagagaggguuaaagguggggccagcccuucaaacacgcgcacacgcuccuuacucagaccugucacacgcgucugucgcuccggcacuuagccgaggcugggggaugggggacccgaggccugcacugucggaacucgcgccuucggaccgagcccccucgccggagcgcacacacgcuccagcgcgcgcacacaccucggacauucccauagugccucacgugacacucggcccgaacgugcccacccuacccacacgcucacgcacgcgugcucacacgcgcgcgcgcgcacacacacguacacacacacacauacacaaccucuggucacucccgaacuccgcgcugaccccgguccuccgccccgcaaaagcacucauugacggcggcacaccuacacucauucacagacacacacucccccccacauggcagccacagccacacauucauaaacaagggcccggagauguacacacgcacccccucgcugccuacucguuuugggagcccugagucauuccugccccccucccagggcuccccauuucccugagugcaggcacaauaggacaagcuggagucucccuuaauggucucgguucuccuaggcccccuugcccaguuugcugccucugacacucagccaaggacuuccuguaggucugcgccuggacgguugccacagccccggcgcacuuggggaggcacuuccuuuuccugaacucugggauccugcgggaggaaguugggcgggggccacagaggccaggcugccuagcgggacuagccuuccuuaggagcaggcgacagaggccugggaugggaaucuuggcggcugucgagguacuuggggaaaagggaggucuggggaggagaccaagccgaguagucuaggcagguucugggcugugccaaugcugggacagcagcccucccucccaucuguccacaggucucuccucccugccccugauccuugguccuguuuaucaguugucccccacuccacucaugacgucuaucugguuccauuuccuucuauaagcagucacagcaggggauagggcagaaacuugagagagaagagagagagagaguuaguugugagaucugucucuuggcugaagcuccccagcuaccacagguuccucagaccagcauggaagaguugggaacaaagagcaggugguccucuuuacucuguuccugcacucucaggaggcccagggugggcugaagcccuuaccauggaguccauguuugaagaugacaucagcauccugacccaagaggccuuggggcccagugagguguggcuggaugguccuggagacccgucccugggaggggacauguguucugccucccacuuugcccucaucacagccuacggagacaucaaggaaaggcuaggaggccuggagagggagaaugccacccuccgccgucgccucaaagucuaugagaucaaggucagaaccuagaugugauggcgagcugagcuuguaguugccugcaagggcaggagggucccaagagguggccagcacuggaggcugccuggucccugaagaaguggcugccuuggggaugaggagcucugcuccugcagccaaucucagggguggaggaggagcccagcuuuggaguggugggucccauuggagggggcggggagaggcgccugugaagcuggcagugggguugggggacagagcgguccugggaugggaagccaggcuucucagaggacgacccucccacaguauccgcugaucacugauuuuggagaggagcauggcuucccucuguaugaacucaaggauggcucccugcuggagguggagaaggucagucugcagcaacgacucaaccaauuccaacacgagguaagcccuugcuucgcuucccagccaaccccacucccuuagccuccugcuucccucacuuugcccucaaccccgcccugcccccgccuucccuaaaucagcuucagcgcuuccuguuucuauugggaauaggguuggggagguugggagcccccucugcucccugucaaggcugguccugacccuggcacaccucuccgggccuacccaguugcagaagaguaaggagcaggaggagcagcucggggagaugauccaggcuuacgagaaacugugcguggagaaaagcgacuuggagacagagcugggggagauggugaggcccagagagcgggugugugugugugugugugugugugagguaucugacgugaugugauucucuacgugcauuccaacccgaugagugugugcugccugugugucacacacacucugcugcgugcacacucccuguauccacucgucccugucugugaaugccugcuuugccgugugaaugagacaguaucauccgggucaugggugacucuguaccuugggcuaggaugcuguguguguguguguguguguguguguguguguguauuuggcucucacacugcaucaacccuguaccuauaguauaguauagugucugggagaggguauaagugacaagagaggugccagagcucuccauagucccagcacaagcgugaugagaguugccauguggccguuugugugugggcagguggcaguaucaggagauaaggucucugccaacuccugugcugugaccuugaucaaguuauuuagcucucaccccucaucugaaaagcagagaaaaacgguaagccaucucacuaagcugcugugacggcaacgggacauuuguguaaaacgguuuuccuuuuauagucaggaacguuugcuugguagucgcagcgugccaggcacuguucauaucccucuacacacauuuacucauuuuagcucucacaacaaucaaagagguaggcgugguacugcuauccccauuuuauacaggagguagacaaagcuuagaagugcuuaaguccuguaugcaaaugcaagucacaucccugaggguuuggggugacuggaccuggagcccaguguuggcauaaaugucucugugugauaagacccagaggagguuuggcucugaccuugccggcaccaguagccagaaacaucugcauugcaggagcugugagaggagccuucauaccugugaccacuugucgugugaguguaggacacuccagcugucugugcuccagucuggagagugaugacugcccagccugggggacucuuggguuugggagaccacagggcucccuggcgcucuguagacccuuggccgucugucuucccugcagcgggcccugguagagacucaucuacggcagaucuguggucuggagaaacagcugcagcaacagcagggccuccgggacgcagcuuucuccagccugagccccccagcuguccccgccucagccuguccugacuuggaccugcacuaucuggcucugagagggggaccugccuugggucauggugagaucuuagugacuccuaccuuccugcucuccaugucucuguuuaacucccauuucagugugacugggcaccucuggcuugccgaaaaccccauugcaauaugcuucuuuuuuuuccuuuucuuucugguuuuuuccuuucuuuuuuucuauuuguuuguuuguuuguuuaaagauacauagcccaauuggucugguauuuacuguguacgcuaggcuaucccugaacuuggaguaauacuccuuauucugucucuccagugcugggauuacaaucauauaauaucacaccaggcuggugucuucaguaucuuaaauuuauucauaauuauucccuucuccucuccaaccguuccuccuccccagcuacuuuucacaaguucucccacugauaucccuuggccguucagaucgugcaauucucgggugugccagcagagggcguccccacucagucccccuaggcugucaugaguagaggccccugaggauguucccgacugcugguucuaaucugagacaccuuccugagcccauucuuguuucuccuccggccucccugauugaaucuacaacaagcccauucuuaguccccuuggaauaguaucugcuccuuccuucguuguuugucuuucuggcuccucucagucccugcccauaccgguuucacuuugugcggaucugggagucaguuggggcagcuagagccuacccgacaucaucuugucuccugacagcagguuggccuggcccuacgaguguaagugugagcgagcuggagaggaggcgccuggaagaggcccuggaggcugcgcagggggaggcucggggggcucagcuccgggaggagcaacuccaggcggaaugcgagagacuucagggagagcugaagcaacugcaggagacccgggcccagguaaagggugcuuuggagcugcacagaguagccgaggagggaggggucugggcagaagugaagcuggcucugacuucuugcuucucuccucaggaucuggccuccaaccagucggaaugugacauggcuugggucaagagaguuggggaugaucaguaagucacaucuagcccuugcccucucgaccccauaugcuaggggacuaucccagggcuccaucguuugcccuccgucuguccacaugauuucagugaccucucuuccuagcucuugggguguggcgccuggguugcuuaccacucugccccugucacaggaaacggggagggacucugaaguagucugaaucuggaccaggcccaucuccucucacccuguggggugggagauguacucaguggcacugcgccccguucuguguucucuauacugaguuuguauacuagaaacaaaacuucgugggucagguuacccacucugacuugugaggagggagguagucucccucauuuaggaucugaccugccuugucuguuuauuuaaagggaggagugcuugagauggguagaggggagcuagcugugucuguggggccuugggaugugcugagcagcacgggaggugagugcucacggagcccggugacuuucaaggccugccgccccacucugagaaacugcuuaaacuuccuugugcuuaguuccucucugggagaugaggcaggugauacagguuccacacauuccuuaccagagaacacugaggcucagagagggaggagcuagccuucccucacacagcauaaccaguucccaggaucccaagggcccucccucccuuccaacagguuuccucaguauccucucugcuccuggccagccagggguaccccuugcuuccucccccuugcagggugagggccuggguggagcugugacaaccagagagggugagaacccagugugugggacugaugagggagaccccucccucagcuaggcuucuguggggguugggagggagcuugguggaaaggguccacccuagcuugugacuggggcucggggaccacugaggccccuauguucaaaccuggaacacacacauaccgacauaguguaaauacuugcucaucccagaaguuaugccaaaggcacuacuaggagucagugguuccagccccuucucauagugaaaguuacacacacacacacacacacacacacacacacacacacacacacacacgaaugcaugcuuaauggaauucacagggcugacauaccagcuuugaucccaagaacucggucuggguuggggaaaggccuggccuuugucucucuggacccugggcagucagucauuccugucagaugugagaggggagggugaaguagaacuugggaaggggcagggaggggaggauccucagggaacagggaugcgugugcaagggacgagggauggauaacaccaucucagaagguguuuccaaaguucugucagucacauugcuuguucuggacaaacuagucccuucccucccgaccugagggagcuggcugaggcaauucucccaugguguggugggcuccccuuaggcuuguguguggcuucuuugaucauagcccccuggaucucugucagccuagcaggcccugccugcucauuccuucccuucagccuaugugcuucuggacagccccagcgugacaggaucaauucucaaaggaaguccuuacucuccugguagcuuuauuuucuuauuaauucagucuuuuugguacuagguaauucccuggggcucccgcccauccucccaccuaaagauggcucagucaccucuuucagcucccaggaucagcaacccuccucuuccauuuacuuccgcugacuccauaucaagugggaauuuuauugaugggcuuuccugggagugaaaugcugguaccaaauuaccuagagaaggggggcagcuccugaguucagccugucucucgguauaaaucuuccuaucuugaaagguaccuuccuucucagcuuguucgcuggggcagccaaggugaucacagugauccuccuuccaccaaugccuguaggaaccccguccuggggcugucugugcuuaggaguaggccguggacauggcaggcaguuccuuguucucagcuccuggcccacaaacucuaaccaccagugguucccagcaagcaggacugacgccaggccagacacaccaggcuggcauccucuggccugcggguaagauucuaguggagagcuugcugccugguggucauagcccagcccagggagccaaauggccacagaggaaggcagggaggcagggaggagggggcaguggaguucacugaauuugugaggauuuucagggagggaaggacccagggaggucccagucaagauggcagguggaggaugccccgucuccuccccuccgagccuguggauuccuggguggggcugcugaaaggauggcaaaugcuggggaacacaggcauuuuagggagggcuccaaguagaucgcgucucuggaagucaggugaggucuugguggugaggggcccagugaaaagaugaaguucacuaugggucaugagggggaaauagugaauuacagcccuuucuuucuuccuaauguggggggcucaagguugcaaccuggggccuuuuccgcccacuccucccaccccucucucuccacccacaagccucugcgugggcugugguuagugguggggaagugugaacucagaagagagaggauggaaacucugcacagaggucaagggcaguguggggugggucaggacggaagucggagacccccauguacccugagcuuagccuccugcccccagagccaguaagcccagggcccccuccuccagacuucucccccucccuacuuccuuuccuuuaagucuccuuaggccugguacccagagcacaaagaauuaaccucuuagcacuugcagccacagggcacccugagggugggcaggggcucugcuggucuggcggacuguggguuuggaaggcauuuccacccugugcacagcugccggcugggcccagagcugagggcggccccugucauccuucucccuguagagacaugcacaccuuaucgcuuaucacugagcgguuuuuguuguucuuugucagagaguuuugguuugguuuuuguuuuuuaagacagagguucacauaguuuugaacuuguuagagagcugaggaugcccuucuaauccuugcucccccaggucucccucccaagcucaaacguuacagagugugcuaccaacugagguuuuuauuuauuuuauuuuauucauuuauuuauuuugagacagggucauacuauguaucucuggcaguacuggaacucacuauguagacuaggcuggacuggaacucucagagaugugccugccucugcugggauuaaaggcgugugcuacuauagccagcgcuuuugucuuuuuuuuuuuuuuuuuuuuugagacaguaugucaccauguagccuuggcuggccuuuaacuaauggugguccuccuuuuucuucuucccaagugcucggauuauagacaugagcuacuacauccagcauacuaaaucuuaauccaguaccuuaaaggccaaagcuuugacguggccuuucucacccacaccugucugucuagacuggacccgaggugaggugcuaucucuacaaagcuuuaucuuacucucauaaacaugaggcacuaagacauugaggagccagggaugggcaguccaggcaggucccagcuuagagugaccaggcucacuguugacugcucgggugguucugcagguaggaggacuuuuauaagagggugaccaugugauuuguugaccaaauugcaucacuuuugaaagugaaaggggacauuguuaauuaugcaacuagugugaacagggacaggccugggcaaacuaggaagccuggcuccugccacacugugagcuacucagucccacgguaucagggaaacuuuugggcaccuagccaccucacucugccugggagagagaggcugcccugaagagcucaggucuggggaccacaagucuuagcuggucgaggagcaugagggcucaaggcucuggaaaggaagugguggagcacuggcuuguugcaaagcgacuuccuccuccgccagcccacaaccucaaguccgcuccacggccuggugccugugguccccucccugagggucuggcaggcgggaagacugaugcugggugugccuguggguggguggaaaguuuggccccuaaauuccccugcugggcgggguggcuggggcgucgaggggcagccauggguaaagauggaaggguugggagggccgggaaugcuguuucucacaggccugcauccagggaugguucugaccacauggcagaccuuucucuggcgucccucuccucacacaccugauucuguccccagcccuuacacuguacugugccugauuuuuaccccuauuucuuauccugacccucaacuguacccauagccaugaccacagaagaacuaccagccccauauguagcuggacccucaugguggcugucauuccgucuuuaacccagucucaugacuuggcugcauucuggcccuacggaauccacccuguacugagucaggaggcugagggagucuguguggcucagaagcugcucugaggcagagagguuugggagugggcgcucagaucuuaggucuucugguuugcaggugcuucauuaguggcugugaagacaaaugcccucggggggggggguugagauuuccccggacuacuggagggaaggaugaaugacauguuaaaaaagagugggagccccccuccugccggcucugcugcuggugcgccggcuucucuaaagacuccagggcugaggugcccagagcaaguguuugagccacugcucugcgggcaccaggaucugccccguccuugugugccugucagccuccuucacucuucccaggguacagcacuucucucaacaccugggccucuuccuccuccuguucccuucugcuuucucccuucauuucucucacuuccaugagguuugggagccauauaaguaaugucuauagccuggacuuaggaaucugggagacuggugcuccuauccgagcuuuaaggacacggccaagugacuuuaccucuguguaccucuuuucuuaccugugagguggauuggcuuagaguagguugugaagacaagugaaguucccagcauggagccuggcucccuaucagugaucaucacccagggcuucgugugcuguugcucacaugaccuguuucucccccaagccaugacugugaaaagccucucagguguggccaggaagucaggaagcgggguguguauucagacgcacgugugaggcucuguguuguguugucaaguugaguuuuuuuuuuccacugaauuggcaguguuuucagugagucacucuaguaugcaaccaucagugugugaggagagagaagccaaagaaagggcaugccccacaggccuguggggugucaggaggaggccagagcaugucagucuguccagggucucagaagucuuugugaggcugggcuggggcucuuagaggauguaucagcuugcucugggcccagugucaucucggagaggguuugagcucucugagccaggggcuucuucaguuucuuguagcuccaauuguuuuccacuccaaggagaaugccaggcgcuaggcuguggaaacuaggguggcuccugacaagggagccagcaggggagcaaggggccuugggaacugaaugugacaggugagaucucccaggcagggugugaaggagccgaccuguaucugucaccugagaugcagcagggaagguggcugaggauagcaacugcuuucugagcagaccugacacuccacaacuguacuguccugagcccccuggcuccccugcugugugugaagcaugauccugccccccccaagcccccagucugacuaggaacacacagcuccugcccucggauugcuuucagucuaaaaacugagacuucccuggaggaguccccagucuggugugggacacaccuggacuuccuggccugacaggaagacaucacgccuucguagacuugugagaugaagcagaagaugcgucuuacaaacaugggaccugagauaugguggguugguggccauggagccugaaacugggcucccaagaugacgggcagugaggccuuguuuucccuaagaagugggcuuaacucccagaguucuuacuguaauuggauucaaaguaguguuacaccauauccccagauuacagagagugccagucucggagcccagucugagcagccuaacccugaacuugaucuguaacccaggcugucugucaguucuucuacucccgcaucugccuccugagcagcagagauccugucaccaggggccugugcugauauguguguugugugaauucaguauggcuuucuuaggaacugcaauuucugcaacaauuagaaaaacguucacacauaccugucugagcuauggucagcccccaaaugggauucaguucagggaccccuugguaucucucuauuccacauccuugcccuaggcagggcucccuagaagagauggcuguggccgugggucuuaaagcacaguggaucccugcagcugggcuaggugugaacgcuguauggccgaacagguucuuuucuacagccaaggcugaagaaccacaucccuuuucuuccucaccccuugcccucugaccucagggugaacuuggcgcuggccuacacagaacugacagaggagcugggucggcuucgggagcugaguucccugcaggggaggaucuugaggacuuugcugcaggaacaggcccgcaacgcaggugagcugggcaggucccuggugugggaacaggagugcugggcccuggagucaucuuccacucccugggugggcauugccauuguaagcccucuggcucgccucuucacgcagucuguccugcuuugucuugcccaggccaaaggcacucaccgcugucgcaacgucacuccccggccccugcgugccccucacccuccccgccugcccgaccgccgcccugugccccgugccagucccccgcugcacagcgccguucgcccgugcccccgugcccuucgccccagcagcgccgcucgcccgccucgccguccugcccguccccagucccacagcgccgcucgcccgugccgccgucgugccagucgcccaguccucagcgccgcucgccugugccacccagcugcccggccccgcagccccggccgccgccaccaccgggggagaggacgcuggccgagcgugucuacgccaagccgcccagccaccacgccaaggccggcuuccagggccgccgcagcuacucggagcuggcggagggggcggccuacgcuggugccucccccgccuggcuacaggccgaggcugccacacuucccaagccccgcgccuauggcggcgagcucuacggcaggccgcucagcccgcgccgagccuuugagggcauccgccugcgcuuugagaagcagccaucugaagaagaggagugggcuaugccggccagcccgcccagucccgaagcgggcaccauccgcugcgcuucauucugugcgggcuuccccaucccagagucgccugcggccaccgccuaugcccacgcugagcacgcacaguccuggccauccaucaacgugaguaguguacugcuucccucagccuggguaauugagaugcagagcagagagucugcccucucucuggggucgcaccucauugcuuaucuucacacacaguaggcagggacgacccugcaaacacauccuaguuuagccuuucccucccuccuuuuccgguugguaggaaugaguccccacccccaccuguacuauuaaaaguguggugacaguacuggcuuugauuccgacuccacugcauagugucugaaggacccccuucaaguucucuccgguugucuccucgguaaaaggaagaugcugcuguuauugucuuagguuuuuaggaagaggcaauggaccuaaaguacuacucagccugugugucucaagcacacuauuguuggugagcgaaggaugggcuucuaaaagggacagaagaacauggacccccuuagggacaggccuaccaguucccuccuccaagccucagagccugggcuccuuucugucugucggcaugguaacccauuucagggcccgagacuuucacuaaaucagugaguuuccugagugucucagcuaccccuugccacuuggaaggacuaaaaucgggguuguauguggcuuaaguugacuguguuucagucauuccagaagcaugcccaggucuugguuccccuccuuacugaugugccugagguaacagagcagugacucuuaucugcuuucccagcccugugggcagggcaguaaccgcugagcugcugacuugcaguggaugcugaggauggcgcuggagaaaggauagccagacuccuccaugccugccuccaugccugccgcaacccucccugauagccgcagcucucccugauagcugcagcccuccuugauaggaguccuaggaaagggcaggugguaugugagaccgaaucuaagugccuucauuuucuucccacagcuacugauggagacggugggcucugauauccgcagcugcccccucugccagcuggguuucccuguuggguacccagaugaugcucucaucaaacacauagacucccaccuugagaacagcaagaucuagggcaccucucccacaauuggcuguuucucuguucucucucucaucgcccccccaaacacucacuuugaaugcugcaugaaucucguggggggccccugccccuugcgguccccagauaccuccacuagcuaccgagucaaugugugugccgucuucccugguccaggcaccacucagcucuggcucuuuccuggaggucgaccaaggcucuccccaucuuccugguuuccacuggggagcggggaucuggucugggaugaggaggauauacccuccaccucucucugccuuucuguucuucaacaggguugucuccaagaggaagucuagugcucaggggagggagaggaggaggugucaagagcucugggagccccuucccaaaugucugucuuuccugggcuguguucuuccaggaaagaccucuugauagggucucagagccugcccugcacacugaugccagcccuucugucucaugaccgaccagcuuggggcucgugguacuggggaaggaggcaucuuauuucuuguuagucacugcaggccagcucuguucucccccucugcucacccugggaaaccagguggcagaggggugggaggacccugcaggccuuggaugauccagcccaaaggggcugccuugaggcugggacuccugggccauuacccucaauccagggaacugucugccagccucacaggccugggcucuucaggagccccuggcacuaaggugcagaucaccaaggcagaugccuccccccaucacccccacugcagcuccugacaccacagguuccccagagcccaagugugacucagccuguguuugcuggguaggugucaucagccccugccuuccaggccagaaccugagauugggcccagggugcuguggagauuaauuucaaaagagcuaacccccuucccauaccuacccacccaccccuauauucccucugugaaaucuaccucagaguccuccccucagaaagacaggggagugggaggcuggggccccaggcugaggugggagccucccgagggagucugcugcccacuaugaauccaccccucgcuuugagccucccuggggccucggccagccgauggcagugaacgccacuguccaucgaaugugccauucugauccaaaucuuccaggcccccuccccacaccccuccuuccucugugaagggggugagggguaugucagcagggaaggggccaaggacuccagagacaugucauuguacccugaguguuccccagggaggggacauggggaagggggccuguagaggggagagagggccaagugcucucugaacaaguugaaaguccaaauaaaacuuaccuguuccaucugu

SEQ ID NO: 6333 - RNA, 74987 nt, Mus musculus
acgcagccgccgccgccucccuccccgcccuccuccccugcccuccccuccgcccccuuccccguaggcagcccgcccgcaccgccgcccgcccgcccgcccggcccaggcacccgcugggucugucccccgccccagccuccccggcggcucucggcaggcggucgcccgcgcccggugaauguggcuggcagccgccguccccucccucgcucgccgccugcuccuccucggcccuccgccuccuccccuccuucuccuccucagccgcuccucucgccgccgccgccgccuccacagccugggccucgccgcgaugccggagaagcggcccuucgagcggcugcccgccgaggugucgcccaucaacuacagccucugccucaagcccgauuugcuggacuucaccuucgagggcaagcuggaggccgccgcccagguacugcgacccucgggcgccggggggcgagcagcgggcgggcgggcgagcaguuaggccgcgcccgcgggcuggguuggaggccggggcggguugggcgcgugggccgcgggaccgagcgggaggcgggugcggcgcgccccucgagccggccggccgggcggggaccgcgcugcgggagucugcgggcggugcgccccucggggggccagcacaccugugugcagcgccccugguccccgccuuccgggccccgagcuccgggagaggcugggugggggcuggggaacuagaaggggcuaggacugccugcucgguggcaccccugcggacugcguucuuuccuggucgucccuuuacuccgccggggauagguuggaaggggcggucaucaggcacuugagagcgaggaggggcgagucuagaagguugggggcaggggggaguggagcgagaauguuaaucccaggcagccucaccgaguucucccggccugauccugcccaggggccggguuuccaggaugauccgcccccucccccuuccccucaaaugacagugcagcagugacuuuguucuccccuaaccuccagagaagccgcggaggacccuagcuccucuucuccuauccgccuugcucucgcaaccugugaagcugguggauuuauugcuucaguggcgguugcuuagcaguccccucuucugaaagaaagcucucagucuuagccugccacuggugaaaauauuccauuacucuucuuugcaguuuuuuuggugaaucauacgcuccucccuccuccccgaagcauuaucuggcaguauuguuugauuucggagaccauccauauagauggcucacagaggucucaaacgguuacgauaaauaaccauggguaugauguguuacgugagaucggaaaugaaaauugggagcuguuugauagcuaucugugacaggagugguggaaauagaauugguuccguuucuuuuccuaccccagcuagggguuggggaacacgagugguggaggaagccaggccaguaggccucaaccaaaaagaugagggaggguguguguugcaaugaaaugagagaaacguagacuagaauuugagugauuugaaagccgagaaaguaugauacucgaguuugaaaaucuguguaaaaguacagaacuuaaaaguaugcuuuuagauuuggaacauuggcuuugccagccuuagaugcuggcagcaucacuguccacagcagagugccuugugaccuuuggagaaagggccuacacuugggaugaguuugaauuaugagaaaacacuaacuuuaaggaagcuggcccgaguuaauaaaucuggaaggugugcgcacugagugaagacauugaggaaaaagcaguacagauuugcuuacagguuauugagguuuauggacauguuagaacaacaagcagcaacauguucccccgccccgcccccccucuaaaaguguguuugugugugagugggugggggugcgugggagcuaugguauguauacucucugucucuuacccuuucacuaugggaucucggguucuaacucaggcugcuuaguuuccauaguaaucacguuuaccucuuccuacuucucugaagagcuggaaacaaguuggagggcacaucuuuauucccagcacuugggaggcagaggcagguggauuucugaguuccaggccagccuggacuauagagugaguuccaggucagccagagcuaccuacacagaaaaaucuguuuugaaaaacaaaacaaaacaaacaaaaggagaugauaauauguggaagauugguuucugccuuugcggaagcacaagguuguauguuaccuagcagcgggacuuaguguccuugaacucacugucucuugccucaaccuccagagcagcuuagauucuugacacacaccaucaugucuggcugauuugugaaucugauccaaggaaguaacuggaucuuuuugauagaauagacuuuacaaagaaggaacaaggcauucccgucuuuaauuuuguguccuacugugagugcauaggugugugugggugugcauacacgagugccgaggcaugcauguccauagaggucacuggacagguuuucagaguagguucuguguuuccaucaugucggccccgggauugagcuuaacucaauagucuuggcagcaaaugccuuuacccacugagccaccuuucugaucuucaaaaaagaaaaacacaaaacaaaaaaaauuuuuuuuuccucccagagagucuuuucaggcuagguggcaacauaaagaugggguaauagcaaauuuaacaaguugauuaagggauaauuagacuuuuuaguugucccuuuugaaguauaaaagaauucacaguaguuaaagcaacuagauccuugacgcuguauguuggaauaguagcauuaggugguaucauuguggaaauuaaaaacauuguaaauuuuagauugguuaaugacauuagguaacuuucuuagcaguucguaucauacuacauggaauauugaaccauuuuucaugguugccuuaguuguuuuaguugcaaaauugaaugcagaguauuuguacacguuauauauuagagacuugguggauuuuuaaccuggccucaggugucggacuucugaaaggugaauguaaaaauugucuuuuuacauagaugaauuuucuuuucuuuuuuuauuuguuuuuguuuuucugagacagggcuuuucuagguagcccugccugcccuggcacucacucacuagaucaggcugaccuugaacucagagagccaccugucuugucuacugagugcugugauuaaaggccugagcaaccaucgcccaacucauagauggcuauucuaauuuagcaggguuuugaaauggggucuuauacuccguggcugccuuggaauugagcugcguauuccuggccaccuucaaaggcuuaucauuccuccugccauuggagugcuaggauuguaagcaugagccgcugugcucaguuucaacaggcucugaacaugucucaggggccuggagagauuuguaggcuuauaauucauuucauuuucacuuuuauauuugauguuuuggaucaguagacgcuugagagauuucaaaaucggaucugccauuauugaugaugaauuaaauuggguuccaggcuuacgugagugugacugcagccucugcuugaguagcuagaacaggaguaggacacuacuguggaaacccgcugucucagagaaaucagguuauacuagccuguuucugggcucuagcaacaaaauaguccauguugcagcugacuccaucuccaguaaaggagaguaacagaaaccgaggguuuggcagcugaaaguuugucaucuaagugauugguuguuuuuuuuuuuuuuuuuuuuaaauccuguguuaagaaaauuuauguccauauuuucauauuuucucaguaaucaugauugacaguuucuuuucuuucuuucuuuuuguuuuuucgagacaggguuucucuguauagcccuggcuguccuggaacucacuuuguagaccaggcuggccucgaacucagaaaucugccugccucugccucccaagugcugggauuaagauugacaguuuuuaauuacuuuaaaaaacccagcaaaauucauaauaugcuauagauagcauuauguuagcuaguuaauuggucuuaaauuugagauguuaaggguguagcuuaaagguaagaauguguguuucauggaccuguguucaaugccuagcaaauaaauaaaguuuagaagauguaauaaggaauuuacucacauuuuuuauguucagcuuuuuaaaaauguauguauaaaauaaauauaaggcacuaaacugggccugguggcuuaugcuuguaacuuuagcccuuagagggcaggaggauuaauuaccacaaguucaaggccaguuccaaaucagccaggacugcauagugagauguugucuuaaaaugcagagacagacagacagacugacacacaaaagaaagauaaagagaaagcaagagcaaaaggaagcaaacggcagcugggugguggaguucaugcugugcauuaggcugugcagggacucagcucagagacccagcaucaccauucccucaaaauuggauuuuuauuuauuaagcuuuugucugaggccaucugacacugaauucuguggugaauuuuccauagaaaucaaacuuacuguugaaccauuuaaacuuaaaaaagcauucaccugauuuggguggaaauguuuaaguuuuauaauucaugcucuagauuucuuuuucuuuuuugaaguacuguauuguucugaaugucugucauugaugcuagaauacuuaaagaaguuuccucaaacuccacuacauaauucacuaacuuaguccuuuagaguugguuuguggcuccuugcucucgggcauacugcuuuuuguuguggguugugucuugucacacugccuauuuugcacugucuucucuucuguuuuacugaaccuggagcaggagaggucuauguaaugagucaagcaaaacaaguuucgaagugagaguuggguggauuugcaucugagugaacaggaccagcuuuauuguauggacuuuguaguaucuagucugcuguuguguucaagucuuucuuuuuuuucuuuuuguuuaacuuccugguucuagauuaucaaugucuaauacagccaggauaaauguagucuugaguagcaaguuaucugugaaacaucuuugaacuuugcuacauaaaugagccuguuuuuauuguaaaguaaaucuacucuaaucuguacucgagucaguggugaaguacgaaccuucugaugguuguuguugaguuuagcaccccaaauuuuagagauuuacuuuuuuuuuaaaaguauuucuuuuuuacuucuuucuuucuuucuuuauuuauuuauuacauguaaguacacuggagcugucuucagacacuccaggagagggagucagaucucauuaugggugguugugagccaccaugugguugcugggcuuugaacuucggaccuucagaagagcagucggaugcucuuacccacugagccaucucaccagcccgagauuuacuuuugaacaccuuuugaaccuguaguuuuuguuuuauuuggucauuuguaaucugauuuuauuuuuauuuugaaccgggaaauguuuuagaaauacagaaacgacuuaccuagauuuaguauauugccucauugcuuuagacuguuuauacuauuuuuuggaaaaagucacagauagaugcuggaguugcaacucaguugaugagaaccuuucuagcacacacagaguccuagcacccugggguaguguaaucuccgugcuuggaagguaaagggggggggggagaucagaaguuuaauguuguuuuucugugcuuagugaauuucuagucuacaugaaaccugcuccccuuaaccuccacacucuuggggggugggggaaggcuggguauugguauacaccucuaaucccagcauuugggaggcagaggcaggcagaucucugaacucacugcuauccugguccacuuagaaaaguuccaggauagcuagagcuacauagagagacccugucucaaaauggggggaaggggagaauaauaacgaauaccacggaaauucauuuuccuguuuuacuaugcucaaagguaacuccuguuacccaccuagagauaagugcagaaugcggcauaguacaguuuuaacuucauccuguuuauaaguagucacagaguacacaugucaguaaucuguguauuuaaauucuuuauuuauucugaggugccugucucugccucucauguguugggaguaaggauaugccaccaugcccagcaaggcuuugauugauagauuaauagauagauagauagauggaggugcaugcauauaguccuaacucuuugaagguagagucaggugguuuauuuauuuauuuaaaaaaaaaauuuuuuuuuuugguuuuucgagacaggauuucucuguaaagcccuaacugcccuggaacucccuuuguagaucaggcuggccuugaacucagaaauccgccugccucugccucccgagugcuaggauuaaccuggccucguuuuuuuuuuuuuuuuuuuuaaaagauuuauuuauuuauuuguuuuauguaugugaguacacuguagcuguacagauagaugguugugaaccuucaugugguuguugggaauugaauuuaggaccucugcucgcucuggucagcucugcucucucuggcccaaagauuuauuuauuuauaauacauaaguacacgguugcacucuuuagacaggccagaagagggcgucagaucucauuaugggugguugugagccaccgucaugugguugcuggguuuuaacucagggcccuuggaagagcagucaauguucuuacccgcuaagccaucuccacagccugagucaggaucuuaaguuccagucccuggguuaccauaguaaguuugaggccagccuaagccacaaaaagccacaaaaacaaacugucuuuuuuuuuuuuuuuuuuuaaaagaugccaggcaauggugggguaugccuuuaaacucagcacuuggugggggugggggugggguggggggugggguggggggugggcagagucaggcagaccucugugaguccaaagcuagccuggucuucagagugaguuccaggacagucaaggcgacacagagaaacuauuuuuaaaaaaagagagagagacacacacagagaaaguacucccuugguuuuuccuuggacuugcucuuuccagcaucgcuuguaagaagauuuagcucagucccagugacugauuguuugcuucccauugacuugagaaauuacaguucugcuccaccagcgcaacaaccacugcaaaguuuuaacaguggagucacucguuagggaaaguauucagcuuccaaaugauugcgaauguaguuacagcacuuacauuuuuuauuuuuuaauuuaucaggcaaucaggaaaaaaauauugagucuuacuguaguaaaugcaagacauauuaugcaugugguuacaacacaguaugaugucauccuucuagcacagcaaggccuggugauguagcccgucacuucauugcagagaaggcucauugggcucccuaccucugcagugccugggaaucuuccauuguagaagauuguagaauuguuuccaagguccauguugccacuuuaguacagccauuuuuaugaauuucauuugaaguacagucuguauagaaguccaaagacuuaauccuagaacugaaacaaagaaaugacauucuacucuuucuauggcauagaagaauugaaaauuaguuaauuaucaacacaauugauaggccaacuuaagcauuucacuuguuguugacucccccuccgaaccuccaacaacccccuggcuguccuggaaccugcuuuguagaccaggcuggucuugaacucagcagagauuugacugccucugccuccacagugcugggaucgaaggcacgugccaccacuaccugacacauuucuuuuuuuuuuuuuuuuuaauaauguauacaguugugguuuuuuuuuuguuuuguuuuguuuuguuuuguuuuucgagacaggguuucucuguauaguccuggcuguccuggagcucacuuuguagaccaggcuggucucgaacucagaaauccaccugccucugccucccgagugcugggauuaaaggcgugcgccaccacgcccggcuacauuucauuuuuuaaacuuagaaauugacagguuuuuuuuuuuaaagauuuauuuauuuauuauauguaaguacacuguagcugucuucagacacuccagaagagggugucagaucuuguuacagaugguugugagcuaccaugugguugcugggauuugaacucugaaccuucggaagaacagucgggugcucuuacccacugagccaucucaccagucccgaaauugacaguuuuaguggaaacuuauuugaauuaauaccuguuucuuauuuuuauuauuuugacuuauuuauuuuauguguaugaguauuuuuuuaauuuuuaaaaaauauuuauuuauuuauuauauuuacacuguugcugucuucagaaacuccagaagauggcaucagauuucguuacggaugguugugagccaccaugugguugcugggaauugaacucaggaccucugaaagagcagucagugcucuuaaccacugagccaucucaccagcccuguaugaguauucuuacugcauguguauguauaugugcaccacauguaugccuggugcccauggaggucaagagaggaccucagaucuucuggaacuagaguuaugaauggugguggauucuuggaacccaaaccagguccucucaagaacaacaaaugcuuuuuuuuuuguuuguuuuuuguuuuuucgagucaggguuucucuguauagucuuggcuguccuggaacucacuuuguagaccaggcuggccucaaacucagaaauccaccugucucugccucccgagugcugggauuaaaggcgugcgccaccacugcacggaacucaggaccuucgaagagcagucaguguuguaaaccacugagccaucucaccagcccuacaccauaucuuuuaagugauuacuacuuaccaggcaguaaaugcuaacucagccacuuucuacagauuauccccguguuugguugccuuuuaaaaugcaguucuaauaaggugcaaaaaauacugacuauuuaaaagguuuaguggaggucuauuuuugagguacauauuuuuguuccucugacuucuuuuacucuucuaaaaaugucaguaucuugaaaagagaaagaagcuguuaaguauaaauagcuugauuuauuaguauaaacagguguauuuucccuaaacauaggaggaaugaaaaaaaauacugguaauuugauguuguauacagugcuuucuaaaguaaacauuuuaagcaccuuggugguuaugguaguaauuagcuaaaugugauuugcaaauguaaugugguucggguauguugacauugauaaaugcuuggcugccaugaaaauugacuguauguguugauagaugacaaaugguugccuagaugaggauuaaggucagcaacuaaaccaguuguuuuguuggcauaaguuucauacuuugaaaaauacucauaucucuuuggagcaaaucuccaguuacgugcuuucuuucuucuguauuucauuuuguaaaaaaacauuccauuccuuauuuguuagugaggaucuggggauggcaugguguauauagagguccuggggaucagauucaguuuguuaggguugacagcaggaaccuaccaacagagccaucuuuugccacaguuugaacuuuuaagacaagguauuguuaugugacccugguaggucuugaacucaaagucuaucugucuucugagugcuggcuggaauucagguauggccuacuguuccuggcucccacccuccuuuuuaaauugaguuugugaguaggcaaaagguuuauuguccauaaccaguugggcauaaagguuuugggaacugauugguauguuccgauaaaauacaaugggaauuccauuaauauugccacuuuuaaaaaaauuaacuuagaugacauuuuuguuuugaaacaggaagauuuguaagaaguuuuuuaaaaaguaaguguguguguguguguguguguguguguguuuuggaucuugaacaaagggccuuguaugaucuuaaggaauaagaguuuaggggcuggugagauggucacugacugcucuuccagagguccugaguuaaaaucccagcaaccacaugguggcucacagccauccauaaugagaucugaugcccucuucugguguagcugaagacagcuacgguguacuuacauauaauaauaaaucuuaggagggcuggagugaguggggcugaguagcagagguccugaguucaguucccagcaaccacaugauggaucauaacuaucuguacaggaacaguguauucauauacauaaaaucgauacauaaaucuuuaaaaaaacuuuuuaacaaacacuuaggggaaaacacaagaugauuaauaaucaguguuaguaacucaggagauuauaauuuaaaccaucgaaugacauuuaauauucaucagauuguuagacuuuuuuuaaaaaaauaauuuagguuuuuuuugguuuguuuguuugguugguuuuuuuuguuuuguuuuuuguuuuguuuuuuugauuuuuuuuuuuuuuuuuuuuuuuuugagacaggguuucuuuguguagcccuggcuguccuagaacucacucuauaaaacaggcugggcuugaacucagaaauccaccugcuucccaagugcuggggcuaaaggcgugugccaccauugcccuauucauuuguuaagacauuuuaaagugguucagaaaauacugaauuuguuuuuuuguacaguggaaugucaguuggagucacucuggaggaaauuugucaaaguauugguauuguugagauauauauccuccaguccagaaagacuaccauuuuugguucuuucucugaaaaaaaaaugugcauguguagaagaagacacuagaccaagauguuuauuguaguacuguuuuguuuauaugcaauacaaacaagcaacagaacaaugguuuaaacauggaaauaaacuucuuuaggaagagucuggauaaauaacugcuuuauuuauaggguggaacauuuuaaaggaguucagauuaauaagaucaugccagguguggcaguguauaccuuuaaucucaauggaggcugaagcaggugaauuucugugaguucuaggacagccuggucuacguaaugaguuccaggauaccaaaggcuguauggugacaucaugacuuuaaaauaaacaaggaaaucuaugugaauaacauuugauauaaguaaguuaggucugcaucuaucacauuaacccauuuccagaaaacacaauguuaaauuaauaaaguuaguugggaaaguuauauauacccuugaaauuauuguguaaaauguaaagaacaguuugcagaucuuuguguguuugaacaaauacaggaaagauagaccauagcauuaaguugguaguuaucucuagaaaaugcaauuucauuauauuuacucuguaggccccuguuuuccugaggagaugaaauccaacaccucuaguggauaccugaaauaugagggcauauuugcucucuccuuuguaucuugccaacaguaaaaagaacuacucuauucuucuucccccacccccgaccuccaccccauccuuauuuuuucuuuucuuugagucaggguuucucuguguagccuggcuguccuagaacucauucuguagaccaggcuggccuugaacaacuucugccuccugagugcaggagggauuaaaggcaugugccaccaugcccagcuaguucuuccaucauuaauguuuuaaucucugcuuuauguuauuuuuguaucuuugugucauuuguuaaggauauaaaauaaguauuacugggacaugcgaacuuguacaucucugcaguuaaucucauaacuuggauuucuaucugacuaguuguaaguagaauauauugucuacaugcacuggacaaaggauuccuaggugguacaggagauuuuaugcuaaguugugaaguuuuuaaaagcauuuuuaaaagcaucuauuuuaugaauauggguacacuguugcugucuucagacacaccagaagaggacauuggaucccauugcagguagauggucgugagccaccaugugguugcuggaaauugaacucagguccuuuggaagagcagucagugccucuuaagcacugagccauuuuuccagccauuaaaaagcauucuuuuuuauauuuuauuuuauuuugauuuuuauuuugugugugggguguguguguguguaugugugcaggugcauacccauacauguccacagaggccagagacagauucccccaggagcugagguuauugacgaaugugagcuuccuggguguggaugggauguugggaacugaacuccacccuucugcacuuaguggccaggcuaucugucuacuccccaauauaaaaugaaaauuuuuauauaaagacuuaaguagagaagauuuuauauauugauaaauaguaugaaaacuguaaacauguauuauugcuuuuaaucuaauuuagaaaauaugaguugcuuugaaguauugaaauaacucauuuauuuuuaccauuguauaaauaauuaaucaagguuuaaaaaaagugcaugaaacauuagcccagguugaaggugaacauauuuuguacuauuucugauaauaauuggucuuucuuuucuuagguaaggcaggcaaccaaucaaauugugaugaauugugcugauauugacauuauuacagcuucauaugccccagaaggagaugaagguaagaacuguuccauuuuaauuugguaugugagagacagauagagccggacugacuuagacuuucagucugaaacuucuauacugccugcuuuaaaaugugcugggcacgcugauacauuccuguaaucccacgauuugugaggcugaggcaagaggacuguauucuucuuaaaaagaccucaccaccuugaaccuugagauaguaagucuugcuuauaauugggaaaaauacuugaugagcccaaguguuaagguuagaaguugcaugaugguguuagucaugaggguguuaaaagagccaugauguuuuucuuguggaaguccuaugagcaucuuuaagugagaacuaguguagacgguuugguaaggggugguguggauguguaguuucaguaagguuacaauaguuuugagguucagaauuucuuuuuacuuuuguguuuaccuugccauuccuuggcagaauauuuuauugguuaauugauuucauugaaaaaucucauuugacauagauaaaauuaccaguauuuuucuuaguuucuauuuuuuauucuucugcuuuacauuauguugaaaugaagcauacagguuucuuuuaaggucuagcauuuguguuacgacuuuuuuuuuauuuuuuaaugauuuauuauguauaugaguacacuguagcugucuucagacacaccagaagagggcaucagaucccauuacagaugguggugagccaccaugugguugcugggaauugaacucaggaccucuggaagaguagucagugcucuuaaccgcugagccaucucuacagcccaucaugacuuuuucuuaagacaucuuaaaauagaaagaugagguaauagugguugcccauacuguugcuacaguuagcuuaugcucacuaguuugugaaauagaacugugugcuacauuuuaacuuuagaaaaacaaauucuucagauagacuugaaguguggacuuaugaaagauugcuugguaagugagaggaugaucaauuucuucacuucugaggaaaaguggaaauacuugagauaguuccauggagacuagcuuucaguuaaagaacauuucaguuaguauuguuuuuuguuuaaagaaaaaaacccugccauuuauuauuuacuuaucuagucuagcccauguacuucgugcuauggcagauagaaacacccagaaucaucauucuuucucuaauucuauguacacugguguuuucccugcaugugucugugugaggaugucugauccucuggaacugcaguuacagacagaugggagcugccauguaggugcugggaauugaacccggguccucugaaaagcagccauugcucuuacccgaugagccuucucuccagcucugucacugcaggguuuuaacuguuaaugaggcauccaguauagauaggcaaaucuaguaaaauacacaugcacccuucaggagcuuacuuaaaaaauaagagcuagcauaggaggaacaacaauaugaacuaaccaguacccccagaacuccugggacuaaaucaccaaccaaagaaaacauauggugggacugguggcucuagcugcauauguagcagaggauggccuagucggucaucaaugggaggagaggcccuugguccuguguagguucuaugccccaguauaggggacugccagggccaggaagugggaguagcuggguuguugagcagggggaguggggaggggauggggauuuucagagggaaaccaggaaaguggauaacguuugaaauguaaauaaagaaaauaaagguacaaaaaaaaaacccccaaaaacagcaagggccuggagaggugguuaagaauacugucugagccaccaguggcgcacaccuuugaucccagcacuugggaggcagaggcaggcagauuucugaguuugaggccagccuggucuacagagugaguuccaggacagccagggcuacacagagaaacccugucuugaaaaaaacaaaaaaccaaacaaaaaaacaacaacaaaaaaaccacugucuguucuucuagagguccuaaguucaauucccaacauccgugugggaaucggaaucuuuaauggaauccgaugcccucuucuggugucucuaaagacagaaacgguauacucacguacauaaaacaaauaaauaaaucuaaaaaaacaaacaaaaccaaaaaaaccccaaacacuucccaaccaaacugcaggaaaggagcagaggguuuacaagguuugcugugugugcagcugaguggugcuaagcuggcagugaccugcauuggagcaaccugagagugcucucaccuugcaagcagcagggcaguuccugcucaaggaguaggaucuguagagacucugauaaaacauugccgcuuuuuuagauacuuaaaaucuuuuccaccuggcagugguggcccacgccuuuacucccagugcuugggagguauaggcagcugaaucucagaguuggaggccagccuggucuacagagugaguuccaggauagccagggcuacacagagaaacccugucucggagaaagagaaacaaacaacagaguuuuccuucagaacuagcuaaaccacauuucucagucccuuucuccuguagcggcaagagaaacccagagucaugccgagcucguuugauauuagaauguaauucacaaaaugguaauuuuacugauuugaucccccccucccccccagacaggguuucucuguguaguccuggcuuuucuggaacucacucuguagaccaggcuggccucaaacucagaaaccuaccugccuuugccucccaagugcggggauuaaaggugugugccaccacuggcuggcuggcuggcugauuugauauuuuaaaguuugcauaaggaacagugauagauuuagccucuguauauacacacuuuuacacacacacacacacacacacacacacacacacacacacacacacaccaaauaguuauaaauuugauccagcucuuuccagagcuacuugcugguaauagggaccauuuuaaccuaacuaaucacaucaagugauuaauuauuaauuaauacuuaugauugauuacuuuguguaagauugauucagccaugcaugguauccuauaccuuuaaucccugcucuauagaagcagaggaagguggaucuuguaugaguuccagacaaauugguucuauauagucaguuccaguccagccaggaguacauagugagaccuggagagagagagagagacagagagacagagagacagagaaaggaaaaaagaaaaaaauucauucagcuauuaggagccucuaaguuugaugcuugaaaguaaaaccaacuagaaaaguauuugaaaccaugaaguuguugcaauguaaguuuuuaauaggugaagaaaggucaucuugugauaugugcauuaauccugagaaaccauuagacucuaaggcacuguauuuuaagcaugguuaauuuaauacaacugagaucuuacucagcaaaaauggcugaaaacucuuuuuuuacuguucuacacuucaaggguuggugaaauucuagcacuuaagccagugcaaggaguguaccucccuacacagggcaggguuaguguugucaucagcgucugcaagaaaaauacgaaacucuugagugccugaacucagguccugacagguaaccagucuuuuaauuuaucauuaauagacagauugaguaaagccacauagaaaaggaucuuuggaagguuuugugcuggcuuuugccugaguguauccuucagguaaucugcuugcagaguuagugugugggaaaggauucccccuggugaaguuugucuauucagagcucuaguguauaguuccugaucuaccagcaucaccuuggccuaucuagcuaagcuugaccuaaauuacacuguucuuuaaguacaguuguguauuugaaugugugcuuauggaagugugcauauauuuaauguaauaaaaggauaucgccaaauacaccaucagagcagauuauuaaaccuucacuugauuguaagcccuugucuaacucuuaguaacguauauucuaucauauaauuauauauauagauaaauacacuaguuacuucuuugaaguugacuuaaugucauuauucucaaauucuguguagcccuuauaaugggaagacugagaaggggggugaggcacuacaacacccucccaaccucaugaccuauguugaaucuugugaacccacaugguggaaggugacagaguuaguguguuguggugugcacccccuagaaaauaaugcuuaaagaaagaaaauauuaguggcugguguguaguucagugguagaaugccuguguaacaugugcaagccccugaauuucauuccugcuacuauaaauacugaaauauucagaaucucucagucagcuccucuugguagaauuuuagacuucuuuguguggagagguugggcccaugauggacugaccaccagggcuagacucccucauucacuuccucacacucaguuacgccguacccagguuaccuucagagagucuuuguuuuguuucauuuggcuuuuugagaaggggacacgcuauacagucaagacuggccuugaacacuuaacagaccccauauuucaucuuuuauuuacuuuuugagacaggguuucuguguguagucuaggcuggccucacauucagagauccaccugccucugccuccagaaugcuaggauuaaaggcgugcaccaccacugccugucuuuuuuuuuuuuuuuuuuuaauuuacuuuuucugguuuauucuuucugaauguagugaguguggagaaugggaauauaauucucuuuguccuauggcucuuuugaggaaugggugacugacuacuccggacuagcuugaggaacuguuuucuaaguuagaugacuaccuuauuucacuuauaucuguacuuucagagcuaauuuagguuaacagcagaauugagaagaaaauacagagagugcccauauaaucccugugccugugcacuuaacagcuucaucuaaugucagcccagugcccauaguuuugucuuuucuaaaauaacacaauuggaaucaugcaguauacaguuuuuccagauugguucuuuuugcuguaauuguauacauugggauuuucuccaugucuuuuugugguuuaauaacuuguuuccugccgggcaugguggcgcacgccuuuaauccgagcacuuggucgggaggcagaggcaggcggauuucugaguucgaggccagccuggucuacagaucgaguuccaggauagccagggcuacacagagaaacccugucucgaaaaaaaccaaaaaaaaaacaaaaaaaaaaaaaaacccaaaacaaaacaaaaaccuuguuuccuuuuagcacugaaugauauuccaguugggggugguggcacaggcucuuggaaggcagagguagguggauuucugugaguugugccagucuguucuacacagcuagggcuagccagggcugcauagugagauccugucucaaacaaaaaaaaaaagucugcuuuuugcauaggcuacaauuuauucacuuaccgguauguuuugcuuucuuccaaauuuuggcaguuaugcaucaagcugcugucaacauccacauuaauguuuuuguuugaacuuaagguuuuuaaguccacuaggaaagggaagcuacuuuagauugccacaguuaguuugagaccaagcagagcaaaaagucagagguaccaggagaagcuggauugagucaguuggcauggagaggaguuugagccagaacagagaguugaccagccagccagaguucagaaagaauuugaaagaguguucuuacucagcagcaccucucaggcugaaagcauucuaggacuagauaagauuauaugaagacuagaagcuuccaggacuaugccuagguuagcagacagaggcaguaagccuuaauauaggagaauaaaaaguuccuuuuacgggacuggagagaugaccgagcaguuaagagcacuggcuucaauucuagagguccugaguucaauuccuagcaaccacaugguggcucacaaccaucugggcugggaccugaugcccuuuucgaagcucucuucuggugugucagugguggcgaacucaucaucaaaggcuccuuaaaaaagguuacuuuuacaauguaguugugauugacauugaaauucugaguuguaucugucuuaugagucccaggacuucaguuacagccacuuacaaccauguaccauguuugugcuggggauaggacccagggcuucaugcauguuaaaagaagcaccagauuuacacucccagcccuuuuaagauuguucuuagaagaucuuuaaagagggaguuguggcagggcgugguggcgcaugccuuuaaucccaguacucgggaggcagaggcagggggauuucugaguucgaggccagccuggucuacagagugaguuccaggacagccagggccacacagagaaauccugucucgaaccccccccccccaaaaaaaaagagggaguugugggcuguuaagaacacugacugcuccccugaagggccugaguucaaaucccaacaaccacaugguggcucaccaccauccauagugagaucuggcaccccagcuauaguguauaucuacauauaauaauaaauaaaucuuuaggauggagugaguggggcugacuggauccaggaaccuucauucccaacagccacaugauggcucacaaccaucaguacagcuacaguguacucauauacauaaaauaaagugaaucuuaaaaaacaaaaagagggaguuguuaugugugaaugaauguucuacagcauuuacauagcugaugaaagaacuguccaagcaaacaugggaacccuacaguugcuuggagaauguuugcaccaacaacauuaguuuuaauuuuagguaacauuuuuguugacacucuaguaaagcuaaccauugcaguguguguguguagugcucaguggugguuugaguuugcauuuccuugaugacuguuauguugaacacuuucucucucuuuuuuuuuuuuuuuuugguuucucgagacaggguuucucugucagaaaucagaaacucagaaaucccccugccucugccucccaagugcugggauuaaaggcgugcgccaccacugccuggcuucaugauguuuuuaacaaugacuucuuuuuuuuuuaaagacauuuauuuauuuuauguauaugaguacacuguagcuguacagaugguuuugagccuucauguggcuguugagaauuaaauuuuuaggaccucugcucacucuaaucaacccagccugcucugcuuggccuugcucccucuggucagauccacucgcuuagucccugcuugcucuggcucaaagauuuauuuauuauacauaaguacacuguagcugucuucagacacaccagaagagggcgucagaucucauuaccagugguugcugggauuugaacuuaggaccuuugaauaagcagucaaugcuccuaccugcugagccaccuugccagcucaacaaugaauuguugacauguacuaaaaucuuccaaagauuuaugcugcauagaugcagcauagaaaguaauauuaucuguaaaucuggcaaaacuauaucacaauuuuggaagcuguggcaagagaaucgcuaguuugagcugggcagugguggcgcacgccuuuaaucccagcacuuaggaggcagaggcagauggauuucugaguuugaggccagccuggucuacagagugaguuccaggacagccaggacuacacagagagacccuguuuggaaaaaacaaaacaaaccaaacaaagaauugcuaguucaaggacagucuugcuauauaguaauauaguaaggcccuauuucacaaaaauauaagcacaguauaaaugaauaaauaaaaaagaaaauuaucgccgggcaugguggcgcacgucuuuaauccuagcacucaggaggcagaggcaggcggauuucugaguucgaggccagacuggucuacagagugaguuccaggacagcuagggcuaugcagagaaacccugucucacaaaacaaaacaaacaaacaaacaaacaaaaaaucauuuguaguaacccuauuuccuuauaucaccaaagauagcaaauuuauaaagaaauauaauuaucuuuaaaaauuguguguguggguuguguguguauuaguuauaggacaguucuguggagucggugagucuacauggguuuugagauuuuugaccugccauuaccaggcuuguacagcaagugccuuugcccauagaaccaucucaccagcccacauguaauuauuauuauuucuuuaaugauuuauuuauauuuucugugcauugguguuuuguuuacauguauggcugugugggggugucagaucuucuggaacuggaauuauaaacaguuguaaacugucauguggguuuugggaauugaacucauguccucugaaagaacagcuggugcuuuuuaaccacugaguccaguuccauguguagcuuuuuucuuuuaaagauuuauauauuuuguauaugagcauacuguagcuauauucagacacucagaagagggcaucugaucucauuacugauaggugugagccaccaugugguugcuaggaauuaaacucaggaccucugaaagagcagucagugcucuuaagcacugagccaucuuucucggcccacguauaaugauugucuaaggaacauguuucacucauuauuguaacuugguuuacuaaacugagaaggucacauuuugcccaggcacacaccuuuaaugcaagcacaggaucucugauuuccagaccuggcagagcuaguaagaccucauuuucagaacacacaaacaagcaaaaggacuauuucauuuuaacauguggaaggcuaaggcuggaggauugcuaugagauccagaucagucugggauacuacagaguaccagggcuauauauagauauacauguauauacauauauaucuauagccagaccugucucacaaacgagaguaguucauuuauuucaggagacauuuuguuaaaguuccuaacuguggcaguugagauuuguucuuuucaaugugcucagauuugugaaauaauuucuucuuuccagaaauccaugcgacaggauuuaacuaucagaaugaagaugagaaagucaccuugucuuuuccuagcacucugcaaacagguaagaaacaugccuuuugugagauccuaugagggagaaagcagcuuacuguuccaaagaaauuaucccauuuuuuccacuauuauugcaugcagauuaaaacguuaagagcuuuucuuuccccuuaaaaauucugaauuaugaaaauaaacauuucaaauuucuuugucuuuguguuuuacuuaaacagaaaacuaugaaaaacuacagauuauuugcuauagaauaagauguauagcuuucagguucuguuuguuaacaauccauguaagccgcucccuccgccgggugcugaccgagcucucugaggacaggguuucccuagcauuccgguguaugaccagaacaagagaaguuuuacuagugacagcaucgaaaggaagauuuauugcuaugauguuacuauuauuugacauaaaagcacaaagaauauagaagaccuuuugagcuuaauauagaagaaauuauccucaaucaggaaagcucuaggaauuugguaagaguggaugaugaaagaaacggagagaccgcacagaaacauguaaauaacuauuauaugugugaaagagauuuagcuuccuaguaaucagaaauauaaaaauaaguuacuaucguucuaaacagguuuuuucuugucaaguaaacuaaaguuuaaaaaauucucaacgcgggcugagagauggcucagugguuaaaagaaugcuuguuauucuuccauaggacuaaguuugguucccgacacccagcccuggggguucucacacccucuucugauccccucccaccccugaaauugaaauaacacuuaaaugaaaaagauucuugaaaauaaacaaaugucucugcaauacuaguuagagauaaacccauguaaauacuuugaaaaccagcuuguuaaaaaaaagaagaagaaaaauagcucuuaccaccaguucuguuauaggaauauauucuaaggaaaagucauaacaaaaguauuuuauagcuaaaagaauauuuauugagacauuucacguguuggugaaugaauuagaacuaauauauuuguucaacacagagauugauuuugacacauucguauagugagguguauuuaacaguaaguucaugauuucuuuuuaacauaauaaaguacuaauuauaacacauauuaauauauauguguauguacauauguguguauguaugcauauauacacacacacacacacuacauacacacgcacauauucuagucgacgggucauauguuuaaaauagaacagggccugguaguggugcugcacacuuugaauuccacauucaggaggcagaggcagauggagcucuuaguuaaaggcuagcuuggucuauugagugaguuugaggacugcuagggcuacacagagaaacccuaucucaaaaagauuuaaaaaaaaauuaaaaagagaagaaauuuaaaaaucucuuugaauuaaacacaggagcuuuuaguuuacaaaauauuucuuuggcgagagggagauugagaaaauauaacaaauugcaucccaaagcagauuuuagugccuugggaauaaagugaagcuuugagagaauuucuuuuggggugggauggaagcugguauguaccuucagagcuuaagggucagauuaccacuaaauuuuuuuuuuuuuugaaguaagauguuauguagcccugacuggccucaaacacuauagcaaaguguggcuuuaaacuucuguuccuccuaccuucaucuuaagugcugggauuacaggccacccggcacaucugauagggugcucagagucagacuucgggcuuuguacaugauagacaagcauucuacccugcccucacucuagauuuuuuuuuuuuuuuuuuugggggggugagaggugcuugcuuuccuagguaacuuucuuuuuuuuuuuuuccccauuuuuuuauuagguauuuagcucauuuacauuuccaaugcuauaccaaaagucccccauaccuacccacccccacuccccuacccacccacucccccuuuuuggcccuggcauuccccuguacuggggcauauaaaguuugcaaguccaaugggccucucuuucaagugauggccuauuaggucaucuuuugauacacucuagacuuuuauuaggaacaauggaaacuauccucucucagauuacuuguuuaaaauacuaggugaaucugauuuucaacuuagaagucuguauguagucaaaccaugaauuuguguuagagucuuaaaaguucccgauagcugggcagugguggcacacgccuuuaaucccagcacuccggaggcagagacagguggauuucuggguucgaggccagccugaucuacaaagugaguuccaagacagccaggguuacacagagaaacccugucucaaaaaacaaacaaaaaaaaaacaaacaaacaaaaaaguucccgauaacugcuguaauuccaguucuagggaaccguaugcucuuuucugacuuucuggggcaccaggcacacgugugguaaacauauacacaugcaagagaaguacccauauacguaaaaaugaacauuuuuuaaaaagugaauacaguuauaucaggaaguguuuagaaaugagaguuaaaaccauuggcugcuggaugcuuauggagaguuaagggcacauuggcuaggacuccauaguuuauagguaagccuggggcuacuguaucaguuuaaaaauaugaacuguuaguugauaaaaccagaguaauuuuaggcuaggccuugauggcacagaccuuaaaucccagcauuggggguugggggagcaagcagcaacgguaggaggaccuauuugaguuugaagucauuguggccuacauagugagcuggauagccaggacuacauagagagaucuuacucaaagcaacaaaaucaaaacaagaaguaauuuuaugugugugaguguuuugccuacauguaugucugcgcacuuacuaugugccuggugccaauggaagccagagugggacacauucccuggggcuggauuuacaggugguucugagccaugugagggaggguuggauauuaaauauggcucauuuggaagaguugagugauccuaaccacugagccaucucuccagcccucccaacccccaaaaguauauaucauuaagggacuguauucucaguugaugcugugacaguguaagaaauuaauagcagagcuuggcguaggaaugcaccucuuuaaucccagcauucaggagguagaggugaaggccagccugguuuauauagugagcuccaggauagccaguacuacauagagaaaccaugucucaaaaacaacaaaaaucacacacaaaaccaauaacaacaaccccucuccccaaaaguugcacaaaaaaauuucacauauuuauaauaauugagucaaaacuuguuaggaaaguuaaguuggcagaauacuuggucaggauguguaaggcaaaguccagccccaggacugcaaaaaucaguagggaagaaagaagacaguuagaaaaagcuagacaugggcuggugagauggcucaguggguaagagcacccgacugcucucccgaaggucuggaguucaaaucccagcaaccacaugguggcucacaaccaucuguaacaagaucugaugcccucuucuggagugucuggagacagcuacaguguacuuacauauaauaaauaaauaaaucuuuuuuuuaaaaaauagaaaaauuuagacauaauggcuuggauuuguaauccuggcuauuuaagagguuggaaugagguaauuauuugauccaaggaguuuaagaccaagguugauuacucuaguaagagucugucuaaaauaagagaagcaaagaaauaagaaaacauuuagaacugaauaagaaauuucccacauaugaaaacauaugagacauaaguaaaauacuauacgagcaggauauuuaguuaaaaagccugaaaauuaaccaacuuaacauuaagcucaagugaaaaaaaaggauguggauguagcuaguguuaaaacugucaugcccaaggucuuggauucuguucuuauuucuacuuagaaggaagaagaaaagaaauguaagaaaacaaagguuugcuguauacaagagaccugaguuugaucuccaggacccacaugguagaaggauuuuuccaugcgcgcgcgcacacacacacacacacacacacacacacacacacacacacguuuaagagcuggaguugaguaaaaaugggucauaaauauuaaacuagaggcuaaggagauggucaaguugcuuccacauaggccuuaugucucaaguuagagccacagaacccagauaaaaaugcagauggaagccagcccuguaguauacuguagugccaugagccccagcccauccugggcagcauaauacaauaauacaaccguucagaaauaaacagagcaaacaaaagccugugucucugcuauacucaccaugcuuuuggguugcuucuuuguucacaguauuagggauugaacccagggccuaauccuuggacucuaccucuaauuucuaucaccugucuuuugagauaggucuuggguguuucucuagcugaucuggaacucgguaugaaagccaggcaggcuuugaacuuugcucugccuuccagugcuggggguucuagguauauccuacguuguucugcucagguuuuuuguguguuuauuguuuucuuuuguuugaggcaaagucuauguagcucuggcugggcucgaacaugauaaguaguacacaccaugcuggcuucaaacagagauccccccugucucucccuccugaguccugggaguaaauuuguguguccaacaugcccaacuucagcucagaauuuaaucccuauccccaacaacuuggaauugaaccuaaaacuuacacauguuagacuaaugccuuuaucacugagccacauuuucacaccccuagcccuguuuuauuucauucugacagaaucuugcuuaguuuuaaaauucauaugcugucugaugaaaucuccacuuguccuucugucaguucgccccucaaaagugaugaguuucuuauguaucguuagaaacucuaucauaauuuuguagucauuuauguacuauuuucugaauaaucuuauguauauggauguuuucucuguaugcuugucugugccuggugccugaggaagccacaagaaggcucagcucaacugugacuggagucacagaguugugagccgcucugugagugcugggagucccaucuggguccuuuugaagaggagccuguacucuuaaugcugagccaucucuccaguuccaggcuacaucauucuuuuuuuccugagacaggguuucucuguguaguccuggcuguccuagaacucacucuguagaccaggcuggccuugagcucagaaauccaccugccucugccucccaaaugcuggaauuaaagggcaugugccaccaccacuagguuaggcugcauaauuuuuaauaaauucauaaaacccaugguaaauguuaaaauccauuucaaauaauaccagagaaauuacauacaaguacuaugcuauaaaucaaaauagugguuuuuauuaucugcuucauauuuuauuggaaauugaguaaaccuauaauacuuuauauauuuuuuugagauuuuuaaauuacuagaacaauucuuuuaaaagaaaauauauuugauguuugugugugucucuguguaugugugugcagagccagccuauaggaucagaaagcuggugcuggagugaagguggcugugagccucgugugggugcugggcaccaagccugggcucuggaugaacagccagugcucuuaaucacugaggcaucugccacuguaguaaauucuuaauauaaugacucacaaaacugcuagaaaauccugcaagugugaauuauuaaauuauugaauauugagcuaacaggaugccccaguggguaaugguauuugccauagaagccugguuaccugaauccaauccccagaaucuaugaagagauagaaggaaagaaccuaccccauuuaaaagagaaaagaacccccccaaaaacaaacaaacaaacaaaaaacccucuauuuaaagaaagaaaaagaaaagaaagaaaccuacuccucuaaccacugauaauagcaacacaauuuuauuuuauuuuuuuaagauuuauuuacuauuauauguaaguacacuguagcugucuucagauguaccagaagaucucauuaugggugguugugagccaccaugugguugcugggauuugaacucuggaccccuggaagagcagucagugcucuucaaaccugcugagccaucucuccauccccccuuuuuuaauuuuaauuuuuaaauuauugaauaucugugauacuguuuauuggaaaaccauugacuucacacucaaaguuuucaggaucauuuagucauuuuugcuuuaaauaaaggucuugccucacaaauaaauaucuaugaauuuggaagaaauaaaaccaauuaaaucugaagaaaaaguucuuuaucuuuucggauuuuuaucagauauagaacuggucuugagugaugauggaguaaauauugaaugaacauaaucgugugaugucgucaguagccuuugcguuuugacucuucaaacuuaacaauuguacaaguuauccgauagccacguaaagcaucucugauacuggcaucauucuguaauagugguuaguaucccaugaucacuguaaggucugaaaacuguaauagugguuaauaucccauaaucauuguaaggucugaaaacuuaagaacagucuucaaaaucuuguaaagugacaucauuaugcagaaacacacuguucauaauguuuuccuuuuauagaaauugauuuuuaguuucauagcauuuagcaagcuuaucaaauuauuucaagguauguagguuuuacaguuauaauuuccuaaacuuucaacauuuacguuuuugauggauguugugauuaucuuaguuauuucauuuuaaucauuauuuuaugguuuuuuuguuguuguuuuggguuuuuucuuuucuuguuuucucuguuuugguuguuguuuuuggagagaaggucucauuuacagcucuggcugaccuagaauucucaaccauggagaccagguuggccucaaacccagaagaucugcccaaguuuugggauuagaggugugagccacuaacuuagcuuuauguuuuuaaaguagguuggacauugaaauuaaguaucuaauuugaggaaacaguguaguuccuaaugaauagguguaaaauuaaagaucaaccaacuguugguucaucuugguauuugauaaaugaaauuugucaaaaaguccuuuuuucuaguuaccuuaaaauucuguuaguaguaauguuuugugauuaguauuguauaaugugaaacuaauuuaauaaugauuuuuaaaaaaucuuuaacuuguguuuuguuugaauuucagguaauuauccuuuccaauacuuuguauuuuguuuaguaaaccacucuuuggaaguggucacugucaguaucuuguuaugguuugauggccuuggagauuuaaaaccaaguaaaaguguaagcagccuuucuuauuuaguuaugaguuuuaaauccacuuuuguuccaaaucgaaaaauugaaaguagauuuucuauggauaugaguuauuagaaaacauauugacagugaaagcagacugccaauuucaucugugggauuguaacaagcaguucccacuaaggguaaugcauuuuaaaaauuauuguauuuucuuccuaaaacuuuaauaguuuuuuuuuuuuuaagauuuauuuaucauuguacauaaauucacuguagcugacuucagacacaccagaagagggcaucagaucucauuaugggugguugugagccaccaugugguugcugggauuuuaacucaggacuuuuggaagagcagucggugcucuuaccugcugagccaucucaccagcccaccuuaauaguauaaauauaucuacuuuuuaaaagcacaguaaauuacuauagaaacuaaaucauuuaguuauuuucuuauauuuuuugccuuaguuauuaauuuguauccaucauuaauaauucuuauagucucauaacaauguuaauauuauuguccuaguaaucugucuuuuuuuuuuaauucacuuauuuauuuauuauaaguacacuguugcugucuucagagacaccagaagagggcaucagaucucauuacagaugguugugagccaccauguggcugcugggauuugaacucaggaccucuggaagaacagucagugcucuaaaacgcugagucaucucuccagccccuguaaucugucauucuuguuaaaagaaaaaguauucccuggaguuugggcuauggcucaauggcagagaaccuuuuuagcauuauucaugaugcccuagguucauccuagcacacacaccagaaaauauucauugacccuugagcugucacagaucaaugucugauuucaaaccauucagaugccuuuucaauugagcuucagugaagcagucagugcaagguuauuuuacuugugugacacuaguuuagugcuugcugacacaugagacaaugaguuuagccacauggcaaacacaccuguuuuuaaguagaagccaugccuuuuguccuuugccuauuguauagacuugcacuugugugacuuugaaacuuuccaaagaacaaauucaguuucaggcaugaaauuugacuugaaggccauauaaaaaguuaaugucaaaguagaaaaaaaaaucaacaacauuaaaucaauguuagacaucauuacuuuuagcauuucaaaaugacauccugaaauaucaggauaugacaguuugguaugauuggcuaaucauuuuccucaugucuuuagacucacauacucuagaucuuguuauaaauaaacacacggaaaagaucauguccaaagucaacauucuuuucaaauacuuuguguugugaguugauuuguagggugugcaauggauuauuguuuugccauguaucugcguucagcaggugaauacuagauguuaugaauacuaggugaauacagaucuucauucugcuauuuaacauagcacuuuuuuuuuuagcagaaaucacacauauaggcaaaauugguuuuaccuuuaaaaugauaggcuguguauuuagguugcauuugugcuuagcuuaguaauuucuuucucuggugcucacacucagaugaucgaguaagccuuaugccuuaguugaucaaauaauugcucuucccuauaauuccuuacaagaauaugcaaucaauguucuaucuggaucaagcaaacuugucuuuagugguaaaguaauuggcuacauuuuguguacuaaaguuauuuuuaaaagacuaaagauaugauguaauuggccgcaagcauguuuuaggugaaagcagucuugcuacuuacuaguuucaggacuugacuuaacauuuuuaguccuugauuuucucuucuacaaaaggggacaauacuuccaacuuuauaaauauccauaaauauuuuuagaaaucucaugcacagaaacaugucagacauuucauaauaaaugcuuucuuuccuauuuuuaucuucauguaugugguaauuugagacuuagugaaauuauuuucuaagcagucccccuaaauaaaacuuaaaggauuaguuugccauucgugucaguguguagaguguucucuccagugccaaaaggaguauuugagaaaggagauaaaugcuuugaauauuguaguagccuauugaauguagugucuugagggcauauuuugguaccuguauuuauaauuaacaugucaauaaaaaggucuuuaucuucaaucacagguacaggaaccuuaaagauagauuuuguuggagagcugaaugacaaaaugaaagguuucuauagaagcagauacaccaccccugccggcgaggugcgcuaugcugcugucacacaguuugagguaugcauggcuguugucacaaaugcuauucuuaguuuuuuuauuuuguuuuuuuaaacauaggucucacuauguguccccuggcugucucagaacaugcuuuauagaccaggcuggccuugaacccuugccucugccuccugagugcugggguuaaaagagugugccaccacaccugucgcuggaauuuguauuuuauguucaggacuauuucuaucuauauaaaggagauaaaccggacuggggaugaguggguaauuguuuagcagacuauucugcucuuagaguuuuuagcuacagaggauccggcacuuucucgccuuucucugagggcacuugcucuuuccugcaugcaugcauacacuuagaaauaaauauuaaaaauagaaaccuuuaaaaaagaacaggagggaaugagagauauagguuagagaaugauaauauauuccuguguauauacaugcccagguaaugaacuuuuacaucagauuugcucuuguuacuguuguuuuagacugcauagugaauuugagagcugccagggcugcacagugcuacccuacaaaaguaaaccaaaaaaacacaucacguuuauguacgcauguuucuuugcaguuauccugcaaucuuagcuacaguaugcugugaucauaaaaagauaaagaaauuuaagaauauguucuaucuggguguggggcaagggugugccucaguggcccaugccgaggcaucccuucccccugagggaccagccacaggucuauucuauaacauagaauagaguuuauucagggcauggggaggggaguuaggagagcagcagaggcaacaguacaucucuacucuuuuucuuuuuauauugacuuuucaggguuuuuuugguuuuuuuuuuguuguugguuuuuuuuuuguuuguuuuguuuuuugguuuuuucgagacaggguuucucuguauagcccuggcuguccuggaacucacuuuguagagcaggcuggccucgaacucagaaaucugccugccucugccucccaagugcugggauuaaaggcgugcgccaccaccacccagcuuuuccggguauuuuuaaauagucaaaugcaccagucugguucauuucaacuccuucacugccuaucagagggcaggggcugccuuaucacugccuucugcuuaucuguacgaccaggcuguaaagcugccugcugcagugaaccuugaacuucacauaauccuuguucuugaucuuggcagauuuggcauccacccacugggcugugagcagaaagucuuuguuuccuuaguuuuucaaggcguggcgcaagauccuaggcacuggcgacuuuacugguuucagauuuucuuugauuuagcuuucuuccccaccuaaccaaaaaccucacaccuuugggguguuuugagacuugaucucucuauguagcuuuggcuguccugaaacucaugacguaggccaggcugacucugacucacagauaacgcuuaccucugccuccuaagugcugggacuauaggugugugccacagugucugacggcuuuuguuuuuaaaauauuauuaugaaauuuguuguuugacaguuucauacacauauauagcauauuccucccucuuuuaucucccuuccacacacauccagauccuuucucacauucuugccuuuuuguuugacuugguaacuuagauuuuauauacauaaauggcuuuaaacuuuuuuucaccaugcacacauggcugugugagugcuugugugugugcagguuuaggcgcccacauaggugagguguccauucuucugggguuacaggaaguugugacgccccagcaugggugguggaaacugaaucaggucuucugcaagagcaauaaugugccauuucuauagcacugacucuagcuuuaaccagcacugacuguguggccauuggguuggcccuauuuacuagagccugguggguuaccauuugccacacaauugaaggcaaugacuguuccucccccagaauugaucagucuuugaaaguuagcauggagagcaaacaguuggguuuuuguuuguuuauuugauuuaauuuuuauuuguauggauguuuugccugcuucuauaucugugugccacauguauauagugccuguggaggccagaauggauccccuggacucaguuauuuaaaugguuaugggcuaccauacaguugcuggguccuuuggaagagcugucaguacucuuaaccacugagccaucucuucagccccuacuuuuucuuuuucuuucuuucuuucuuucuuucuuucuuucuuucuuucuuucuuucuuucuuucuuuuuguuugcuugucucucuccuucuuccucccucccucccucccucccucccucccucccucccucccucccucccucccucucucccuuccuucuucuggaagagaagcuggugcucuuaacugcuaagccaucuuaccagccuuuuuuuuuuuuuuuaaaagaguuucagucagggcugggugcuggcacauggagaaacugugucucaaaaaaacaaaacaaaacaagaguuucaauuaggcuagacuagcuggccaaggagcccuaauaucuucuuaucuguuuccccaggacugcaauuacaaauacuaccacauuugaacuaauucauccuacuugcuuagugugcacuuccugacuaagcuaucucccuaaucccauuuuuaauuuuuauagaauacugucucuaaguaggucagauagugaguucugauguauaccauauagacaggccauuaaauaaaugacuugucucgaauuuauagagcaucuguauuuauugucauucuagauuaagaacaguguaucagagacuuggaauauuuuuauuuauuuauuauuauacauguuuuuauuacuguuuugcuuauuguuaauuuaaaacucagaggcaccgucgcucauaauuuucccuaauuugaauccuuaaagcuuggcaauaaauggucugugcuuugaguuauauaugcuguauuagugaagccguucauguuaaaucugaauguuauaaguauuuuaauaaaagcaaaaauauaauuacaaauaauucucauuuugucaugaucugcagcagaauaguugacaaauaacugcuaaugugacauugguagcagcauuauguuuccuuuguagucagcacuuagcucauuaccugacagaauggauaguaaaucucugaagcccagggauagagaugaguagaugaggccuugccuauuguacauggggcccuggguuuugauucucaauccugaaaaaaaaaaaugaaagaaggagguggagagagagcucagagguuaaguacacaggcgaaucuucaagagaacucagguuccauucacagcacucacauggcuacucaaaacucucugcaauucuagguccacaggaucugaugccuuauucuggugucugaggguaccaggcacaaacuuggcauacaaauauacaugcagaaaaaacacucauuaaauacaauuuuuauaaaaaaagaaagaaaaaagagagaaauaauugacuaauacaaaacagcaaugauuucaugaaacaaccucugagauuaauuaaaugguauugauaugaguuuauauuuuuuucuuaaggcuacugaugcccgaagggcuuuuccuugcugggaugagccugcuaucaaagcaacuuuugauaucucgcugguugugccuaaagacagaguggcuuuaucaaauaugguauguaugugcuaauaagcuuuuaauagucugguauauuugcucucuugauuaaguaggagaugugaagucaccuagcauagugcuugcugcuaacagaagcauugucccuggucccuuuaguuuccguaaguccuguuuuccuccauugcauucugaugguuucuuccucaaggagcaacuucccaagagagccacaggaaggcaagauucuuacuguguucuuuuguuuuuguuuuuguuuuguuuuucaaaacaagauuucucugugcaacccuggcuguccuggaacucacucuguagaccaggcugaccucgaacucagaaauccuccugccucugccucccaagugcugggauucaaggcaugugccaccacugcccagcuauugugugguuuuguuucuaagucagggugcacuguauccaaggcuguccuguuacuuuguagcucaggcuggccuugcaggaaaguaucuuccuuccucacugucucaggugcuaggauguuguccaugagcugcacuuuuaucuacuuuuuaaaacggaaggacauaaauaaggaacauuaauaugugaaauaaccugcaauaagagugucuuggcuuucucauuaaauccuagaagugauagcuauauuaaaaaaaauauuuagguuuuuggcugauuauauuuucacauaugcucuuaacuauuguuauugaucucauucauaaguaugauaagcuuuuauccuucaaccugauugucugagaccaccuuguuuaagauugauaguagccaggagcuuagaaucugacugugagccgggcaugguggcucaugccuuuaaucccagcacuugggaggcagaggcaggcggauuucugaguucgaggccagccuggucuacagggugaguuccaggacagcaagggcuacacagaaaaacccugucucgaaaaaccaaaacaaacaaacaaaccaaaacaaaaacaaaaaacaaaaaaaaaaagaugaaaacaaaacaaaacgggaacaaagccuguuagcguuugccagguuugcgauucaagagagguuaucuucucuuucugaguaagcucuuaguguuuuaauacuuugcuuccaauuucuuaguguaaggacuuugucaaagaccaggcaagaugcuacaugccuuuggucccagcacuguggaucucugaguuagagcuuaaccuguauacauggcaagauccugccaaccaagggcacauaauuacugagacauugucucaaaaagaaaugaggaacuuauauguuuguuugguuuugagacagaauuucucuguguagcucugacugucugggaacuugcucuguuugaacuggccucaacucucugggaucuuucugccucugccuucugagugcugggacuaaagauaugcaccaccaccaucucacugaaggaaauuuuucuuguaagagcaaugaccuucauaauauaaaagcacugaagaacuuaguuaaaauaccauucuaagaaaggggaaaggagaaaauacuuaagccuauagguuuuugccuaguauuuacucuaaaauaccaauauaaaucuccuuaaauuauucuuguuuucuguuuuuguuuuucccuuaagaauguaauugacaggaaaccauauccugaugaugaaaauuuaguggaagugaaguuugcucgcacaccuguuaugucuacguaucugguggcauuuguugugggugaauaugacuuuguagaaacaaggucaaaagaugguguguguguccguguuuacaccccuguuggcaaagcagagcaaggaaaguuugcgcucgagguaaauguccuugaagaggauugccccaguaguccacagcugcaggcuggggaguuuacaucaucaguuacugguucgguuauucgguuauuugugauuuaauggaaaguugcuuugauacuuucauuucauuuuacuagaauuuuggauaugccauccuuguugcauuaacauuuucuaagauaaugauccagaaaauacaaaagucagggccaagggucaugggagaguuuguguguaacagugcaugaagucgugaguucaaaccucucccucuggaguaaagagagagagaauauaaaaacaggauuuguuuuucuauggacuaccaugaaaauauauaauuauuauucauaccaacuuauaaaugggcuagaguuaggucagcgacaacauuuguagcgagcgaacacagucuucagaggaagccggguucccugggauccguuucuagaagcuucaggugguuuagccuaaagcagcucuccuuuguggguuucugugugacuuauaauacaauauucauagggugauuuuguuuuuuguacuuuuuagguugcugcuaagaccuugccuuuuuauaaagacuacuucaauguuccuuauccucuaccuaaaauugaucucauugcuauugcugacuuugcagcugguaaaguaaauuucauuuuacugcugaauuguaugacuuuauuugaauuuugugauuuuugaggaaaaguaugcauauauauaucaauaaauguuuauauuuauuuuaugaaggugccauggagaacuggggccuuguuacuuauagguauguuaaugacacguuacccugccuucuuucaaaucaccgaucucauaagggcuucacucuguucacaguugaguggcuuuugcuuuaugcucugggaaaauuuuucugccucuccugaguuucaugaauauuugaagcaugcagauggauuucccucacuggcgcuaucugaggguacaauauuuuuaaagggugcauuuggcacuugucgcuuuuuagcuguguucuuggcugagucacguccagugcuguuucacgagugacauagcuauugcccgaugugacgagccuccgguucuguauuuuguaggcagaguuuuacauggcugucagcacaguacaaacauguggguugcauaaguucugaagcugagucuguaaacaauuuuuucuuccacuuucaguugucuuuggaugagcugagcucuguagagccugcucaguguccucuuugggacuuuacacugucuucugcugcuacuuuuucgugucuucucugauuagcagucuuccuagucaccaggcagcacacuaauaaacuuggcuaucuuugauuuucuguuguacauagucuaucaaaguagucuuuagacuuccugaacccuauuuaucuuacauuuccugagaaaauguuuacuugauauugcuaaagccuaauauaaagccaguugacuuacugccugaaccuccuucucuucucuaugccugcuuuuauugaaaugcuuuuaccauuuuauuuauuucuuuuuaaacacagggaaacggccuugcuuauugauccaaaaaacucguguucuucaucacgccaguggguugcucugguugugggacaugaacucgcccaucaaugguuuggaaaucuuguuacuaugguauuuaauauuuuuaagugcucaaauauauccaucuauguccugcugcacauuauuuuggccacacucuuucaaauuuggcuaugauacuaugccgaaaauuaauaauuuucuuguauacucugugcuggugcugcuuuaaccccacacuuggggugaaagaggcagguggaucucuggccagccuggucuacaaagugaguugcauccagagcaacacagagaaacccugucuugaaaaacaaauuaaaaaagaaacauuuucuuuaaaagaucuguuuucaaacgcauuuaucagggcugugcagauagcccaguggucagguacuugcccaacauguuuaaggcccuuagguucccuggcaucuagaggagguaagggaagagagaaguuaucuuuguucuauaguuugcaaguugaaccauauaaacacaaaaacgugguuauguaagucauuaguguauuugccuaaaauaaggugaaguuugaaguaaaauuuuaaaaaaaucuguugaacuaaaaaucuaacuaucuaauuggaguuuucaguuacuguauguauuuucuaucuguuaaugcugguguuucaccuuuacuauaaauaaaauucuaucuguggaagccaauuauguuaguguuuugaaauacaggguuuaauaaaugaauuagacuuaacugugcccugaaagaacuggagacuggacuuagccggauuccuugacagcaccauagacugccaaagaguugaaccugacuuagauguugguuaaguccaugugccuuagaaaugagugaaaauuaagauguguuucaacuaugaccuagcuaagaacacuucuaaagaaagucagucucugaaaauacccucuuauauuuuucuuccaaugcuuaaaacuuuucuuacagguuagguggcuuuuuaaaaaauaacuuauuuuacuuuaugguguuugucuggcuguaugucugugugagggugucagaucuuggggcugcugugugguugcugggaauugaacccagauacucuggaagguauucaaugcuccugacugcuaaaccaucucuccaaccccaguauuuuuuauuuuuaauacaauaucauuggaacuauaugaguuaaugccuguauuauguguauuauguauguguauuauguguacaaauuucuauucucccucugguuuuguguuugauuuuuuuuuuuuuuuugaagguuuucuauguagccuugaacugucuuggaacuuguucuguugaccaggcuggccuaaaacucaagagauugcuaccucugccucccaaguacugccacuaccacacguaguuuuguuuuguuuugagacagucuuucuguguaguccuggcuguccuagugcucauuauauagaccugaccaggcuggccuugaacucagagaucuuccugccucugcuuccugagugcuaggauuagucuaugucuuacaguucuugguuggguauuuucuuggcacauagcaagucuucuauuucuauucaaccuugagaaaaauuauuuguuuauuaccagcaguaaauuuuagcggaggaaauaugcacuuacuguuuugaaacaacuucuuucugagcuuauguaacugucuuuguuagaugccaauuguuucauagaccgaaauuccuaaggauuaguguucaguugcucugaacuagcuuaccucagugggacuuauuaauaccuaguugacaaacaacccuuauuacuuaauauuaaaaaaaaauauuugaucuuugcaaacugugugcauuuuuacuauucaacaaaaaauucucuggccucugauuuggauccauauauuaauuuacuaagagguuuaaucaacaucaaugaaaauuagacugauguguucuaaaagauaguucuuaaauuuuuucaugucacuuuuuuuucauuauauagaaaauucuguauuaguuucuguggucaaacccucauagauagacuucacauauuucacaguguuaccucugaacaaauggaauaaaaagguguaaugcuucuagaccaggcucuuaguuccuguauauuacacuauucaacucacugugcauuauuagaugugaauuuucuguuuuauaaauccuuaaaugucauuuauuuuugaacuacuuccugcugugagugauauuucugcuagauuuacauaguccuuaaggcuguauuauauuucuauuuaauuagaaauagaaacccaauucacuguuucucccagucauugaguaaaugauuucuaccuuuuucauuuggccaugagagccaugguuugguuuggguuuuaagggaaauucuuggcugcagauagcccucugguuuccugcccagccugaucccuuuugcaguaaacucaagaaucuuucucuuggggcuggagagguggcucagugguuaagagcacugacugcucuuccacagguucugaguucaauucccagcagucacaugguggcucacaaccaucugucaugggaucugaugcccucaaauaugaguucauuacuaacugguuucuguugaguuuuacuuuacaaaauuacaaauuuucaaguacaauagaagggagacauguuuuuccaguaaugcagugacuauuccuauguguccuucacucgaucugccuuuuucuuuuuuaggaaugguggacucaucucugguugaaugaaggcuuugcauccuggauugaguaucuuuguguagaccacugcuuuccagaguaugauaucuggacucaguuuguuucugcagauuauacccgugcccaggaacuugaugccuuagauaacagccauccuauugaagugagcuauacuuugcaaucauuucagugaaauaaguaauuuguugugucucaggauguuuaggauucugaaaugcaaaaaaagcugcauggauggcuuccuuugggugacugauuuauuuuuagcucaugccugaaacucuuagacuaaguucuaaguagcauuucucuuuaaaguagggaauguaaagauuuuuuuuuuuuuuuuuuuuuugguaaaggcaggaacuauggguauuuuuauugacugauaggagaaaagcagucuauugagccacacuauacugguuccaacagcagcuguagacaaaucauuauccccaucacuccacugcgucugucugcuguuuagcuugucuuuaucucuuaaagcuuuuuuuguuuguuugauuuuuggguuuuuuuuguuuuguuuuuucaagacaggguuucucuguguagcccuggcuguccuggaacucacucuguagaccaggcuggccuugaacucagaaaucugccugccucucccucccaauuuuuuuuuuuuaacuuugguuuuuauugauaaauagggcuuuuuaauuuuuuuguuuugcuuauuucuuauguggggccauggggugggggaagaguugaaacaggguuucucuguguagccuugacugucauugcucucuagaccaggcuggcccccaacucagccaccuguuucugccccaucccccaagugccaagauuaaaggugugcaccaucauuucuagcuuuguuuuacuuaauauuucuaucugugugagagcacuuaccccagucugcacugauaacagagaacuuuugagagucaguucuuucauuccacuguaaguuuuggggaucaaacuuuguggcuaacucuuuuauccacuaggccaucucguaagcuucuuuuguuguuguuuguuuguuuguuuguuuuguuuguuuguuuuuuguuuuguuuuuuaaagauuuauuuuauuaauauauguaaguacacuguagcugucuucagacacuccagaagagggagucagaucuuguugcggauggcugugagccaccaugugguugcugggauuugaacucuggaccuucggaagagcagucgggugcucuuacccacugagccaucucaccagcccuguuuguuuuuugagauagaauuuuguuaugugacucuggcuagccuuaaagucaugugcaauauuccucuuuuugcuucuugagagcuaggagugagccaucauaccuagguaguuuauacauuuugcauccaaagaacuggaguuauaguccuguuuugucuuugaccauugcucugacccuuccuaccugccaccuuuuaguaugguuucucuguugugcugacccccagcccuaacauuucagugcuaauauguaacugugauuuugcuacuguuauuaauuacaauuuaaauaucugguguguaggauaucugauauuugauaccagugaaaggguuauucaaccuucaaaggaguuguacccacagguuaauaacugcuguucuaaacuauuaauauauauaagugugugugugugugugcgcgcgcguguguaugugaguguaugugcguguguguguaugugaguguauauaguuauaauacuaguggaacaaaucaaaucuguuuaagaauaaauagaauguucgcagcuugacuuugauuugaucaaaagagagaaucuaggcuaugaacaauaacagggaguuaaaagauuacauauuguuuuauuuaaguuuguuauucuuuuuuuuuuuuuuugaggauuggcauacuuuuaugaguaaguuaaaagaagaauaucaugaguuagaaggguuuuccuagaaagcuuuuuauguaauucaguguuacaggcugucugcuuccugucauaacccugaaucacacugucugccaggucagugugggccauccgucugagguugaugagauauuugaugcuauaucauauagcaaaggugcaucuguaauccgaaugcuacaugacuacauuggugauaagguaaauaauaaaaauaauaauuccaauccugcauugugaaaucacaguuuuaaucugauuuuuaguuuauugacauuucuuuuuauauugguuauuaaagguuccuaguacaaugauacacaaauuaguauguuugugguaagaaugggaagcuagccgggcgcugguggcucacgccuuuaaucccagugcuugugaagcaaaagcaggcagaucucuuucaggccagccuagcauauagagugaguuccaggacagccagggcuccacagagaaacccugucucaacagaacuaaacaaagcagagaauaggaagcugcuauacaacuuacaagcaguuggacauguaaaccagcacuggggagacagaggccagccuggucuacaguagcugagagcccucucucuuuucaugacagggauucucuguauagcccuagguguccugacacucacuuuauagaccaggcuauccuugaauucagacauuagccugccucuggcguucuggguguguagguauuguugggaauaaaaucauguacagccacugcuggcuaagagcuguccugagacaccaccaccaggcagagagagccaaaggagaauaaaagucugccccuauuaacacaccuccuccaaaagccacaacuccuaacccuucuaaaacaguugugccuacugggaaucaagguuucaaacacaggagccuaugggaaccauucucauaagagcacacugucaagauaaauaaauaaggcaccacauugagaaagcaaaagaaggcaauuuuacucuuagauaaaacuuaaugggcuucagaaggaugcaugcuuuucagcauaucugauauuuuaggaauugaguacauuuaguuuugauaaauguguguaucugcuauaaauucugagaucugacucacuuuuacuuaaaauuguauuuuuuuaggacuuuaagaaaggaaugaauauguauuuaaccaaguuccaacaaaagaaugcugccacagguaaucuuuacguuuuuaauuuuuuuuuaugauuuauuuauauuauauauuugaguacacugucugcauucacauacaccagaaggagucauugagucccauuacggaugguuaugagccaccaugugguugcugggaauugaacucaggaccucuggaagaucagucagugcucuuagcugcugagccccucguuuuaguuuuucccuacccccuugccuccuuccccuuuuugucaugcuaagggucagucgagaacuuuaugcauacaaugcucuacuggacuaagcugcauccuagccucaaaggucguguucaguaacuugaaguagaaauacagauaaaggcucugaguuugauuuccuaguaccagaccaugaggugcuggagauaaaaugucguucuacauuuacgaugacuccucagacguggugcaugaagacauggucugcacuuugagcuacaaagccuaguguuuacuguguuuauuccagcuacuguggcauucccacagcucaggguacuguggauccuuuucauccucuuggagaaguuuacugccugucaguguucuucccagaauucaugacuuuaugaucuauuagaauuuugugauuugccuucuaacccaguacuuacagcuuugcucuguaccaucucuccuuccuuccuuccuuccuuccuuccuuccuuccuuccuuccuuccuuccuuccuuccuucuucuuuccuuucuuccuuucuuuucaauaaaaaaauuauuuguuuguuuguuuguuuguuuaguaaggcgggucucucuguauagccccuggcuauuccagaacucacucuguauacuagccuggucuggaacacagagauugccugucucugccuccccagugcuggaauaacaggugcaugccgccauaccucuuuguaagcucucgugcccugagugccuuaguccuugcuuauguuuuuagugucaucucccuauuuuucuguacuguuuucuguuuuagaacuugcugaauauauugguguuaauuuuuuguuguuuauuuuuuuuguuugcuauguagacuggacucuccuugugagugcaaaaauccuccugcuucugucuccuaauugcugagauucagggcaugcuccaccagacccagcaagagucugaggggggaugguguacauacaugcgucuagguuaaaggucuacauuggaugccauuucuagguagccacguagucuuuuuuggguuuuugcuuguuuucucaucuucaguguaugcauuccaugcaugcagaggucagaggacacuuuuugugagcuuauauucuccuguccuugaaggugagaacagagcucugguuauaagcuucuguagcaaaugcuuuuaccuauaagcuccacccuaguuuugcuuugcuugugugaaugguuuaggauuuauuauuuuuaauuauacauaagugccuguguguggguauggucacgugaguacacauaucucucaaaguccagagccaucagaucccucugaagcugaaguuaugggcuguuggaaugaccuugcauggguguugagaacuuaauucgggugcuuugcaagaacuauaauaugaucuuaggcauugagucaucucuccaacccaauccccaaauuuuacacaccuuuuuuuuuuuuaagauuuauuuauuuauuauauguaaguacacuguaguuaucuucagacacuccagaagagggcgucagaucucauuauggaugguugugagccaccaugugguugcugggauuugaacucgggaucuuuggaagagcagucggugcucuuaaccacugagcuaucucucuagcccuuuacacaccauuuuuaaaggcacuaaauuuaauuaacccaagguucagaaaguaggcuuguauggcuagccaggaagcccuggguuucugccugucucccagggcugggauugcaaaugcacgcuacaaccucagcuuuuaagugguucuaggaucaaauucagggucucaugcuuugcauagcaaguacuucacuuaugugcuuuuuuuccaggcauggcauacauuguuacccuuuugcuuucccucuauaaccagugaaguuuaaccaaauuaguuuuauuuugguuguauccacauugaauauauuuaaacuuagacugauugaaugagugucagugaguuugucagugauuguguaaugagcuuauacuuguuucuguuugucuuacuuaugaucaauuuuuauuagaaugauuaaauuuauuuuagaauaaaagucuagguguuuggucauuaugugugugcagaagcugcguauaaguguugaauggcuuccucaguugcucuguaccuuacuugucuuugaagggcgucacugaaccuggaccuuacccaauuaggccaguccagcuggccgucccccaggagcccucuugucacugcuucccuacuacugggguuauaaagcuuuccccaccacaggaucucccuacauagucuagcucucuuggaauucacucuagaucaggccggucucaaacuuagauaaaugcccauuccucugccucccucuugcugguauuggaggcgcacacuaucacacccagcucauguuaccaauuuccuuaugggugcugggugaaggggaucugaccucgugcuaguguggcaagcacuugacugaguccccagaacagcuuuuuuuaguagaauuuacuuaguuguagccuuguggguagaccauuuguuugagccucuguaugauggaccuaacaguugguaagccaugcaauguuaaaagguaugugaagcugggcaugguggcgcacgccuuuaaucccagcacuugggaggcagaggcaggcggauuucugaguucgaggccagccuggucuacaaagugaguuccaggacagccagggcuauacagagaaacccugucucgaaaaaccaaaaaaaaaaaaaaaaaaaaaaaaaaaaagguaugugaauauuugauacaggaaauaaacauuuccaguuauuguuuucauuuaccuucuagaggaucucugggaaaguuuggaaagugccaguggcaaacccauagcagcugugaugaauaccuggaccaaacaaaugggauucccucucauuuauguggaagcugaacagguaagccugugagaauccuugcacagcugggugugaugugucauccauggaaucucuguacuuugaaggagauaagcagacaugaguuugagccaugucuuggcuaccuagccagacaguuuggaaaacaaagagaauauuagcacaccagaaugauuguuucuucucugaggauuucauuucucaaaacuguuaugcuuauuaaugauuacacuuaaugcaaacuacugguugcuauuuuuuuuucuuuccuuuuuuuauuuuaaggcucagaacccuuuuaaacuucaguaggcugcuggguauaauggugcacaccuuuaagcuuaggaugugggaggaagaggcagaaaagagcucuugugaauugaggccagccugcucuacauagugaguuucaggacagccaauggauaugcauguagagagacuuuuuuuucuuucugagacugaauaucacuguguagugcuagcuggccaggaucucuuaaauucuaaaaugcaugauaucugggggcuggugagauggcucagugguuaagagcaccgacugcucuucugaagguccugaauucaaaucccagcaaccacaugguggcucacaaucauuuguaaugaggucugucgcccucuucugcggugucugaagacagauacaguguacuuucauaucacaauaaauaaaccuuuaaaaaagcaugauauccauaacccauaaucccuacuuuuuaaaugauuuaaucauaaauuuuuaaaaauuauuauuucauguggauggauguuugccugaaugccugucucugcaccauuuguguaccuuguaaccacgaaggccagaagagggcauugaucccuuggaauuguaguuacgcagaugguugugaguuacugugugaacacuggggaguuaaacccagguccucgggaaugaaggacagccagugcuuguaacugcugagccauaucuuauuuauuuaguuagugaugcuguguauugaaccuagaaucuuuucuuucuuacuuguuugcuuccuuguuuuaguuuuuggaaacggucuuccuauuuaaccucagcuggccuagaacuuguagcucccuuuccuccccagugaugagguuaaaagcuuguaccacuaugccuagacuucaguucuguuucuugugcuuaguuuacuuacuaaggucauuauuuguuuaguuuuacauuugauuuaaguucaagugugugaucuuuuaaauaucccagaaugcaguuauugaugagcagugaggccagugacugccuguuuuuugaaggcuuuuguccuuuggugggggugggugaggcugagugccgaguguaagugugcacauuugagugugugaagggccgucaguaggcugcccacccugguuuuuugauagggucuuuuacugggaccugggauuuguuaguuuggcuggguuggcuggacagcaagcuccaggaacccucuguuucugccuugcagacacugggauuauaaguguucauuaucacaccccaguuuuuacaugggugcuggagacugaacucaggaccuggagcuugcauggcaguuagauugcauggcaagugaguuaucaucuuaaaguguuuuauaaacacauaggcuauugcuuuugauuucuagacuugaagucaccccuacccucacauuuuuuuucuuuuuaagacauuuaaaaaugcauuuuaaaaccuuauugcauucacauggguaugggacgaucacugggacaugaaugaacagcuuaccaggggccacaucucuggagagaauugaaagcagcuccuuauuagcuagggguguggcucacgauucuuuccucaagagugacugacuuucuuuuccaauucuguaguuuucucaucucauugcagaagauaauuuguacugcuucccugccuauauugucacagaaacacucccaacccaaaucgccauuguugucacagccuuugcuuugccucuguagguagaagaugacagagugcugaagcugucucagaagaaguuuugugccaguggaccauauggcggugagcaaauaugaucucagagggaacugaccaguaaaucucgauuccuuacuaauaguuuucaaaauaagaggaagcauguuauuugucuaauuauacuuuggauuuaguuuaguauuuauuuauuuauuuauuuauuuacuuacuuacuuacuuccuuaucuaccuccuuauuuacuuauugugaaauagaauuuauuguggcucugacuaugugcacuagaugugccugaucugcugaccaggcucacaugguuugugcaauaaauacaucugccgggccugcucuccagugguuggaaaugcccagggguuuggggguaggguugucaguccagcuucaugguccccuugguggccuuuuucucugccugcuuggcuuccauuucucuucuacuuuccucucacuuuuuuggucccagcuccuccuuuaccugucugcucucagccuccaagccuuccuaguuguuuucaccccaggagucugggucuggccugggcugagcgcugggaccaacagacagggcagcaaagggguggucgcccaugucacugggcucugcaccacccuaguuauacuagcuagcagugugcuuucuagggguggcuccacagagcuggguuccugccagcccuggucccaggagcugucaacuuccgagcugcuccagugugaguccagagacuuauggucucgguggcugaccuguccggcuuggcucccuuggaccuuggcacuuuagucaucauccagcugugccgagacagauucagcuuccuguucgaugcugccccaguuaucuuauaugugugugugugccugcuugucuguguguguaccaauuaugugcagguaccugaggaugcuagaggaggacauuagauccccuaggacuacaguuauagugcucuuaacugcugagccuaaucacucuaggccuaaucuuuaaaauugugugucucccacaaagcuucaguggccuuuaaucccaucauuucggagucagaggcaggcagaucucuugaguucaagagcagccugguuuugccagggugauccaggacaccuagggcuacacagagaaacccugucuugaaaaacaauaaaguuuauagcucucuuacugaaagagaauaaaaaaggauuggaauaccccaagaaauguaaggcagugguuuucaguuuuccuaaugcugcaacccuuuaagacaguuccucuuguugugacuccccuaaccacaaaaauuauuuuugcugcuacuucauaacuaauuuucuuacuauuaugaaucauaaugucaauaugugauaugcagaauaucugaugugugaccccuaggaaaggggucauucaacccccaaagaaguugaggcucacagauugaaaacugcugcucugagaacuuacuguguuagggggguuuuuuuguuuuuguuuuuuaagugauugggcuuaauaaguauuaauucagugacgauugucuuuacuuaccauuauccuaggcacuucaguugcuucuuacguuaugcucucagcauagaguaaugcuucucuucuacacacuaaagcugagguguggcuacggugguuaaauugcucagucagguugcuuuagucucagccuuugggaggcagaggcaggaagaucucugugauuuuuaaggccagccugucuacaagauugaauuccaggacagccagggcgauguauagagaucuuguuugcuccaaguuaucuauguaaugaguuuagaagagugagaauucaaauaagauuguggaagucccucacuuuguccucccaacugcugccaccuuccugaauaacucugcaugucaucaaacccuuucuaccuauaaaguuuuaaccaggcaauuuaauuuuuauugaagaaacuuaaguuucauuuucuuuagaauaguagucucaguagggagagauauguguaccugccacuuugucaccacuguccugucauguuguguucacaagauccaguaaagaaaaauggccuucugcucuucacugucucacuuugaacuacucuucucaguaggggccauggauuugaucuccagcauuccuugccuaaugggaaaaagaagucuaacaugucaguuuauggcuuuacucgccaauuaagucuuuaagugccacaauuucuauuuucucccucauauuuauaaucuguguuguaauacuaacagguuugcagguuuuucuaucccuaagaccaaugcaggugacauuaaaaccuuggguaucucagugauuuaacauucagcuuagggcuagagagaugauucagugguuaagagcacugacugcucuuccagagguccugaguucaauucccagcaaccacaugguggcucacagccaucuguaaugggaucugaugcccucuucuggugugucugaagauggugacagugugcucacauaaauaaaaauaaauaaauaaaugauauauucuuuuauaaaaagacaugcagcuuacucauuguugacucugugcuaucuuuaaauaguucuguuacuauacucagacaaagucugcuuugcuguuugauaucuaggacacuggcucuaccuuucaauggcuuuggcuccucggggacgagagaaauaguucccaggauugguucugcacagugucacuggagugggagcccuuaauggaagcaucauagagcacugacuccucaaguugacuguaaaaucauugcugucuuuauugcuuuguaaaagggaaaaacauccccuuuagaugagugugauuuugguaggaucuuaucuugucccuuguacuaauaguguugaggucaccgaaggcaugauuuaacaaugagaguuuugucuugguuacagcguggcaguccuguguuuaccuuacuaccugcuucuuucaguguaaccugguuuuccaaguuuucuauuuguucucuucuugcuuaggugaagacuguccucaguggaugguuccuaucacaauuucaacuagugaggauccuaaccaggcuaagcugaaaauacuaauggauaagccagagaugagugugguuuugaaaaaugucaaaccagaccaauggguaaaggugaguuuagaauggcauagccauuuuuauuuuauaugaaaugauuuauuucucuuacuccuaugucuuuguggcugacccugaauuguauuucuucaauuuguacaaguauuuucaaaggaaaaacuuuucuaagcagauagaagggaggaaugaagaguagaaguugacuggguuuggucauguauaccuguaaccccagcgcacaguagucugaggcaggauguuaaaauuugaggcuagccuaggcuagugagacucuguuucaaaagaagaaaacaaagggaagaguaaauacuacacuggcauagaacaucuguaguacugcagcugcaguugccucccuugcuaaaaagccagucuguggugcaucucugggaguucaaagccagcuuggucuacagagugaguucaaggacagccagggcuacacagagacuguugaaaaccacccaagcuguccugccauuccaagcacacuuuagccucaggucuguguuguccucauauaacuuucuucaagugagagcagaaauagauaaaaaucuauuugucacuggaauaugaaaacacaaauggguaaguuauuuuuacuuuguaaaaaaaaaaauugcugcaauuucuucuuaggauuauagguuaucccaaaauuuuaguugccaagaaauacccuuuuuuccuauuuuaauauuuaaaauauacucuggaauauauuagcauuugaaauuaugaucuugaagauuaaguaacaauauggaacuuucucacaaauuagaaaaaguuuuguacacuaugacuguaauuaagcauaugaagauacaguuccuacagcaaaagauaaaggacucaaaauaauuggauuagaauuguuuaauuaguuuaaauaauuuuuuauuauuuauucuugucuuaugugcuuugguguugugucugcaugugugucuguguaaugggguuggaugcccuggaacuggaccggaugcuggaauucaaacccaauuccucagaagaguagccaaugcucuuaaccacugagccauccacccccccauuuuuacaauacuucuaaguaguaaaucuuauaauuacauuuuaccuauguuuguuuuuuaagacaugacuuagcucaguggaaggaaacuugagaggcguggcuuugaaccucaucacccccaauauuuuuuugcuucuuuguuuuauguuguuguuguguugcucuuuugggacagagucuuacuauguagcuacagcugcucuggaacuuaguauguagugcaaguugaccaccauacccacucaaagauaucuuuuuaaaaugaaguggcuggggcuggagcgauggcucagugguuaagagcauuggcugcucuuaacuggauccugaguugaauuccccgugcccauaaugguggcuuacaaucaucuguaaugggaucugauucccucuucugguuuguguaaucacagaacacucauuaaauaaauaaauaaauaacuuuuaaaaaugaaaaaagaaagacaaaaaaauggaguggcugaucacgguccggcccaccuguaaucccagcccucaggagucagaggcaggcagagagaucucuuuuuuuuuuuuuuaaagauuuauuuauuuauuuauuauauguaaguacauuguagcugucuucagacacuccagaagagggggucagaucuuguuacggaugguugugagccaccaugugguugcugggauuugaacucuggaccuucggaagagcagucgggugcucuaacccacugagccaucucaccagcccccagagagaucucuugcguuugaggccagcuugaucuauagaguaaguuccagaacagccaggguuacauaaagagaaccugucucacgaaaaguaaggagaaaggaaguggcuaauaguauuuauugucuccuuucagcuaaaucugggaacaguuggguuuuaucgaacccaguacagcucugccaugcucgaaaguuuauuaccaggcauccgugaccuuucucugcccccaguggaucgacuuggauuacagaaugaccucuuuucucuggugagcguucucacucacacuuuggucauaugaugcauuuuguugguuacagaguauaaugguuaaaucuauauaaagaauauuagaaggauaugguccuuccugucuaagguuagcuaauuugggaugacuaugaauggcuaauuauuaauuaacaugacaaaauuuuuaccuauaucagugucugaagcaaauuucauuucacuaauccaguuuuguuuuguuuuguuuuuguuuuuguguuuuuaacuuaccacaaacuguccuuuuagggacaaaaguccauucuuuuaaaaacaaauggauaugagucaagaagagguuucccuacugauuuuuuuucuuuuguaagauuuauuuauuuauuuuauguaugugagcacacuguuaaugucuucagacacaccagaagaaggcauuggaucccauuacagaugguugugagccagcaggugguugcugggaauugaauucaggaccgcuggaagagcagucagugcucuuaaucucugagccaucucuccagcccccucccuauugauuuuuuaaacacuaauucagagcgauuuuauguuguucuuaaguaguacuuguacuuugcugagaaagcaagaauguucuaacagucuguuauuacucaaauuauagcauaucagcccagaauuauauacauauuuggcuuuguuccgggaaggauuuaaagcagcaaaauuccuauuguugucuuuaugacuccagcagguuagguauuuucaggaugucuuugccuguggucaaauuaucauucuuucuaguguugcuuuaaauuggaccugaagucucccugcccugugauugcugauuggauuccuucucuaaauaaaugcagauuagcauugauggacaaacgucccaccugcugaucucacuuccaagagagaccuguuccaggacaauaggcuguuugugcaguuggcugcuagaauagaaguucuuuuccaagucuuguuagucagugcuaaaagcacucugacuccgcagagccuucccaucccugccccuuuagagugaggcaaggagaggcugacguugacacagugggcagagucagccuugacagagccuuugucaagaaccagagccccagcuguuuuuuugcaacuuuucucaaaguagaagauauuuuaaaaaagaaagagagaaauuuaaaauaucaaagugaugccccagaaacugaguagaaacaagaaguuaacugauuuuuauuggucccaaaauaugagauucaaucuaaguuuuuuuuaagguguucuuuuauagauagcaaggaaauuaacaaaagauguugucaugauaggauuuuuauucuaacaguauucugaacuuacuuagccucguuuucuuaaaccaagagaauugcuagcaguagauaaugccacaugcauguuuguuuucuuuugucuuguugagucugaaggcugagcugauuuguguuuuuuccuaucccaggcucgagcuggcaucauuagcacuguagagguucuaaaagucauggaggcuuuugugaaugagcccaauuauacuguauggagcgaccugagcuguaaccuggggauucuuucaacucucuugucccacacagacuucuaugaggaaauccaggaguuugucaaagaugucuuuucaccuauaggagagagauugggcugggaccccaaaccuggagaagguaauagaugaauguacuaucuggggaagaaucuaaaguuaguacuuucuauuccugugugguugacaguuagcagcaucucuguauccagauuuuagaguauauucaguuggucagaaauguaguguucugaaccugcuagugaaauuguuacaccaucacaaaacaguagcucacguaccuuggaaccuauacugacucuccugccucagcauaaaucuucacacuuggcaggguucagcuuuccaaaguaagaauuuuaauugcuuucugccuuucuaugauuaugucuauaaucauguuccuuuuaaaacaauugugauuuaaauguugaaagugguaauuuggagguuuuaaauccauucacuugucgccaucugcuuacuaaaugagguguucucuccugaauaaucuuaaucuaggauuuauuuuauuuuauuucuaaagauuuauuuauuuuauguauaugaguacacuguugcugccuucagacacaccagaagagggcaucagaucccauuacagaugguugugagccaucaugugguuacugggaauugaacucaggaccucuggaagagcagucagugcucuuaaccacugagccaucucuccagcccccuuauuuuuuuuucuucuuauagcaauggguuuacccaggagccuagucuaugcuaaacucugcuagugaucuacucccagaccauuacauugaucugggauuuuuaaaaauaagaacaguaauaguauccaguucuugccacugccuuuccuucauauucaccuaauauuuauguaacuaguaaaaggcaggugcuauuuuacaaacuggcagucgagauaaucaaagcauuguccuguauagcuuacauucuaaugggagacacagcaaauuauauuaagguagaguauagauucacaaguaaaauuagauaguaugaauaaggagugcuaagccaguguuugauaaaguaguuggagaaaaaccaacccucccuaauaacugaucuucgagcauaaauggagaacugagagagagagcuacaagugcagagcaaacuugguccagaccagagggcccagcaaguuacaagaaucuaaagcaagagcaugcccagaguguucaaugaaaaaccagaaggcugaugaggucaggacuggggaagaggugagaggcccauggcaagucaaugacucccuuacagggaggcggccugaagcaaaguuccuuguuuuucacauuuugauucaagaugcuaguuuuagaaguuuugaucagaggaacaugauuuaauucaugugacuaugaaacugaagggaaaucauuuggaaggcuauuugaguauuccacuugguugccguuagcacauaacaagugaugccuucucucugugguuuuggaggacugagugugguaaaaagaggaaucaacagauuaaggcuacuuaucugacgccgggcgugcuggcucacgccuuuaaucccagcacucgggaggcagaggcagguggauuucugaguucgaggccagccuggucuacaaagugaguuccaggacagccagggcucuacagaggaaaaccaaaaaaaaaaaaaaaaaccaacaaaaaaaccuacuuaucuggcccacaguggcacauaccuuuaauccuagcacuuggaaggcagaggcaaguguauguucuuaguugaggacagccugguguacagagcaaguuccaggacagucagggcuguuguacacaagaaccaugucuagaacacacagacacacaccacucaugcuccccucccccaaaaaauacuacuuguagagggacaggcacaaagaguuccagguuccaggucagccaagggaaaacaagauugucuauagacgcagguuugguugcaaaaaagagccagauuggguucauuugcuacauuugagagugccuggagaugaaggcuagguaaauacaguuggagcuaauagcauguaguuaggauuuauaacugugaaacuagaagaaaccaccuaaggacuaagaauagagagauguuugaggacuauagcuaaauucaagaguuagagauuggcagaagaaaagcuaagcaugccuguaaucaggaagcagaaacguucaaggccaaucugguuuaccuauggcucuuuuauuucaagaaacaaaggagaaaagaggcauggugguccacaccauuagcccuaggagguagaagcgggaggaucaggagccauccucagugucauagagaguuaaccaccgcucuggguuaugaggcucagugagaagagggugaagaaucacaaaagaaacugacuggccucugaggagcaucaggagaaaguagaguggcccauaauuucaaaguauuguauuauaaggucgagggaaagugguaagcuguguugguugccacaagcagaaaguaauagagaauuaacaauuuugguuaacagauucugugaagugguaugccuauaauagauucuccacagugggaggaauuggagacaguguauauagacaacucuaaaaggaauuuuguuggccacagaaauagacuugacgugggauuggagaagaaauguucuuuaaggagagaaugacaccagaguauauagggaaguugaagguuaucaaggggaacaaaaugcagugguacuagaaacgugugugugaugagaaagguagaagguuacugcuguauggcaacugagucauugagaggaguccagacccagcaagucguuagcuuuagagagagcauacauagugacagcucagcagaggacuuccuggaugccgcacuugucuguggaaauaauaauguguaaaaucuuugauuuggaaugaauacaggauaaaugccuuuguucuguagcuguacagacagggggauuaaagagcaaauaguucuuauguugcuuugaccuacaacauaagucaguagcagauucccaguaagggcuggggagauagcucgguucuguuucuaagagugcauacuugaagaccuguguuuaaucccaggaagauagccuggagcagugacaugugcuuguggaccccccuccccgcccccucgcacugaggaaagaaguagaucuguaggguuccauuccagagagugauaaugucuucaagagugaaguggccgggguucuggcacacagccuuaucucagcacucgggagaaagaagagguagaucucugugauguugaggccagccugcucuucaaagagaguuccuagacagacaaggcuaaggaguaaggcccugugugaaaaauaaaacacccaagguuggccugcccuccacauguauggacauagaaauauguacccauauguacacacacacacacacacacacacacacacacacacacgcugucacaggagcuagagagcuggcuuagcaguuaagaguccuuauagcucuugcagaggacaaggcucaguucacagccaucuguaauucuaguuccagggaaucugaccugccuuguaguauaagcuaucugcccaaauaaaauuacuugucagugcaaauaccucugccaugcucugccacaaagcugcaucccuggugcuuucauggcgguuuuuaucagugacagugacacugagcuggagguauggcuuuaucacagugacagugacacugagcuggagguauggcuuugguaauugugcuguacgggaggaugaauccauugaauguuuacuuuaaaaucuaaggcuuuaguuuauugaacaaagagcauuuuuuaaaaagcuuugaagagcuggagagauggcucagcgguuaagagcacugacugcucuuaaccagagguccugaguugcugaguucccagcaaccacauaguggcucagaaccaucuguaguggaaucugaugccuucuucugguguguccaaagacaugacaguguacucacauacauaaaauaaauaaauaauuauuaaaaaaaaaaaaaaccuugagugaaacuugugugauguaagucuuuccuuuucacguguuuuuaacaguauagcuacauuacuaggcuccaguaucugguaccuaugaguccacacaaagucagcaaauuuguuugcuugucuaguauguuuauuccuuucuucuuacaauuugauaaacuaaaucaaguauucucauaaguacuagagugaucgauuguguuuguuuaagaccguagacuugguaucacaguuacaacguauguaacuugugcauuaucaaagcaggcuucucaaguugucugugucuucacuucuccaccaggucaucuagacgcacuccugaggggcuuggugcugggcaaacugggaaaagcaggccauaaggcaacuuuggaagaagcccgucgucgguuuaaggagcacguggaagggaaacagauucuuucugcugaccuaaggaguccugugaguuauuguaauaaauuccccugacagcugggugugguaguauacuccuuuaaucccaguacucaggaggcagagacagaggucagcaagugacccugucuggggguuggggggggggggagauaauaauaaaucccauugaauuguagauaugaguuuuaauuugugaguuaaaauuggccuaaaaaccgacacucacacccugucugacuguaaacaaaggcugcuugggugguuugcagccagccucuccuuuguuucuccaguagcacaucagugcugcaaggugacuaacuuggugcauuucugagagaacugcuacaagauauugucugcacaugacagcccugugugauuguccaccaccagugacugauaaccauagucugucugucugucugucucuguauugauacguaacuauaauuuguaaacuggccuuguagcccaguuuuguuuuacccauacucuuacuguguaucccacaaaggcauugaacuuaggauccuuuuccuuucugacucacccccaaccuccaguuguacaacaguaggccuuugccaacaugcccgucuucuuuuuaucuuagcaucagacucuuuauaaugaaauacuuauaacuuaaaugacuuccuuuuuccugguguucuuuuguaggucuaucucacuguuuuaaagcauggggauggcgcuaccuuagauaucaugcugaaggugaguauauuugggaaaggucuccagacgucugcauuugaacuuggauguguacuuagagguggaggagagccugggcaaagagauagaugugcuggauuuggcuuguaaucucagguaguaaggagauuaaagcaggagugcagagaguuuaaggucuaccuggacuacagaaggaguucaaggacagacuggauaacuuugugagauccuacuaagacuaaaauguaaauagcucugggaguugagcauaauggggaagcuauuagucuagcaugcccgauggaggcgcagaucccaguaccacagacccugggguucagguuuauuuguugguuuuccuacacaacuucaguaucuagcugacccuucacccugaaauguaaggcugaucccacguccucaugcaugucugagacagggucucagguagcccagacugacacugaagaguggcauugaauucccgauccuuguguuucaagugcugaaauugcaggggagccaccuauguccaguuuguuugguuuuucaagacaggguuucucuguguaacccuggcuguccuggaacucacuuuguagaccaggcuggccuugaacucagagauccgucugccucugccucccgagugcugggauuaaaggcaugggccaccaugcccggcucuauguccaguuuuuguuuguuucuuucuuuuguauuucugaagccagggguucauuuuaacccaggcuguguuccaucucacuuuguacuugaagcugaccuagaacucuuaucuuccuugcauuuccccuugaugccaagacuuuggagaucauaagcaugagucacaccugccuccaccauuuuauaaagcaagguucuucagguugcccuugaaaucgauuuacccaguuacgccuucaacuaauucuucuguagccucccaacuuucuuaaugcugugaccuuuaauauagugucuuguauuguggugaucuccaaccauaaacuaacuuuugcuaauguuaugaauuguaauguaaauaucuguaucuaauucucuuaggcaucuccuaugaaagggccaccuaguaccccuggaguagguggguacuaggacccacagauugagaaccacuggacuagauguauaagccagauucuuuaaaacuuccaugugaaagccaggcauaguggccauugccuuuaauaccagcacuugggaagcagagacaggcgaauuaaggccagccugaucuacagaaugaguuccagggcaggcaaggcuacacagaaaaacagaaaccuugucucaagggggagagggaaaaaaaaaagccaaaacuucuaucuaagggguaaaguuguccucugauuugcacaaacauauacacacaugcagcacaaaguuuuuuguuuguuuguuuuuuacuuuguuuuuuuguuguuuguuuguuuguuuuuugagacaggguuucucuguauagcccuggcuguacuggaacucacucuguagaccaggcuggccuugaacucagaaauccaccugccucugucucccaagugcugggauuaaaggcgugcgccaccacugccuggccaaaguuuuuuguuuguuuguuuguuuuuuaaaucaacuuuuaaaaacuggauggcgggcuggugagauggcucaggggguaagagcacccgacugcucuuccaaagguccagaguucaaaucccagcgaccacaugguggcucacaaccauccguaacaagaucuggcgcccucuucuggagugucugaaggcagcuacaguauacuuacauauaauaaauaaauaaaucuaaaaaaaauaaaaauaaaauaaaaacuggauggcacuuugcuuuuuuauaugcaaggaucuggguuccauuccagcaugggaaagaagagucagagaaagagggaggaugagaaaaugagauguuagugguacuugagacaaguccuauccugucccugugcauucauuuccagucuguuaagaaaaaucauggugucuauauuagaggugggagggucaaaauaagcucacgucugucaucagguaauuauguaaaaugugccuaaauagccaagucacccaucagaacuguguauucauuaaaagauuuacauguaagcuaggcauguuggcacucaccggugaguggagcacuuggaaaguaaaacuaaggagaucaggaguucaaggucaucuucagcuacacagagaauucaaggccagcugaauuauaugagagcccugccucaacaacaaacacgucguucucacuaguucuggagggaucacuuaaugguuaaggguacuugcugcucuuacagaaaaccuagguucauccccagcacucaugugguggcuugcuuuccauaacucuaguucuguggggucuggcaccgucuacuggcauugagggaccagaugcacauacaaugcacuuacaggcaaacccucauguacauaaaauaaaaauaaauaugucugcgaugaagcgauggcccaacagucaagagcacugacugcucuuccagagguccugaguucaauucccagcacccacaugguggcuuacaaucaaaccaucuguaauggggucaggcgcaaucuucuagugugucugaagacagcuucaguguacucauauacauaaaauaaauaacuuuuuaaaaagugaugggggaguucuagacuauccagguuugcauaaugagaccuugaaucaaaacaaauacauagucuggguuuuguauuuucuuucuuuucuuuaaauguguaugaauguuuugccugcauauaugucuuuguaccacaugugugcuugguauccugcauagcucagaagaggacuuuugguccccccugaagcuagcauuaacaggcaauuaugagccaccaugugugugcugagaaccaaacccaggcccucugcaagagcagccagagcucuuaacuucagagcuaccucuccaacuccaaauaauccugugugacuuucaggguugaagagaugguuuuguagguaaaaagcuugcugcacagcaagaaaaccucaguuuggaguccggaguccgugugcaguggugcacaucucuuucacccagcacaaugggcagagguagucagcuuacgggccgacuauucuaggugaaauggcaaguuccagauucacugauagauccugacucuacaaacaagguggacuuccaguacaggaagacucuuggcaguaaccucugcccuccacaggugcacucguggggagcagagccaacacaggcacauggacacacagauacacauuuuaggcaacauucuacaauauaucuuuuuguuuugucuuuuuuauuuuggggggacagggucucauuuaaaaagguuggcuucaagcuguguugccaaagauguccuaaaauuucggauccuucugccuccacuuccccauuauuaaugcauuuuuuucucauuugaguaauuaacagcauccagcuacuagaugucuagauuauuuucagcuucacgggcuaaauuaaugauaguuaaugauaguuuagugauaguuuauuuaucuaauacaaagcauuagccaggugucagugauguaaagacugaccauggcagacuuacucuuuagaccuuuauacuagccuggagaccgagacguacuaucugacuaacacacaccugcaucucguggcuuacuacuguggcagauguaggguuuagugcccaaccacaguagcaaaguacuaagugguguagugcagugccccaccagucaguccuacccagggaggaggcagagcagagguuccaccucaguggaagagaagccgguaugaacaugccuggaauccagggaagagcuaacuguucaucuuuauuuuuuucccuguagcuucacaaacaagcugauaugcaagaagagaaaaacagaauugaaagaguucuuggggcuacucuuucaccugaacugauucaaaaaguccuuacuuuugcacuuucaguaaguaauauguuggauugcaagagaacugcugcugagccaugaggugggggcaugcgccuuuaaccccagcacucauggggcaggaauaggaggaucucugagcuuggggccauccuggucuacagaaugacagcuacauagagauacucugucuggaaaaaugaaagagaacugguguuccaugaugugugucaagugucugacucggcacaccccugauauuuuggggaagcuggucggagcguuuguuuuuguuugguuuucauuuuauuauugcuuuauuuuguauggcaggguugggauggggaugagaggaggugaguaggucguccuuccaucuugugguuuccagagauugagucagguugugaggcuuggcuacugugcugaccugcccucucccacuaguagugagaauuagaacagguugaagagaaaguggaggccuuuggaaucccuuucccucccuggggugagugcuuccccugcuguugcgcaguuuuccaacagucuguuguauucucugguaccaggagguacucuagagagcugggcugcuaguucuuuuuuuucgccuuaggaagagguccguccgcaggacacugugucggugauugguggaguggcuggaggcagcaagcaugggaggaaagcugcuuggaaauucaucaaggacaacugggaggagcuucacaaccgguaccagggaggguucuuaauauccagacuaauaaagguauguaggagucuugaguagcuugcuaaucuugaauguuauugaaugauuauccaugauccauuagaccauugguucccaaccuucccuaaugccaacacuuuaauacuguaccucauguuacaaugacccccaacuaccaaauuauuuaacugcuccuuuauaacuauaacuuugcuacuguuaggaauuauaauguaaauaccugcugugcaggacaucugcugugugacucccgugggucgugauccacggggugggaacaucugcguuagagaguucggcucuuuguucuucccgcgguucuucagccggccgccguggacugugcuuauaaccucggcacugcagaagcugagacgggaggauugcuuggagugugaaaguagccauggcuauauagcaagacccaaacucccacuccuaccuucaaauaaaggguuccucaagggcugugcuugcagcucacucauaggccugugccacacuggcugugaauucaagccccagcaaaaaaaacacaaaacaaaaaucucucaaauaguuacugaaguuuguuuuauaagcauguacauccccaucuuaucuucuguguaacaaaccagagucgggagaacagaauugauugucuuugggguaaguggaaguuucugucuagucuguuuguuucucuaaacuauuuaaaaccucugcuuuguuuucagcucucaguugagggguuugcaguugauaaaauggcuggagaaguuaagguaaggacaguacuguucacuucucaguuuucaguccagagcauaaaugaaccucccuuucuuucuuuuuucuuuucccucccucccucucucccuuuuuccuucuccuccuccucguccuucuucccuccuccuccucuucucucuuucucugucuuucuuucuuaacuuacuuuauuuuguauauauguguguguugccuacauguauauguguauguacuccauacuugcuugauacccauggauaucagaagagggcgggcauaggguccccuggaucuagacuucugggaaguugugagccaccauguggaagcuaaggaccuaggucucuggagcaauaagugccuuucaccugagcugucucucaagccccaugaaccuuguucuaauguucuaaagaguguugggguggugcaguuuuguggguccuugugucuuagacagauuugacuuugccuucaauaucugcagagucuacaguagagagauaauuaguuuuguguagauccugaccugguaaaugucagcauuugggggaaagauuuauucugagugggaaaugcaaaacuccauuauacuauaaacuucgucaucaugugugcugucaguacauuaucugcuuggaggcaauacugagagcugugaucugguucauuguggggaccauuguuagggauaaguuuuauagccaggcagaguggcucagaccuaaacacagagacaaauggaucugagucugaggcuauccuggucuacagagcaaguucgaggauagccaggacuacaccuguuugaaacaaaaacaaaaaaacaaaacaaaggggaagaaaacaggaauacauuuuacuauuuuuuaggucuugagaaaacagugaaauacuugauuucagaugucauuuaaucuacauuguauauuguguuaugugaacaauuucguuguaaaggcaguggggcuuugaagaaaagacuccuaaauaggcuuaggaagcagggcaguggcaaggugaagcugguaaggcagacuuaagauugcaugcagacgggaacacugucuccugcugcucaggguaaggcaggaggacugcugugccucaaggccagucacgcugcaguauggaagauaguuugagaagguugagacacucauucuccgagcaagaaagacauaguauaguucuucuucucugagaaaaagaauggagucguagugggauucccaguaagcauuggaguguauggggugaguuagagcucuacucuuguagccaugcuggccuaaaagucacuaugaaccccgaguuggcccugaguucauaaugauccuccuauuucagccucagaaguucaggguuacauaaugauuuaugagccaccacaccuggcuuucguuaaucguuaauucaacaguauuucuguguguucugaccaccuaaggcagcauuucucaaccugugggaggagacugcucucaaaugacccuuucacaggggccaccuaugaaaggagaccaucaggaaauauggauauuuacauuacaauucguaacaguaacaaaauuacaaaguagcaaugaaaauaauuuauggcugcagguuacaacaagagaggaacuguauuaaagaguuggaaggcugagagccuaagagaagaaaaagagccaaggauacccuccuugugggccugccuuugagcccaggacuugggagcuggggcaggcaggucucuaaggcuagccugauuuauauaguaaauuuaggacaacaagaauguguagagagacugucaauggguguuggccaugauaaugcuggugcuguuugcugugucacuccaguccugagaagccuacagaccuguugucuucuuuguaaaucaggcuauugguaucugaaguuuacaccaggacagccuuuggccaugugcugguuuguguuuucagaugcuuugauuguggugagagcagaugaacuagcuagaaaauagcuugguaauuuuuauguauaugagugcacuguagcugucuucagacacaccagaagagggcaucggauuccauuacagaugguugugagccaccaugugauugcuggaagggcagagcagucaguguucuuaaccacugagccaucucuccagcccccagcuuaguaauuuuuaauaauaaucucaagaggcauguuauucuaugaaaaacguaaaacucugaaguagaauuggauuaguagcaacauuuuaaacuugguagcuuauugugaggcaguuuugaauccugaagugccccgccuugcuaagugcuccuuuguuuuuucauccaguaaacguuucucggagauuagagauggaagcuuagagcaguuaacuuacucaguaguaagccaucaccuagaccaauccuagccucagguuccauauacaucacaucuuagcauugggacagcacacugucaucuaugaaauucaugcugagagccaugaacucagaagcaauucccuuucaguggccucaccuuccaaaucccauuaacaaacuguauacaagagagcucgguaaggaaucugccucagagggaaguguucuagguauucuaaaagacuggguuuuuuuuggguuuuuuuuuuuuuuuuuuuuuuuuuuuuuuugguuuuuuuguuuuuguuuuuuugaauaggagagagaaaauauccugaaacauuuggaagaguccagaacagaggaggaagaaaaaaaaaguggacuggauguguccagagcugucugcaggagagcaagccaguagagcagggguggggugugcugggaggauaguggagauaacaugaguugcuggggugaggaggauacauguccuacagagaacaaaggguaucugggaggugagaagggcuagggcacuagcguagaggcugugaaacauguaacaggcacuugugagugggaacuaaggaauccuggagaccagcaugaacuuucauaugcaguguuagcuacaauucuguugcccugaggagacaccaugaccaaggcaacuuauaaaagaaagcauuuagcugagguuuugcuuacugugucccagguuugggcuauuguuauggcagggaacaugagacaguggcuaagagagacaacaacccuaggccuggcuugggcuuuugaaaccucaaaacuuucccccagugacaugcuuccccucuuaauccuucuaaucccaccaaagacuuguauucucugaugacugagggaauagucaucaaacccauucacaccacaggagccaugugccucugccagaagcaaagaaaggcuccuuuggaggacagaaaacccaguucacagcuucccaaggaacgcuggcuucuauccccaggaauccuucuacaggccaaccugagcucauuucuagacauguggagggccugagaccuaauacauuuaacucuuagaaauaaguuuccagaauaugaaguguaaggguaggggacauuuccaaaugcuagcagcagaauguuaaaaugagagucagggcuuuugucgagucuagguuaggaccagagagauggcucagcaaggaaaagugcuuuugccaaaccugaugaccugaauuggaucuccaggauccauuuggugcaaguagagaacccaagacuuguccagcuguccuccauaucuccuugggacacucuaaaggccacaaauauguuagaggcucuacaaaugcucuggguuuaagagccauucuuacaaaggaccugaguucagucuccugaacccaugucagccuccaacgccagggcaucugaaaugcuccuggacucacaggcacacacuuauacuuaaauaaaaauaagccuucagccaggcggugguggcgcacgccuuuaaucccagcacuugggaggcagaggcaggcagauuucugauuuggaggccagccuggucuacagggugaguuccaagacagccagagcuacacagagaaacccugucuugggguggggggcggggaaucuucaaagccaggaauugguggugcacacauuuaaucccagcacucaggagacagaguuagauggauuucugaguucaaagccagccuggucuacagagugaguuccaggacagccuguuuucucuuuacacagagaaaacccugucucggguggugguggggugaguuaaauagaaucuucaaaauucccaacacccacguggcagcucauaacugucuauaauuaucucaugggauccaaaucaugugcagacauacaugcaaacaaaauacccauauacagacaaaucuuuaaaaaaagaaacaaaaaaccaaagcaaaacuagguuagauuuugaaugaagugagggaaaagacagucaaauagacuugaggagaguagaggggccugaacaugccaugcuccagaggguccugccuugcucuuuucuuuuucuaaggaaagccuugggugccacaaguggcaucugagaacuggaaauguagcuggucuuaaaguauaaaauagcccagacuuuggaggcuauuugagaaacagaauauaaaaaucuaaauuuuuaaauauauuuauuauauuuggaguaauguuuuuggucugccuacuuaagauauuuuauggagaaaaaaagaacugcacagucauuaaguaaaccggauggcuucaguaggguuaugucauaaacugggcucuauucauaucugcaagcacagcuguauguagcuuuugcccgggccaugaauuggacacacugguagauaauuagcauuuuaaaaagcagguucagccucuaucaguuuuugauuagguuuucgauugcuaaggaaggauucuuacaggucugcuggaggaguugcucauuuagccuauguuggcaauggucaauucucaugauggaggcugaugagucaguuaguccacaugaugcuuuuagcagucccaguguuaacuuguuacuguugcuaacggugauucugcauuccggauuguuuucacaccaggcuuucuucgagagucacccagcuccuucagcugagcgcaccauccagcaguguugugaaaauauccuguugaaugcugcuuggcucaagcgagaugcugacagcauucaccaguaccuccuucagcggaaaaccuccccacccucggugugaggccuccuccgcaccugggccucacugccucucugcagggaugagguggagcuaccaaacagcugacucacaugccaagaaucuggagucuuacaccaguggggguuggacaaugaauguaguaggucccugcucacacuccagaauuaaauucuauugaaaaaggaaaaucagcaguucagcaaaaaaauaaaauaaaauaaaauaaaaaauaaaauaaaaauguaaauaugauaguaauaaacuagagcauaacgaaacugugaaacuuccugaagccugucauggucaaaguguugaacacucuccuguuagugacggauauuguuuuauagccuaccagaaggaaagaggcuuugggggaagagggaagaggguuuugugaagugggugucugcagccugacaagccggguauguccaucacuggggaugcugaccaaaaggcugauagcuggcucacauaguggagccugugcagaauuauaaguggguuuucuuuuuccuuuuuggcaugggaaccgaccaggaagguaucuuuuccuguauaacucaaucugaaccaaggauuguaguucccucccugccucccuucugugugauccccaaccccccaaaaaguaaugaaaagcuuuaaaaaacaaaacaaaacaaaaaaaaaacacacccucccucccuucccggguucuucucccuuuaguucugcccagcccugaccuguccuuagauaacagaaacaucuuugauggccacauuaaauaagaggagcugauaugcuuuuauuuccuaugauaaccuucaaggaacccugacaugcauaagaggugaaagaguagaaauaaagauuaucagcuaggccuucugcucaaaacuguccgguuaccugacaggccaaaugcugcaccucuuccgaucaguaucagugagccuggcucaccacuugugcauaugaggggccaguggggacugcuguggggcccagauguccgcugcaccgcugugucgccagugugcucacuaacaagccccgccaccuaacccaguguguuuuuacuaagucucagcccuuucccccaccccuuuuucuucucucuuccuuuuauuuuuuucugaauccuuuuauuuuguguuaacagaaauucauauuugguguggcuuaauguauuuuggaaggucaucagauugugagacugcuuccuugaaacauuuuugugcuauuguuuuaaaaaauaauaauuaaaaaacaguuggcguuaauaaaaaugucaaugugaauuuguuggccugguucuuucagcuuucuugaaaggaaacuaaaguuucucugugccucagaauuacaggaauucggccgggcggugguggggcacgccuuuaaucccagcacuugagaggcagaggcaggcagauuucugaguucgaggacagccaggacuacacagagaaacccugccucaaaaagga

SEQ ID NO: 6334 - RNA, 2770 nt, Mus musculus
cagcccgcgggcgcggccuaacugcucgcccgcccgcccgcugcucgccccccggcgcccgagggucgcaguaccugggcggcggccuccagcuugcccucgaaggugaaguccagcaaaucgggcuugaggcagaggcuguaguugaugggcgacaccucggcgggcagccgcucgaagggccgcuucuccggcaucgcggcgaggcccaggcuguggaggcggcggcggcggcgagaggagcggcugaggaggagaaggaggggaggaggcggagggccgaggaggagcaggcggcgagcgagggaggggacggcggcugccagccacauucaccgggcgcgggcgaccgccugccgagagccgccggggaggcuggggcgggggacagacccagcgggugccugggccgggcgggcgggcgggcggcggugcgggcgggcugccuacggggaagggggcggaggggagggcaggggaggagggcggggagggaggcggcggcggcugcgugcgcgaccccgcggggcgggcgcgaccccgcugagggcgcgcgccgagggcggggcggggcggcgaggccgcggucggcgaacggggaaggcgagaggaggcgcuuggcgcugcaccugucgucggccgguggcaggaaagagccacgaagggcauggaggagcucuguggaaaauggaagccuacgcagcggucaagucagcgcggggggguaggggacgcguggaaagagccauuccaccucagcggugugagcccgaccugaggcuuuuuuuuuucccuaggaaauagccaguugaagggaugaucugaaaacaguuuuccgaggaaacacuuaguuauucaaggucgcuccaaccagugaaaucuagaccuuuuaggagagugguuucaaagacuagaaauacaggaucccacgauuucauauuuaaaacaagaugcuucauugcugggcacggaggcugaggcaggacgaucaucaugggccagccuggacuacagagugaguuccagaauggucugggcacacaguaagauuuugauuaagaaaacacagaugauaauaaugaucaacugucuguuuccggauuuuucccuuccuguggugcuaggcuuugaacucaaagccucuacacaggcugggcaagcgccaugccacugagccacacccccacgccccuuguuuuuguuucugcuuuuuuaacugaaaagacccuuuaccaguugugacuucuguaaaaguauccuaacuguggcucccuccauucuguaguuaucucuaagaccuauguuuaaaucaaggcaaaaauauuccuaaaagcguauuucuuuuauagaaacuuguaagguagagucaaaacuaaacaagcacuguccuacagacaugacacugugagccacuagauagaauuaaaacaacagaaguuauugcaccucaucucccuagcccaauauauucagauuauaauuucaucauguaaugcauuuuaaagaugcuaaugaggugccuggcaguggugguacuggcuucuggaggcagaggcaggcagaucucucugaguuugaggccagccuucacuacagagugaguucuaggacagccagggcaacacauggcuaaugccuacuguauugggcagcacaguuguggauccucaaccugcccugcuuuccuccaaaaauccuacgugcuuuuuagaaacacagaugcaauucuuaaagagacgggccuuuaauaugucuggaauacuugcuaacacuuuacacguucauuuuaucucucagacgcucugugagguggacccccaaccuguuuuauauaugcaaaaacaggcacauagaaagaucaugacuugcucuagaccuguguacagcuaauaauugguggagcuggaauugagacccaguuguuucugguuuucuccuugagaacauuauaaacagcuuccuucauaauucugccaguuugguuuauucuaauccaacuguguaugaucuccucaaaauguuugcauuuaaaaaaaaaaaaaaaaacaaaaggcuuccuccugucaaagcaaaauugauuuauaaccaucuaaggcugccuaugagcuguuuacccuuuaacaucaauucuacagucuaacucgauuacugucuagcccucacagauugcuaauuugcucaggaaugaguguuucaguggccugcucauccguuuuugugaaaugugcgccccucccuucccucaccuugccaggaagaguuccauugcagaacuccacccugcucuagcccuuuccgauuagcuccggaacucugccgauucauguggacuuggucuuauguuuugcaauugaauauuagguuuguagaucuuuguaggaugagcuagcaagagcuggcuugcuuuuuuuuuuauuuuguuuuuaauguuuuuuuuuuuuuuuccucuuggacaggguuucacucuauagccuaugcuggccucaaaaucacuauauagagcagccuggcacggagccuuucagcaguuuuccugccucagccuuacaggcagcagcagcagccccaccaccaguugguuuguuucccuauuuuauuuuccauuucuccuccucuacuuuucuaucuuucuuucuuuuucaaaaacagggucucacuauauagcccuggcuagcaugaaauuaacuaugaaaacugguuggcacuuaacucucaaagaucugcccaucugugcuucccaagugcuagaauuaaaguccuaaaccaccgu

SEQ ID NO: 6335 - RNA, 9555 nt, Mus musculus
ugaaaucuuaaaaaaaaaaauuuaaccaagggaagauucugggcccaaggcacuuacagucugacggaggagacacagcagucugaugggggugauacaggucaaacuccgagaaacccaguauuuagcauguaggauaguccagucugaugggagaagcaaagcccauguucuuagcugagggagccuuccagcuucugccugugggagaucugucaggccuauucucagggcauccccacugagagagccccacucauggaggacaugagcccugucaucaagcugccacuucuugagaggccugggggggcuaacgaucugggagacugacgccucccucugcuugcagaccccuguugaugacaaggagccacagucggugcccaacaucgaguaccuccugcccaacauuggcaggacagugccccccagugauccaggcucaggugaguuaagggaccuguuugggggggggagacucugccuuucugagggucccagaugccuggccagauguuuaucuucccugucuccucccugaaaggcccuggccuggcaacaccccaagaugggccgucgagggucuucuucucugcgaaaaucuagcuguuaacucagcuuccccagggcugggcagggcugggcagggcugggcagggcugggcagggauguguguuuggccuucuucacugguuucucucuugagcccuugauuuuuacagcuagcggcguacauuccucuuuuuaauuucucuuccuucucuccuuuacccugucccuccucucucuuucccccuugaucuccucccuccuccuccauccucccuucccucugcuucuccugcccuccuccuccagcggaccuguuggagauuuaaaggguauagugcgguguugcgcgcggccucggucacuaacaguagccggugauuauaagaagccugggcaggcaugaguggaagacacgcccccagcagugaggaaccccagccugacauagcaguuggcagcucugguccacagcugacccuuggcuccacccugccuccucuuggaggaagucagaccccuugcccugccaccagauggcccugagcucccugcccaaccugugcagugggagcacuucagggugaccaagaugagggaacuugaguuuggacccagccucuguaggacccaccccagaagccauugucaaacgacaaccccugccucggcucaggcucuggacacucauccuggaaauccugugcuagaggaagguagcuucugugcucagaggcagugaguggccccagccacagcucaucucacauucuggcuucacugccugcuagcauguccaguucuugucccagagaaagaccucacagcauccuuaguucugagauacuggcugggguaaaguagcagagaggagcccccugucucuuguaaucaccugcugccgccuguccugugugugucgcguguggucagucauucuugcucugcucaccauuugcagggggagggggcuggggagggcucuaaccugccaugccugaaaguguggauuaacugcaccagcuccguaccagguuugaaccaaccugcucccucuccagccucggagagggcacugccaggccuuguuauccauuuccuucuccauucuggagauauuaaggaguggcacucuaggcccuugggugugacgguuuugacuggguuuaaaagggggacuugccccuuaagggcagguugaugucggcucuaccaccagcccacuguaccugugucucgcccaccucaucucugcuucguuaccugauaacuuaguggggcccuuuuccuucucguggggugggaguggggcacacaccuccuccugcacugugucgucuccaucucuucagaguaucugugaugugcugugucgccccauugugguuucuguggacugcauccgaaacuggcauuuucucuccagugcuucagugucaugggggcagggggguugggagaggaggagccagauguagagaaaaagcccccuuuguccuuaacccugggcaagugaagacucaguggcccgcagccugaugucacuuccugccucuaaaagaagugguggcuaacaacaucuucugauggggacaacccauaggaaaugccagccgagccaguggcccuccuagggucuggggagaacaaaggccuucacccuugaaccuuugaucuuucuuggucuaacuucaguuuucuuucuuuugccagcagauuccaccaccuguagcucagccaaguccaagguuaguaccauggcuucccaaaugugguuugccuggacaaggcagcccacuguaguuuguggucaagaggacggaaguuggacugggggcuuuuggguugagggugggauggaaguugggaaauacugagugucuaggggcagggauggggagcggagagaagcugacccugguggugcguggaaggcaucugauguagaagaggcugguggucucggguugcgguagcugaggagcagcgugacuugagaacagcucucguggcagaaguccugacuuuacuacuuauuuuaugauguugggugacucuuucugaauugaagcuuccuuaucuguaaaaugaaaacaacagcaauaugucugcugugguaaauguuuuaaggucccuaggcaagcugagaaugguggcacgagccuguaauuccaacacuugggagguagagacaaccugggcugcauacuggguuccagguuagccaggacgucauagcaagagccugucucuaaacaaagaaacaaaacaaaacaaaaaaaacaacaaaaagcugucugggaggacuuaacgaagaaaggaaaggaaaaaggaaaaggaaaaggaaaaggaaaaggaaaggaaaacaauauggaugauugagaaauccaugaaacugaaaacaauuaagaaaaaucaaugaaacuacaagcuguuucuucggggaaaaaaucaauaaaauggauagacuucuaacuagacugacagaauaaaaagauaugguacaaauuacuaauacuaaggaugacauaguacaucuauagaccacacagacgauaacacaggggcaucaguacagaccacacggaugcuaacauggggggcaucaguacagaccacacagauacucagagaauaauaccauaagcauuuuuaugccuaaaaucccaguaacauuuuuuuaaagauuuauuuauuuuauuuauaugaguacacuguaguugucuucagacacaccagaagaggguaucagaucccauuacaggugguugugagccaccaugugguugcugggaauugaauucaugaccucuggaagagcaaucagugcucuuaaaugcugagccaucucuccagcccaaaccccaguaacuuaaaagacaaaccuagucuuaggauucagacuaccauaauuugcauaaguaauagcuuaaguagcucugcaucuacagaagaaguuuuguguauaaaaacuuccaacagagaagauaccagggccagaugacuucacugguaaauucuaccaaauauuucauggggaaaauguuugggguuuucuguuuguuuauuuuuucaauuauacucauuguguguauguuuucuacaauguggaucauagggauugaauucagguccucaggcuugguggcaaauuccuuuaccuaccaaguaauuccuuauuucuuuguauguguguuuguuugcuugcuugcuucugagacagggucucuauggaguccaaauuuguggucuuccuaccuuuuucuuggguucugggauuauagguguaugccaccacaccuggcuuauuguucuaauuuuaaauaauuuuauaguaucuuaguuguaaaaugguugucuuagucuguucuauuucuaugaggacacaucaugaccaaggcaacuauuauaagagaaagcauuuauuuggggacuggcuuacaguuucagagguuuaggccauuaucauccugacaggaagcuugguggcaugcaggcagaccccagagaaguagcugagaauuacauccugauucagaggcaaagagagagacucugggcuuggcggggcuuugaaaccaaccccucagugacacacuuccuucaacaaggucacaccucuucaucuuuccaauccuuucaaacaguggcauuccaugaugacucagcauucaaaucuaccagaguggaugaaggccauagucaaaccacuacaauagaauauuuaaaaauagucucccauuccacaauagugggccacuuauaugaaaguggccaauacagccuuauugugugauagguuaauacucugaaguuuauguagguucacaaagugauuauaucauacuugaagaggaccagaguccaguucuguuuuguuuuguuuuguuuuuuugagacaggguuucucuguauagcccuggcuguccuggaacucacuuuguagaccaggcuggccucgaacucagaaauccgccugccucugccucccaagugcugggauuaaaggcuugcgccaccacgcccagcccagagucuaguucuuagcacuugcaauugauggcucagaaccaccaguaacuccaguuccaggggaucuggcacccuuuucuggccaccuuucuguaugcauguacaaaugcaugugagcgcgugcacacacacacacacacacacacacacacacacacacacacauacaaacaaacaugcacacauaugaacuaaaaaacaaucuuuuaaaaaaaaguuauuuugcuugcauagaaauacuaccacaggaguugagagagagaaagagagagagagagagagagagagaggucuaagacauucaaaguauuuugcagaggaccugcauuuggcucccagcacccacauggcggcucauagcugccuguagcucuaguuccagaagcuuugaugcccucauuggccacucuacucauguugaacaugugugcaugcacucacauauacacacaaaauaaaaauaaaucuuaaaacaaacuacuaccaauuuuccaaaaucuuuaaugggguggaagagacaguaauugcuccacaucucaucgugugacaccgccacuccccaauaucuaaaggcuuccagugucuccagacacgcuguguccauugagucaugccacacagaucuggucugaaccucugcuacauggcuucauguacugaacccgaggaugcaagcaggaucugaggagcuggagagacgcucagugguuaagagcacugacugcagccgggcgugguggugcacaccuuuaaucucagcacccgggaggcagaggcaggcggauuucugaacagccagggcuauacagagaaacccugucucggggagauaaaaaaaaaaaaagaguacugacugcuauuccaggggaccugaguucaguugacagcaaccaccugguggcucacaaucaccaguaaauuugggucccagaaucuaacacucuuccagucucuacaggccacaaacacacacacagagagagagagagagagagagagagagagagagagagagagagagagagagagagagagagaagaaaggaaggaaggaaggaaggaaggaaggaaggaaggaaggaaggaaggaaggaagaaaacuaaaaccaagcugagcaaguagacuccuauccacaaaggguuuaucuuggaauggauuccaguacuaaugagcaaacaacacugcuggagagaauugagacccagaggaggcagaagcuggguggaguucacaaaccagaugucggcaugcacagaugugagacacuuagcugagagguguucagagcaaaacugcaaagccccgugggucgaggaaggcuggugcgugaagaugugaggaugagccccaaggcuagaagaugccuccagggggauaacaagaaggaggaagcaggugggcaaccucugggcccugcugguggguaggaguccccucugagguggauugcaggaggccucagaaggcugcucugcacugcugggucugugcucagcagugcuguccucuguaagagccucaguucucaaccugugagucgcaaccccuuggggugggccaaacacaggggcugauaucagauauuuauguuaugauucauaaacagcaaaauuacaguuaugaaguagcagugaaaauaacuuuaugguugggggggucacaguugagugacuguguuaaaagguuuuagagggucccagcauuuccuagacagaaauccuccucacuauccccuauggccacaucugucugcaguagacaugacaccucccuaaggcugugagaguccagccuccccagauucugggccuccuuaaucccuguguuggcuccucuggaggauucugcuuagccacagagcauugaaucuacacagcgugcuuuucagaaagugucguacacuuggcuugcacaucuccaagacucuagugagcuacccagucacaagugugccaguucacauuugcagccacccacccacaccgucuucacgccaucuuuacuagaccucuccauucugucccauccucaauacauaguuagggaaggcaaugcucagaguugagguaacuagaaguuugggcauguucucggucacaaggagugggcaucugcaggucugcucuucacucggugaaugcuguggagauccuguucugauccucugcugucaggguggagcauuuggggaugggauagccucagcauggauaugaaacagcuaguuaaguacuugagagcccaaggcacaaggcacaaaccagacagccugguuaauaggaauaacuguuacagagacagagacuuugaacuguguauagcagguggugucuguacuaugacccacagcaucugagucugcagcagcccauuucagcuaccaaggccugggccccagccagcccugcauuccaaggguuggugacggcaccugcacagcgcugagacuugcugauacacuuaaucaaucugaggacagcuauauagccuuguuccagaaggaucuauacacaagcucucaagcccaaaucccccagaccuccagcucagcguucuguggagacuguggcugacgauugcccuguuuguaacaguagcaauucaguucucagugauuccuccuauugccaccgaggucaguguuugggguaccaacuacaucaacagccaucacugacuauggugcucuuucuaagcauguguagcuaaggaauccaauuggggcugggcugggcugggcuggagagaugacucugguuaagagcacuggcuacucuugcagaggagccugacucaauucccagcacuuacauggccguuuacaacuguaacuucagucuggggauccaaagcccucuucugguuucuauggacacugcaugcaaagacacgcaugcagauaaacacccacacacaauaaauaaaaguaaaucucagaaagcuggaaggacuucuguagcuuuacccgggucucgcagcuaccacuuguguguuccagcaucugcucuaaguggcccagcuggaaagaguagagcugauggccaccgugcaggucuuagcugaaacaaaauagcuugcccgggaggcuuagacagugacuacuugcugggugguggcaguggcacgugccuuuagcccuagcacuccaaaucuuggaauucgaggccagcuuggucuacauaguuaagucccaggacugccagggcuacacagagagaccuuaucuugaaaaaaacaaaaccaaucaaccaccagcagcagcaacaagaaaaaaagaccaaugaauacugacuuccuacagcauuaggagcuagaaguccaaguucacagugcuagcaaguuagcuucuggugaaggcuucauuccugguuuuucuuugaccuuuuaauuuuuuugauagcuaucucuucacugugcgguagagaaggagagaggggaggagagaugauuaauccccugugcucaucaucaaagccucguuuucucccaaagcucugccucuaaauaccaccacagcugcgggguggaaguguaaucucuggcuuuggugggggacacaguucaguugguagcacugaguaaaaccagcugaguacuaugaguugaacagccucaucuuuugcuucaauggcucaacacuggccugguuccccguaagcccaccccaggcagguagccugaugucuggcaguuuucagauguguucucugaacaaaagcagggucgcaggagccuggggcaaggguccccgauaaccucaccccagagcacaguucagugaccgggaguuuuguccuaaagucacuaaugucucagagaccugcaaauaacuccuugccgcugcuuaaacccuuugcuucuaguccuccguuccugugcccaccuccacccccauugcacucccugguagaggccaugaaccucuuugcacuagagggaggaagguaguuugaucaagcacacaggauccaggagacaguagggcugccagucauauugaagugaaaaaggccucaaaaggaggcuuaguggggcagucaccagaguccacacuggguucaaguaggggucugggcucugggccugagguuggugcuacuugcgucugauaguggugggaucauccagucuugaaaaaagcuggcaggaaagcagagccccacuuuugaaggcugguucuacagugggaagggcugcuggggcaaggggaaggcggaaccuguucuuagggggcaaugugcauggaggaaguuuggggcaggguaggugggaugguguccucuccguggguagaucuggguacaaacagaccaagcagacagaggauagagauggaaucacaguuggaaaggagucgggagcucacaucuaggucuagggacuaggugggaaggaggaagugaccuggguaguucccaggagagaaaggcuugucgggugcgugaguggaugcuugaaccauuagcguuuacaaucaggcauccugaaccagacauuuauuguuuuggacuguuaccaguuagucuaaggaauuuaucuggaaguggcuggagaagacccuacccagcucccaaaucagacaggagcaugcggugguggcgcuccaguagaaaccgugugcgugggaaacaugcuggugugggcacuggcuuguuugggaacuggugauuggaugccaugguacgaggcgaggaauagggauguguaaggcccuccuuacccucgcugucuccuugcacaggguuccuggguccccaagaaagagccuuacgcccgggagaugcuggcgaucuccuucaucucugcggucaaccgcaaacggaagaagcggcgggaggcgcggggccugggcagcagcaccgacgaugacuccgagcaggaggcgcacaaggcugcgguggggacgcaggagccacccgaggggcagcugccgggccccgcagccgaggaggccccuggucgccucagc

SEQ ID NO: 6336 - RNA, 24430 nt, Mus musculus
uuggcagcuggcuuugagauuucaaaacccagagccuuucccacccaguuagcugucuugucuccuugauggcugcugucucaacauaaguucucagcuccugcucuagagccaugcuugccuguuuccaugcuucuccagacgauggucaugaacucugcugcccuccggaaucaugagccccagacuaaaugcuuucuuacguaaguuaccguagucauggcguuuggucucgaugcgacagaauaguaguuagcuaagacacuuccuggcgaucccaaacuaggguccucuggcuugguggcaagagucuucacuugcugaccccucucuuggggcgucguuuguuuuuauuuuuguguauaugcuuauuugcacauggguugugugcauaucugugcagguauguuaaugcacaugugcggaggucagaggauaaccuuggacgauaugauuauacacuuuucugcuuuuuuguuuguuugaaacagucucacaagccuggaguguccccaagugggcuaagcuagcuggaagcuacauggggcggagacuggacgugcacgccaucuugcucguguucugccggggguuggggaaacuaacgggcuucagacuuguaaggcaagcacuucauugacugugucauuccgcuggcauuuggguguuguuuucucuuguuuuaaacggggucucacuguguuagagugauauuuuuguacauugugugaagaugugucucuguccuuccuugccugccuaaggcaccuucugauuggucaaaauaaaaagccuauggccuauaggagaagguagaauagagagggugggucauccagcgcagagagaggaacucugggaaagucaaguaccggaagacccgccaccaagaaggaagucaggcuuaugaugcaaggagaggaaaccaaccauguggccgaacuuaguauaaaugaguuaauuuaagagcuaguuggggagcaagccuaaacuaaggccauaaucaucguaaaugaaaauaagccuccagccgggcagugguggcacacgccuuuaaucccagcacuugggaggcagaggcaggcagauuucugaauucgagaccagccuggucuacagggugaguuccaggacagccagggcugcacagagaaacccugucucaaaaaacaaacaaccaaacaaaaaaagaagaagaagaaaauaagccuccaugucauuguucggcaacuggggcguacauggaaaagccuucggguuacaacuacguaucccuggcuagucuacaacucaguguguaaacuaugcugaucuguagagaccgaccugccucugccucucguaaacuaugcugaucuguagagacccaccugccucugccucucaaguucagggguuaaagauguccaccacucccuucauuuugcuuguuuuugaaauugguucucaaauuacagccuagacuggcccggaauucacaauguagauuagacuggucuuaaacccaugguaauccuccugccucaucuucccaauuaguacaauuauuggcuggagccaccucaaccagcuuaacuauaaauguauaugaagguuggacuugguagcaugugucuguaaucuuagcacuccggagacugaggcacaaggaucaagaguuugacacuuugccagcaccugggaggcagaggcaggcagaucucugugaaucugagaccagcccagucuauagagugaguuccuggacagccauggcuauguauagagaucaugucucaaaaacagaacaaaacaaacaaaacaauaacaaaaagagguugaugccaggauuggagagauagcucagagauaaagagcacuagcugcuuuuccagagguccugaguucaauucccagcaaccacaugguggcucacaaccaucugaaaugggauccaaugcccucuucuggugugucugaagacagugacaguguacucauauacauaaaauaaauaaaucuaaaaaagagaaaaagauugaugccagccugugcuacuuaaaaaaaacaaacaaaaccagaguugacaagaugguucugcagguaaaggcaguccccaccaagccuggugaccugaguucaguccccaggacccagugaugaaagaagagaaauagcuccagaaaguucucugaucaccaaacccacuucagagcauuugucuaucuacagagauacacacacacagauacacacacacagauauacauacaugcacgcauauauauauauauauacacauacauacagauauacacagauauacacacaugcaaacacacagauauauacauacauauauauacacacagauaugcacacacaugcauacacagauacacauauaugcauacauauacacauauagauacauaagcacacaaaaaggaaagaaauuuaacaaaaaugaaagguagacccaaaaccauacauaaaauaaaauaaaauuuaagacuucuuuaagacaguguguguguguguguguguguguguguguucgguuuguguggaccuguugaggucagaaaaggucauuagguccccuggaauugggcuaaaaacaguugugcgccaucauguggguacagggagcugaacccagguccucugcaagagcaacaugugcucuagaccacugagcagucucuccguccccaaagaaacaaauuuauauggaaauacaaagugagcaaauuaguuaguuuuuuaaaaauuuuguacaaguauguguauaaagcaauagugagagguacauucagggugcagcuagacccucggugcugaauagagcucucaaacaaagccauccacacggcaucaccuggcucacacaaaggcacagcugcaguccagacagggauggaagagccuucaauaaauguugaauaauuggauauucacaaagaaaauucaaucccggcuuuuacuucaaauacauccccaaaucaauuugaaauggacaauaagcuuaaguaugaaagauugaaaaaaauagaacuucgaaaaagaaucucauggaaacuaauuuccauagucuugugguagccacaaccucauuguugaagccagacugcuauaguaacuuguggucauccaugccuacaugaaguuaaagucuagcguccauaccucacaguugagcugaguguggugauccaggcuuaugcaagaggaucaccaguuugaggcuagccugggcuacguuacaagaccccaccccaccccaaucucaaaaagaaccaaaauccaaaaaccagcuaggcuggguagugcaugccuauaaccccagcuccugaaagguagagagacgggguugggacauaggaaucuaaggccagccuggacuaaauagcaaauuugaggccaacuuuagcuuuaugaaaccuugucucaaaacaccacugccacaauauauuuugccugucuuugucguugggucaagcagggagguacauaagcccccaccucuuguuacucauuuuggacagaggcagugcagccuauuauucauuuuagacauuaaaagccuuccuuucugagacauuuccuagcucuugcuguauacucucucucucuucucucucucuucucucucuucucucucuccucucucucuucucucucucuucucucucuccucuccucucucucucucucucucucucucucucucucucucucccuguuuaacacuggaaauccaucugucuguugauuauucauuuguucacguguuuguuuugagauucggucucagguaguccaggcuguccuucaacucacucaauagcugaggcuagccuuguacuucugauccuacugccuccaccgucuaaaugcugccauuguaagagaaugccagcaggccgggcucccccugagcccugucuuccuggagguucccugcagagcagggcuuugucugccugcccccagcacugggugcucugugaauacuuaaaagauuccagcccgucuuuuccugcuucucucugggugauucuuauuuuuaucuccuccacaacuuccuacuuaauuuuaacuuuccguucccuccuggcugguuuauauuccaggaggcucuaugcuauucaguuccuuaugacuccuucuaacagcguucgauucucugggucuuguccuagcuugguuuucuuucauuguucuaaaggauagcuucuguuuacguaaccuuucuccuuaucccuguguguaugucaugcguaguuagggucucgagugcaccaggaaacacgccauguagccaaagagaacccugcgcuuuuucccuuuguuguccuuuugguuuguuugguuuuuauuuuuugcuuuuuguuggugguguugguuucuugucuuguuuguuaugugagauagggucucccuacagaguagcccugguuacccuggaacucacuauguagaccaggcuggccucaaacucacagagagacugcuuccccgccccacccccaugcugggaucaccgcccagcuucuuuugauauauuuuggcuuguuguuuuguuucuuccuuccccaguuuuguguuucccuuucacuccaacaguaaggcugucccugggcugucacugagcaguacuguuugacccucaccuggaggaagggacacccggcaucuccuggugcagucaggucuagcgaacguggagcuggggucacgguuucuccaaacagcucuagcccauacugaguacaacacgggacuuggaauggauacccaugcccaguggggacuccuacagugggcaguuucugugcuaagacucuugggggaucacuguagccugggauucuuccggaaggccguguuccuuuccucuucuuuggcaggcgucugaggaccagccagcuccuccucuuuauagucccucaagcguuuccucuuaacaggugcaagauauuucuagcccuucuaacucuguggcagcucuacccccacccaccagguguguuaguuagcuuuccguugcuauaacaaauacuugugauaaaucaacuuaguaagagggaagguucagucuauggucccgucuucgguuacacaggagaacguggcagagggggcuguccaccucauagugucuggaaagcagagaaaagggaggcagaguaagagccucaguuaucacccuaucucuacccccacuccccgccuccucccccucccacccacccugcgcauuccccaccucccuaccccccccucccugacugcuuuccccaucaaggccagacccccagugagcuaacuucccuucacuagacugcaccuucuaaacgguccaccaccucccaauaaacaguaauagagacggaggucagauccuucauccuuggacugaagauagagcgcucauccuuggggacauaucuuaaccugaggacaggcacuaagaaaggaguuuaccuuauuuauugggucguccuuggucggcugcuuggacuuaacuugcaaagcguuagaaagcagacuggaagugcagugcguucgguagaggacgacacagguguuacgucagugguuugggcucuuccgggacugggcaucgggccagcggugguuucacugaggaccuucuggguguuaagauuugaaaauggcucuuggaagccuuucaguuccaccagcugagaaaacuuuuuuuaaaguuuuuuuuuuuaaagguucuucauuuuucuuccucuuucuuccuuccuuccuuccuuccuuccuuccuuccuuucuuucuuucuuucuuucuuucuuucuuucuuucuuuucuuaucuuuuuuuuucuuuuuuucuuuuuuuauuucaagacaggguuucuuuguguagucuuggcuguccuggaccucuauagacuaggccagcucucuagaccuggcuggccuugaauucggagaucugccuggcagaauaguucucuccucccuguguacugagauugaacucaggaccugaccgugcuaggcgagcgcucugcuacugaacuagggcucccuucgcucuucagcuuucuuguccaggcagcaguggauagagagagucaaccucuucccggugugugcagcaccucuguccccacugguuaucuccacaucucuucccuccuuccuucaguguuuugauuucagacagggucuauucuagcccaggcuggccuggaacuugauguauaggcaaaguacgacagcuuuguaauccuaauccugcuacuuucaccucccaccccccaugcuggguucccaccaccacaccugguuuaugugaucuuggaacccaaacccagggcuuugugcaugcuaagcagguucucuaccaacugaacuccauccccaaaccugccucuccguuucuugcuuuuguugcuauuuaaccuaaggaugcagcucagaagccuuguccuucacaugcaaggcacucuguucucuucuaggaccaaagugggcaaggaaucuagaagcacguaagggaaacaucaggguggaauacaaugucuucaaaguccgacccuggccagccaaaaguucuagguccaaaaguucccauaguuccucccccccacucccgccccccaacacacacacagcgccagcagcuggagaccaagcucacauagcagcuuguacgagacauuuuacauucaaaccaugauaucucccuuggauauggcuggacgcaagagcacuuuguaaagaauggaacagagauggcuuagauggcucagcaguuaagagcacugacugcucuuccagaggaccugaguucaauucccagcaaccacaugguggcucaaaaacaucuguaaugggauccaaugcccucuucuggugugucugaaacagugacaguguacucacauacauaaaaaagaucuuaaaaagaaaacuuauuucauuuuuauuuucugggcaguguuuuugccugcauguaugucugugcauggguguugcagacaguugugaaugggcugggauucgaaccucuggaagagcagcuaguguucuuaacugcugagccauccucuccagccuccuuccuguuucugaaaacaaggagugcuaugaccaggacauauccucuggauguccuggaacuuacuaccucgcugaggaugccuuugaccucccgguccuccuaucuccaccuccccaguuaucacaagcugguugcuacuaugccccguggaaaugucugcuauguaaaccacugaguugacagggaauguguugcacagcggggcauaaugcaggagaugagggagacucacguuggaguuugggacuugaacacugaauaagugucagcagcauuuaccaaaugagggaaucucugcagaaagaagcauuagaaaguccaauauuaaucaggcaaugcuggcccacaccuuugaucccagcacuagggaggagaggcgggcggaucuccuagugcaacgccagccuggucuacagagcaaguuucagaacagccagggcuccacagagaaacccugucuugaaacacccccaaccccccaaagaaaagaaagcacuauauuaccuggauaugguagugcaugccuggaacccuggcauucaagaggcagagacaggaagauugucagaucguguggucagcuucagcuaccuaguaaguucaagaccaccuugagccacauggaaagaagacuccaaagaaauaaacauaacacccaggcuuauugccuuuagggguguagccaguagugaagccuauaacaugcucuggccucagaauuucccaaucccagcacucuuuuggaaaaaaccuuuggcagcuagauggagcuugcaacagaugcuagguguggucuccauucuggagagaggauggggaaucucugacaugcucuaagugucgaaaaccaugaaugcccagagagaaaagaugagaggcccugaggguggaaaggcuuggucacugagagcccgaggugucccgagauggaaggaguguaagggguguaacccagcaggaaguucagagaaggauaacaguuccugaggcuuauaugccacgcacuuuaacacagccugaacugaaaauagugggauagcccuguaaucccagcauaugggaggucaaggcagaggaacagagaguucaagggcagccuagacuacauagcaagacuaucuaggaaaacagaaggauagagucuucuggucaagccccauagcaacucugcauggccaaaaaucguaaccuccuuuucacagaugaagaaacucacaauaccacacagucuuuguggaguggcaacaccaaaagucaggcuuugaccauaaaggauggguaggucacaggccccuuagucuuuugaguucagcuguacaaaaauuugccaacugagaguucaccaaacaggugguucucagaugggcagaaauagagguggaaucaggggauggucccuaaggaagaaagagagaaucaagacagaggccaggagauccaugccuuuugccuuuaaaggagcagcaugcaaaucauagucaaagagauaugcaaaugagauucaaauugaguugggaaugagcaucuguuauuucugagucaacagcucaggcacuuuuggaugagcccuccucagcuuucucccaggguugccagggucaggaaccccaaagggaaggccugguaacuggacagaagugggccucuaggacagcaggguucuaaauaggaagggaagccccacccacugcauggaggugagucaucuauuugcaucuauuugcauauucauauucaucugacaaaugcuuguaaagcaccuacugggugagagggcugaggcagaugcagaagacaaggaggggcucacugcuucuaaggucuagaugcacucuucuggguuacgggaugaacagcaaagacgccggcuuuuucuagaaucuaagccagacuuucccaaccucugagcucuggacuggacacuuuccaucuuccuuuagcaacauccugggcuugacccacuagauaaaugacccuaguaacccuugaccugugauagauaaacauguccccagacauggccuaauauggaagaggccaagaagcauucagguugagaaacuuccauucuagccaaacauggagguauguaccuauaagcccuggggagguggaggcuggagggucaagaaaucaagccgggcgugguggcgcacgccuuuaaucccagcacucgggaggcagaggcaggcggauuucugaguucgaggccagccuggucuacaaagugagcuccaggacagccagagcuauaaagagaaacccugucucggagaaaaaaaaaaaaaaaaaagaaaucaaguacaucuguaacuacauagagaguaugaagccggcuggacacaagaaacccugcacuaaaacagaaacaaaacaccgcucagaugucuaaggccaugagcccuucaucugagcaggcgcacuccuggggcugaguaaggguuuuguucuaaggacuuaguguucuauacuguuauuuauuuauucuuuuuuuuuccccauuuuuuucgagacaggguuucucuguguagcccaggcuguccuggaacuuacucuguagaccaggcuggccucacagagauuugacugccuccaacucuggagugcugggauuaaagaggugcaggguccccacugcccggcugcaaggcuguucuugagugcuuuccucuggccuucugucugucuuccaguugacaucagugggucugugggcuccaugccuaccuccauugguaggucccaagaguuuggaagggcaacuuugccaaccaguguuuucccagugcugcccuggaauccugagggaccccuggaagccuccgaggguguugggaggggccggcaggaguagagucagcccagcaacucagaccuucuugguuuuguuucugaguuucuguaucacguccuuuggauaaaaagucgcaaguggacaaaagucccaaaggacagcugcuaaucacucagccggacguggggucacgagcaagcaucccuuucccgacaugucugcucuggagcgcauggugcgguggcucugggguggcuguuuggaggcuuucucagcuuccuacccagcuccugccauggauaggaacagauuguggagcagagaaagaacacuguaccuaaaaaccaagcagucuacguauguguucagagcagacgggacagaagugaggguccuugaucaacuacaucccaaagcugucacacccaguuggcaauacaaagaacuggggcuagacaaccagaaagaacuuuccaacuuagcaccugggggaauugcucucugagauaggagggugucccucccaucagagcugaggcuccgaauccugcagagauaaaucucugaaacucaguaagagauagagccagacuuggggguuuuacccaaccccacuguccgagaauucucuucugucugauucaugucaggaagaguguugggauguguggggaucuuguuccccaagggcugggggauggaacgggcuuccccaaguaccacacccucgggacccaggcacaaucaggcauuucacaucucagaagggucagaaugaaaggccagugucugucuguuugccccccacccccuuccaucuccagauuuuuccaucugccccugggccacagccugcucuuucucacuucuccccccaccccagaccccgugucauacacagaauaguagaaacagagggauugucuuuaguucucuguguggcuggugcucucugccccaacacuccagugaggaagcccccuccugucacgcacuggaucccagaggguucaggggcucugaugggccacagcagccaccagacccucugauccagcucucucuacuccuuacaauguucucugcauuguggcccuaggugaggggugacuuccucauggacacaaaaggcuuccucccauuggagacuuugcuaaagguuaauuguccaaaaccugguugaauggcuggaccaaagaagccacuucugucauugccuauauguccccaaaaagggauguucucugugcugccugcaggagcccguauccaauaggcucucuccaaugccacuuuugccuugggaccccaaugcugaugauucuaacauccggaagcugacaucacuauucuccagacccuccaccuguuugucccaccaccaccaggaacugugagcaaccauuccgggaccugacauucuguaaacuucacaccaccuuccagcauacccagccaggaguacuuccuggauaaaauauuaaacgcgcaaaucugagaagugccuuaaccagcgacagacugcacgaccacagccuggcgaaggagacgcacgccguccgggggugggaagguauauauagacacagacuuugcaucuaucuucccaacuuguuugaggcagagcagugucuauggaaaaauacugccgcaaccuccagcugggguggccuaaggucggagccggggcuggcaggaggggugucaggaggagccccaaagcugagcucaggguggggugacaaaagcccuuugugcugguuuucuguacaaugccauuggccaacucugcaagggaaccagaggacgguuagaggcaaggucucaagauagagcaagacagaagagcggggaucuagggcugcugagagcacaccucaugcccccugugccacagagccucuaacguggcaccgugauacauggggugucaugcaguucauagagaugggucacuaguguuccugcuugggucuggaccugcaaagaaccuuguugauguaccccugcucugacccagagggaugaggguggggcuaaaucuacauuucccgaaaccugauuggugcauguaagguccaaccuacccuggccugggcauuugcuaggcuccagagucccaugaggauccacaugaauuuaaguuuuuuugcuuccagguuauuuuuuguuuuggguuuuuguuguuguuuguuuguuguuuguuuugagacaagggucucacuauguagcucuggcuggcuuagaacucacucuguacaccugacuggcuuccaacccacagagaugcaccugccucugccuccugacugcugagauuggagauaugugacaccacuuugggcacaaaaccaagagucuuagaacacagcugagcucaaccuacgugugaccuguauguggcaucugucgaggacuauaguacccauguuuucucacagugaccuggaaaacccaagccagaacaucagggggccagcaccaaaaaaagagaucaaagacucuguagugacaguccccaaauccugggaaugacaaauaagaguguucaugucauuucagacuaucacagagcccaucuagauuuagaaggcagacucacuuugucucagaauuaguuagccacaggagccuggacugauaacauucuacaaaggacacccauuuggcuuaggguggcucagagcucaccauagcuaggacuaauaauauacccauagcugagccccuaacccagggagggccccagugcagguaugccugggaagggcucuucucagaccggcaggauguggaagacuggaaggugaggcuggagagaagucgaucaggcucuggggagcuugccagcuccgggcugcugcaagcugccugcugcugugggcugggugcuacuuggcugcgcccaguuggaaggugcuaagaggaggugcugcggcuacugugccagcucagccugaggaggaagugggaggcagaggcagggugggcacggggcccuggcacaggaagagcagacuccccuaagaggccuggcaccaggacaauccacugccgaggcaggaauucaaacagggaggagccgagaugcaguacccugaccuucacacacccagucuccauuauggccagggcagggcaccggaggcaaauggguuaaggauuuacagaucucaagugagggaugccuagcaccucaccgaaagacagcaggcaucucucuggcuggugaacuccagucuccgagguagagccuuucccaugcuacagauccugggacaggugcucugacugugugugcguccccugcccugaucccaggggauggagcaagagcuggagagcuggugaugcagucuuagcuaagucuagucugucauccaucagucucuccagccucauccucacucaagaggcaggcaucccuaggagcuggugaaagucagggcagcuggggugaggggccuuguuggagggcauugagcaggggggggacgccaaccuuuuuuuccaagaaaggaaagaucuuuuuaaaagaugcauuuuuauuuuacuuuagugugcacacguaugcgcgcgcgcgcaugugugugugugugguauguauaugcccuuagaaaccagaagagggcauugcguccucugguccuggagcugugaggcagguaugaaccacuugaugugggugcuugcuucgaaaggaacuccuggccucugcaaguuuguaaccacagagcaucucucuagcgucucucagcuuguggacuguuccgcaucuuucuagcaacauuguuguuacuggcuuauagauuguuuguaguuucauuuuuauucuuauauguugagggguuggggguccuucuaaggccaggagaggaacucagaucccuugaugcuggagcuguagguggucuugaggugucccacauggguccuggaaacaaaaccaggguccucuagaagagcagcgugugcucuuaacugcucagcuauuucugcggcuucucugaguucugguuuuguuuugaaacagggucuugcuauguaacccagcgugaucuugaacucacuauguagcccagcaugaucuugaacucacuauguagcccaagcuuaccacaaacucacuuugagccucuuccugucucagccucucaacacuuggaauuaacacaggcauacauuaucacuccugucuagaaacggacauguuuugcaaaguuccagacagcuguucuagcuagaaagaaagaagggaaggggagggagggagggaggcauacaccuuuaaucucagcacucaggaagcagaggcagacagaucccugaucuccagggcagccuggucuacagaguguguuccaagacaguuuuucugucucaaaaaaacaaagcaaacaaaaacaaaccaaccaaaaccagauaagcuucuuccuuucuucuggucacacaccuugccuugggaggcaaguaucagggagaggcuguggccccaagucuaagggaacugguaccaacuucugcccaaaucauuccccauucagccuguuacugcuggagaaucccucuuuaacugcauuuccacggggacaccaccaggcugaccuccuuugucugugcagaggagacacauuuuacacacucuuagacacagcuguguccgaccaagagacacacuccagugcacaccggaaggaugauauggaaggauaccguguacacuccagaacauucucagacucacgccugcguccacacauggcucaugaacaggcccgagaccccucaaagacacaugcagggaucuagcucauaggacacacacaggcaggacuuaccacagaauucuaggaaagggaagggucuuguucucugaaguacggaguccugacguagaauaaagaucacaggcaugggccacacugaguuuaaauauauauauuuuuuaauuuuuacauuuuuauuugaaaauauuuuauuuuuaaucuauuggugacaaggucaccauguaguccuggcuguccuggaacucauucuguagaccaggcugucuuggaacucacagagacccaccugccucugccuucuuagggcuggguggguuaagaggcuacaauaccugaccuuuuuguuuaugugucuacacauaugcauacguaucgguguaagccuaugcuaugggugugcagaugccuauguaagccagaagggagcaugggauucucuggagcuagaguuacagaaugcugugaggagccacugcauucuuuacuggagugcugggaaauuaacuugaauccucugcaagagcagccagugcucuuaaccacugagccgccucccuagcccuugguacucucuuuuuguuuguuuguuuguuuguugguugguugguugauuugguugguuggguuuuuguuuuuguuuuuguuuuuuugagacaggguuucuguguagcccuggcuguccuggaacucacucuguagaccaggcuggccuggaacucagaaauccaccugccucugccucccaagugcugggauuaaagacauacaucaccacugccugacugguauucuuauagaaauuacauuuaucuauuuauuaugugugucuacacacauauacaccauaaugcccuucuggaggucagaggagacagguugcagauguuguuucucuccuucuaccacgaggguuccaggaaugaaacucaggcucacugagauaccuugcuggcccuuucauugauguugcugcugcugcuacugcuguuugagacuggucucgaaaguagccuaggcaugcuucaaacuuaagcucuuccugccucaguuucccaaacugagauuagaaacaugugccaccauuuuaacagaauagaaauuuaaucucggggcuggugagauggcucagcaguuaagagcuccgacugcucuuccaaagguccugaguccaaauccuagcaaccacaugguggcucacaaccacccguaacaaaaucugaugcucucuucuggaguaucugaaaacagcuauaguguacuuacauauaauaaauaaauaaauaaauaaauaaauaaauaaauaaauaagaaauuuaaucucagcauggugguacauuucuaaaaucccagugcugaggaacuuaaggagggaggaucaggaauuaagggcagacucacccacaguaaguuuuuuuaaggguagccugggauaccuaagauccuguuucauuauccugccagccaaacaaccacaaacagcagaaaauaagaguuagagaccccuugccaugccgugguggcacacucuuuuaaucccagcacuugggagacagaggcaggcagauuucugaguuugaggccagccuggucuauagagugaguuccaggacagcccgggcuacacagagaaacccugucaaaagaguuagagacccugaaagaugcucagucaguaaagagcacuuggaggagagaacccacaaauauacucaauagaugugaagacuaugaggaagaggccaaagagacaaagaagcucaggaucucucaggaugcuuuucuguguucaccacagauaugcucacacgaucugaaauucgcugcugugaaaacagaaggaaacgguccugucaggagaaccagccccugcaguucccuaaggcuggcacaauggaggaagguaaggacgcaucccaggcucugggagucccugacagaaaagccauggcagcaaggccuccuuugagauauuuguaaccuagacggauuugggagcaggagcuggagguugggggagcccacuugagaggcuauggcaagaggacucaauauuugaggccuacaacauagcagggggcucaagcuaagcaagagcugggcaccauggugcaagccccuaaucccauguugugugacaaaaaaauaaacauuccugggggaaggcaacauauguucucaccucagauugggaaccuaugacagcccaaagaauagauaacaccagugucccacuuguugaaccaauagguuuuacuggaguuacuuacaggaauaugggugaagggcuauuuacagaagcagaaaugacucacagacagcuguaucagcaaagcccaccccagcacagaugacaguucacagagccaggaacccagagcacacugcacagccugcaggcaguucaacaugucgggcguuuguugcucuaaaccucuuccagggaguucagcugguuccugcgccuuucaggaggcuggucuggucucagaaguggcuguugcagcuuuucuccauugagaguugcucagcuucaccgcucugaaagggacgcucagcauguauugcuuacugugacagagaggagccuagugaaucuggucaguuucagggacuuccugaagcuauuuugaguuguguaccuuuuuguuuaaagagcuucucuacuggggguuggagagagaguucugcaauuaugagcacuggcggcucuuccaaagguccugaguucaaaucccagcaaccacaugguggcucacagccauccauuaugagaucugaugcccucuuauggggugucugaagacagcuacaguguacuuacauauaauaaauaaauaaauaaauuaauuaauuaauuaauuaauuaaaugaccaggguagggugacagcuuuaauuccugcccuggagaggcaaaggcagguggaucuccgugaggggugcacaggaccuacagacaagugcuagagagaugacucuugcagaggaagaguuugaagcccuccuggugagcaaagugaguucuagggcaaccagaacuacauagacccugucucaaacacccaaacaaauaaauauggcuagaaauggugguauacaucucucaucccagcacuugggagguagaggcaagagaaucagaaguucaagacuagccucaacuuuacagucaguuugaggccagccugggcuucaugagacucucucaaaaaccaaagcaaaaauacagggugggaaagauggcucugcaaguaaagggacuugccuucaagccggacuaccagaauucaauuucugguacccacacaguagaaggagagaaacugugguugccuguaacuuucaugugaggacuguaaaauuaauuaauaauaaaugaacaaacaagagguaugcuuggcucuccuggcaggagcauggcgguccuccuaggugggugagcugggaacccagggaggacacgaagagggaaaaaacgacgucauuguugcucugcuaccucuaggagcuccuccaaccucuggaccuuccacaacggcucuccagcuccuuuuguuagggguugggggugucuggcaaaauccaggcagaaggcaguguccucugaggcaccgccccuccuuccuaccucuacaccuucucugucugcacuuaaguacuggauucauaguccuccuuaguacuggauccauaguccuccuuaguacuagauccauaguccuccuuaguguacuggauucauaguccuccuuaguacuggauucauaguccuccuuaguacuugauccauaguccuccccaccuccagcuucagccuccuucccuguccaacccaaacucuagggaucauccuguucucucucucucuuucucucucucucucucucucucucucucucucucucucucucucucucucucucucucucucucgcccaggcuacuaacucccucugcucucaguuuugagcucuuucugugcugucaguaguuuccuucuugaauaacuccuccaagcgccucagucucucccucaggucccuuuccugucucaccccuccuucgcgugcugcccaauccuccucccuuucccuaccucgucccucuuuuaacuucuuacagaaagccaucuccaucuucccaccuucugcgcccacagccgcuaacccggucuccauccccucugagauagcgcuccucagucauccugcccagacuccucuccucagccccucacccacccuuaacuugcacuguugggggugcuagucucugagccuccuucuagacucuuccccaucucuguaguuccacagaaaggaagccugcacugcuggauugucuucuccaccccucccaggacuucucucuccccccacagaaggacaucucuccccccacagaaggacccacuagagcccccaauagcaaagccugugaaccucucacuccauccucucaauccgauggcucacuuucuccuccaucuguuucuucuuccucccucaacucuuucuuuaauacugaggauccagcccagggccuugcacuugcuaggaaagccaaacaccacugagcuucgucccuaacccucccuucauugcgacauuacuuagaaguugaaugguuucaggugaauuuucuauuaauuguagaguuuuccacuuuuucuuuugcuuuguuugagacagaauuucucuauguaacaguccuggcuauccuggaacucacucuguagaccaggcuggccuugaauucuuaaagauccgacugccucugccugucuaguacugggauuaaagacaugcgcuaccccacaacccagucagucugugcuccuaacugcggagccaucucucuagccugccuauuucuuuuuugauguugguuuguuuuuguuuuuguuuuuguuuuagauuuaagugugugcacucgcgcaugcacgcgcacacacacauacaggcucacucacuauauacacagaggaacuagaguuacagggaguuuccugauauggguucuggggccugacccuucaguccucugcaagaacagugucuugguuaguuugucaacuuaaaacaaacuagggucaccagagaagagggaaccucaauuggguaaaugccucauguugauugccuauagggaauuuccuuaauuaaugauugauggaccuagcaggguucaguucacuguggguggccuuggcugguuuaagaaagcugggggggacgguuugcgcaugugggggacgacagauaggugagccacacuccuccacugucuuucugcacuuucuaccuucagguuccucuccgccugaguuccuaccucggugauggacuccgugauggacuaugauccugacacguaagccaaacgaacccuuuccucuccagguugcuguuuagcacagcagaagcagcagcagcaggcuucucucucuccucucagaagcaucaugugcucuucgaugcugagucaucucacuaggccccucccgagcccucuuccacaccuucugagagauaaugucucacgugaaucucuggcuggcuagaacuuagaaccagagcaggcugaucuccaaacgaggaccaucuccugccucccagaugcugggauuccagguguguggguaugugcgccacacaccuggcuacuggaacacauuuuuguuaauuagcugaauuagucauauagucguauuaugcuaaacugcauuaauuuaguuaggccaagugguauuaguuaauuaaauuccuguaacauggaagacagcggcuggggagaccuuuuccuaagugcuccucgcucuaucucccaauguucgaacuuaaaucucuauuaaaacuauauuuuaggcaggugugggugcucucauaggaucagaaauccaaagccauuuuuuggcuacauauagagcucaaggccagccaggcuauaggagaccuugccuuagaacaaauaaaacaagaacugugggucauaaaaccaguagguguagugguuaaagcccagagucucaaaaugugaaggcucacagcccgauaaucacugcaaauucaaggcuagucugagcuuuaaauaaaguucuagccaacccaaggcuguauauagggagacacuauuuaaaauaaagaaauaacuauuuaaaauaaacaaauaaaauaaaguaaaauaaaauggguccuuaaagaaugugaaguuucuacccugcaguuccaagaaaacaaaagcugguuggacucuguugucagggcuacucaaagacuccagcuuuuuugugugugugccacuguacugcccucuagggcacccuccuggucuccugaccaaccuuggguggcugccauccugggguaugccaggcagaaauugaaagggcauaaccaggcugggaaggcacacaauacugcccccugcagcccacugaugcgauucuagucacguagccacauucgacugcacagagguuuaggaagccccagucaggcccgaagaaucaucuguuggcaaauuagcaguggccucaaagcaccccugcaucacuccauacugauggccacugacgucaucagccucugcuucacuccacacugauggccacugaugucaucaggguucuuucuggccuuagccccuccucucucuacacacaucccugagcuguucuugcccaguccuacccucaagguuccuaccaaccuuccuucagcuacaucgcccuggaguggcugacuuaccuggacaccugggccagacuucaguuucuaggaggacuccgucaacucucaaccugacucacaugccaacacaggagccaaaaugaugggguaacagacuggaaguagggcccaguggguaaugugugugccgcgaucuggacuaguuaaagcuagauguguguuuucagucuucagcccucuuccucucgccuucccugccuccugugucugucacccccacugccauccccaccccuggugcugaagauuuaaaccaggaccccaaccaugcuccgaggguacucucuacaggaagcagacgcuucagcuccuucuuuucccuaagugcuuggguuuugugauagcucauaggagaaggucucguuuccuaucaaucgcugugauaagcaccgugaccaauagcaaauugggaacuaaaggguuuauuucaucguccauguuugccauuuaagaaagucaggacaggaagggaggaagaaaccauggggagaugcugcuuuaugcagcccagauccaucuaccuagggaauggugcugcccauagugggcuggguccucccauaucaucaaucaagaaaacaugggcuggcgagauggcuuagugguuaagagcacccgacugcucuucugaagguccagaguucaaaucccagcaaccacaugguggcucacaaccauccauaaugagaucugacgcccucuucuggagugucugaagauagcuacaguguacuuacauauaauaaauaaauaaaucuuaaaaaaaaaaaaaaaaaaaaagaaaacuuauagacaaagccacgggccaaucuaaccugggcaguuucucuacugagacucuuucuucccagaugacucuagguuauguccaauugguaaaaacuaaccagcgcagguaaccaaccuaccacuugugucgcaaaauccacugauuuuuggaggcaaugcugaggcucagagagaguaagucacugagccagaguugacaaguguuaucuguagagugcccacauccugaagaagggaucacaugaccugcuucuccuaugcuaguacaggcacacauagacgcacacaggcacacacagguacacauagguacacacaggcacacacaggcacacacaggcauacacaggcacacauaggcacacacaggcacacauagguacacauagguacacacaggcacacauagguacacacaggcacacacaggcacacauaggcacacacaggcacacauaggcacacacaggcacacauagguacacauaggcacacauaggcgcacacaggcacacacaggcacacacaggcacacagaggcacacauaggcacacauagguacacauaggcacacacaggcacacauaggcacacacaggcacacauaggcacacacaggcacacauagguacacauaggcacacauaggcgcacacaggcacacauagguacacauaggcacacauaggcgcacacaggcacacauagguacacauaggcacacauaggcacacacaggcacacauagguacacauaggcacacacaggcacacauaggcacacacaggcacacauaggcacacacaggcacacauaggcacacacaggcacacauaggcacacacaggcacacauagguacacauaggcacacauaggcgcacacaggcacacauagguacacauaggcacacauaggcgcacacaggcacacauagguacacauaggcacacauaggcacacacaggcacacauagguacacauaggcacacacaggcacacauaggcacacacaggcacacauaggcacacacaggcacacauaggcacacacaggcacacauaggcacacacaggcacacauagguacacauaggcacacauaggcgcacacaggcacacauagguacacauaggcacacauaggcacacacaggcacacauagguacacauaggcacacauaggcacacacaggcacacauagguacacauaggcgcacacaggcacacauagguacacauaggcacacauaggcgcacacaggcacacauagguacacauaggcacacauaggcacauauucugugucucugucacagagcugugacuucuaaaaccaacuccacagagguguucucuaacuuccacaugugugagcgcgauggcaauggcaaccaugcacaucccccuacaacagagagagaacacuuagaauaagccagguguggugguacacaacuuuaauagcagcucuuggaagacagaggugggcagaucugugaguuccagaccaauccggucuacauagugaguuccaggccagcuagggagagugaaacuacaacaacaacaacaacaacaacaggcacuuagaucagaacaaugcacagcucccagcaaaugcugucaaagaaccuacugugugacuguguagcuaucaggaaaaaaacaggucaacucaggaugaacgcucuuccacaugcugugugaccucaggguaaaucaauuagccucucagagccacauuuccucaguuggugaacagauacucuuuaauguuuagaaagcaaaacaacucaugcauagcauuuagcauuagccuuaaguucugaggaacagaggccauguaggucaucaccauuucucagggccucaccuaggggccagcgcagcgaggcacucaaugagaacuaaucucuucuucacccucuagccacaacuaagauccggcaggugcuugcagacagugacaucuugugggaaaucucaggaacugcaccguggcaaaucgcugcuccuuuuacugugggguccuuggaauacccagucaacaucaaggaagcauucauucauucacugccuucuguguacaaggaacugauccaaguccuggaauaaagaaagcaagagagacuggauggcuacacggggagugaaaaaauucccaaggauuauaaccuugucauuacugcucaacuuuaaauauauuuugugugugugu

SEQ ID NO: 6337 - RNA, 3240 nt, Mus musculus
caugaugcuucugagaggagagagagaagccugcugcugcugcuucugcugugcuaaacagcaaccuggagaggaaaggguucguuuggcuuacgugucaggaucauaguccaucacggaguccaucaccgagguaggaacucaggcggagaggaaccugaagguagaaagugcagaaagacaguggaggaguguggcucaccuaucugucgucccccacaugcgcaaaccgucccccccagcuuucuuaaaccagccaaggccacccacagugaacugaacccugcuagguccaucaaucauuaauuaaggaaauucccuauaggcaaucaacaugaggcauuuacccaauugagguucccucuucucuggugacccuaguuuguuuuaaguugacaaacuaaccaagacacuguucuugcagaggacugaagggucaggccccagaacccauaucaggaaacucccuguaacucuaguuccucuguguauauagugagugagccuguaugugugugugcgcgugcaugcgcgagugcacacacuuaaaucuaaaacaaaaacaaaaacaaaaacaaaccaacaucaaaaaagaaauaggcaggcuagagagauggcuccgcaguuaggagcacagacugacuggguugugggguagcgcaugucuuuaaucccaguacuagacaggcagaggcagucggaucuuuaagaauucaaggccagccuggucuacagagugaguuccaggauagccaggacuguuacauagagaaauucugucucaaacaaagcaaaagaaaaaguggaaaacucuacaauuaauagaaaauucaccugaaaccauucaacuucuaaguaaugucgcaaugaagggaggguuagggacgaagcucagugguguuuggcuuuccuagcaagugcaaggcccugggcuggauccucaguauuaaagaaagaguugagggaggaagaagaaacagauggaggagaaagugagccaucggauugagaggauggagugagagguucacaggcuuugcuauugggggcucuaguggguccuucuguggggggagagauguccuucuguggggggagagagaaguccugggagggguggagaagacaauccagcagugcaggcuuccuuucuguggaacuacagagauggggaagagucuagaaggaggcucagagacuagcacccccaacagugcaaguuaagggugggugaggggcugaggagaggagucugggcaggaugacugaggagcgcuaucucagaggggauggagaccggguuagcggcugugggcgcagaaggugggaagauggagauggcuuucuguaagaaguuaaaagagggacgagguagggaaagggaggaggauugggcagcacgcgaaggaggggugagacaggaaagggaccugagggagagacugaggcgcuuggaggaguuauucaagaaggaaacuacugacagcacagaaagagcucaaaacugagagcagagggaguuaguagccugggcgagagagagagagagagagagagagagagagagagagagagagagagagagagagagagagagaaagagagagagagaacaggaugaucccuagaguuuggguuggacagggaaggaggcugaagcuggagguggggaggacuauggaucaaguacuaaggaggacuaugaauccaguacuaaggaggacuaugaauccaguacacuaaggaggacuauggaucuaguacuaaggaggacuauggauccaguacuaaggaggacuaugaauccaguacuuaagugcagacagagaagguguagagguaggaaggaggggcggugccucagaggacacugccuucugccuggauuuugccagacacccccaaccccuaacaaaaggagcuggagagccguuguggaagguccagagguuggaggagcuccuagagguagcagagcaacaaugacgucguuuuuucccucuucguguccucccuggguucccagcucacccaccuaggaggaccgccaugcuccugccaggagagccaagcauaccucuuguuuguucauuuauuauuaauuaauuuuacaguccucacaugaaaguuacaggcaaccacaguuucucuccuucuacuguguggguaccagaaauugaauucugguaguccggcuugaaggcaagucccuuuacuugcagagccaucuuucccacccuguauuuuugcuuugguuuuugagagagucucaugaagcccaggcuggccucaaacugacuguaaaguugaggcuagucuugaacuucugauucucuugccucuaccucccaagugcugggaugagagauguauaccaccauuucuagccauauuuauuuguuuggguguuugagacagggucuauguaguucugguugcccuagaacucacuuugcucaccaggagggcuucaaacucuuccucugcaagagucaucucucuagcacuugucuguagguccugugcaccccucacggagauccaccugccuuugccucuccagggcaggaauuaaagcugucacccuacccuggucauuuaauuaauuaauuaauuaauuaauuuauuuauuuauuuauuauauguaaguacacuguagcugucuucagacaccccauaagagggcaucagaucucauaauggauggcugugagccaccaugugguugcugggauuugaacucaggaccuuuggaagagccgccagugcucauaauugcagaacucucucuccaacccccaguagagaagcucuuuaaacaaaaagguacacaacucaaaauagcuucaggaagucccugaaacugaccagauucacuaggcuccucucugucacaguaagcaauacaugcugagcgucccuuucagagcggugaagcugagcaacucucaauggagaaaagcugcaacagccacuucugagaccagaccagccuccugaaaggcgcaggaaccagcugaacucccuggaagagguuuagagcaacaaacgcccgacauguugaacugccugcaggcugugcagugugcucuggguuccuggcucugugaacugucaucugugcuggggugggcuuugcugauacagcugucugugagucauuucugcuucuguaaauagcccuucacccauauuccuguaaguaacuccaguaaaaccuauugguucaacaagugggac

SEQ ID NO: 6338 - RNA, 22350 nt, Mus musculus
ucucuuuggauuuucuuuuuuuaguaaaacauucuuuuauuaaaagaacaagugcuguuuacgaacugcccuucguacaaauaacauccguuauacaaagauacaagacccaggcuaugcacaauuccaggcuuggaggucgcaggggaacaccgucucuugggcugaggauauaaagguuucagaaagaaugaaaaaugagccccuggguuugcaaucuguggcuucccuuccuugcucccuuaggaagggucugcuacauggaaacaggcugggauggaaggaagggagccacaguccuucgggucuucagucccaaguggggcuggagaaagugaacacaggagaaagaggacgguccucaguccccaacgcuucaguaggucaagacaagguggucugcugggaacuagacacaccuguaauccaggaggaagcggcuggagggaacagagggacucccugaccccaccucccuccguccuagcgggcaccucucccuggccccaccucccucuguccuagugggcaccucuccccaggcaccagcagucuguuacucccuuuggcccucugcacucuugggaugacugagacuagcagggcgggccugugucucugaaaacaggucagcauuuccagggugggaagaggaaauggaacugguagccucuuugggcucucauuugucuaggcccuuccuaggagucuagggugggaacucccugggucuucacacaaggaagggaagggaucaccagcaguagacccaggagcuugagagggacacccacaagcugggggaugagggagagggggaugggacauacaauuuauuucuucucuuaaaggcaacccuuaaagugucauugucuguggaggauucgucagcucagagcuaagacagucagugcuacauagauaccuucccgccacgggcacaacccuacuacacucacaccaccacacucaccacacacacagggacagccagccaaccagcugcagcuaaaaggcuugacagucaggcaguuaugaccagaaggccagguacaaaggcuugucacugcuguugcugaggucacgucacuccuagguuuagagcaguagccuguaaagccagcuccaaugacccccugaucagcauccaucagccaugacccagccaccccugcccuggugggcacaggcucagcaucugucacccgcucaccucuucucacuuaggguggugacauuaagauccacucaugcauucugagacuccacuuccgcucugcaaaccacauccucccccucccagauagagauggccccaaaucugcauccuuucucuccuucuaccaagcucuuuaucaaaaaaaauggaccaaagccagacauaguggcacacaccuuuaaucccagcacucaggaggcugaggccagccuggucuacauagcaaguuccaggacgaccaaagcuacauuaagaguagaccuugugccgggcgugguagcgcacgccuuuaaccccagcacuugggaccuugucuuuaaaaaaaaaaaaggugaggucaucagagccauuuugcagaacccuggucccucccaaggacccuaauucucccugugcugcggcaccaggccacaccucuccucaugucucaggauauggaauagcaccaccagcucgccucuaaucccagcacucuggaggcagaggcaggcagaucugagucugaggccagccuggucuacacagccaguucuaagucagccagggcuacacagagaaaacccugucucgaaaaacgccuccccaccccaccccacccccaaaaaagaggagccaacaccaaaccauccagcccagaggccucugcaagccugaccugacucuguuagggcauccugccuggcccagaacagggaaaggagcccagggaacugcugagaacagaguuccagagccccgagcaccccugcgccacaaugcaggguacuuggcucugcguggggcaagggugugggccuggauaaaaaggucguagacgaaucugaagaaucacuggcucguagacaaggaggucuacaagagcggaagagaugaagaugucuuucuaguaauagcaguuagaaaaguauuucugaggucaucucaacugucccccaaaguccuuccaagugucaaaggguugccucugaagggucccggcccauccuaucuuauccuaucuuauuccugucuuaucaacaggaauaguauuucccagaucauggggggugggagugagggacaacaguugagcagcacaggcaaaaauauaucuguacuacguuucuguccuugccaaaaauauacaccuuuucuuuauuaaaaaaaaaaaaaaaccaaaacaaacaagcaaaaaaaaaaaaaaacaacaacaacaaaaaaaacccccaacaacaaaacucaaacguaaacacaccaaaaugcacacaugcagagacccacagacaugagcaagggaaacuggaacugacccucagucccagccagugcaaccaaaagggacacaaggccuccuuggcggugcuccgugucccacucaacguuuuucauuaccgcccugggcagaaagucucugccacuuauuacuacacccuggaaaauagcuggugggguaaggggugguuguuagcuuaaguggcucuacuagcuggugaaaggauucaagaggcaggcuagcuacuucggagagggagacuuuugcuaaaaagaaguggcacuuuaccccuccccuacucucuugugccaggacugaucaaacuaacagugggggaggaggcccugaggggcccugaggugggguagaggggagggaagguaggguauuacccugauucagagcccccagccccuaggaauucuccaauacuggagguacuggucuguuguuuguuuuauguuuuuuauaaguuaaccauucaugcccuggaaaaggagcagaguuggugaggggguagaggaugcaagagcuaggagcuccugcccugguacuggccacugccccgguacuggccacugccccaguacuggccacugcuccuguccuugcccuuggcugccccagguccagaggaagaaaugacagauagacagacagguuaaacagacuaaccaucucucucuuuuucucucacucacacacacacucacacacucacaaucuguggagucaggcagcccccucuccccacccucggcacuccucaagccaauagugcaaaaaggggcagggcacccaggucagcacgggacguccccagccagccccaucauggggccccaagaagugcuguccugcccuuccucagccccccacaucuguaggcuuuuccaagcucagcuugugacccucagugggaagggaugauaagaaacagucaaagggauggaucccuucugcugggaagaaacggaaggucaggugggcccagcccuuucuccguaagaaauuuccacacagggauaggccuggggguccacccuucuuccaccuuccccauucaagugcugauugguuuaugugguagguccaaccaacccuccaucucucaugcugagaccuacuuugcucuuugggggccccuaggcaucugcggaggauggggucuccuaggcaggcuaggagccuguccucccgacccucugaagcagccagugcagugaggggugggccaggugaagggcucccuccagucucucuccuccaugugcaccuggaacgccaggcaugcacucccuggggaucagcacaggcccugggccuggcuuuccagagucugggcccaguugcccacuccagacaaggacccucaagccauguagggguagguaggggcagauggaguuagccuuuuuccuggcugguugaggcuccuuugucagcggucuggaaagacaggaagaaaggcuuuaguguuguagucaucuugcccuaauauccaguuaggaaaagcucucagaguggaaaaggcugaugaagaagcugaguggucaagccugcggagugagcugucuagccugugccaaaagcuggauucuugggcccaggcgggcccuucaaggaaggccuuuucuucugucaguccaugcagaggguccccucucucuaacuguuguacacagaaguguccuuucuaauuacuccucuaacagaaggcuguuuucuuuuuuaaaaagaauuuaaaacaagauauuauauauauauauauauauauauauauauauauuucuuuagugugugugugcacguguggauggcagaggacaguuuucugaucaguucucucuccacuacacgggucccuggaugaaacucgggucaucggccuugguagcaaacaccuuucuccuucuuuaacacacugggcugucaccagcuggaaagcugguuucuaagugguccuuuuuuuacuggaaccugcucaguggccuuccucuccucuagggggacaccaacaggagcugagguccugcugucugcagcaggccaccaugcugaccuagggauauagcuagccucccacuagagacauagcugcugcugcuauagccauccuccucugccugucccauaggaauauaggaaggcccgggucccuuacucaccccuccuuuggggccauucccacuggcgucugccccaggcaggcugagaaaaggguuggucugagcagugaggacuggagguccgccugccgccgccaccgcugcggcugcagccgcugcagccauuagacuuguauugcugcccagugaaggggccaccagggcuccagcaggcagcagggguggggcugaugcugugggcagcaggccaggggugcccgcggacagcagugggguggagcuuccagccaguagacuggccaugggcagcugagagcccccagccaucuguagccgcugcagcucccguuucugcugcaucugcuggaucaucugguagaccacagucuggugcuccugcaaggaggacagccugguuauuggcagugggcucccguugucucuucucaggggugccugccuugcuagaccagggccccucacacuuaaaucauaaaggccacaacagggagacaaucuagguucugucucuaccuuccuacucuggacaagaaaaugcagacaugugagguaaacaccugugaacugaguagcugggcaagcccagaccgugaccauuucuggccuugcccacugugucaggcccuccauucuuaagacaaucacaacgugcuccaaauggaaaagcgcuacacagggagggacagcaaucuccaagugcucccccgcccuccccucuuuccuuccaaaaccuggcuugaaagauuuuagaaaauagguuauggguugggugugguggcacucaagaggccaaggcagagacaggaggcucucuugugaguucaagaccaaucagggcuagugagagacugccucaaaaaaaaaaaaaaaacaaaaacaaaaacaaacaaaaaaacugguuuguggcucacugucugcucuuccaagaggaccuggguucgaguccuagcagcuaccaagguagcuuucaacagucuguaaguccaaucuggucuacagagugaguuccaggacagcugggggguacacagggaaacccugucucgaaaaaccaaaccaaaccaaaaaaaaaaaaaaaaaaaaaaaccaucacaaagcuaauaauaaaccaaugaaguaggcauuaguguuaggggcugcacgugcagggcaggaaaucuguuuccccuuccauggguccaggggagagucaguucgucagcucaucagcagggccuugacccguggagcaucuuaucagccuccuuacuguuugggguuuucuguuuuguuuuucuuggcuguuacaggagucuuacucuguagucuuggguagacugaaauucauuacguagcccaggcuggccuugaacugauagccauccuccagccucagcugccaagauacuuggauuacagcacacaacacacagcacuugugugccuuguaggggacacagacaagcaccuaaggcacgcugggccaccuagccauucccucauuuuaacaggugacaccacuucucucggaagaagagcaacacaugacagacagaccaagguguugccugagagaaccucccugcucagacaccuucucuuggagacucaggcagggacuacaaagcucaguuacugcaccugccaccucucaacucucacugggaugugacccagggccccagggcuuccuaacugcccguaggccccacagggccaaucccaccagcuuggaacccucccugggaggcuucguucuuagagguaagcaauuuggguagagcuggagugaggggugggggucacucacuggggucagcuguggagaggccaggagcugcugcaguugcugcagcugcugcucuugcugcugaaggaggugucucugcugcucugucaggcugaggcagggauaacacagaugaggaggugcaagagacccauaccccacaacacccaggagcucccagauccccucaggcccaggcagauggacagccugucuagaagaccuccaguagggacauggauaagaucuuguucccuguaucuggggagucccuuaagucgacagacugccagaucuauaaauccuauagggccggggaauuauuuuucccuuugggggaauaaggggcuuuggggggcaucccucccauauccagccucccacccccucccuagggcugaacuuucccucaccuguugagacaaccuggcaguugaagcgugggggccccgccagccuggcucaagcccgcgggguugggagcagcagccccauucaacccucccagaagcccauugaggggcaggcucccgcugccugccagcccacccaacagccccucagccaugggcauggcucccagccccguugcuccaggcgcccggcccagcccguucuguggcuggggugggaguggggcaggagccccaggcagggccaagggcagaguagccgggcucugcuggagcaggggcagcggugggggcgugcuguggaaggagagcgaagagcugcugcggcucgggcagccugaguguggguccuggggagggagggggaagggaugggucagagggcggagggccagugugacccuuccggcccucagcccagaauccaccagcauucucccauagcaaagcccccccaagccugcagacccccuggagaaacagcaaagcccaggggugaaggcuagauccgcacagugcucagaugacguucaccgagcacuccaggaggcucagcacccuccguuccugugcuucucaggcuuaacuacaaacaauggcaagaucggcugcuuuucaagggaacaugucccggguuaggacuugaccugcacuacccucuuauuuccacuugauggccagagcccuugacuuuaaugguuaaggaguucugcagccaagagcaaaggagcucucacuaaagcgaggcucagguucaaauccuaugcccaacacucaauggcuuggguagcccuggguucagcaucucugccuccguuuaucucugccucauagucuaugggugacagugaugugcaucccacagucaguguggagagugaagaaacccaggcuggugucccaggcuugcagcuagcguuacuguuaugauuacgaccgcccuaagucucaguaaguggcagagaaaaaacaagcauugcccgauucccaacaauaaccacaacauaacaauagcaagugccguuccagccgccaccaauuacacagggauuaguuuguaugaggcacuguaauaaacccuucacaacgcuuccccgaauuccuucccgccuggcggccugcccucgcgggccuuuagcucucgacugagcuggucuuucuguuccuccuuugcaaucccuugcugcuuuccugggcucagccuaucuucacgaggacugagucuguccuucacugccggcuuagugagcacccuguguuaagaagguucucacucauauuacuuauuuacaauaaugaauaagauaaccaucauucagucaauuucuucuucgcuggccagccuccagcagcugcugguuagucacuagaccaaaggacccccuccaggucccuucccuguccuguccccuccucacagcgccuaccucggaagagguggacagggaauuguccaggccgaggcuguucuucccgggagggcucuugcugacgcucagggagucacugcugccagcugaccgagaagagacgggagcugcaggggagccagcucaggccacgggcagggauucuucccccuagccugggcuggauccccucaccuugaggaagcaguccauagggcccugggauggggccguuaguggccggcagggcagcaggcagggcggggaagggaacggagagcugcacguugaggacuuggagccgcuccuucuucgcugucaggcuaaggaucugcuccugcagccgcugguuuuccuucugcagcgcaugcagggccuucagcaucuccacaacuucagagagaggaggagucuggauuuagugcauaaugcaucagagaagcagggccaggaugagggacggggucuggcgagaagaggugaccgagauauccuuagaggcugcuccagauagugguaaugggggggggggggucugaccaucuuaagaggacccugaugcuccacagggauggggggaguggguguagcugggguuugguuaagaucuacaccaggaggccuugagaaacagaaagugcccagagcaccacuuaggcaaggccagugaagaggcuugaggcccuggggaggggggaggggcagcggaucaggccuccccucccugugcaccccugcucacuguugacaccagccucuccgucacccugcuucuccagcagcugcuccauguugguugucccgggggcuguggagucuaacuggccacccgcacagggcgccgacgucuggucgaagagcgcagggaggcugcugaugggagaccuggguccagaggagaacaaagcaccuagcaccuagcuccagaggcucgcucaccuagcaccccgauuccagccccccccaggaccauuucagccacagccaccaggaugucacaauccaguccccacccauuccucccuccuccaagguucacccucccucacauggaagagagacucuccuggggggaggucccgugacaccggaagcugcagucuucuaggucuggcucuuggaaggagaaggcaaggaucagggggggaaggagacucgagacccgcaaccccagaagugggugcucucccaggaccucagcucacaccuccuucuucagucuccuccaacccuagccuaguaguucauguuggcaaggagcugggcacagcaccccaccucaggaaagcucucuuccccuugccacuggguuccugcugccugcuugcagaucuuucaguuacagaaucugaggucaagauaaaccuggguaaacugaacguggcugcuggcugggagaccuuguguugguaaccugccucccaccagugauuaaaugaggauuaaaaugaggccacaaagggaguguuuggcuggagggcucggcaagcacaaagcaagcccuuaaucauuuuauuaucauaauuagcuuugacuuuuuuuuuaaagacuuauuuauguaugugaguacacaguagcuguacagaugguugugagccaucaugugguuguuggaaauugaauuuaggaccucugcucgcucugguuggccccgcuugcuccagaagagagcgucagaucucauuauggaugguuguaagccaccaugugguugcugggauuugaacucaggaccuucagaagaguagucggugcucuuaccugcugaaccaucucgccagccccuagcuuugacuuuuuauauucauaagcucagaugagaaaacuguuggcaacagagcccugguucugggcuacagaaaacacugaucuuacccaacuggguccugaaacugaagucugauuugcuuucuuugaaaaagcuuaccuaaucuggcagccugaagcuaagcccuacgcgcagacgacaguccugcugucuguugggcugaguagacucuggggagaugguaggggagauugccuaccaccccuuaaccccugaauaccuggagagcagaaagcccagcugccaaaaccugugacccccaacuacaacuaggugugcuguagcaagagguguguguugggggugggguuacauuggacugggaccugauuggcugaacuggcuuugucauuucauucucuaucauuacugcuuugaggucucucugugcaauggaguggcaccccacgccugccccugcacagguuuucccguaaagugccucaugguuuauaguaugugagguaaauucagagggaggggacucucaugcuuucuacaggagcauccuucagaaggggaccaggagcagggacuagcauaccuguguggcugcucuccgcuugggugaggaggggguuaacagugcccauggggguuccaaagaugugggaugaagggaggcugaagguugagccagccagagaaaacaccuguugggaggaucaaacagagccucgugcacagcugaauacaguuguacugugugguggggaacaaggaagagcaggaggacacaggccacggaccacagagggcuucuguccccauccugcccaggaagaggagccaggagcagggucucaccugagugguggagauggaagcagaagaggaugcaagggugcuggugaagggggaccggcugaggcgcggcaaggcugagguuccugugggccccagcaggcuggaagagaguggggugcugcagacagcccgcagcaucccuccaccaugagagaugggauccuuauuacugguauagaugccuaaagguacaaagagacagagaaaaacccaaggucaccuucuaccccagaauccuccagucagcgguaaaagcaaccccucuucagagaacacagcaugcccgggguucuacauauucuacuacucugccccagucugggaaaugcuuagguuuucuuauuccucuaucagaacccugugaguucugcugguguccaccccaaacucuucaugcaggagacauuuaaaggaacaucuuagagauaauggccaccuccguucugccuguugggaguuuccacaugcauguauuucuucuuuaugccccuacccgcugacacgacuggcuguacauggagccauucuuuagcgacagggacacuaaccugcccccagcagagaugacucuaagcucaagcugggcaagcuuccugaaggcccaaagguacgggaggccagaccccccaggccagcgcugaccagggagcccccagagaagggugaggccgcaguggcagugaagccagcgagcugagccgcagggagggaggcagucgggccugaagcacccuccuugccucugcucccuuugggucggccuggcccgugucggcuccuuuugcuggcuuuguguuucuucuccuucaggguggucucaggggccuccucagcagguccaaggguggcacucagugcgggcauccguuugugggugccugcugaggccccggccccgguaauauggggagacuuauagucuccaggugaaggggcucgggcccggcuggagcuggaggcggugguggugaagcgcaugaugggcccaaagccagagaagacaacuuucuguucaaagaggucagccuuugggggcucaggggccgugggcgagggaggggccggcggggugggguccgcaggcuugggauauuugucuuccuccggcuguuccagcuuggggaacgcugcaaagucaggagagcucugcagagacgagccugcagcaaaggaggggcuuuacugcuggaccaccucccuccuucccccagcgcagacccuaguuaggaaccgcagacccuaguuaggaaccguagcuggugucccagacagcuccaccugccuuuguccuaggaugacagucccugcugggaacucccacccuugagcaaacugagcaaauuccugcuucuugagcacugacugggacagguucuccggcguuaguagaggcuggccucaaauucagccaauucugcagcucccaaauguugggauuacgggccgcugggccuggaacuaauuuugguguuuucagauggcccuuuugacacaaagguaggggacacuauugugggguuagagaaugggccuuguaaggaaaggggcucugguuuggggggggggggcugggcaacaguguaaacagugcaacaguguaaaacagcacuggcugcccuuccacagggcuuccgaucaauuccuagaacucacguuccggcccacagccaucaguaacggguuccaacacaaccaccuauaacagggucugauucccucuucugcugugcagacaaagcacccauaugauauauaaauaaaucuaaaagaggguggagaauccagcugggggagggguucccugccuugucacccccacagcacuuauaaaaaaaacaaaggagagaugucgggaaaccaccaggcacagacccuugccacacggcacgggucaaggggcucccgcucucugccuccucuaggacacccguacucaccugcaggcugaaaagggcccccagaggaggaagaggaggaagaggaagaggaggaggaagaggaggaagcggaggugaaacugcucacaccuuucccagugcccaguuucuuguccuuaugacucaggcuauggcuggaagacuuucuccccuuugagucccugcuacucucagaggucuccugagugcuggccucauggugggaggaagaagucgcugaggagaccuaagacagagacaagagagguuuaugucagcugcacagaccggcucagccugacucgggagggugcacaaccugaacugggaguccguccugcaggacucagagcugugggaaggaagcucuagaacacagacacggggaggcagcuacggaagucuagggaaugcccuaaacccauguuugucccaugacccaacagagagaccaguccacaaucugcacgggccucuuuguccgaggcauccguagucaaugacuccggccugaaggcugcugcuggccuuggacgcuucggugguuacauucacaagccaccuggcuacagcccaccucugaccacugcaagcuccugcuggauaccuggcccuacaugugaacccuccaucgggcagccugacuuuggucagccaacauacagcuaggaaguccccacaccagggagccuccccuacacaccuaagccuauacacccuacacuuaagugagugacccauuaugucuuacucgcaggccacugagagccuugccugccugucagcagucgccacacagccccgugucugaggugcaauaccaggguagcagggugugggugggcaaggggguaggagcccagcuaugagcccagcagccucuggaccuagcucagcuguaucauccuuaggaaacuauuauacgguccugggagucaggcugggguucaauacacaaggaguccggcagugguaggucugcuacuagaccuagcaaggacaguucuguaugcuggguaaaaacacagccuuccaagucagacuacacuaguucagaacuucaccaucuaguauuacguugugcuuuuagacaaauuacacagcuucucugagccuccgcuucacuuaaguggaagugauaagacaucuaccacugggagauuuuugaggaauaaauuaaggccucuacaugugucccuucccuugguucugaagacagucuggccucuauguauucgggccucaaguaacagggaaggagauuuucuuuuggguggauaccagguauucaaauugugcucaagaacaaaugagggggaagucugagccaccccauuacagcugccccuccuuggguggagcccuugucucugucguccuuuguucuuuucagcagcuggaguucugaagggagccagauguggaucagaaagccagggaugagaggggcugggggaaggggcuguuuagcauugggcugggugugggggauaggcaaagcuugccauccagggguuaccccaguaggaggggacauucugagucuuucuaccugucuguaggcuccuggaaagguagggccagcuucccaggugagcucagggaagcaaagcaggagggaagaguuacuggggcaguugccacagcaacaucacccuggaaaccugauaccugaaacuccugcuaggaugcccagugcccugccaaccacgugagggaguggaggugacugucaguaaugguacaggagggagugcuuucuccagccccugggggacucucacuaaucuguucaggcugggauuaucacucacuggucaggguagggccugccuguugcucauucagaugcuacccacuacuagagcccagccugcugagaacaguggugugaguaggagggauuccaggguguagccagaagccuggucacaccuccacucccacuggcuugaaacagaaucuagauuuuucuccugguguuucucuggguuugguagaaauucaccaauccuacagggcugggcucucagaagccugaggaccacacacuugcucuuagaagucacgaucccagagaugagccccugccuggacaaaggugcccauacggcagcuagcaagcagaaaggcaccccaucucacccccgucacccucaagaaguguugagguuugcugggcagagcagacccucugugagcucagccgggugguggcagcagagguaacaucaaccaugggcugagagaggacaccuauuaacaggccacuguucaccuuaacccuucacaccucaggcuuccucacccccagaccagcacacccugcauccugaguauaaggagugguaccuuaucagcagugggaaccgcaggcggggcgaggacgcuggggggggacucaggccgcuucuugugcuucuguuuaaggcguucuuuguccuuucgacucugggggagcgaaaugugaccagauacugauacagggguuaucugaaggaggucaaccaugacauguggguguggagaacugaaccccucuuagaaauggggcucagcaagugcucucaaucuacagagggauguaaaacuccagcuggacaggaguggcucagacaagauccucugagagccaagagcccaucccccacucucccuccugcuaaaaauagccugucccauuaucgugccagugacagagcgagagagacacacacacacacacacacacacacacacacacacacacacacacacacgcucgagagagcaggcacucacaggaguaucccuccuggaaugcacgcugaaccaaagugggcacucugugggaugggcacaggccgacagacuggagauguaaacauguagggacacaaacuggagguggaggacacuguagugucaugaggagaacuggagaauacacagacagagaagccaggucccaagcucugugccucaagcugugcuuccuaggccaccucuccaaccucaguggccucagaaggcugaggcgccugguggcggucucuggaaagaagcccaugagagagcgggucuucaccuucuucuggcccuucucaugguggguagggugcuucuccggcuggguggauggcgaggcugaccggcuucuccugccgcuaaggaagcuguugccgcugccucccccggugccaccuccaccaccgcuggcacuacugcugccaccuccucccccgccgcugcugccuccuccugcuccuccuccucccccgcuggagugccgggaugucuucugggggaagagauugagaggaauugccaacccguucuuucaggagccuagggaggguuccugaaggucgcaggauccuagaagcaacuccugugcugcugcagguccccugugucugccaugacacuccgcucagccuagcuauccuaaagcuucccagcuaucuuaaccaacgcagcacggaugcagccacagaggcucagaagaggcauggaccagccgcagcccccaacaaggugcaguggggcuggggauggggcaggaccugggcuucuccuucugcuccacccccacagagcuccccuagcagacuggaccacagcccauuuccaucuccuucccugagaagcagggucugggaaggacacacagggagccccugcuccccaggagccccauuccauccuccucccucauuuuccucugugcagcuguauagcagaagcccugcugcccuggacugggggcugcuggcaaugaacaccaaccuaaacuacacugcgucccuggaacugcucucaucccaggcucacagcugcgcccuaaggucaccaaccuccuccaauugccacagccugugauuaacuucaggccuccucaggcuccacuccuaccucaucaaauucuacaccuucucuuccaugucucuuucacaucuggacacccacagagacagccucugccugcacccaccaucugcccuugccacuugccuggggacucccacccaaucugacaucuccauuuggugucaccugcaagugcaacuggacaacugcccuaguccuaagcugcuccaagacucuaaagcuugacaaccagguaaugugugagcaacccaggucacugugggaaaggaacuauuaucauugcagcaggcaacaggaacaaaccaagaugcuccggagugcgccucucccuaccccgugaucgcuacagccugaaucuuagcucaaauucaccuugccaccucuggccacucucacgcugcucagccagguccaccuauggugacuccagcaucagccugucacccgcccccauccucccagcugucucucuccccagcuccaugguugcuugccaggguaaucugccuguaacacaaaucugaucuuguuacucuauggcuuaggcgcucuccaagcuguggccuggggcacagaguccugccugcacccugccucuguagaucaucacauuaugaggaaucuccaagucugcucagccaugagacccuuggacugaaugaagcucucacccccgucuggaacucauuccacaccugguccucaacagccuccccugcugccaccaacggaggcuccuuuccaccuuccugaggggcuuucugaucaaacuguuugccccaaaucccacucaccaacuauaaaacaagcuaucuaaccucggggaaccuuaauuuaccuaucugugaaauggggcacaugcagcauacuuggggcugagggagaaccacacaagucaucaauguggcaaaaagaaacugucccagggggcuggagagauggcucagugguuaagagcacugacugcucuuccgaagguccugaguucaauucccagcaaccacaugguggcucacaaccaucuguaaugggaucugaugcccucuucuggugugucugaagacagccauaguguacucauauacauaaaaaucaaucaaucaauaaaucuuuaaaaagaaagacagaaaaagaaaaaaaaagaaaagaaacugucccaggagcugggcagugguggcacacgccuuuaaucccagcacuugggaggcagaggcaggcggauuucugaguucgaggccagccuggucuacagagugagcuccaggacagccagggcuacacagagaaacccugucucacaaaaaaaaggaggaggaggaagaggaagaagagaaggaagaggaagaggaggaagaggaggaggaggaggaagaggaagaggaagaggaggaggagaagcugucccagugcuguuaccugcuuacucuucuagaacgccauugcuuacagauuccuagauugacagacauggggagggcuaucuucuagccuggacugcuuggucuaguucuaauuugcugcaccccucaggcugcaacucauuuccugucacagacagaguuccuggaaggcagggacugagggaugggaucuuucuaagcucucccagccccaggcacaggcaaggcccaagcccccaccccucuaccggcaggcgggacucaccaucuugcugaagugguauuugcaguagccgcaguacuugacguuguccaccuccaggacuucuuccucacacagcaggccagccaucugggcacugaggagaagugggucagaagggugcagccacaaacaaaccacagcagccccccaccuccuuccuccuggacccaagaccuaagcauggcguggcugccgucucgcacgagacaggagguaggaugcucccacucgguggccaccuugaaccucccagcagccgggcucugagaucucaccaggugacauggaaagcuugucggcauccguggcgguuacaggucaugcaggcucccgaggcagcuuugcucucccggcccuguuccucacagauguaacaggucuguggggcacagcacaauugaccccuccuccagggaacccuaccucuccugcugagggauccuuuggccuguccucaaugccacccugacccccaccauccagaucaguacuguccaguagaauuuucuacagggacggaaagguucucuaaccuauacaaucuaagccaguaaacgcaaugucacaggaccaccaagcacuugaaaugcagcuugaugaggcugagaaaaugaggucuaaguauucaauuuaaagguuuaucucuucuuaucuuagauguguacuuggccauacguauguauacacguacauauauacguauaucacaguggauaucuggugcccuuaauggccagaagagggcaccagacugauucccuggaauuggauguaaacaugguuuugagcugucaugagggcgccaggaaccaaaccuggauucucugcuagagcagcaagugcucuuaaccaccaagccaucucugcagcccgaguauucaauuuaauuuccacauucacaggcagucagccacugcguuagacagugcaauccuugguaaaguuugagaggccccgauguaccuacugucccacuugcuggacuacauacagacacacugugucuuuuucauagaaccugggacuggccagccuuccacaaagucgguucuuucucaugccccagaucccaaccuaaaugucuccuuccaugaccaccagauacccaagcaagccucacaggguauccucuaucucaaagccuguuuacacuucugucuugauuaacggcaagcacuagguaccugcuguacugugccugucauguguuauaaacuuaauaaaaugugaccuaugagcaacccucuggcugugcuaccgagggagcucggagcgcaacgguggcacccaggauugcuaccaggaaagggaggagugagggccgcuaaccuuguugaagcgaucaugaggcacguacugcagaacgaugggcuccaucgugagcacguuggcgaacugcaccuccgggauguagagggcgcacaccacaugggcccagccuggggcaguguggggacuggccucagcaggacggcaacacaagaccccacgccucccaacaccaagcuguagacuguccccugcgucuacaaccuuccuguaccaacaggagcagggaaagccagccuccaccccacaccugcuggggggccuggcugaccucagcaggcguucaggguuccccucaccuccauugucaguccucuucaaugccccaucuuugugcgggcacagcucacaccucugccaaugcaaggagcacagggauuggggggaucugcugagcugggcccucccugaacucauccaaaaggcccgaagauaacauaagaucugggugggggcugaggcuguagagcaaagaggcuccuaacugcugaaggcugaauaaggagaaccugcuggucacuacagcggccccucaacuuccauagccuugaaaaccuuucauaguaaaaaguuacaaagcagcacauagacaccccccccaaaaaaaucaaagcccccaagccggaggugaggcggggcagagcugagugcagagcugagggagagauggggcuggugauaggcagcagcaaacaggaaauccugagugacagagcuuaguccugccccagccucaggguacccuauuaaccugcaggagaugcucagguguaggggagaggaaagggagaggggcuggacucaccacccuggcugcacgcuccugagauucacauuuccugcagaaccaggguccuguuggcaccuggacgaugccauagcaagcuaagggugggggaaggagacucacugagcaaagccaucagccaaugguucccccccccacagaguaacugggggcaggcagggaagagacccagccuacuaaagccagcccaguagguggggcugcuccccagacccgggaucacucaauggaacaggacuacaagaaauguccaaccgcauagagccagccuucaaucacacaaccaagcauuucaaacaggggcaaaaagucugacagaguccuugaccuuaaacuuccaaagauccuccauucucaucccaccccucucccuuuuuucuggaccugaauuccucccccucccccccccccccccccgccgccucugcccugaccaguccccuaggcaccagaacaagaaauagucaugauuguaacacguuuuguuguuaugaggggagggggggugcuucuuaaagggccaguaagggauaagccaaggaagucggggguucaaggaccucaucuucugccucugucacacguacaggucaaaagugaaaacagagggcaggugcggggcagguacccagaggagaguggcgggaaaggcccgcagccacagcauuaaggguugucuugggaaggggggugguggugguugccugugccagacaggcggagaugccagccugcgcccucggcaagauuccuuaaggaguuaacucccgaaccaugugcggcggcagggggaaacuccaaaccucucucuccuccauuccggcccccuguaaaaccgcucucccagccucagcucuuccccggaggguuucaggaucccuucucccgugggacccuucuccucccuucccaauuccgcuccucccaguauccggaagcgaagggggaugacccccccuugaccucuuccucccggagcgggaaccaaaauaaaccgggcgggaggggggguuaccucgcagguaaacauucccgggacagcccugacaccggcggugcggggcucagggaguucacuccuugcgcccuggacucuccccaaaacuccuucaacuugggguggggggcgcgggacugaacaauaggcaagaaaacaaugccugacccgguccuggaggaccaggcuggggaugggggggagcccacgccgccuuucgcuucaggugggugggggaggggcaggcgccccaggagggcuccggagggcgcggccgagggcaccccgugcgcgcgccgccccggggucccgcagcucccccccccccgccggccgucuccccccuccccuuaccuugguggacggccacgcugcacgcgugcccaucgcaguagaccagcggguuuucggcccagccccucucguccgaacauacgcagcagccuccuaccaucuccuucauacucccaugagcucccuccggggcuggggcugggggccggccggcgggggucgggggucagggggggagggagggagcgggggccgcgcgccuccucgcccccuccuccgccgccgccgccgccgcuucuuuucuuugccuccuccuuccuccuccucggcguccuccuccuccuccucgcucgcucugucuggccgccccccccgccgugcucucgcccucaugccccgacgggccccccccccccaacaaugagacucgcgcgccgcgcuccccuuccgcgccgcucgccggcuaccagagccgcccggccgcggugcaagcagggcccggcgggggaggcgccgaguggcacaucgcgggcgcccgcccgccccgcgccgcccgcucacgcgccgcccccccggccccccugcccggccgcggcagccauggccgcgcgccuccgcucgcucg

SEQ ID NO: 6339 - RNA, 3038 nt, Mus musculus
accggagugcacagaaugugcggugcaggugaagaugcagacgucagagcccugcagagugauagauccacauacacacugacugccuugaacucuagagccaggguggcaccugccgacuccagggcggcucggccgugcccauccugugcgggccugggcggugucuuccuugggggcggagcggagagggcggcgacccggacgcggcuacgcgcagagcggccaugcgcagcgugggggacgagccugcaugcuguggucaugcgcggcgucugggugagcgucccaucuuuggugaccccuggccguucggccccgccuccaccggcccaggucagacuccaccccucggccgcgcguccccacagggcagucuuuccggagggagcucccgaguagaugccaagauccgcagcgccucuucuuugaaccuuuucccaaccauuaaaaaaaaaaaaaaaaaaaaaaaaaaaggucccacgcuccuuugacuuguggucuuucccuucccugaugggcuuccggcgucucuccuuccccacugauuuuauuuuucuguuuccaaaucauaucugccugccugccuugucgaagccguaucagaggcgggaaaucucuucuuggcuggugaguacaccucuugucuaaucucagcacaacuccuaucaguuccccaaaccucaagagcuacauccaagacagcgacagggagacccuugcucccagcaugcucuagggaagguuugguggaccagagggcagaaggcaaggaaccaggucucccacugaggggaggacagccaccugauuucaagccccagaguuugaagaagaguuacagaaccccccgccaacuaaaaguauauccaagacuugggaucaucccgagucacucauccacccugaucauaggcccgaugguuccccaaagacccagccaagccagugguggcacagaagacacccaucagauuggagcugguugccgggaaaaccuacaggugguguguauguggccgaagcaagaaucaggugaguuacuccuguagcuuuuccuuuagaugugacacagccugaucucugacgcuaacgguuaggccuggcagugugacacgcaaacauccaucuccuccucuccacgugcuuggggucagcauggucuauccuggggacuuucaguccguccacauuucccuucuuucuguauauaggugagauacauacaauugggggauggggcucgauggcaggaaccagcucacaggucagggacaccacuaucaggauggccauugucaguguauguccaugucccuccccaggagccuaggagguacagaagggccacagcucuguggcugacucagucuccucgaaggcugcccgcccugcuccuuccaagcagcccaugugccaggccuugguccucacagcugggaggauucuguucagucuucccugauguccccucccaggucucuuuucaccuuggaugugacuuuuccugcuugccugcugccauccgaugccaucccagcuguacaggagcccuucacuguagccggagcuucucccuuucauucuggagaacucuguccuguuucccaugcugugguugagaccauaaauccagcucuggaggcuuccuuuguggccuuugaacagauauuccagaggguggggcaguuucaagggcaugccagccagaggauuguggguacaugcccaugcccuuuaggcagggugcugguuuucuaguuuucacuaguucaucucuccgcacacucugccccugacaaggccucuccccuccuugggccucugucuucaccauccuuugaaggguucuccugugagauguggugcucacauucauagugguacucuaggcaggcuguuguagacacccccuugcuuacaggcaagacugaccccacccuacaaaggcacugcgcacugggcucucucccucccugaggaacauugcaaagaauguugcuuucaugggccaauggggacucaaccucaccuagccguuaaaaaagaaaaccaaaacaaacaaaaacugaggugaggcuaugaaccuaacccaguggauagacccuuugucugcaguguguggaagcccuggaaucuauccauccccaacacgcaauaaacaggguguagcgacauacauccauuguccuagcccuuggaagguagaggcaggauugguguucaaggucuggguuacaugagaaccuggcugggaagugcucaguggauaaaguuacuugcugaccugugugauccccagagcccacauggugaaaggagaaaaccaugcccccacaaguuguugugugacuucgugugugugugugugugugugugugucuggggguaguagcauugccucuacuugaggcccaguucuugcaaauugugugugugugugugugucugugugugugugugucuugggguaguagcauugccucuacuugaggcccaguucuugcaaauuguccuggucucuggaucucccaaaggugaccaaugagaaaugcuugcaacauuauacagagacaguauucucuucaugacagccuuucugugacccccacauugcagggcucggggaaacgagaaugcuccacuccccacccuaaccuuuuucugucucucucucaccagcccuucugugauggcucccacuucuuccagcguacuggccuuucuccacucaaguucaaggcccaagagacacgcacaguggcccuauguaccugcaaggccacucagcggcccccuuacugugacgguacccacaagagugagcagguacagaaagcagaaguagguuccccacucugaggggguacugugacuccaggcaguaaugcugagccacacauggaagggaaccuccaaggaccccaucuuguuagcaauuguacccugaaaaaccuguauucuccuguugggcagcugagagccagguccagcauccgguaaagcugucaauaaacacugaggccugcccucuaacu

SEQ ID NO: 6340 - RNA, 502 nt, Mus musculus
aaaacaaauucagccggugguucggggagacauaccuuccaccuuagaccauggccaaguucauccguaacuucgcggagaaggcaccgucgaugguagccgcugccgugacuuacucgaagccucgauuggccacauuuuggcacuacaccaagguugagcugguucccccaaccccugcugaaaucccuacagcuauucagagugugaaaaaaaucauucaaagugcuaaaacugguagcuucaaacaccuuagaguuaaggaagcugugcugaaugguuugguggccacugagguguggaugugguuuuauaucggagagaucauaggcaaacguggcauuguuggcuaugauguuugaagaccaaucuuuaacuucugauuugaguucuuauuugaauguucuuggaccauguguaacaggacugcuaucugaauaaaauacuagguguugaaaaaaaaaaaagcaaaaacaaaacaaaaaaagaacaccggcugcuu

SEQ ID NO: 6341 - RNA, 3322 nt, Mus musculus
aaugacccccagcacagugagaaaacucagauccaugcccagggucgcccuacccccaccccucgccuccugagacucacaugagaccuuccucuauguucucugaacuagguaauggcccacaaaacuggcaacaauuugucuucugagauagauuaccagagaugugugagagggagaaggaaaaaggaaggcagaaaaauccauuccuaaggagucuguagagauccuccgcucacaccuuccggagcagcccacucagugcagaaacuguaucuaaauagagauagcgguuuuuuuguuuuguuuuuuuuuuuccacacaaaggggcggggcuggcuuccugggaagaaauuaaaccucuccgguuuugccuggucuaaaaguagcuguucccugguuacccaccguggacuuugugauuggcuggccgugaugguggagguggagaguaaguugcugaugggguugcagcaucccuuagcuucagguccccgggagggggagggaacaggaagcgggagggaagaggagccauuucuccgcgcugaccgaccuccacgcuugcagcucccacuuccccggaaucgaggggacuccucugcuuguacugagccaugcuggauauuuucauccucauguucuuugccaucauaggccuggugguucuguccuacauaauuuaccuucucuaguggccuggcgcugcaggggcugcgaggggaaggauggagcugaagggccgagcauccugcuugcugacgcaccgguggaguuuugcuucuggucauuauucggguauugauuaaaaaaaaaaaaugaaaagaaagcuuguuuuuguaucuauuugucauacacauugacguagcauuucuuggaucaaugugaaaagaauaagaaaggccagcuuucuuugggaauugauuuaaaauguuauuucuuaaaaauaaacaucacuacaaauaaguaaauaaauaaauauaaauaaaaugcacuagguuuuagguaggaugggagggagugugcugggggguggagggggacagacuauuauuuccuaauuuccuuccagguagaugcaaaaccaaguuguccauucucuccugacaaugacuacaguacauccuuauguguggacaaggcaguuuucaaaucugcuggcauaauuguauucauuaauucacugcugcgccauaacugcauucauuaguucacuagugauuaacucccacuugagaaaaaauagcaaaugaaaccuacuugggguaaggggugagggagaugcccacuuuccccaguuguguagaggaauggggaggauucucagaacuccugcuaguuccugaccaguagggguaccccugcugcaguuugcagcugaccauuguuuuuggguuucccacagcuccugugucggguccagcaagaggccucucaccaccagcagcaauccugaggcccaacugaucucuuccaguguauccggauguggcugacccuuggcacgaaggcauucugugaggcaggggcacuccuggggacaucaggaguuaguccaagaaugccagccacuggcagcugcugcaugcgauugagcuguagacagggacuauucagaauauggaagauuggaacagugaagucagaguggagacugcccaaacauucauauggacagccuuuccuuaggucuaaaugcaacugcacacgaugcuaaaauauucuuugcuuucugcuucacaagcaggcguucccuuguaaccucaagggcaaacacugaucaguaauuuacaguuuguacagccugagguugcgugguuucccuugacuuacaacccaucccccacccucaaaauucccguuauuugcauucuuuaagguuuaucauuucuucccuccuuuucucauuuguucccagcuccuuaguugacuagaggcgcaugguuguaaaguccuuauucuuugugcuuaccuauaaagcauugaaacaaaauggcuauauuaauuuaggagaaaaacuuuacccuaaauggaaggguuugaaaacuuuaaaaaaaauuuuaaacguuccuuuaucuuuaaaauaacaaagcuguuauuuccuuguccaauuaggguucaaacaaacaaacaaacaaacacacaaacaaacuguguuuuaggauacagcauggaucugaccccaaauccguguuaucuauuauucccuuaaagacucuaccauaauugcucugcauugauuuucuuuuuuagguuaaaauaaacaagaaaaaaagaaugaaugaauaauuucuuguaauaauauuuuguucaauugcuguuucaagaaggaacgagcugaguacuguagcacacgccuguaaugcuagcacuugggaguagagacagaagggucaggaguucaaggccggccuugacuacaugagauccuaucuucuagagaggggcuggagagaugacucagcuguuaacaacacuuguugcuuuugcaagggaccccguuuugguucccagcaccuagauaguggcucacagucaucuguaacuccaguuccagaaauuuugauauuuucuggguuuugcauguacuauacacacaaguggcguacagacauacaccuguauauauaaaauaaauaaauaaagagagaggcaaaaauugagauuguauaauuuaugcuacaaguuugcaucuuaaauuccuuccuggacaaaccuugugguuacccuguaguucuagagcugaggcaggaggacugccaacagcagcagggauagagcucaccucuucccauucuuuaucucuacagugcucgggauugaacccagggccucccccgugcuagccaaguacucuaccagccccagcccaagacccuuacaucugaaauuaauggugauagccgggcaguggucuuuaggcccagcacucaugagacagaggcaagcagaucucugugaguuccaggccagccuggacuauaaagugaauuugagaacauccagggcuacucagagacacugugucuggaaaaaaaaaaaaacaaaccaaaacccaaacaaacaaacaacuaaaaagauacaauccagagaagaaagaaacaucaauucuaccuaggucacagucauuuaagcgcuacagcucuaguuuauucccagacuggaaaagauuuccuaucucuucccauguuaaaauucuaaaacagccagguguggugacauacucaggaggcagagguaggcagaucucuaaguuugaggccagccuggucuacagagugaguucaggacagccaggguaacacagggaaaccuugucuua

SEQ ID NO: 6342 - RNA, 6092 nt, Mus musculus
gagucaaaaaauguggggagcacggggguggcaaaaaucauuaucagcaagcacgacggaggcuccccgagcaucaaagccaaagugacgcuacagaaaccuggagaaagugguggagaugggcucaggccacagauagccucaucaaagaacuauggcucuccacuuaucagugguuccacuccaaagcacgaacgggguucucccagccacaguaagucgccagcauauacaccacagaauguggacagugaaagugagucaggcuccuccauagcagagagauccuaccagaacagucccagcucagaggaugguauccgaccacuuccagaguacagcacugagaagcauaagaagcacaaaaaggaaaagaagaaagucagagacaaagacagagacaagaagaagucucacagcaugaagccagagaacuggucgaaaucccccauuucuucagauccgacggcgucugugacaaauaacccuaucuuaucugcagacaggccuucuaggcucagcccugacuucaugauuggggaggaagaugaugaucucauggauguggcccugauuggcaauuagccuaacuuucuaaacagacacguccagaggagaaacuaaugauauauguaaaccaacccgaggggugagucagacaggcccugucagugcuuaagagcccuaaagggcauggccucuacaccaagcuggguacauuuauaaacauacaucuagacccugcugccgaaaccaugugguugguuguucagaaacaagucauauuucuuugccagaaagcaaugaauaaauuacuugcuuaaggggagagggguggugggagaggguguagagagggaggggugggaaauuguugugggaaauauucauauauuuuucucccuuuuuccauuuucaggacaugcuuuaaacucauuuuagugcauguauuugaagggcugggcagaaaaugaaaaagcaauacauuccuugaugcauucgcaugaagguugcucaccugugggagaugcccauuggaagcaugggcacgggaaggacuuugacaguucuggacacugaaagcaauguuuggugucuguuucuuaggagugaugggggagggaaaauuauuuuaguuauuuauuuguaauauuuuaauccuugauguuuguuuuuaugcaauguuuguuccuaaaucuaugaagguuaugguucagaacaguaggaggcagguagcaaggcucgccugguggggagcucgcagccugugcugacgcugcagcaccagucccacagagcuaaucacagccugucuuuggaguugaauagaaaaaccaaaacuauuaucuuuggagguuuuucacaggguucagacaccauaggaauauuaggagugaguuaccucccuaugcagauaaaagauuuaucuucuuucauuaaaaaggaaggguggcuuugggggguauacauuuguuuucagagucuauacccuaucguauaaaaaucaguauagaauuaauaguucuccuacuuccacaaugugccaaaagucuacaucccagcauuuuguuugcaggagagcugaugccauuccuaagagcuggacucuuuguuucucuucaucacaagaagaaggaguucagacuuaaaucacuccacuguaugcuccccgagauaaacaguuaaaaaaaaaaaaagcagccauaguucacuuaaaacaauuucaagcucacuugaagugauuagggccuggaaugcuaagugagcaugaagauaacccuugcuaccguguagcacacagucggaccuuuuuggagaaacaggucugagucuggauucugagggacaucaaaggaagaccucauaaauagagaaaugcaggagaccguuuugagugcaacagaaguucucaguauuuggaggguccucucaaaaguccgcggccuuacuuugauuucaccaccugcacugugccauuccugaugauuccguuugggaucuguaucagcgggguggggguggggcgugauccccagcacaacucuucuggauuacaaaacaagcaaaagccaggugauucauguuuguguguguuauaaguggagugacuucaucagauacggacgauuucuacauccaacacugcagguuguuggaguuagcauagacuuggaaaaucuacugcggcuuucuuuccuaguucucuuuuuuuuuuuuuuuuuuuuguuuuuuuuguuuguuuuuuuuguuuuuuguuuuuuugguguucucccuuuucuggucauugguuuucaacaacuccgccauuucugugucccaaggcaauaaauaggaaacaaaauauuggaaaguggagcaagaaaaguuaucuguuccccuaucagagcccggugucuugggugacaugggcaggguguauuggagugcuuucucuuguggugcugacauaguagccgugcgguaucucagauaaaaccagguuggauuucucagaaauuugccaccugguugugaauccuaucuucuuaguuucugcaggaaaauuguuguuauaugggguuucauuuuguuguggguggggacaaucucauggggaaaauguacugcauaguauaaggggcucaggccccccgagcagagucaagaaauaccaaaaucaguaaacugggaagcuuuucucucuuucugucuucaucccagaucaaagaaucccgaguuaggaucuggaugaaggauaagccccugaauugcugaugggcacaccccacacaaugacccagcaucugaacuugcuuaacagggagccggggcuaaacugcuucacccugccugggaaccagggagcacugcauuucuccacaggguggaggagaagcggcaggauaaaccaagccugggacaccucccucccauccaggugugcucacccuccuguuugaaagacggcaaggacaugaagucaacguguaccuauuugcugcugcugcugcugcuggaguuuaugguuuuuuuuuucuuuuuuuugaccuauucuucugucuuugggcuucauguuaagggucuuuggacaaaaaucugcucugauguacaagaauauuucaguguaucuuaaaacaaguguuuucgaggugagcaaggggaccugauguaauugccaaagccagcuugagggugauaacucuugaauuggauuuuccuuuugucaggccaaggccugaaaaaucuguaacagcaauauaucaugaauuuucagaagagccagugggucccauaguguccucacuggucccagcagaugucaguauacaaaacauaaucaaucccugggcaaucuugugcucuacuuuaucuucauccuuagccacguccuccugucauuugucucggagucacguuuuggagagacaggaaguauuaucuuagaaacuagguugggaaaauguucaacuauagagcugagauuuaaauuuugaguuuaaaaauguacaucaggagcaauggaaaggguguuuucuuaaaggcauuucuaauuugcuuuucuguguguaugucuguucuguaaauaauuuuuucauuuuugaaaguggauaaaaucuguggauuuucccucuuaaaacaacacaaaaauaaaacuuucuuuacaugcaaauaaauuucuuugauaaaaagaaaugugccucuguguuuuuuauuguuuguuguuuuguuuuuuuaagauagauucucacuaugucccccugcuggucuggaacucacuguggagaccagccuggcuuauguuuuuugugacuagguuucauguagcccagccagaccuuuaacuuguauugcugaggcgaaccuuaaacucuuuuaucuuccugcauuccucucaagugcuggggcuuuuguugucugucucuagcaagcccagaaggauucugaccucaagcaguccuuaagcggcauuacagguugggauuaccuugugggauuacagucaauauaaaaucauauucguugaauauuuccauuuguuaaccucucaaaaauccaaauuaauuagaaacccaacagcuucacugaguacuguucuaaaugagcccacagcacaguugguagaccaaugaggccagauuuuuuuuucuuucccauacuugucugucaacuuuucucuuucucaccuuuucuugacuugcaguuaaaccuuuaucaguaauucuugcugggagaaacagcuuuuggaugccacuaaacuuuguuuuuuguuuuuccccacugccugaaguaaauacuuuuaaaagcaugggggggaggaagagcuggagagauggcucagagguuuagcgcacugacugcucuuccagaggucuugaguucaauucccagcaaucacaugguggcucccaaccaucuguaaugggaucagauguccucuucugcuguguacucaauuguguacucauaugcauaaaguaaguauuuaaaaaaaaaacaugugggacucagaaugucucaugugaacuagguuuuugugggccaaagaacuaaguuuuuuaaagguaguuugcuuaggaaugccucuucagggaaaaaaaaaaguucugucaggcgugacaaaugccuuuaaugccagaacuggaggcagagacagguggaucucugacuuccagacgaccagaacaggcuucauaaacaaucucaaaaaaaaaaaaaaaaaaaaaaggaacauuuuauuuuagggacuauaaaucauaaguuuuuuuuaaaaaagguucacaacauuuugcucuuuuaguuuuuaaagaggaccagccuuucucucuuuuuguacacauuugcuuauuucauguauguggguauacuguaacacuuuugcucuuaaaaguucaucuuuuucaaguucuaaaacuaaguagaaaaggucugacgacaaacucguaauugcuuugagcauaaaauuggaagcaguauuaaggucuaauuaggacggcugggauuuaugguaguuuuuaauauuucagguuugguacauuuuguaaugucucugacggagcaauuucacucucgguuguuucauaauucguggaaaauaggucauagauuuuggaagucuugaaggcuggaguuaacaaaaagaugacagacuaccuuuuauacuaggagcgaaauccaauggaagaguuuccuaugggcaaccgcccccgccuacucgcuccuacaugcuuguuucucccgccgaaauggcgucacgccguggcucucacgaaccagcucuccgauuggagggugagcagccgcugcagcccauugggcgccagcggccggaggggcggggacgccaauggcccuugugccuugcccgcccccacccgauugacgccagccccucccccggcccaaggaauggguacugggcuggggcauugcacccccugaucccgagguguagccucgcugccagcuccugugcagagcuggcgcuacguccuccucuuagcgcaaccagcuccugccuucuggagccuggcacugagagccauccgccccgcaggggccccccaggccucccugcagcaccccguaaugcaauucaccggggugggggaggcggcggcagcaccuacggcggcagcggcggcggcacugccccaaccuagagacgucuagaaagaggaggaaaauggcuccgagcagggaccgccugcugcacuuuggguucaaggcgacagugagugauagaggacgggagcuggguggucagaaagacgugggugccagcucaggccgccggggaagugaucagaucagagcuggggacccuaggcugaaagcucagguuccgcgugggucgcuacgugccagugagcccucgcagugcuggaggggauccggugauguuccugucccuguucugcucuucucgccgguccgcgggcacgcgcgcacucgcacccgccccacagcacacacaccgugccccccccccccacgcccgcgcgcgcaccgaagcaggcgcgcacuugggcacuucccugcuucuccuuguccuggugggcuggcgcccggucaccccacguuccaggcgcucgcgggcucaccguccggggcug

SEQ ID NO: 6343 - RNA, 41142 nt, Mus musculus
cgaucuuugggaaguuccguuggggaagauggcggcggccgcgagcacccuucucuucuugccgccggggacuucagacugagccuuccccggaagagucggggccgcuggugcgccgcuuccccggagcccaggcuaacuugguuccccucugaguggcggggaaaggcuccccggcucguggcggacccaagaccuccccgcugucaggaugaaggcucagggggaaaccgagggugagugacugggggguggcggggaaggaggggcgguacaccgcugcggcgagccaauccgagagaggagguggggacccacgccccuccagggccaccgugcgugggaccggauccugguggaaugugcaucuuagaucccgaccgagcccuacagaugcuggagcgccuccuccggggcgcugcucccccgucuccuccacucgugaaagguuuucugcgggacgagggacgaggaaguugagccucaggguacuuugagcuuagcccggugggacccaaggagagggaaacugaaacuuguugaugcuuuguuccaggagagaucgcugaagaugacacuagaacaauguaaugucaaaguaauggaggguguuuuagccggagugacuugcuugguucgaucuucaucauaguaaaagcgggccguuuauuacuuggaaggucauaguguucaaauacugugcugugucuuuacgaacugcuuucaguugugcacgaccgguggcuuuaaagcuugggggagagguguucagaacuauaaacuggcaggaacaauccccaaaccaguuucccaguugagggaagaaaagggaagggauagaaucuucuuuguuucuugagacaaggucccccugccucagccucccaagugcgggcuuacacaccucucggccagcuaagaguuugauucuugguucagauacucccucccacgaccuggacuggcuuauccaaaaaugaagucucgacauuuguagcaaaguggacgauacucaaaauaagccauauuaagauaaauagcacauuuucucuuaugaggaaucucgacguagguauguguugguguguguugguugugaaaacaugggaccaugugggaacaaaggaggucugcaggauagaaagguuaguggaauaugaaaugaagugagagguuuggcuguuuggagguuggggcaguguggcucucagagggagaggacuuggaccaaguauaauggccuauauguauaagaaugccaaaaugauaugcauugcuuuguauguuaauuuaaagauaauuuagaggcugggaauguagagcagugguuagaguaaugucuucuuguccauggguucaauucccagcaccaaaagaaaaggaaaaagggagccaggugugguggcccacagcuuuaaucccagcaccugggaggcagaggcaggcgguuucugaguucgaggccagccuggucuacagcgugaguuccaggacagccagggcuacgcagagaaacccugucuccaaaaaccaaaacaaaacaaaacaaaaaaaaccccuaauuauuuuuuuuuuaaagauuuuauuuauuauauauguaaguacacuguaguugucuucagacacuccagaagagggugucagaucucauuauggaugguugugagccaccaugugguugcugggaauugaacucaggaccuucagaagagcaguuagugcucuuaaccucugagccaucucuccagcccuaaaaccccuaauuauaauaacgucuuccuuaaauugugcuccaaguauauccuucaagguguugugagcccaaggguccagugagaaacccugucuuaaaaacuaacacgcaaagagccaacuggugaugguuccugccuuaguccuagcacuuaguagaaagaggcagguggaucccugaguuugaagccagccagaccuacaaagagacaagacagccagggaagcucugucucagccguaccucauagcggcacacacccauaggaggcugaugaaaggagacaagaggaugccuuagagcauagucugggcaagccugggaggugacccauguuuauaauccuagcacuucauagguagagguaggaguaugaggaggucaccacuuacauuucuuuacuaggagguagggcaucuaccauauccacugugggcucuggggcgugaacccagacucucauguuuggcauugcgggugccucuacucuuguagccaucuugucagcccucaaggucauggucagcugggcugugagagacugucucaaaauggaagaaaaaaagcagggagguggcuggagaucgagcugaggguuuaagagcccugugcuuuuggcauagguucagguuugguucccaggaaacacauguccacguagcaacucacaagcauuuguaacuuuaguuucaggagucucggugucuucuggccuccaugagcacugcacagacaugccacacauccaugagucaaaaaaucaaaacaauaacagcaacccuucccccaaaaaaacccaaaaaaaugcauacccaacauauuuuuuuuugaaauaaagaauauguauuucauguguauggugguuuuaucucccuguauuucuguguaccaaguacaugccugguguccuuagaacccagaagaggagagcagaucuccugggacuggaguugcaugugacugugagcugccaugugggugcugggacuugaacccagaacuucugaaagagcagcuagugcucuuuaaaggaugcauugggcauuguagaacuguuuugaugccaguacuuaagaggcagaggcagguggaccuuuauuuguucaaagccagccuuuuuagacccuaacaccagauaaaacaacacaaugcaucggggccuggaaggucccauguacucauggugaaaggugagaacuggcugcagaaagccaucuucugauccccacaggcacuguggccaguuuacaccuguguucacacaucacagacagccgggcaugguggccacgccuuuaaucccagcauuugggaggcaggcggauuucugaguucgaggccagccuggucuacagaguuccaggacagccagggcuacucagagaaucccugucucaaaaaaacaaacaacaacaaaaaaagacauccucacacaaauaauaaacacagucugguuugguuucuaguaguauuuucaauguucguuuuauauauguggaugguuuguuugcauguaugucuaugcaucgcauguguggccguggaaaccagaagagggugucagaucccccggaacuggaacuggaguuagaaauguuugugagcugccaugugaaugcugagagucucacucagguccucuggaaaagcagcaggugcucuaaccacugagccauuucucccuugguuuuuauuguugcugucuguuuuaagacagggucucauuaugcagaccagacuggucuugacaugacaaagguaugacugcuucugucuccugaguuuuaagauacaaggugcaugucaccgugccuggcauaaaaauaaaauuuaaagcuaucuucuaagcuggacacaguguguaccuguagucacagugacucacgaggcuagggcaggggcauugucggugcugaagacuccaaggccaacaaaauggacaacuuaguaagauucugucuccaggaaauuacguuagacaaccuuguguguuguguauauauuugagacuucgauuuccuuuguagcucaggcuagccuugaauuuacaaaccuccugccucggugucuccagugcacggauggaauuuaugggugagcauuuuccuagcuggcuuucuuuauguuuuggaguacauuuauauaaaagugcuuugacaguuccuaagugaaauacagggguucuuuuguaggagaaacuguggaagucuugaugucagagugucuaauggugguuucugcuuuccgucguagacucagagaggcugaguaagaugagcucccuccuggaacggcuccaugcaaaauuuaaccagaacagaccuuggagugaaaccauuaagcuugugcgucaaguaauggugaguauugggaagguacugagaauuacugcccaguuguacacaacucaugcugaaucuuuaaaggaugcauugggcauuguagaacuguagaaauaucacuuucaguuaugucuaaagaaauuaauuaaaaaguacuuuguaaaaaaaaaauauuuaagaagcuaguugccaggccgggcuugguggcucacgccuuuaaucccagcacucgggaggcagaggcaggcuaauuucugaguaaaaaaaaaaaggagaagcuagcucccgaaugcgcaaggguugcuagauccaaugcuguguccgugcuuuuacucaucacaaaacagcauggugguguugauuuccaaggccagcucaggaagaaugugccuuaggaaggagguagcuugaauucccauccacagaggauuuauucuaggaccucucacagaucagaggcaagcagguaucugaguucagggcuagccuaauuuacagaguggauuccagguaagccugggugacacagagaaacccugucuacaaacaaacaaaaaggcauugucuuugcacacuauuuauaaacauucuccuauauacuuuaagccaaucuuuacauuacuuacaacgcuuaacaauacaaauaacaugacuauuuguuaugcugugauguuuacugucaguacagaacaguauucuuuuccuuuuuaaagauuauuuauuuauuucauguaugugggugcacugucucugucuucagacacaccagaagagggcuucagauuccauuacaaaugguugggagccaccaugugguuucugggaauugaacucaggaggaauugaacucaggaccucuggaagagcagccagugcuguuaaccccugagccacuucuccagcccacaguguuuuuuuucuauuugagaagcagucuuugguguccuucucuggccuugaacuuguuuugguggaacaauugcgaaagcuggcauugaauuuguuguguauuucaggcaggcucugagcacccguccuuguuguguuucagcuucccagguaucauagaguccuucucagucauugucucagucagcgucuucuguguagcuuagguuggccuugacauugcuauagaucugagguaguccugcuguagcuucccaggugcugaggugacaauugugugccaccauccugcucucuucagccucucucuggucugugugaaguagggccucauugagucuuuagguuuuaguuuuguuuuugccuuuguuccgucucguucaguacccguucacuguucaugucuuucucuguggugcuucugaggggugccccgugcggugcuacuugaacuacucaagugggagguggagcacuggaaggcaggcuggcugugugcuaaguacuccuucaagucacucagccacagucaaaggacagggauccacuugguguugguucucuuagguuuaacuuuucuauauauaaauuacacuuuaaugagacuauuucguccucccuauaauuucaacauuuuuauuaccauuuaucuggccaaucaucagaauauuggcuaguggaagaacuaaauuuguuaauaauuaauaaggaacuauaucuuauagccaagggguguaauuauuucagugguugaguguuugccuagcauguauaagacacagucauucacuagcaucggaggaagaauaaaccagagccaaagccccuggacgucaggcuccauggcagugcuugccacuaugugacuuugagcaaauucuguaauuguaaucucugugaguuuguuugcucauagaagcagaugaugcuagucugcuuaucuaagauguuuugcuuugcuuugcuuugcuuugcuuugcuugaguguguguguguguguguguguguguguguguguguguguguguguguggucugcauggucugcauaggugccuuuguacccuguguguuccuggugcugugggaggcaugagaucccuuggaacuugagucacagaugguugugagccccugugugggugcugggaguugauucugaguccuccagaccaaccaguuauccacugcugagcaucucuccagcuccuuuuccaaauaguuuaguuguaaagaucaaaugagacagacaugaagaaccuggcagugguggcacacgccuuuuuuuuuuuuuuuuuuuuuuuuaauuuauuuauuuauuacauguaaguacacuguaacugucuucagacccuccagaagagggagucagaucucauuacggaugguugugagccaccaugugguugcugggauuugaacuucggaccuucagaagagcagucgggugcucuuacccacugagccaucucaccagcccccguggcgcacgccuuuaaucccagcacucugaguuggaggccagccuggccuacagugugaguuccagcacagccagggcuacccagagaaacccugucuugaaaaaaacaaacagaaaaggggggggggcuagauaauggagggugaccuugaaaugaccuuuaucuccauauccuucuuccaccaaaagcccugagauuacaggcaaaggccacucugacuggucacuguuugcuggagauugaaguuggggcuuggugcaugccgggccauugcccuccauucugaaacuauggauucuaucaguaaaugcaugugcauccuccuuuaguuugcaacuaaaaaaguacuuuuaguuuuuauuuuguuguuguucaauaguuuacuguuuugaggcaggcuguuacauauuccaaacuguuuucaacccuguaauucuccugccucugucuccugagugcuggcauuugaagcuugcaucacucuuccauuacacuuuuuuaaguacauuuauuuaccuuuaauacagaggcuuauuguauagccuaugugggugcagugaacuaaacucaggucuucuagaacaacaagcacucaugauugcugauccaucucucuccagcccacccucuucuguuauaaaaagaagaauuuuuuuuuuaaagauucaaugucauuauuuauuuguugcucuuaaagacucauuuuugacuggacucagacuuagaaguagaagcucucagcgaggacagccuacgucucuuggcaaucuguuccuggcgcuuuucuuuggcuuccuucauucucuuggccaaaaguuuagcauauucugcagccuccuccuuguucuucuuagugcguuguuucuucagagcaauacaucggaguuuguguugcaggacgcauggaguaacaagaugcugaaucuugggugcuuugguccugggcuucuuaccuucuuuguuuaagggcuuccugacaacauacuggcugacaucaucuucuuuagagagauuaaaaagcuuucggauucuacuagcucuuuuaggucccaaccgaggaggcacagucgugucugucaguccaggaauauccuucucuccuuucuuuacaauaaccaaguugagaacacugagauuagcauccacgaugcauccgcgaacagacuugcgcuuccucucuccaguucuccuuggucuguaacagggaugcccccuauucaacagcaggcgcacucugccaugggucagagcaccgugcuucaugggaaaaccuugcuugucauucccaccacugauccggaccacauaacccuuccacucuucaccaagagcauuagcggcuacuuccguggccaugugcuucucauagaagauguggagcuugcgcucgucaaccaccucgaugacagccgguggcgggaaaggagauguucaguuucaucuugacacagcugaccgccugggaggcgucacgaaaaagaggccaaaaagaggauuuuuaaaauaauuacuucaugugugucuaucuguucaucaguuuuuggagacaguuucuuuguguugacuuggcugucuuagaacucaauuuguagauuaggcuggcuuggaauuuacagagauccuccugccucugccugcugagugagagcugggauuaaaggcauggccacuacgacauuuuuuuuuuuuuucuaaagguuuacuuauuuuacuuuguauguauggguguuuugucucuguauguauuuggaccaugucuguaccuugaggccccagaggucagaacagggcaucuguugaaucccaugauacuggaguuacaggugauugugagcagcccuuggggaugcugggaaucaaaauuggguacucugcaaggguaacaaguacuuuguuuuauuguuguugguugguugguugguugguugguuuuucgagacaggguuucucuguguagcccuggcuguccuggaacucacucuguagaccaggcuggccuggaacucagaaauccgccugccucugccuccugagugcugggauuaaaggcaugcaccaccaccguccggcuugauaguuggauucuuaaaaguucuaaacuucccccaaguuuagcuuagaugcuagaauuccuuuuuacuaucauaucauauugguauggauauauucacuuauaugaacuuuucuuccuuuagguagaugaacagaauaacggucuauaggcucuuugggcuuggugcuauacaacucaaaucucagaaagauggccauucuaggcuauaagaggaguuccagauccugucuuaagaaagcuaaaauagagaugcccauuggacaggcaaacuuuauaugccccaguacaggggaacgccagggccaaaaaaugggaauggguggguaggggagucagggggggauggggagggugugggggacuuuugggauagcauuggaaauguaauugaggaagauacguaauuaaaaaaaaaaaaagaaagaaagcuaaaauaguucgggcuggugggauggcccacuggcuaaggacuugcugccaagaguuguggccugaguuugauaucuagaacucauguugugggacgccgugacaguuuacucugaccuccaugugcccaugcuccuuugucucaugcauacaaauaaguguuaggaaacaaucccccauacaaaagacaacuguucuuaggaaguggaggccagaggaucagauccaaggucaucccuggcuggcuuggagccuugucucagcgaaaggaaagaaucuguagucuaauuguacuuuaguucuauuaguaauuugacaucuguuuaccugagacauugcuaugguugauauuuuuacuuaauucauucuguaauuugauacaggagaagagggucguaaugaguucuggagggcaucagcauuuggucagcuguuuggagacauugcagaaggcucucaaagguuuguauaaaccuuuauaauauauugaucuuaauacucacauuaaggauuuuuaugagaaggccaacuuauaaauucaauagaaauauaaauuaagguagaugaugacuuucuaugcuagauguugcuuuuguuuucauuuauggaguugaacucaauuuguuccugaaacuuguuccugaauuuguaaauuuuuuauugacuuguuugcuuuaugauuugcaugugugcguauauguguuguaugcaaaugugcauguguaacaaagcucauggagguuagaaaucgcuuaugagucagcuuuuucuacuguacagucugggacuugaacucagucugucaggccugcaagguaagugcuucuuuccaauuccaaaaugaucuaccucauuuugaaucauuuauuaugaaucauuuauuuuugagacuggguuucacucuguagcccugguuggccugaacucuacuguguagaccuuaaauucacagagagcugccugccucugccucccaagccaagggaccaugggguuaaagguaugcgccaccaagccuggcuugaaacaaugaauuauuacuuacucugggcuuuugagauagggucuuaguauuucaggucaaucuccuugucuauccuuugaucugaagaucuuccuaccgcauccuccugagugcugggauuguaggugugugcucuaauacaggaguauaccuuuguuuaugaugcuuggcugcuaugugcagggccaucaguucugguggggagggggagaaggaauaauacuauaucuauacuaccuuuuuguuuuauuuuuuaaucuguuuagauugauuuauuguauaugugugaauauuuugccugcauauauauguaugugaacuauaugaauauagugacaauggaggucagaagagagagagucagauucccuggaacuggcauuacagauggcugggaaccaucauguggguaccuggagcugauccugggucauuugcaagagcaacaagugcucuuaauucuugcgcacgcuccacuggccaggaagaacgacgcugcaacaggauccuucugcacaugcuuauugggagagcuugauuguagaggcgaaaagaccccaagccagaacuggugcugcuuuuauaggccuaggaggggcgugucucacacccggauugguuaugcacuaagccucauuugcauguuccucaucugauuggcuacucucucucaguaccuuacagaaccucauuaucauaccucauuugcaugucucacaucugauugguuauacucucaguaccuuacagaaccucauuaucaugccugggccaggcagugucuuugcaaaaaacuuuacugcauauguacacauugguuguuuguccaaucuuaugcgugguggccagcaguagucagugccacucagcaacggcacauguggcuucccacacuuaauugcugagucacaacuccagccacucccauccugaguuugagacaggguuguauaguauccaggcaggccaaaaccuccuuauguagccaaagauggccugaucaccuuugcuuucuucagugcuggcacucuauggaugaugccaucaugguccuccacugcuuauucagccaucuguucauagacccguggauugauuuuguuuggugccagaagucaaacccaggacagcacacaugcuaggcacgcacucuuauugcgccucagcuuccuugcugccaucuucauucuuuuguuuguuuguuaguuuuuguuguuuuguuuuuguuucagagacaggguuucucuguauagcccugacuauccuggaacuuacuuuguagaccaggcuggccuugaacucagaaauccgccugccucugccucccgagugcugggauuaaaggcgugcgccaccaugcccggcuccuaucuuugacuuuuaugaguacugugagaauccuuuuuuuguuguuuggggagcuaccaguugaacuaaggggaguucacagcauguaaaguacauguucuugaaacugaauccaauccuuugggggccuggagggauggcucugugguuaagaacucuggccugucuuuuacaggacuugaguucaauuccuagcacccacaugacagcucacaacuguguguaacuccaguuccaggggacuuagcaucuucacacagacauacaugcaggcaaaacaccaaugcaauaaaaaauaguacagccugggcucccuuguguucucaucguuacccuucucacucuagcauugacagccuaggagucaacccaagaggggcaccauucugccuggccagcuuuguauuaguuccauaugcuuucucuuaguuaaagugaccuugacccacauagguaauaauaaaaaaggagaaaaacauaguuugguaguauuucuguucccuuuuuuuuuuuuuuugucuuuuuuugaggcagagucucauagacuagucugacuugggaauuauuauauaaugcagaccaggacuggcauaacagguguccauugccaugccugguauucauauuuuuuugucucucuguaucuuguguuuuaaggcaggguuucacuauguggcuaagcuaaggcugaccuugaacuccugauccuucugccucugaccacccccccccccccaaaguguuagcuaucauuauacagguaugugcuagcacaccuggcuugacucuauaauuuuuuguuuguuuuuucuuuagcuaucuaucuaucuauuuuuuuaaauugugacagaauuucuuuguguaacccuggcuguccuggaauucacucuauagaccaggcugaccucaaacucaccaaaauccaucucccucugccucccaagugcugggaucagagguguauaguucagacucaggccugccucugccucuauagugcugagauuaaaagcaugcauuaccagugcaggcuccauaauuaucaaauauaucuuuuaucuuggucacuuuuauuucugugacaaaauucuuaaucaggacaauuuaaggaugaagguuugacuuuuugcggaggguauaagucggaggguauaaguuggaggguauaagucuaccguguggggaaagcauggcggucagaaugucaggucacagugaaccgaugucagaugaaugcuggcacucaugugcuccucgguccuuguacuuaguccuaaccacccauauucagagugggucgcuucaguuagaccucuuuagaaacacccucaaggacaucuacagcagcaugucuccuugguacuucuacguccaguccaacugacaaugaagguuaaguaccacaaucuuaauauccucuuaccacuugucaccguguccuuuaccugacuacugggucacagccaagccucaauaaacuugcugcagauuauaggugucugaacuauugaauauguuuauggcuuuggauggguagauauacuccuucuuuuggaauauucuuuaugaauuucuccccccaauccccauuaucuuuuuacaguaacaucuuugccagcaaugacugaucguuuggaaucuauagccagacagaauggguauguaauuuuaucugugggcaaaaauguacaacacagugcuaauuuuggggagcuuucucacgugucuuguauuaaucuuuguuuugauuuguuccugcuagacugggcucucaccucagugccaguggcacugaguguuacaucacgucagauauguucuauguggaagugcaguuagauccugcaggacagcuuugugaugucaaaguggcucaccauggggagaauccugugguauguguugauauuucccuggaaucuaugggguuuaccuaggaacauacuuaaaaaugaauuguugggguggguauagcuugucuuuuaggguuuuuucaugagccacuguagagaugaugugaugggccacacugguaguuuuagaauaaaguugagaauaacaggucuuucuggugucaccaagggcuuugcggaauagaaguaccaacuauagccaagcucauaguaacaaacuagagcuuggguugaacaagagaaguucagaauacagaaacagucuuucgaucccaucaaagugauuauaauccuggcagacaauaugaacgguccuggaguagaaaugaauguaaaguguguauaaccgagcaguucuauguagauuccagggaugauguugaagaaagaaacuacugacuaccuuuauaaaugauuuuauuuguuuugauuuuaaaagucccaccccacguuuaugguucacuaguaggaaaggcuuuugaggggcuaggaagcugacucuggguagugccugaggaccugcacuuggguccuucccaccacguaaaggguguguucauaccccgggcuagaacugcuggggcaagcgagacaggcagggccgggaugcuugcuggcuagcuaccuucagggaagcaccaagucuccagguucagggggaccuugucucagaaugcauggaggaggacagcgauagaggaggauggcuguggucuacacacacacacacacacacgucagggcuuucugugcuguuaauguuuuuguuuugaagcaugugcuauuaauauaaaacuuuucgauguuuuucauuuuguuaauuaauuuaaugcuuuaaccuaauuucuuugguuucagagcuguccagagcuuguacagcaguuaagguaagcagauaacauugauauauuucuuggcacugacauuggcauugauaaaauccuguuuucuggagggaaaacucggacuuguggauuuauuuauuuaucuauuuauuuaugguuuucagagacaggguuucucuuuauagccuuggcugugcuacagaacucacucuguagaccaggcuggccucagacucucugcccucucagugcuggguuuaauggccugugccacuauagccuggcugugaguuuauuuucuuuuucuucuucuucuucuucuucuucuucuuuuuuuuuuuuaauuuauuucuuauuguaaacaagugcacuguagcugacuucagccgcaccagaagagggcuucagaucucauuacaggugguugcaagccaccaugugguugcugggauuugaacuaaggaccuucggaagagcagucagugcucuuaccugcugagccaucuucaccagccccgaauuuauuuucuugacuuucugucuguuccuguuuaugauuagaauugaguuaacagagccugguggugguggcacacaccuuuaaucccagcacuugggaggcagaggcaggcaaauuucugaguugaaggccagccuggacuacagagugaguuccaggacagccagagcuacacagagaaacccugucucgggaaaaaaaaaaauaaaaaaauaaagaauugauuuaacacgacuuuuuguucauuguuugaaacaugguuucaugugaccuagacuggcuucagagcucucuguuuagccaaguguaaucuucaggucccaauccucucucuuagauguuggaaauagaggcacaaagcuuauaauggacuugcaacuagccuuagauuuaccauauagucuaggcuaaccuugaacuuuuaauauucuuuaaacuugggcuggagagauggcucagugguuaagagcgccgaaugcucuuccagaggucccaaguucaaaucccagcaaccacaugguggcucacaaccauccguaacgaaaucugaugcccucuucuggaguaucugaggacagcuacaguguacuuacauauaauaaauaaauaaauaaaucuuuaaaaaaaaaaaaaaauauucuuuaaacuuauuuaauucuuguuuguuuguuggguuuuuugaaacagggucugguccugaaccagacucaagcucacacaacucugccugccucugccucccaggugcuggggcuaaaggugugcacagcacuauggcuggccuuuauuuuacuugcuuuugugugcuugguauugaauccaagguuuuguucauguuagucauuuuacauuauucacccuuccuccccaggccuugaacuccuaacccuccugaacucuccuguuuccauuuguauaaugcugagguuguaagcacccuccaucacacccagucuugagugugacaauuuuuuguuucuuuguuuguuuguuuguuuuuuucgagacaggguuucucuguauaguccgggcugucuuggaacucacucuguagaccagguuggccucaaacucagaaauucaccugccucuuccucugcugagugugacaauuuuuaccccuauguucaguuucucacuucaguauuauagguaauuuuuauauuuuuaaauuccuuuuugaggcaggauuaccacuggcuggccuggacucucuuuguagaucagauuguccucaaacucacacagaauccaccugccucugccucuggaacgccuugacuaaugguguguguuaguagcccuggcuguguuugucuuuuugaaacagugucuuaucuaguccaugcuggccuccugcucacuguguagcuaggacagucuugaaugcuugaucucagaccucuuuucucuaaguacugagguuacagguacgcaccacuucccagccuuauuggcauuccguugccaaagugaauuuacuugauauauugugggucguuuaucagcaucccuggccucuuuuuuuuuuuuuuuuuuuuuugguuuuuuucaagacaggguuucucuguguagcccuggcuguccuagaacucacuuuguagaccgugcuggccuugaacucagaaaucagccugccucugccucccaacugcugggauuuaaggcgugagccaccacacccggcuguccucuucuuucuuuggacuugacaaaaguauccacucaauugugauaaucaaaauuaucuggauaaggacuggagagauggcucagugauuaagagcaccgacuucuccuuuagaugucuugaguucaagugucggcagucacguaguucacaaccaucuguagugggauuugauuucccucuucugaugugcaugaagguagaacauucacauacauacauacacacacauauauauauauacacacacauacauacauauaauaaaauaguuuuuuaaaagcugugguucaauuaaaacaaauuauaugagcuggagauguuaacucaguaguggagcauucgccuaguguguacacuuggggauucaguuucuuccagcaucacaacaaucaaaacuauguacauagauacauauuguauauuuuuauuauaugcuuauguuuauuuauguuuauguacauguguacacugcacgcuuacacauacacaccuugacagauguaugcaggacaaaaucacaacuggguaagaagugcuaaaagaaucaugggaauucuuuguugaucaaaagugaauagcauucuaggcaugguagcacuugccuuuaaucccagcacuuaggaggcaggcagaucucaugaguaugaacacagccugaucucuagagugaggaguuugaaggcagugagugagggcuguucaaagaaacccugucucuggcuaccccagugcuaccaguaaaggugcucaccaacaugcuuuuucauucucucuuucucucucucucucucucucucucucucucucucucucucucuuucuuccuuuucuuuuucuuuuuuuuuauuucuuuaauauuuuuuauuacauauuuuccucaauuauauuuccaaugcuaucccaaaagucucccacacccucccccaccacuucccuacccacccauucccauuuuuuggccccaguguuccccuguacuggggcauauaaaguuuguguguccaaugggccucucuuuccagugauagccgacuaggccaucuucugauacauaugcagcuagagucaaucuuucuuccuuuucuacuuuuuuuuuuuaaacucagucugguaccugaguucauaggacuuaccacucacaucuuagacuggaucuugccaggucaguuggucuaauguacccaaucccuuacagauuugcccagagacuugguuccauggugauucuaaaucccaucaauuaacaauucagauuaaucucaucacaaaucacuaccauugaauuggaaauuguauaagaacauugacuccaaaccauuaauacaacauuuucauuucaacuuugagaaaaagcuauguccguguauuacauauaaucugucacaguaaaaguaguagccuugacaacagucuguuauuuuugguugcuuuuccugccauuuugauuuuuuucccuuugaacugaguggaauuccuguguuuaaauuuaaacccagacguaagacuuucugguaauuugaagaaguucauuuuuguuuugaauauugaacauaacuggauaucuuagaaagacuucacuuugaggaaguagguuuuauauucaggcuuuuuauuagcaguuuauuauauuuauagccaaauauaccaaauuucaaucuuuaaaauguuugguuuuuugaauuauuuauuuuauauuguauaugugaguauuuugccugcauguggacaguugugagcuaccauuuggguacugggaacuaaacuuggguucucuauaagaacagcagaauuuuuaacuacugaaccaggucuguaaacauauuuuaaaaauuguuauacagccagaccaugaugguggcacaugccuuucaccucaguacucgggaggcagaggcagguggaucucuguguuugaggccagccuguucuacagauaaguucuaggguagccagggcuacagauaaacccugucuugaaagaccaagaccaaaccaaaccacaagaaaagauguaauauggucaaauauauugguaugcauacaucuguaauuauuuccaguaucccagaggccaguguaggggaauuguugugaguuugagcuuugggcuauauaauaucaggcuagccugaguuacauagcucuacccuaucuaaauaaacaauggggcuggagaaauggcucagugguuaagagcacuggcugcucuuccacaugauccagguucaguuccuacaucuguauauuacuccaguugcaggggaucugacacucuuacacauacaugcauguaugcauacaaccaaaaauaucggugcacauaaaguaaaaaugagcgagugaauuaauuaauuaauuaauggauaaguaaauaaauggugauagucuaaaauaagccauauaaauauugcauugaaacucaccaagaugugucaucagaauauucuagaaugagugaauauuucuggccuuuacuuggaguagauuauguuaacuuaugaauuugugauauucuaaaauuaauuuguaaacuuauuugaagggggugauuuauaauggaacuuuaucuuuuuuuaaaaaagauuuauuuuauuuauaugaguacacuguagcugucuucagacacaccagaagaggcaucagaucccauuacagaugguugugagccaccaugugauugcugggaauugaacucaggaccacuggaagaauaguuagugcucuuaacuacugagccaucucuccagcccaauggaacuuaucuuuacaucauauuuuuagucacuuaguaugcauggugauaguguguuagggaauauaucuuuuuacugccacugugcuguucuguuuaaacgcuuacagcauugagaauaaacuguuuagccuuguuguagcuaauuuguuuuagacccuuuuuucuuuaagauuaaaagcaguggagggggagggacagcaugggugcauguaugugugcaugccuuuuugacuuacuuuuuuuuguuuuguguuuuguuuuuuaaagacaugguuucucuguguagcucuggcuggccuggaacugaauuuguagaccaggcuagccucaaacucagaggauucaucugagggaaagauuuauuuauauauuuuaugcguaugaguuuucugccuacauauaugccuacaugacagaagagggcaucagaucucauuauagauaguugugaaacaccaugugguuccugggaauugaacucauguucucuagaagagcagacagugcucucaaccacugagccaucacuccaggccucuugcuuucaguuuuuagaguuuauguguaugaaugucuuuguaccauauguguccuaugucuauaccccauaaguacugagugcuaugggggccaaaauagucuaccagacgccuuguugguggaggugcagacaguuguaggagcuucucgggagcagcagccagcacugggaacuguggagccaucugcaacccagcuugcuuuucuuccuuucuagauuaacuauacgauuuauguggauagaggugugagcagauuauuaaaugaguuuggauagccaugguuuuuguagaauaaaguaguaauuucuuguuguauuuucucuuuccccaccuuccugaauucccuuauagggaaaagaauuuugaggaauuuuccaagcaucuuaagggucuuguuaaucuguauaaucucccaggggacaaguaagucauuucauuuacucauuugcuuuccguuuuggaaaaaggaguaugagucugugagccaguuuggguuauacauaccuuucugcuguauguuuauuuaauuuuuauugucuauuuuuauuuuuuaaagaaguauuuauuuguuuuauguauaugaguacacuauggcugucuucagacacaccagaagagggugucagaucccauuacagaugguugugagccacuaugugauugcugggaauugaacucaggaccucuggaagagcagucagugcucuuaaccccugagccaucucuccagccccuuaacuuuuaaauguuuauuuuauguauauggguuuuuaaaaauugguuuggaguuuuuuguuuguuuuaguuuuuuguuuauugguugguuuugggcgggguuguucguuuguuuuaucuccauaugugccuuguuuaucagaucuguaccugugaaggucagaauggacugggaauugaaccuguguccucugagagagcagucaguacuuuucaaccauuaagucaucucucuaguccuuuuuuuuuuucagagcugaggacuaaacccaggaccuuccacucuaccaccaagcgcucugccacugagcuaaauccccagccccucuaguucuuaaaguauuuuauuuuuaacuuuuuucuaucuccuaagguuuuuaucugaaaauggacaugucugcuuuuaaugacuuaaaauuugagaagauagaacacaauuguugaaauaucuucaguguguugauuucauggauucuguuaaacugcuuuacucuuuuaaaggaaaauauauguaaacucugguaguccucccccgcccccccccccaaaaaaaaguauauuagcccaggcuugaccucaguauguauuugaggauggccuuggccuugaauuucucaguuccuuuuuuaucccaugugcugagauuauccuguuugaugggauguccaucuuugauaguuuguauuuuauuuauuucacuuuuuauaaugagcucucacuguguaacuccuagcuguccuggaacgccauguagaucagcugagcucaaacuccuggcaaucugcauaucucugccuccugagugcuaggauuaaguaagguugugcaaaccacaccuuguuuuuuaacuuuuuuuuuuuuuaagaguuaaaauaguuuaauugguucuaaccaccuagucaguauuuuuugguuuucuuguuauuauuguuuugagacagggucucacugaguaaccucaacuggaguagaauugcuuuguagacuaggcuagccugaccuuggugagaugagcuugccucugcuucacacugacugggguugaaggugugugccacuaugccuggccagugacagugccuguaugugcuuauuuaauucaacuguuuaacucauuuucuucucaucuacucucuagcaaacugaagacuaaaauguaucuggcucuccaauccuuagaacaggaccuuucuaaaauggcuauuauguacugguaagacuggcugaugaggccauucuaugacucuuaguuucuccuccaggggauuuuuaacaucuuaauuuuuacacuuauagguguacuacaguauaugcgauuacauaucuuugcauauuacugcguaucauauguuugcauuauacguguuuauacacaauuaugauuugcuguugcuucaaaaugaguauuuauuacauuguauuuucugaguauaacaacucagaaacucauugauaacugagauaguucaguuauugcugaguuguugguuguuauucuauagacuauaucugaaauauuuucaaaguugaauugauuaucugauaguuaucuagaucuaauauuuuauucauuaauuugagauugagugucucuaggacucccagcccggcugacauguaaggugcagcagugucagccacuccgguuacagaauuacgggaugugcauacauuuacgggauguuguacauuucacuguaucucacacugaugguuacaggaaagcagccccguucauggacagugagagcacaucuuaugugugcaguuacaagcggaaguuauuuugauaguaguauaaaacuuuaugaccuuagcucuguaucagacuuuuacugaaacugucaguggcuaaauccagucacacauagauuauuugucuuguaggaaggcaaccaacgccgcucccuuggauaagauucuucauggaaguguugguuaucucaccccgcggaguggggguaaguuagccuuucuuaauuuccuuuuccuuucuuucuuuucuuuucuuuucuuuucuuuucuuuucuuuucuuuucuuuucuuuuuuuuuuuuuaagaaaauguauggaauuaguuuaaaggcuauuuuauuuuaacauggaugugaguguggugugcauauaugugugggggccagaguaggacaggcagccuacccugccauucugcuuuagucccuugaggcaggauuucucagggauccuggaccuaggcuggcaucccguaagcaccaguuagugaucuuccugccucuacccagcacggugcugagauuacagggguuagacugccaugcuaggcugcuugugcuuagcacgcugaccagggagccgucucuccagcacccucacuuccuuuuuuguucuuuugcagugcugggaaucaaaccagagcucugugcauucuaggcagauguucaccgcaguauaucacuuuuuaaaaaaaaauuuauauuuuuacuuuagguuugugacuauacuguaccugucuucagacaccccagaagagggcaucggaucccauuacagaugguugugagccaccaccaugugguugcugggaauugaacucaggaccucuggaagaguagucagugcucuuaaccacugaaucaucuccccagcccauuuuuuguuuguuuguuuguuuguaagauuuauuuguuuauuuuaugagugcucuauuuucauguauacugcaugccagaagagggcaucacaucccauuacggaugguugugagccacuaugugguugcugggaauugaacacacgaccucuggaagagcaggcagugcucuuaaccgcugagacaucucuccagccccagguauaucacuuuuaauuuuaccuugagcuugugaagacagaagcucaauaagaaagugaccauuaccagucauuuuuaaugacuucuaagauguuaauacuuuuccuuguuuucuuugugugaaguauauugcuguuccuagaaucaauaaacuuuucauaagcuuauuuaggacuuugcauauuugugcaacucuuuguuuucuauuuuauuacauuuaucuucuuucugagugugugucuuuuuaaguauguggaggucagagucaguucuguccuagcauaaaagguccuugggaacucagcugucagacuugguagcagguguucuuguuggcuaugcuaucucacuggcccuaucgaguuaagugugugugugguguguggguguaugugcucgcccguguguggagauuuaggaauguauguguguauguuuauuaagaaguauuaaagcuuuuuguaggcaagguaaucacucuucucugagcuguccccagccuuuucuuguuaguuuaagaugagguuucuuuauaggugagugccaccacaaauauaaugaaugcuuuuuuuaaaguauauaauuuauuaauaaagaugccuuaauaacuuuuauuaaugauaggucauuuaaugaauaugaaauacuaugccucuccaucugaccugcuggaugauaagacugccucuccuaucauuuugcaugaaaagaaugguaaguguguguuguuuauguacuuugaggcagaucucuuucuguaaccuaggcuguccuggaacucacuauguaacaaaggguggcugucaaacuuauguauagugaucauauauaucacuucagccuuccaagaacugagaguauaguuaugaacuaccauuccuagcuagauaugguuuuuugagacaggacaaccucuaccucccaggugguggaguuacagcuuguaccacuauguucaccuuucucugauguguuaaaaauguugguaaaauucaacugcccagucuccccggcuaauauucauauaaugugguauuucuuaauuugcuaucuuuauguauguauaccugauauaauacaaacaugucauauguacguguccauauauaucuuacauauauacguguauauguauuuaagcacucaagccuauauauaauauuagcuuaguaaguaaaugagucacugaugaaauauagauuacugacaaauacccagcuuccuuauuacgcuaaaggggaagaaggcuggguuuggugggacaucccagagugcccacagugagguugcucaggcagggaaaccugaguggaagguuaacuuaaacuacauggugacacuuccucaaugauuaaguaaauaacuaugacuuaacugcaguaaugaaugacacuugguguuuuaacuuucugcucuugguguuuugagacaggaaugucauauggccacaccuggggguuggggggaggcagagucaacuggucucagauuuguuauauaaccgaggaugaacuugggacucuguuccucuuaguucuuguauacaccaccaaaccugcuuguguuuggacuaauacagcaaaagaacagaagaacuagcccaggacuuuacuugaccucaguauagcuucaaucauuguccugaaauuguaagcucauuuaaauacauugugaaguugugaaugaaaguaaaaguugauagugagcucuuuaaucauuagcagaaagaaauacugauuguuauggugagguagcuuguaguccuccccccuccccauuuuuuuacaccuuugggcaggaauugauucaggaugacauaggagugcuugcuggcuuguuccuuauggcuuacuccaccugcguccuuuucuuuuuuucucuuuucuuuauauuuauuucacuugcauuuguguuuugccugcacguauguuuguggaagucugagaccuugaguugcaaacagcugugagcugccaugugguugcugggaauugaaccagggaccucugggagagcaaccagugcuuuuuaaccacugaccuaucucuccaacccaagcuuguaacauuugugauuuuugugggauuagaguauguagauucauggugacugauacuguacggguuucuucugcauguuaguuauugguuguuguuguuuugauucuuuuggaaaauaauguuucuccucaggcuggccucagacuuacucuguagccccugcuuaugugcugccuggcuuuucuuuuuuuucuugugcuuuguucuguuuuugaaacugggucuagccuuguagcucaggcaggccucuaacucagguccauuuuccuuucuuguucugcagaaugcuggguuugcacacagggccaccauuucugucuuuuuagugcugagauccuuguccuaguuaugagguagaaaaucuuuuuuucuuuuucuauucccaguuccucggucuuugggaaugaaugccucagugacaauugaaggaaccucugcuauguacaaacucccaauugccccauuaauuauggggucacacccagcugacaacaaaugguaagauaaagauaguuuuaaaguugugucgucuauuuucugagcugcaaccccagugcguuuaucuuucugggauguucggacgucgcccucugcuuccaugcaugcacgccuguccuauacuggaauguuucuacuugaggccuacucagagaacacacauugucacacauuuguguuuuuuuuauucuguguauguauauuuugccugcaaguggguuuuugcaccauccuuuguccuggugcccucggaggcuagaagcagccaucggauccccuggggcugcaguuacagaugguauaaacugccaugugggugcugggaauugaauacaggucuuuuagaauaccaguuagcaucauuaaccaccagguuaauauauucccuauagaccacauucuuuguucugaauaaauuaguuggaguuuuauauugguuuuuguacccagggcuacaaauaggaaguguauucuuucauacugagcuagacccugagccccauuaaacauauauuuuuuaaauacuucagaauuaaaguauuugagaauaagguaauauauuuuggaauuguggucaggauaguagaaaaguaagcuuuugauagacuuugugggucuauguauuauauuauugucuaagaaaaaguguucauagucuucaaaauagaaaauaucccccucuucuuuuuuugaaggaccccuucuuucuccgcagucacuagugccaacaguguugaucuuccugcguguuucuucuugaaauuuccccagccaauuccaguaucuaaagcauuuguucagaaacugcaaaauugcacagguaagcuuuguuuuuuaaaauguuugccagccuuuaauagagguagguuuuacucauugaguuaaaacuuguuaaaaucagaaugaaaaacuucagauuaucuuaaacaauuuacagucuuuuggcuucaaagaagugcugcugaguacagcuuuuaggaaaguacuaguaguuaguacugguaguuaguacugguaguuaguacuggugcucuguaagaacuuuuggagaugugggcagaugcauaggaagaucacaagaagacagugcagcugucacaguuugaucuuacgugagcgauacaaacaguccuuguauuuucaggaaucccguuguuugagacuccgcccacuuaccugccccuguaugaacucaucacucaguuugagcugucaaaggauccugacccuuuaccuuugaaucacaacaugcgauuuuacgcuguaaguaggcccuguggacuugcaacaauguuguuucucuauagcacuagugaggucccuccaauagcuuccuuuuagauugcuacaucauccucaguugggcaaaagaagucaucauaaacaugcuaaagcagaagagaaucagcuuuugaguuaaacagccauguacauuucugucuguuuguauuugaugugcaucaguauuuugcuauauuuaaguauauacauaaccugcuugccuggugccaaagaaguaagaaggucaccuaaacuggaguuauguacaucugugaguggccauguggguucugguaacugaagcuaggcccuccggaagagaagcuguggcuguaaagcaaggagcauucuuucauguccuuuuccuucuucuuccuuucuuccuuccuuucuuccuuccuuuuuuuuuuuaaggauguauuuauuuuguguauaugaguacacuguaucugaacagaugguuaugagccaucaugugcuugcugggaauugaacucaggaccucuguucgcucuggcacaaagauuuauuuuauuauuauauguaaguacacuguagcugucaucagacacaccagaagaugacauccuaucuauggaugguugugagcuaccaugugguugcugggaauugaacucaggaccuuuggagaaacagucagugcucuuaaccaccgagccaucucuuuagcccuuccuucuucuuucuagacagguucucauguaacccaggcugccauugaauuuuagcaagggugaucauaaaccaguccucuagauugcugugacaauaggcaugcugagaaguaucuacagagaaauccaggacugguggaacauggcauuugggaaguggaggcuuaaggauugccuugacuuaggaguagcaaaaccuuuucucaaaaaagcaauugggaaaaaaaucagaauuggaaaucuuuuaaugcuaucuugaacucuuagaaggcugaaagauacuaugaauuuuguuuuguuuuuuugaggccgugguggcacaccuuuaucccagcacucaugagucagaggcauucgagcaaguucuaugauaggcagggcuauagagagaggcucuuaggauuuccauugcugugaagacaccaugaccaaggcaacucgcauaaaggacuacauuuaauugggccuggcuuacagguucuaaggugcaguccauuaucgucaugguaggaagcaugguagcauccaagcaggcauggcacuuguacgguuucaaagcccaccccaauaguggcucucuucuuccaacaaggccacaccuccuguuuuaaaccaccacagaaagcggugagaccugucuuaaaagggggaaaauguuuccuugguuuuuuuguuuuuuggguuuuuuuguuuuuguuuuuuuuuucaagaugggguuucucuguaaugcccuggaacucacucuguagacuaggcuggccuccaacucagaaaucugccugccucugccucacaaguguugggacuaaaagcaugugccacaacugcccuauuuuguuuccuuuuacuuuaauauuuuuaugucuaugagugcucucccugcaugaauauaaguguacuauugcauuugugcauacaugaaggucagaagaaggugucagauucuccuggaauuagaguuacagacgguuugaacugcugugugaauggaugggugcugggaaccaaaucuaaguugucugacagagcaguacagacucuuaacuacugagcuaucucuucagcccuagcccauuaggugcuagaaugagaaaggccuuuuaaauacauauggagaacaaaugcugccgcacauaaaggacgaaaggucccaaaccucaucuggguguaaauugcauaggaaugcauaguuuauacaacuuccaagcucucuaguugcagcuaaaguauaauuauauagauuuuuuuuuaagauacagcuuuguaauucuuuagagacugcuaguguaaauuucuaaggugguuuuuguuuuagcuaaguuaggaauucaccucaauaaugcauucauaaacaaguaucuuuuagcuaaagaauaacuaguuggcauucauaacaucaguugaaagaggucuguauagcuagguaacguuuacuacgucccauacuuugguauuccuccugcccacugcaggauagucuguggcugggcuugguacacuggugaguaaauaccauucauuugcauuccucuuuugccuaggcucuuccaggucagcagcacugcuauuuucucaauaaagaugcuccucuuccugauggucagagccugcagggaacacuggucagcaaaaucaccuuccagcacccuggccgaguuccucuuaucuugaauaugaucagacaccaaguggccuauaacacucuaauuggaagcugugucaaaagaacuauuuuaaaagaagguacucucuuuccuucugaucaacuuacugggagaugggugcucacuucuccagugguuugguuauaguuuauugaaacaacacccagauggcuuuagagaccacagguauuugauuccacauccagagcaaaagaauuagaauuagaaugucaucguaaacaaaacaagcacaaugaggaauuuaguuuagucaccauuaauuauuuugagggaacuaauuuguuacaauugucauuuauaguaaaaaucauugucacuggugugugugugucuguguguguguguguguguguguguguguaaagcaguucucuggauuuacauucuguuucuuuuugccugaaacuucagcugauagauacugacugucuugucuaugagauuuaaccguuucuauugauuuguuuuuauucuugaaaugggcucacuguaagacaggcuagccuugaauucauuguuuuacagguuagucuugaaauugaggugauccuccugcuucagccucucguauguuaacgucaaggucuacacuacccuuccugauuacuucuucuaaauagugacauaacuagcuagugugucuucuuucuaucuuagugcacugagauagauuugucuaaauacuacaguuuagguuguuaugugugguagauuuagccuuuaaaauaccaucccacuccaccccauucuuuauagaauuuggucauauaucuuuaaaagucuaagaucuaugacccuuucuuuuucugucuggauuuuaaagggauacuuuuuaaagacaauuggcuacuugaagcuuugaugcagauuuuggcuacucccaucgaucaguuaguuuccccaggucauacaguguuccagugaugguuauguauuguuaaauaucuaucagcagaaguuuaggcaacaagaaacagaauggaaauccagagaacugcuuuagaaagaugguuuugagacagguauucagauaccccuagauaagauugaacuggguguucagguaaagcugcucuuaaacuccucguccuuggggcuggagagauggcucagcugcuaaaagcacugacugcuauucuagaguucaauucccagcagccacaugguggcuuacaaccaccucuaaugggaucggaugugucugaagacagccacaguacacucauaaaauaaauaaaucuuuuuuaaaaaauuuaaaggggcuggugagauggcucagcgguuaagagcacugacugcucuuccaaagguccugaguucaaauuccagcaaccacauggugacucacaaccaucuguaaugagaucugaccuccucuucuggggugucugaagacaacuacaguguacuuacauauaauaaauaaacagguuuaaaaaaaaauuuaaaaaugagcauuagaaggaaaaaaaaacuuguguggaugguguauguguggguaucugugccugugccacuagaauguuugcuagauaaccaaauaaauuuuaaaaagaaaaaaaaaacaaaacuagauugccugguguggaaucugguguguucauguuuccuuuaauccaaguauuuggaggcagagguagguagaacucugagcuacacagagagacccuuucugaaaauaaacaaacagguuaaaguuguagcauguaaguacaguucuugccuaccacuggugaggcguuggguugucagcccugcaaaaaaaaaaaaaaaagcaagucuaaaacaauauccaaaacgaaucuguaauacauguguauuauguguauguacauguauguggucucagcgcauguugguguuuuguuugguuggcuuauguauuccuguagaccaggcuggccugagccucacagagauccccgaguuugguggaagguggaacucugggauacugagaccagccuggccuacagagugauuuccagaagagucagagcuacacggagaaaccuugccuagaaauacuuaacaaacaaaaugaaaaucgguguuacucaggcuaauguugugcaugacuguaugccagcacuagauaggaggcagaagcaggggcagguagcucuagacagacagugagggucagccaagggcugcaccgggaaccugccucagaaaccaaccaaaccacccuuacugaggaaguuuuacgguaauaguacugauuggccacaucaaauaaaugaaaagacuaauugagagcugggcauggucgugaguaccuguaaucucaguguuagagaggcuaagacgggauuugggguucaagaguaaccugugcuacacaagacuaugucauaaguuacaaaaugaaacaaaagucuuggccauuccugguuucagaauucacucucaauuuaggcuguuuacuaauuuuuuguuuuuaaguuuuucuauguuguaauuauuuuauauucaugaauguuuugccugccuguauguauguguaccuugugcgugccuggugaucaacuggcgauguuacuauuugcauaaagacaauuauuuguuuguuuaaugucuuaaauaugguuaugaucuuuuuccucauuguucagauucuccugggcuccuccaguuugaaguguguccucucucagaaucucgcuucaguguaucuuuucagcacccugugaaugacucccuuguguguggugaguuguguggguggccagccucucuuggggacauccuuucuugaaaaauugagaacccggauggaucacaaggaucacuuccacauuuugucuuucaguggugauggaugugcaagacucaacacaugugagcuguaaacucuacaaggggcugucagaugcacuaaucuguacagacgacuucauugccaaaguuguucaaagguaguaguggcccuuuucuccuaagaauuucacugagauuuguacaguguguggaugcaauuauguauuuauuuauucauuuauuuuucaagaaaggcuguccuggaacucucuauauaccaggcugcccuugaacucagaucugccugcugcugccucccgagugcuggguuuaaaugugugugugcauccucaugauauaucccauacccagggucuauauguuuauguuuaacauaaguuaaaaguauuagaaaaacauugccauuuaaauuuaaauauuuaaauuuacuccuuuuaugcuuugagauuuaaaauaaugugacauuuuuuguuuguuauuuaaaagucacuauguacacaguagggauaaagcuggccauuuccagccuugcuauacauuuaaggugauagagagcugagaaauaaacuuuguuuuuaaagacacacucacuguugccuccauagaauuuacuguuuagaccaggugggccuugaauuccuuugccuugugcugauuaaaggguggguaucuucaugacucgccuaaauuauuagguuuuuuuuuuuuuuuuuuaacauacccucuucuuucacauauaccauguuauauagcuguguguggggaguuaacauuuaaaccagcaaacuuccuggaaacauuaauauguacuuuugaaauuuuucuuucuaaaguagggaggaaguagccuauuuuaaaaaagagauuucauuuacuuacgguuuguuuuuuuuuuaaagauugauuuauuuauuauaugugaguacacuguagcugucuucagacacuccagaagagggaguuagauuuugguuuuuguuuguuuguuuguuuguuuguuuugguuuuucgaaacaggguuucucuguauagccuuggcuguccuggagcucacuguguagaccaggcuggccucaaacucagaaauucgccugccucugccucccgagugcugggauuaaaggcgugcgucaccacacccggcccuagauuuuguuaaggaugguugugagccaccauguuguugcugggauuugaacucaggaccuuuagaagagcagucagugcucuuaaccacugagccaucuguccagcccccuacuuacgguuuuuuaaaaaacucuuauugcucguugugaauuucagauucugcaccacagucccacucauccucccaucccgccacauccacccucugcccuugcgaccucaaaggaaacaaaaagcuuguuuguuuguuuguuuguuuguuuguuuugguuuugguuuuuuugggggggcugaggggaagcuguacugugucacaguguguccugagguaugcccgaaucgcuuuccuuaaaaauguucaaugcagugagucauugaucugguuugaggccucugucuucugcuucacuaucaauacuggauccucacugaggcuccccucagauagucuguuguugcccuguaucauggagauccugcagcuuuggaucugcaggacuggaccuuuauuuaaguuuugaggcauggccuuguguuuuccaagcuggccgugauaauguaauuaaggcugaccuugaauucccaauccuucugccuuagauacccaagugcuuucaucagaggcauaagccacucuaccugguuuauuuggugccagggagaaaacccagggcugugugccugguaggcaggcacuguaauaauugagccccaucuucauccucaaaauagauuuuaauagauugugauuaacuuugauuggaacgcugcuguucauuuuacauauccccagcaccugucaaguaaaacugucaacaucuugaagauaaaacacuuaauaguuauaaugcccaaaauaucaguauuugccucaggguaaaauuuguuaacacacauaguaaagcaaaaugucuuaaaaagucuguugagaauguaaacuuacccagaagcuaaaacuagucugugcuaagauaacuaguacugcagaccagcaacagaacuuuccagaguggcuuuugcuauauuuccuccugaguuuacuuaucaugaccuuuccuccccagguuucuuccauaguuuucauuuuugagacagggucuggcuguuguaguucagacuugccuugaacuugaaguucccgugccacccacgccugacaacuuucuuuuagcucaguguaaauuguuuuuggacucuguuuugguuuuuguguguuucauaagaaguuaguuuucuauuggauugcaauucuuuuuagaaucaauauauccaacaauuuggcauuugucaaauuucucuuguauuacagaguacuugcuuuauguaaacauugcuaacugcuguuuucugaggcuuauguaaaucacaggcaaaaguagagccuuuuguuccaaaugaugauuuuauucaucaccaaugcaguguuaacuuacaugguuuucuccuaucuuacagauguauguccauuccugugacgaugagggcuauucggaggaaggcugaaaccauacaggcugacaccccagcacugucucucauugcagagacaguugaagacauggugaaaaagaaccugcccccggcuagcagcccaggguauggcaugaccacaggcaacaacccaaugagugguaccacuacaccaaccaacaccuuuccggggggucccauuaccaccuuguuuaauaugagcaugagcaucaaagaucggcaugagucggugggccauggggaggacuucagcaaggugucucagaacccaauucuuaccaguuuguugcaaaucacagggaacggggggucuaccauuggcucgaguccgaccccuccucaucacacgccgccaccugucucuucgauggccggcaacaccaagaaccacccgaugcucaugaaccuucuuaaagauaacccugcccaggauuucucaacccuuuauggaagcagcccuuuagaaaggcagaacuccucuuccggaucaccccggauggaaaugugcucggggagcaacaaggccaagaagaagaagucgucaagagucccaccugacaaacccaagcaccagacugaagacgauuuccagagggagcucuuuuccauggaugucgacucacagaacccuauguuugacgucagcaugaccgcugacgcgcuggauacaccucauaucaccccagcuccaagccaguguagcacucccccagcaacguacccacagccagugucucacccccagcccaguauucagaggaugguccgacuguccaguucagacagcauuggcccagauguaacugauauucuuucagauauugccgaagaagcuucaaagcuucccagcacgagugaugacugcccaccaauuggcaccccuguucgagauuccucaaguucugggcauucucagagugcccucuuugauucugaugucuuucaaacuaauaauaaugaaaauccauacacugauccagcugaccuuauugcagaugcugcuggaagccccaauagugauucuccuaccaaucauuuuuucccugauggaguagauuucaauccugauuuguugaacagccaaagccaaagugguuuuggagaggaguauuuugaugaaaguagucagaguggggauaaugaugauuucaaaggauuugcaucucaggcauuaaauacauuggggaugccaaugcuuggaggugacaauggggagccaaaauuuaagggcagcagccaggcugacacgguggacuucaguauuauaucaguagccgguaaggcuuugggugcugcagaucugauggagcaccacagugggagucagaguccuuuacugaccacuggagaauuagggaaagaaaaaacucaaaagagggugaaggaaggcaacggcacaggugcuagcaguggaucagguccagggucagacagcaagccaggcaagcgcagccgcacucccuccaaugaugggaagagcaaggauaagccuccaaagcggaagaaggcagacacugaggggaaguccccaucucacaguucuucuaauagaccuuucaccccaccuaccagcacggguggguccaaauccccaggcaguucaggacgaucucagacgcccccagguguugccaccccgcccauucccaagauuaccauucagauuccuaaagggacagugauggugggcaagcccuccucucacagucaguacacuagcagugguucugugucuuccucuggcagcaaaagccaccauagucauucuuccuccuccucuuccuuagcuucugcuuccaccucaggcaaggugaaaagcaguaaaucugaaggcucaucaaguuccaagcucaguggcaguauguaugcuagccaagggucuucuggauccagccaguccaaaaauucaucucagacuggggggaagccaggcuccucucccauuaccaaacauggacugagcaguggguccagcaguaccaagaugaaaccucaaggcaagccauccucccuuaugaacccuucuauaaguaagccaaacauauccccuucccauucaaggccucccggaggcucagauaagcuugccucuccaaugaagccuguuccuggaacccccccauccucuaaagccaaguccccuaucaguucagguuccagugguucucaugugucaggaacuaguucaagcucugguaugaagucaucuucagggucagcauccucaggcucagugucucaaaaaaccccuccagcaucuaauucuuguacaccaucuuccucuucguuuuccucaagugguucuuccaugucauccucucagaaucaacauggcaguuccaaagggaaaucucccaguaggaauaagaagccuuccuugacagcugucauagauaaauugaagcauggggugguuaccagugggccugggggugaggauccaauagacagucagaugggcgcaagcacaaauucuucuaaccaucccauguccuccaaacauaacacgucaggaggggaguuccagagcaaacgugagaaaagugauaaagacaaauccaaggucucugcuucuggggggucaguggauuccucuaagaagacuucagagucaaaaaauguggggagcacggggguggcaaaaaucauuaucagcaagcacgacggaggcuccccgagcaucaaagccaaagugacgcuacagaaaccuggagaaagugguggagaugggcucaggccacagauagccucaucaaagaacuauggcucuccacuuaucagugguuccacuccaaagcacgaacgggguucucccagccacaguaagucgccagcauauacaccacagaauguggacagugaaagugagucaggcuccuccauagcagagagauccuaccagaacagucccagcucagaggaugguauccgaccacuuccagaguacagcacugagaagcauaagaagcacaaaaaggaaaagaagaaagucagagacaaagacagagacaagaagaagucucacagcaugaagccagagaacuggucgaaaucccccauuucuucagauccgacggcgucugugacaaauaacccuaucuuaucugcagacaggccuucuaggcucagcccugacuucaugauuggggaggaagaugaugaucucauggauguggcccugauuggcaauuagccuaacuuucuaaacagacacguccagaggagaaacuaaugauauauguaaaccaacccgaggggugagucagacaggcccugucagugcuuaagagcccuaaagggcauggccucuacaccaagcuggguacauuuauaaacauacaucuagacccugcugccgaaaccaugugguugguuguucagaaacaagucauauuucuuugccagaaagcaaugaauaaauuacuugcuuaaggggagagggguggugggagaggguguagagagggaggggugggaaauuguugugggaaauauucauauauuuuucucccuuuuuccauuuucaggacaugcuuuaaacucauuuuagugcauguauuugaagggcugggcagaaaaugaaaaagcaauacauuccuugaugcauucgcaugaagguugcucaccugugggagaugcccauuggaagcaugggcacgggaaggacuuugacaguucuggacacugaaagcaauguuuggugucuguuucuuaggagugaugggggagggaaaauuauuuuaguuauuuauuuguaauauuuuaauccuugauguuuguuuuuaugcaauguuuguuccuaaaucuaugaagguuaugguucagaacaguaggaggcagguagcaaggcucgccugguggggagcucgcagccugugcugacgcugcagcaccagucccacagagcuaaucacagccugucuuuggaguugaauagaaaaaccaaaacuauuaucuuuggagguuuuucacaggguucagacaccauaggaauauuaggagugaguuaccucccuaugcagauaaaagauuuaucuucuuucauuaaaaaggaaggguggcuuugggggguauacauuuguuuucagagucuauacccuaucguauaaaaaucaguauagaauuaauaguucuccuacuuccacaaugugccaaaagucuacaucccagcauuuuguuugcaggagagcugaugccauuccuaagagcuggacucuuuguuucucuucaucacaagaagaaggaguucagacuuaaaucacuccacuguaugcuccccgagauaaacaguuaaaaaaaaaaaaagcagccauaguucacuuaaaacaauuucaagcucacuugaagugauuagggccuggaaugcuaagugagcaugaagauaacccuugcuaccguguagcacacagucggaccuuuuuggagaaacaggucugagucuggauucugagggacaucaaaggaagaccucauaaauagagaaaugcaggagaccguuuugagugcaacagaaguucucaguauuuggaggguccucucaaaaguccgcggccuuacuuugauuucaccaccugcacugugccauuccugaugauuccguuugggaucuguaucagcgggguggggguggggcgugauccccagcacaacucuucuggauuacaaaacaagcaaaagccaggugauucauguuuguguguguuauaaguggagugacuucaucagauacggacgauuucuacauccaacacugcagguuguuggaguuagcauagacuuggaaaaucuacugcggcuuucuuuccuaguucucuuuuuuuuuuuuuuuuuuuuguuuuuuuuguuuguuuuuuuuguuuuuuguuuuuuugguguucucccuuuucuggucauugguuuucaacaacuccgccauuucugugucccaaggcaauaaauaggaaacaaaauauuggaaaguggagcaagaaaaguuaucuguuccccuaucagagcccggugucuugggugacaugggcaggguguauuggagugcuuucucuuguggugcugacauaguagccgugcgguaucucagauaaaaccagguuggauuucucagaaauuugccaccugguugugaauccuaucuucuuaguuucugcaggaaaauuguuguuauaugggguuucauuuuguuguggguggggacaaucucauggggaaaauguacugcauaguauaaggggcucaggccccccgagcagagucaagaaauaccaaaaucaguaaacugggaagcuuuucucucuuucugucuucaucccagaucaaagaaucccgaguuaggaucuggaugaaggauaagccccugaauugcugaugggcacaccccacacaaugacccagcaucugaacuugcuuaacagggagccggggcuaaacugcuucacccugccugggaaccagggagcacugcauuucuccacaggguggaggagaagcggcaggauaaaccaagccugggacaccucccucccauccaggugugcucacccuccuguuugaaagacggcaaggacaugaagucaacguguaccuauuugcugcugcugcugcugcuggaguuuaugguuuuuuuuuucuuuuuuuugaccuauucuucugucuuugggcuucauguuaagggucuuuggacaaaaaucugcucugauguacaagaauauuucaguguaucuuaaaacaaguguuuucgaggugagcaaggggaccugauguaauugccaaagccagcuugagggugauaacucuugaauuggauuuuccuuuugucaggccaaggccugaaaaaucuguaacagcaauauaucaugaauuuucagaagagccagugggucccauaguguccucacuggucccagcagaugucaguauacaaaacauaaucaaucccugggcaaucuugugcucuacuuuaucuucauccuuagccacguccuccugucauuugucucggagucacguuuuggagagacaggaaguauuaucuuagaaacuagguugggaaaauguucaacuauagagcugagauuuaaauuuugaguuuaaaaauguacaucaggagcaauggaaaggguguuuucuuaaaggcauuucuaauuugcuuuucuguguguaugucuguucuguaaauaauuuuuucauuuuugaaaguggauaaaaucuguggauuuucccucuuaaaacaacacaaaaauaaaacuuucuuuacaugcaaauaaauuucuuugauaaaaagaaau

SEQ ID NO: 6344 - RNA, 794 nt, Mus musculus
auuuuuuuuuuaaagauucaaugucauuauuuauuuguugcucuuaaagacucauuuuugacuggacucagacuuagaaguagaagcucucagcgaggacagccuacgucucuuggcaaucuguuccuggcgcuuuucuuuggcuuccuucauucucuuggccaaaaguuuagcauauucugcagccuccuccuuguucuucuuagugcguuguuucuucagagcaauacaucggaguuuguguugcaggacgcauggaguaacaagaugcugaaucuugggugcuuugguccugggcuucuuaccuucuuuguuuaagggcuuccugacaacauacuggcugacaucaucuucuuuagagagauuaaaaagcuuucggauucuacuagcucuuuuaggucccaaccgaggaggcacagucgugucugucaguccaggaauauccuucucuccuuucuuuacaauaaccaaguugagaacacugagauuagcauccacgaugcauccgcgaacagacuugcgcuuccucucuccaguucuccuuggucuguaacagggaugcccccuauucaacagcaggcgcacucugccaugggucagagcaccgugcuucaugggaaaaccuugcuugucauucccaccacugauccggaccacauaacccuuccacucuucaccaagagcauuagcggcuacuuccguggccaugugcuucucauagaagauguggagcuugcgcucgucaaccaccucgaugacagccgguggcgggaaaggagauguucaguuucauc

SEQ ID NO: 6345 - RNA, 514 nt, Mus musculus
ucuagugugugagugagucugggcgagggagugagauguggcugugaggugucggugugaggcggaggcuagcgaagggggcucccucaggcacgagggacaaagggggggagcugaggcaaccuaggccgcggaggccuggcgacaggaagccagccgccccgagccgggcgaccggguaggggaagggccugcguaguccucccggggcuccagagccgccgucggccccacaggcuccggcggacgccuuccuacuuccuugagcgccagggcucgcgggcccgaauaucggcucggcgggggugggcggccgugaggggcggacucgagcagcucccggcgucgcgcuccucccgugccgaggaacucuugguuucuucccucucuccuucaccccccaccucauguaggagggcgcugaggcggcgagagggaggaggagccucgccugcggucccugcccuccccacccccgucuaggggcucuucggggggcguggagucggggcug

SEQ ID NO: 6346 - RNA, 514 nt, Mus musculus
cagccccgacuccacgccccccgaagagccccuagacggggguggggagggcagggaccgcaggcgaggcuccuccucccucucgccgccucagcgcccuccuacaugagguggggggugaaggagagagggaagaaaccaagaguuccucggcacgggaggagcgcgacgccgggagcugcucgaguccgccccucacggccgcccacccccgccgagccgauauucgggcccgcgagcccuggcgcucaaggaaguaggaaggcguccgccggagccuguggggccgacggcggcucuggagccccgggaggacuacgcaggcccuuccccuacccggucgcccggcucggggcggcuggcuuccugucgccaggccuccgcggccuagguugccucagcucccccccuuugucccucgugccugagggagcccccuucgcuagccuccgccucacaccgacaccucacagccacaucucacucccucgcccagacucacucacacacuaga

SEQ ID NO: 6347 - RNA, 4365 nt, Mus musculus
gucugcuuugcaucucauuuacauaaauauuuauuaaucgucauuaaacucaacagaaacacgcaaugcacuucggguguccgacaggaguuucaucuucgcuacaagaggaagguaaaauugcguguguggggugugucgccuguggguuugcguuuuuugcaucguguguuugggugccugguucccugccuccgguggggggggagcuucaccuguugccucuugcgaggggaaccuccagaggagcccucaguucucccagcucacuggaugacaaaagucaggaggagccuagaaccgaaacacaaaacaaaacaaaaaacaaaagcaacaacaacccccccaacaaacaaacaaacaaaaacccaaaacaacccucucuagccaccagaaaucaccaggagcuuggcgcccacggaggcacagucuggacaaggguaaggcuguucccaggucugggcuccuccaccuuaccccaagaggggacggaccagagugccuauagagaggagguaccaguagacagcuccuucuguccccggacgcccggggccugcgugugcgugcgguguggugugugugugugugugugugugugugugugugugugcguguucgcgcgcgcgcgugugugugcguguguggugucucucaugcaaacccucccuccccaaaccgacccccccuaacaguuugccauuccauacaaauuuggaaacagguuuuuagaaaacaguaugacgcacaacggggcagggcgggaggagggcaguggcacugggguuccaaaucuccgagucauugauuguaagaaacuggggggggggaggggcggcgcgggcccccacuucaccaaagugcacagauccgcgcgugggcggggcagccagcagacccgaggagcacccaggucaggcugcuaggcucagucagaaccuccuugcauagauauuugugucuuuuuaaaaauuauuauugguaguauuuuuuauuauuauuauuugccuuuuauugcuucuaaaaguucuuaaugcguuuucucuccgauccggacucugaguucggccuccguugccucucaguauuuuuuccuuuuucuuucuuucuuucuuuuuuuuuuuuccuuuuguauguuuguuuguuuucuuuaaaaagggaaaaggaaaaaugguucuaguuacaaauuggcuuggccucucucuuuccucucaauccacauccccucccaccaaaauaaaaaauaaaaaacgcggagauucguguuagggugaaggcguuugggcucccuggcuguggccucuucgagaaggaagagauaccaacucuuuucggccugggaagcucugugucuguuuuguuuuuguuuuuuuaaaguaacuauaagugggggagacacuaucccgagacucagcagccccuuaccaacugccucuggccuguugggagguggggagagaaaacccaaguuugggaauguggaggaagucucuugggagggccuggcgggagauccccagagaugcucuccacgagagaagggaggaggaagcccgcuggggagagagagaaggcgaguccccagaggcaagcgaggccccugggacgggccacccacagguaagagagcacgccgcucuggagagcugcagaaccggcggcccgcgcucgagcgcccggcucuggagucggugggagccccugagcucguggggcuggggcuaaggggccggacaaaggcaaagaaaaagaaaggggucggcgcgaggucucaguuauggaaaaaugcguugagcuccucguacauggggccccgaucguggugaaggugcauaucguaagacaagagauucucggaguggacgcccccgcgcacggccgacgagccgaagaccagcccguggcccgugggccgugagccgggcagcgccgaguagugcauagaguagugguagcucuucucgugaucgggggacgaguccugcuugagcgagaaguugccguugagacagagcgggggacugaguggacccucguacucggagcuguuguaguccgggcuagcgccgccgccaccggccgccgcguacagcgucucguaggcggcgcaguagccguggguccgcagggcgugcgccgcgccuccgcccaggccgccagccgccugacacugugcgccugccaggcgggagcacggguauggguacggaugcauggcgaacgggccacccgagccgugaaagcggccggcgccguccgcgcccugcuccgugaggaaguuacgagaguuuagcugcaggcagccggccaccagauucguggugggcugugacagccccuugcacagagucugcacguaggacaccagauccggccgcuucccggagcgcaagaucuccgagagagcccagauguaguucuuggccaggcgcagggucucgaucuuggacagcuucugcgucuuggaguagcagggcaccaccuugcgcagguuguccagagccgcguucaggucgugcaugcgguugcgcucccgcgcguuggccuucugucgccgcagcuuggagcgcuccagacgcgccuuggucaucuugcguuucuucggcccgcgcuucuugggccgcucgccuuccgccucguccaguccuuccuccuccuccucuuccuccuccuccucgccgcccagcucuccuuccuccuugaccucagccaacguggguucagggaucucuucuccuccacgaagagacacuggcuuggcggcccgggcggguccuggagcccccgacccgggagcaggaggaggcugcggcggcgcgucgcccuugucgcuccucggcucgucgucgucgccgucgccccagcuggcgaacuugggcacguccgagaggaggccgggcucgcugaacaggcgggucagcauggugccugagggcgccccgggggcggggagacagacagcacagagugaggggcgcgccggggucaccacgaccccccaacccgccuccaccccccaagucuccgugagcgccccagcucaggggcccccgaugcccacuacguccugcugccccgcccagagccggcccagcccugcccggcugccagugggggaccgcggcccaggcccuugcccgagauccgggcuccugcuccgccccuggcccggaaggaagcugcucucggccggugucggggucccagagagcuugaccaggugggggguuaagggaccagguccaucuucccggggaggcggugcucucgcccgaaagccagcucucucccggugacggagagaagcugggcggccgccguggggacgcugccccgguuccuccucuccacgguccggccccucggccuggcuccccaagcccuccggugccucucacccccaagcucccuaauccaauuugcaaguuggccgcgcgccgcccccggccgggcccccacccccgcagccccaauucuagacaccggagcaccgucuccucucuagcugcugcuuacgggucucccggagcgggcuccgggugcggggacugaagaagccgggcguggggaggagacccaaaagcgaacccuguucgucucccuugcggucagggacccucuuccccucuucaaacucccucccucccacacgucucuacagaucucguuguauuuugagauccuuggggaaaaauccaaauuuauuuguuugcuuaucuuuuuugguggugggaaaaggucacagguuccuucgggacagucauggggggggucccaucuucgcuucuucgagugccucaugacccuucccccucagcccauccuaggcauaccaucuccuuccgcagccccuuaagcugcggccccaaugggagagagaacacggggcgcccccgcugcccaucccguaaggggguagggucccaggaauaggagaacugggggggacuuccauguccgaagcagcgcccccccaccacuaauagcaggucagaucuagcucccucucggacaacuuaccucagagaggagucaaggggagaggggaggggaggggggagggggcaagagagagaggggggagaagaggaaucuucucgcuuauuucauuguucccccaucuucagggagcgggggcagcgguuccucaaggcggcgggcgccggcgucuucagagcgccaugcgagccgcggagcgaguguggcaucucuaccaggcgggguaccagccucuaugccaggccauaugggcuuggcacgucacgggcagcagcuaucacaugagagacggugauuggcaugcgucugcauugggggagagccggcucccccgggacccgccgccaucugucacucucuacucca

SEQ ID NO: 6348 - RNA, 9412 nt, Mus musculus
ggacaauuauuuacaaagauuuauuacagcguaggagggguucaggccuagaguaagggaagaaggggaagggaaccaaguugcuggaggacaaggagaaccaggcuccccccacuguguggcccccuaaggacagauaguaagugcauuccuggcaccaaagcacaaacaaaacgcagcaagcagccucugccaguccaucuugcaggcacccagcaggaaugggauacuaagggagggacauguugaggcucugcaaagaaugcgugagaccugagcccugguugaagucuaugagaggguuggggacucaacgcccaccacugguaggggaaggaggagaucucagggcaccuguaggcucucaguaccuccuuuccccagaucuuaggaccugcccugugggucuccugugcccaggggagagaaucuggagagggaggggacuuguggagaauaaaugguuguuuauggccuucugggguuuccagugugggcucucucaccucccuacucccaccggguaaauagaagaaugacuggcagggaaaggcauuggggacucugggcuucagccaaagcaaacagagaccagccuuagucuucuaaaagucagaagccgcagcccuagcaggugaaagacaggguacaaaggaggguggggacagaguggguuucuggggaacacuuccuccugggagauacagggcucugagcuuaugugccaggcucagggggggcugggaugcugagguuccucuccaggcucugaaagacaaauaaagaggacucaaggccaggcuuggcccaugagguucccacccaccuccccagcccacacuccaaagcucaccacuuaguguugcucugccuuccacuugguccucagaguuuccaucucucuggggcucauccagaggaggugggcgcucccagggccccuccagaccccggccacaaguaggcuucugccccacugaaagagagggcauacauacauaggcugagugccccucuggugcucucugauggcuugagguugagcuucugagacauccauugcugcauaacgggcagaacacuggccuggacuucuguccccgugauuguaacuuaguucaugggcacuuuuccaaaggaaauauuauguaagaagaucgguguagauuaccuuagauaauaccuucugggaagcuggguguggaggcuuacacuaaaaaugcagccaucaggaggcugaagcaggaggauugcuuugaauucaaggucauugauuaagauugaggugcacuguuaagauucgggccaaccuggauugcagaaugagauccuauacucucaagaggcccagaacuggucuccagaguuauuccggaauucgggaaauugauguuguuccuugaggguccggucaugugacucagggcccccuucuccuuccugagggagucgcuuucauucaucucccaucuguucucaggugggggugggggcucagaaggagcucacugacaccucacagccagagaugcaagaaggagacccaaggcuuuuuugucugagcccaagagcugaaugggagcgggagacugugugucauucccauaaaaaaaaaaaaaaaaaaacagguccaaaaaguuuaaugugcaccaggcuaaacagaugaagcacagccuuugguggccaggaguggaagacacaaccaugagagggagugaggucauucugccuaguugucuagugcuggggcaucuccuggggauuucuuucuggcucugcagcuuccuguguagguuuuaggcgccuuaucuccaggcugcugcgguuaaaguagaggugcagaccagacuggcucuuaaaucgucaauucuacaucuggacacuagagggcacucucccacccuauccuaggaaggaaaagacauucucagggguccuggagagggcaaaucagccagccuccuucagcacagcagagagcgcaugcuagguucagaaaugcaugaaaggaaauguuaggcuuucucucgaucuaugaaccuccucacaauuggcuuccauggauagacaguuccuuuuugggucuagccucgguuguccugugucucgccuuaguuuuuagaaagggaugaacgguggggaaaaccuaaucaggcgacagguuaaccaagacugaggggugccuggucucagaagcuggccgcagaaggacaucgcaggauccuucuggaagagccaccacaccugacccacgguagcaggaaccacagaccacagccccuucagcuuaccagugccccugcugccuuucaggaccuccgccuggcugucuucuucuucguccuccucuucauccucauccuccucaucauccuccuguggguacccaagcucccgaagcuccccuaacucauccucuuccuccgaggccugguucucacucaaguugcuaauggucugcaggugcugcacagcuggcggaggggacgggggggggggggggacaagggucaaccaagaugaaggagcagcucaugcaugccacugaggcagaggugcugcccuaaggggcccaaguccaauggugaaaggccaccauccacucuacagaggguggacaucaaaccaagguaggagccacaggcguacauuuuuaaucacauuagcucuuaagcuguuccgagaacgcugcccccccccccaagacgggcaccagaaaacuccccugcaccacaggacaccugucugggcaagaccaggccagcacagcaacagcuuagcauucucuggccagggagcuuccauaaccaggugcccaguacuggaaaguguuucccagcagcauuaaccccaggcagaaggugucaggccuauagaccggagccauuuuuccugauauuguucacaaugauccauuuugcuguggccucucugacccagacuguccagcauuagauaccagucugcaccucuuucccaggcuccccgggcaggaacagccugagggcgcagcacucugcgggcccccccaccccccguaaagucccggcugggcaaguggacuguucagaugcagcccucacagucgugacccauaucccuaaucucccagcucccucugcggugacccagaaagcagcaacaccccaccaccaccaccacgaagaccugcucagaugcagccgaggaaaggaacagugugggcggcuucccaaagacgcaaggcggggagggaacaaggacgggcuggggguucuggggauugucaggguuugaaagaacaguacuggguuaaggcuggggugcuggggggacuggggauguagcguuugcagggcccuggguuuuguuccuagcagaagccuggaaucacagcauccagaaaguagaggcaagaagaucaggaauagaaaugcauccucagcaguggaugaaaccuagugaggucuagucuauccugggcuacauaaacaagccccucaaacaaaacuaaagacuagagcagggucagcaaggggccagggacuaucaggauuuuagaguaggugagacacuagggccacugcccccagacuagacucugcaguggccagugguucugggcuacuuaauccaacagcggccccuccccuuugcagcccaggggguaggcuggaaaccucccaugcagugagcagggccaugcacuccugccaacucagggacaggcacagagggugcauugugugugcccaaugccccgcccugcccccagcuuccaaccuaccucuucccgcugccuguggguaagcuacccaggcaauaaaaucucaauaaauugcccugcccuggccuuggggacccggcaaaguuucaccuugagccaacccagagagcucugaccugaccucaaagcacccacacccaccccacugcuccccugaggcuuagugcuguccacccuuccuggagggcucuugaauccugcccuacaaaacucaagcccugccagacacuugcccuuacccagaaagggcuaagcuugccaaauagaaccaucucggugcagaagggccucugggcugggggagagguggcggcaggcagucgggggaggagaguuauuuaguucgugauccaaggugcuggcaggugugugcagugccucugcucccccucucccucccccaccccgugagcuccugcuggcauuacucagugucucgugccucccugggccuucaagaaucuuucccuacaacacugucuccuucuuuuaccucuccauuucuaggaccuuaaaaucccccuaccccaagucuuccuuguuaagauucaagaacccagaagggggggugguggccuuacacgccuuuaaucccagcacuugggaggcagaggcaggcagaucucagaguuugaggccagccuggucuacagagugaguuccuggacagccagggguacacagagaaacccugucucagaaaaaaaaaagagucaagaaccccaguacagccugacuccuucccaccaucccuguguuucucuacucagaugcuauagacacagcccagagaggcuggaguagacagaucuuuggucaacuuuugguacacaagaaauuuccuggcccuaaacuccucccuuagcccacuuccuaaguauacagccaaagccagggagggcugaacugaaaguguagcucagcguuauagugugugcuuaguguguaagacccggcuuccaucccuaacaccuccccugaaaggacaugggaugguggucccccucauauucacccagccuaggauggagaagacgcacauugucuuaagacagacucucauuauguaccuugagucagccucaaacucacugagcacaaccucaaacuucugaccgucccgacucugccuccugaguggaggcuuacaggcgcgucagcacacuugguuaacguggugcugguacugggagccagggucucacgugugcuaugcacacacuccacgccccagucucaaggccaaguucuuguacuccuggguaacacgccacuugucuucaugcccacucuaagcccuucuacacgucccuccgggaaguccuugcccgcugccacucgcuguagcuuccuuccuucauguuccugucuugggagaagaagaacaccaacucuucucugcaguccucccugcuucucuccugugcucccaggcguggcaggaaggcugacaggugcauguguugaccuuggcugcuggaaagccacauuaaacccauccaccuggggaacucucagcacacuauugcugccuuccagccccaggagaagggacaagcccggcaagaaaggccuagguuggggguggggugggguguggcaggccacuggcaccuaguuaggaagaggccuuuggcucacucagugcaccugcucuuccuucaggugugucucccccagcucccuggccagaaaucaagucuccagcuguccuuaaaaccuggcuucacgccgccagccccucugcgcgccccauuucuucaccugucuuuucuggcccguugauucccuaagccuuagcgcugucucuccugcaaacucucccugacccucagaagcaaaggaccccagaggccagggacugaaucacucaguuuucauuucuguaugagacauacucuugcugcauugcccuagcuagccuggcauucacugugcggcccaggcucauguccauagccaucuuccugucucugccuccuaagggcagggguugcaggugugagccaucaagugacuuuguuuugguuuuguuuucagguauucuuguuuugcuuuuugagacgggggacuugcugugcaacucuggcuggccuggcacccucucuauagaccaguuuggccuugaacucaugaaaacgaccugucuccuaaaugcugagcuaacacagagcuuugcaccaccauacugacuuaucuaaaaaucgcuuuaacccaaggcaugucaaucgaaugcucuaccacugagcuacccugugagccuccgaaucuucaucuuauuucacccaucgcccacccaugagaccuggcaauaugagacaggagugauaccuuuuaacccagacagaaaaguggaugcaggagcccagcaugaagaccugcacacuggaguggagccguggggccagaggggaaggcaggcagcaagcauggcccagcagagacaccaucagagucucucaucucaaggcuuacuguccuguggggcuacccagcuccccgcuucaacccuucaaccuacuguuaagacccuagcugcccucucccugccucuggaaaccuaaaaaggaacuauucucccaagucaggcagaaaggguugguggcaguccuucccagcugacaguuccucuuccucccccacgugcagaguuccaggagaccauaagacagauggaggggugggauuaguaccuuucagugaugggggcguauaggcacagggguugggucucuucgacuuuggguggugccccucuccagagguucucuacaggaaagaagcaguugaaacaggcuccccagauacccuucccuuuccgcucccuccagugggacaacugacuuggacagcugacagagcacaggacaccuaggacaacuaggcaaagccccacccccauuagcagaagccugacucagagcaggacccucucuuggucguggacaccccacaucagccccgccccacuaagagagagggugacacuagaacaggaucuuuccgggaaaaugcaguugacaugccaauauguccugugguggccuagguuggcucugcagauaucagucuaccacaccccagagggcccagcuaaguguccuuccagcugccccaggaaacucaccugauguggagaggccuccuccucugagaaaggccaucaggcauacagcaaccaugaucaaggaggaagagaaaaagaauaagguuacuuuccccaaagccucagucucugggacggcaaaagugugcccuucccuccuggugccaacaggugccaagaaaauaaaccaacccagcuguguuggcauuccaggccuccauucuccagccugacccucucucgugggagcacuuagaaaggccccagaauugggguagggagcagggaauggacccuaccuggugaggagugcucugagacccggaaaagcauggcagggguuggucuccggcgccggaucuagagagauggaggaaggaaggacaggauaaaugcccuauaggggcaccucaccaucgcacucagccagcugggagcugggcuuuggaguccucagggagccugagaaucaaaggcagcuagagcucacucggcucaugcaaucgcuuuauuuuacggggauuaaaaguccgggaauuagagagguucagcaaagugcccaaggucacacagcacacuugauccaaaggacuagaaaaaccaucccuggacuccuaguccagagagccacacuccacagcuacuguagaacuuucucuagacaccaaagcuggugucaacuccuacagccagcuuaagcacuccaagggagcuaccuauggcccuacccaccaaaggucagcucaaggacuucaaagcagcuggacucagcugcaaaggaagucugagcccaguaccgcaggcaccccuacccucaccugaagcucgagugggggccuuaacuccagacacugaggggucugcuggggucucuggagguuagagucuuucucaagcuguagaauuuaucacccaguucucaugggaaaaaaaaauguaaaauugcucuccuuggccacccuagcuuggcaaucagaccaacugucaguuaauuagguccccuugacgcuccagggaaauagagagaggaccagguaauugaggcuggagcggcugcugccaaaggcugcuuaggcccaggcuucagcccaccccaaccaagcaccccaagaccaagacaugcuuugcccacuuuuuacugcucucccucuucagagccauuggcaucucagcaacaaguguccuugcuaggucgaggagaacagaccucugccuccgacacucucccucacaccuuuguaggucucccaacccucaaggaagagaugucagcucacucccugggguugcaguuccaggucuugagagcagagaguagucagaauaacguucuggggacaccccaccaccaccaacaacuaggccuauagggugagacuguggcccucuagaccaugagugguugaagugacagccucagacgccagagcuguuuguaucuguccaugggauaccaccagggugauggggucucugcggggaauaaaugacuagccuagcggggcuauauaagagccaaaagggcagucccgagaacugauugauagucuccggacgcucacugcaggaauucucccgcccaagauaggcuuaaagguccggagaaaaguugcuaggagucuccggcgaacuuccaguccuguggggcgccccauugcaguccaggcuggauccaacaugggacgggacggacugugcuggggugggggaauauguguugggggugauacguggauggggcgcggcccccuuaccaucuccaccugucgggggucgagcuggcucgggggcgcgggcacagagaacugaaucuucuugcgguccuugggguccauggcgggcggcugagcguucuuggggugucuggcugagcccugcucggcuguccggagcugcggguggcgcgugcugcgcggaggaggaggaggagcacuguccccgcacccaggaaaaucccgcgcuccacgaggagaacgcgcgacggucgggaggacugaacagcggggcucgccugcagcgccgggcucagcguccccaggucagagcucaggauccccgcgccuuagcugcgcgccaccgguuuggggcgcggggcucuggcugccggccugagcuaucucggcgggcugcccucggccuugcucuaccagcuucugucuaucccccacucugccuucuuccucuccgcgccucugccgcuacuggcugcaccccacaggucccaacccuggggucccagcccguccucucugccagggacuggcgcccaggcguuuggagggagggcuuaggggaaagcggccaaugagcaucgagaagcguguucucccgggcugggaggagggugcggagugggagccagggcuaggggagcggcccgggggcccccugcaguauccccagaacucggcguuguauuauuaaugaaguccagcggugacgcuaaggggagggggcaggggcagcugcagccgggacucuggcuuuaaccucuucgcccacccccccucgggacguggacuuuuaagggaggcccguga

SEQ ID NO: 6349 - RNA, 7568 nt, Mus musculus
ucucggagacgagguccggaagcggagccacaaccgaaguuaaacuguguaagaccgugcaggagcaagggauaaaaccccagggugucuugguuauuagaucauacaggccugacacuguggagugaaggggaacugugugagggccgauuugugagcacaagucccuuggagaaauccauuuuucguuuuugagacguucucagguuggccacgaacucagccuuccaaguucugagauuacugacgcgcagcaccacauccaucacacauauuuaaaggaccuuuguucuccccuggcuuuuagccaucucccucaggagcuaguaugucugccaugcguauagccugcaggaaaggcuccuuccugggaagggcuggacacgagaggcaagauccugacccuaagauaaccaccauuuuuccugucagaacauaccauuacuucccggucucuccucccuccccugaaagaggagucucaggacaauuauuuacaaagauuuauuacagcguaggagggguucaggccuagaguaagggaagaaggggaagggaaccaaguugcuggaggacaaggagaaccaggcuccccccacuguguggcccccuaaggacagauaguaagugcauuccuggcaccaaagcacaaacaaaacgcagcaagcagccucugccaguccaucuugcaggcacccagcaggaaugggauacuaagggagggacauguugaggcucugcaaagaaugcgugagaccugagcccugguugaagucuaugagaggguuggggacucaacgcccaccacugguaggggaaggaggagaucucagggcaccuguaggcucucaguaccuccuuuccccagaucuuaggaccugcccugugggucuccugugcccaggggagagaaucuggagagggaggggacuuguggagaauaaaugguuguuuauggccuucugggguuuccagugugggcucucucaccucccuacucccaccggguaaauagaagaaugacuggcagggaaaggcauuggggacucugggcuucagccaaagcaaacagagaccagccuuagucuucuaaaagucagaagccgcagcccuagcaggugaaagacaggguacaaaggaggguggggacagaguggguuucuggggaacacuuccuccugggagauacagggcucugagcuuaugugccaggcucagggggggcugggaugcugagguuccucuccaggcucugaaagacaaauaaagaggacucaaggccaggcuuggcccaugagguucccacccaccuccccagcccacacuccaaagcucaccacuuaguguugcucugccuuccacuugguccucagaguuuccaucucucuggggcucauccagaggaggugggcgcucccagggccccuccagaccccggccacaaguaggcuucugccccacugaaagagagggcauacauacauaggcugagugccccucuggugcucucugauggcuugagguugagcuucugagacauccauugcugcauaacgggcagaacacuggccuggacuucuguccccgugauuguaacuuaguucaugggcacuuuuccaaaggaaauauuauguaagaagaucgguguagauuaccuuagauaauaccuucugggaagcuggguguggaggcuuacacuaaaaaugcagccaucaggaggcugaagcaggaggauugcuuugaauucaaggucauugauuaagauugaggugcacuguuaagauucgggccaaccuggauugcagaaugagauccuauacucucaagaggcccagaacuggucuccagaguuauuccggaauucgggaaauugauguuguuccuugaggguccggucaugugacucagggcccccuucuccuuccugagggagucgcuuucauucaucucccaucuguucucaggugggggugggggcucagaaggagcucacugacaccucacagccagagaugcaagaaggagacccaaggcuuuuuugucugagcccaagagcugaaugggagcgggagacugugugucauucccauaaaaaaaaaaaaaaaaaaacagguccaaaaaguuuaaugugcaccaggcuaaacagaugaagcacagccuuugguggccaggaguggaagacacaaccaugagagggagugaggucauucugccuaguugucuagugcuggggcaucuccuggggauuucuuucuggcucugcagcuuccuguguagguuuuaggcgccuuaucuccaggcugcugcgguuaaaguagaggugcagaccagacuggcucuuaaaucgucaauucuacaucuggacacuagagggcacucucccacccuauccuaggaaggaaaagacauucucagggguccuggagagggcaaaucagccagccuccuucagcacagcagagagcgcaugcuagguucagaaaugcaugaaaggaaauguuaggcuuucucucgaucuaugaaccuccucacaauuggcuuccauggauagacaguuccuuuuugggucuagccucgguuguccugugucucgccuuaguuuuuagaaagggaugaacgguggggaaaaccuaaucaggcgacagguuaaccaagacugaggggugccuggucucagaagcuggccgcagaaggacaucgcaggauccuucuggaagagccaccacaccugacccacgguagcaggaaccacagaccacagccccuucagcuuaccagugccccugcugccuuucaggaccuccgccuggcugucuucuucuucguccuccucuucauccucauccuccucaucauccuccuguggguacccaagcucccgaagcuccccuaacucauccucuuccuccgaggccugguucucacucaaguugcuaauggucugcaggugcugcacagcuggcggaggggacgggggggggggggggacaagggucaaccaagaugaaggagcagcucaugcaugccacugaggcagaggugcugcccuaaggggcccaaguccaauggugaaaggccaccauccacucuacagaggguggacaucaaaccaagguaggagccacaggcguacauuuuuaaucacauuagcucuuaagcuguuccgagaacgcugcccccccccccaagacgggcaccagaaaacuccccugcaccacaggacaccugucugggcaagaccaggccagcacagcaacagcuuagcauucucuggccagggagcuuccauaaccaggugcccaguacuggaaaguguuucccagcagcauuaaccccaggcagaaggugucaggccuauagaccggagccauuuuuccugauauuguucacaaugauccauuuugcuguggccucucugacccagacuguccagcauuagauaccagucugcaccucuuucccaggcuccccgggcaggaacagccugagggcgcagcacucugcgggcccccccaccccccguaaagucccggcugggcaaguggacuguucagaugcagcccucacagucgugacccauaucccuaaucucccagcucccucugcggugacccagaaagcagcaacaccccaccaccaccaccacgaagaccugcucagaugcagccgaggaaaggaacagugugggcggcuucccaaagacgcaaggcggggagggaacaaggacgggcuggggguucuggggauugucaggguuugaaagaacaguacuggguuaaggcuggggugcuggggggacuggggauguagcguuugcagggcccuggguuuuguuccuagcagaagccuggaaucacagcauccagaaaguagaggcaagaagaucaggaauagaaaugcauccucagcaguggaugaaaccuagugaggucuagucuauccugggcuacauaaacaagccccucaaacaaaacuaaagacuagagcagggucagcaaggggccagggacuaucaggauuuuagaguaggugagacacuagggccacugcccccagacuagacucugcaguggccagugguucugggcuacuuaauccaacagcggccccuccccuuugcagcccaggggguaggcuggaaaccucccaugcagugagcagggccaugcacuccugccaacucagggacaggcacagagggugcauugugugugcccaaugccccgcccugcccccagcuuccaaccuaccucuucccgcugccuguggguaagcuacccaggcaauaaaaucucaauaaauugcccugcccuggccuuggggacccggcaaaguuucaccuugagccaacccagagagcucugaccugaccucaaagcacccacacccaccccacugcuccccugaggcuuagugcuguccacccuuccuggagggcucuugaauccugcccuacaaaacucaagcccugccagacacuugcccuuacccagaaagggcuaagcuugccaaauagaaccaucucggugcagaagggccucugggcugggggagagguggcggcaggcagucgggggaggagaguuauuuaguucgugauccaaggugcuggcaggugugugcagugccucugcucccccucucccucccccaccccgugagcuccugcuggcauuacucagugucucgugccucccugggccuucaagaaucuuucccuacaacacugucuccuucuuuuaccucuccauuucuaggaccuuaaaaucccccuaccccaagucuuccuuguuaagauucaagaacccagaagggggggugguggccuuacacgccuuuaaucccagcacuugggaggcagaggcaggcagaucucagaguuugaggccagccuggucuacagagugaguuccuggacagccagggguacacagagaaacccugucucagaaaaaaaaaagagucaagaaccccaguacagccugacuccuucccaccaucccuguguuucucuacucagaugcuauagacacagcccagagaggcuggaguagacagaucuuuggucaacuuuugguacacaagaaauuuccuggcccuaaacuccucccuuagcccacuuccuaaguauacagccaaagccagggagggcugaacugaaaguguagcucagcguuauagugugugcuuaguguguaagacccggcuuccaucccuaacaccuccccugaaaggacaugggaugguggucccccucauauucacccagccuaggauggagaagacgcacauugucuuaagacagacucucauuauguaccuugagucagccucaaacucacugagcacaaccucaaacuucugaccgucccgacucugccuccugaguggaggcuuacaggcgcgucagcacacuugguuaacguggugcugguacugggagccagggucucacgugugcuaugcacacacuccacgccccagucucaaggccaaguucuuguacuccuggguaacacgccacuugucuucaugcccacucuaagcccuucuacacgucccuccgggaaguccuugcccgcugccacucgcuguagcuuccuuccuucauguuccugucuugggagaagaagaacaccaacucuucucugcaguccucccugcuucucuccugugcucccaggcguggcaggaaggcugacaggugcauguguugaccuuggcugcuggaaagccacauuaaacccauccaccuggggaacucucagcacacuauugcugccuuccagccccaggagaagggacaagcccggcaagaaaggccuagguuggggguggggugggguguggcaggccacuggcaccuaguuaggaagaggccuuuggcucacucagugcaccugcucuuccuucaggugugucucccccagcucccuggccagaaaucaagucuccagcuguccuuaaaaccuggcuucacgccgccagccccucugcgcgccccauuucuucaccugucuuuucuggcccguugauucccuaagccuuagcgcugucucuccugcaaacucucccugacccucagaagcaaaggaccccagaggccagggacugaaucacucaguuuucauuucuguaugagacauacucuugcugcauugcccuagcuagccuggcauucacugugcggcccaggcucauguccauagccaucuuccugucucugccuccuaagggcagggguugcaggugugagccaucaagugacuuuguuuugguuuuguuuucagguauucuuguuuugcuuuuugagacgggggacuugcugugcaacucuggcuggccuggcacccucucuauagaccaguuuggccuugaacucaugaaaacgaccugucuccuaaaugcugagcuaacacagagcuuugcaccaccauacugacuuaucuaaaaaucgcuuuaacccaaggcaugucaaucgaaugcucuaccacugagcuacccugugagccuccgaaucuucaucuuauuucacccaucgcccacccaugagaccuggcaauaugagacaggagugauaccuuuuaacccagacagaaaaguggaugcaggagcccagcaugaagaccugcacacuggaguggagccguggggccagaggggaaggcaggcagcaagcauggcccagcagagacaccaucagagucucucaucucaaggcuuacuguccuguggggcuacccagcuccccgcuucaacccuucaaccuacuguuaagacccuagcugcccucucccugccucuggaaaccuaaaaaggaacuauucucccaagucaggcagaaaggguugguggcaguccuucccagcugacaguuccucuuccucccccacgugcagaguuccaggagaccauaagacagauggaggggugggauuaguaccuuucagugaugggggcguauaggcacagggguugggucucuucgacuuuggguggugccccucuccagagguucucuacaggaaagaagcaguugaaacaggcuccccagauacccuucccuuuccgcucccuccagugggacaacugacuuggacagcugacagagcacaggacaccuaggacaacuaggcaaagccccacccccauuagcagaagccugacucagagcaggacccucucuuggucguggacaccccacaucagccccgccccacuaagagagagggugacacuagaacaggaucuuuccgggaaaaugcaguugacaugccaauauguccugugguggccuagguuggcucugcagauaucagucuaccacaccccagagggcccagcuaaguguccuuccagcugccccaggaaacucaccugauguggagaggccuccuccucugagaaaggccaucaggcauacagcaaccaugaucaaggaggaagagaaaaagaauaagguuacuuuccccaaagccucagucucugggacggcaaaagugugcccuucccuccuggugccaacaggugccaagaaaauaaaccaacccagcuguguuggcauucca

SEQ ID NO: 6350 - RNA, 1301 nt, Mus musculus
cgccaguugacacaagcauuuguaauuacucuuuauugccaagagccgacacugcccaggauucagggaaaauaaguuauagcaaccguggcaucugaaagguauugccacgcuggggagaggaccaaacugcagagggcacagaucccgggagagcgauggugauguucacagagaacaucucuuuucugccuuuggccacagaaaugucuagucccuccuugugcccuaagaggcaaagugaagucagggucuuaguuaccuagggccaagugaggggcuaaagguagagggauuccuagcguaaccacaaggaaagguuuaaaccccagaaccaagcuuccaagaaucauuucuuagucacaggaugacacagggaggccggcuguuggugaucuuuucuacagguucuccauugcuggcucuucggauggcuuccaugagcuagcggacagagacaugggcgagugucaugcacaggagaggagggugugucucgucucagccacccucccgagguacauuaaauacucacgucuuucucauaaggaaacccuccauucuccagcuuggagaacaccagcuguccauugaucucaaucucgaaggccccugguaggaaauaaaugcaagaacgaacuaagaacaacaggcagaaguucagggagguccuuggcaccaccucgaguccaagcaagacuguucauggccucggcagacaccgauccugaagccauucagccccaaaccccaaaguccucacccgugcgucuuuccaauacgccauuaagaguuccuucacuccaaacccacaguaggcauuuuugcuaugugucagacccuacuaggggcuuuauauacaacagccaaugucagcucuagaauguagggagagcuggaguuuuaucacauggacugacucagcaggugcucugcggaccucaccuguccccccgagucgcgacucaaucucaaugcccggauacuccuccuucacagcgcucgccagcuccagguaggucgccucaaagccgcaggguuuacuggggagaagagacguggagugagcugggguuccggggguggggccucccguggauccacccccaucuugcgggcgagcacaagaggcuccuuuucaacccgaguggcuuaccaguacuccaccacgauguggacuccacugccugcuuccaccuccccgggagggggcacuacggacaccggcgcuggcuccccacucauugcugcccgcuccgcugcagggcugcuuccgggugugacgccacgccaaagucacg

SEQ ID NO: 6351 - RNA, 1301 nt, Mus musculus
cgugacuuuggcguggcgucacacccggaagcagcccugcagcggagcgggcagcaaugaguggggagccagcgccgguguccguagugcccccucccggggagguggaagcaggcaguggaguccacaucgugguggaguacugguaagccacucggguugaaaaggagccucuugugcucgcccgcaagauggggguggauccacgggaggccccacccccggaaccccagcucacuccacgucucuucuccccaguaaacccugcggcuuugaggcgaccuaccuggagcuggcgagcgcugugaaggaggaguauccgggcauugagauugagucgcgacucggggggacaggugagguccgcagagcaccugcugagucaguccaugugauaaaacuccagcucucccuacauucuagagcugacauuggcuguuguauauaaagccccuaguagggucugacacauagcaaaaaugccuacuguggguuuggagugaaggaacucuuaauggcguauuggaaagacgcacgggugaggacuuugggguuuggggcugaauggcuucaggaucggugucugccgaggccaugaacagucuugcuuggacucgagguggugccaaggaccucccugaacuucugccuguuguucuuaguucguucuugcauuuauuuccuaccaggggccuucgagauugagaucaauggacagcugguguucuccaagcuggagaauggaggguuuccuuaugagaaagacgugaguauuuaauguaccucgggaggguggcugagacgagacacacccuccucuccugugcaugacacucgcccaugucucuguccgcuagcucauggaagccauccgaagagccagcaauggagaaccuguagaaaagaucaccaacagccggccucccugugucauccugugacuaagaaaugauucuuggaagcuugguucugggguuuaaaccuuuccuugugguuacgcuaggaaucccucuaccuuuagccccucacuuggcccuagguaacuaagacccugacuucacuuugccucuuagggcacaaggagggacuagacauuucuguggccaaaggcagaaaagagauguucucugugaacaucaccaucgcucucccgggaucugugcccucugcaguuugguccucuccccagcguggcaauaccuuucagaugccacgguugcuauaacuuauuuucccugaauccugggcagugucggcucuuggcaauaaagaguaauuacaaaugcuugugucaacuggcg

SEQ ID NO: 6352 - RNA, 6115 nt, Mus musculus
aagccuacaacucccaggaggcgccgggcgggccggugaggaggcagccuagaaacuacacuucccaagaggcacaacgugauaggcgcgugguagugacgucaccgccccggcucggggagcugauucggccagagcugccagcgggguagccaccgccgcugguuuguuacagcugcuggagcggccgcggcccggguucucgggcucucucccgggcccucgaccuccaaccccgcgcggugaguccagacggguggcaucggaguggugaagcccgaaggcuccacggguuggagagccgggagagaaggcugcugcuggggaggcguccgcgcaggaggagaccugagcuggguggcuggggguggagagugcgugcaucaggcgaaggagugccaaaagaggaaagugggagcagggggccgggggugauaauccgggaggagcgcugcagcugggggugggaggcggggaacggcuggacuuaagggauaaagguuuggcugccuccaggguugagugaaugcguggagauggggguugggccccgaacccggccagacugcuagugcgagguaccaggcugcagagcagaagcgggaggccccguggaaggaguucucauacacauacucccaagauaucgaggacaccguucccucgcuccugacucguggaggcuugcuuuuuuuuccacacccacuuuccugaguccaggagucgggcuggcgaggacaaccgugguucugcagauugagggugggccgaguggaagcgacauuguguguugcaugaacucccucuugggaucccuugggaacagguuugcuguauaaagggcaagucuuaaacuggggagggauuugggaagugcuuaccggaugguuaacgccgcggggagggggggaaggcgggagggaggagaugggggugguaaucuggucuuggcaugagugucugacagacuggcuugggccugcauggaaaagaggcaaagagcuauaccauagccaaaaguuuaaaaaaaaaaaaagugguuaacaggacggaguugcuucaggcucugauuugaggcagauuaugaaaucacaccagcuaccugccaguugugguagcaguuuucagucuggucaccccagaccuuucugccccugccagucuccuauuucuucacuucugggagaaaggucaguuguguccuaauggaaauacacaaagccacaggaaagucucaggaguacuuuugggaggauggugaaagagggugcagcagucuccugaaguuccuaaccugcuuuaaaagacaacuagcacuuaggcuuuaggaagacaguucccguggggucaccuaggcucucuuagaugcccuguuagagccagaaaggaguggagggucuugcaguccugggauccagccagagguuuggcacuacugaaccgcagugugagggaguugugucuauagcugugccacuguagggcuguguaauggagaaggacagcaguuucugccgagacuugggaaacuuuuccucaccuuaaugaucuuucagagacuuuagcucucagucccugcccucccauggaggcuguuacauaguagaugucccaggggugggcucuguuaagggcccuaaggccugaggaagguaaacaacugguguucuaguuccuuggguuucuguugggaccaguuaucugucuuaaugagccaggaguuuggucccuggcguauguccaccugcaugcacccuaggccaacucagggguauguuuguugggaaacuguuguggguccuaucucccgagguauuugagaagaggaaacuugcuuccauuauccuuaaguaaugaacuuaucugagugaaugcuagcuccuguggaggaggcuuggccagaauccuagcugggugagauagcaucugagucugggggugaggugacuacagcagggugagggagcugggcuggcacuuccagacucucuccauuguuccuucuuucugugcaccuugcuguuagccucaguaaugugucuuucccaggcucgacacuaaagugggagaggguaagccaguacauggaugccucccauuuccacuuucugcuggucagcaagugggcccucaggaaucuggggacagccaugcuccccucuggccacugugggcuacuacuguuguauucugggcaugaaggguagccuuuuucaguuccuuguguagagcuucuaccacuggggcugggcaagaaagggguguugucaccucacacccacagacagaugcugggaagggagcgaggucaggugaggccgagaagagaggcgguaggagggaggccacagguaguuuuguguccuugggaggggaagguugguacagguaccacauccuacccgugcacauccuacccguguugaugucagcugugugcucuggucauguccuccucucucccuggugggcugaagggcuugggugguuuggcaucuagugguggcaccccaagagagucagccucagcagcugccaaguggacaaaauguccuaauggaugggucauuugauguggcaguguuuguaggacugagggaaggcugucccuggccugcuguugccucugcccucuucucccuuccuugucagucauccugggccugggcuugagaaaauccaggguuggagaaauaggggugguaggaacaguagccccaaaguucuucauccguuguugcuugcugcacccacagaucuucucugcuucuuaacguuuuggggggagagcuuaggguggugggugucuucugucaggucuucagugagagccagcagagguuauuuugagugagaguuccagggcaggcuuuuuucccuccugcaggaggaagaggcccucaggagaucuguaggggauaugauugggguaaaggcacugauuguuauagccugggcaauugauugcuggucaccucuuggugacuuguccucccuggcuaugucagcagaugguguguaugacagccugguguuaguccagcccagugacaggaaaugacuagugucacguucacauggacuuucuccagcuucugggcuugagacucccaacaguggacagugguguggaguucucagggagugaaaagccugccucucuggggcuuggggugugaggggcagggaaaguggugugacuugucucaccuguguugcucuuuugcagagcggcagucaagagggguggcaggaugaaugugggcacagcacacagugaggugaaccccaacacacgggugaugaacagucgcggcaucuggcucuccuacgugcuggccaucggacuccugcaugucgugcugcugagcauucccuuugugagcgucccugucgucuggacccucaccaaccuuauccacaaccugguaagauccugcuuaccaccagccacccccccaccccccccccaccccccgugcgggcuguucuaggccagagcugagagauaggaggagcuucuaaugggacagacagcagguccugacaacaucugucaccagagcccaggcccaacucuuaccuggcucccccuugugggcuuuagaaucaaauuugcacaucguccaugucucccuaguuggguggcugguguguuugaaggacagcaaacugggagcugagcccaugcugaggcugcccccaggucccaggaaucugugcagagacauucuuuucccauauuaggaucucauaauccucugugcucccuaaaaccugcugcuuuguaccccacuuuugagcaggcuggggucuaguccuuccuccuugguuugcuccuuuuagcuaacauguagagaccccaguugggcuggaaaggcugccuugcuguguccguuccuuccuuauuuccccccuuguucucccaccaagcucuggugcgcucuccuguguuaaggcugccuuccugaguuacugcagcagagcagguggcaguccacccagagcugcugcugucugauaagugggggagccaggcugggagccaucucguauguucugacaaaggccccucuuuucagggcauguacaucuuucugcacaccgugaaagggacgcccuucgagacuccagaccaaggcaaagcaagguugcugacccacugggagcagauggacuacgggguccaguucacagccucuaggaaguucuuaaccaucacgccuauagugcugugaguacucuggcuaugggagaauaagcagagguaaacgggugggcucagcuggcccuaaacccucccagcuuuggcccuugcuguauggaugagcagagggagggaagagacauauucuugggucucacacggggccuuuggccucccuggcccugucuuuccucacuggaguaagcugggggggaagguaggucaggagggccuugcuagcuagagaguugucacuccacuucuuaucugggaacccauauuuccuccuucccucccucccucccuccccuccagguacuuccucaccagcuucuacaccaaguaugaccaaguccauuucauacucaacacuguguccuugaugacugugcucauucccaagcucccccagcuccacggaguccggaucuuuggaaucaauaaguacugagguuguagccccuuccccagccggguuggcaggggaaggguggaaggccuuugcugugaugcugaagacaggagccucuggacacugccagagaugggggugugcccugggccuggcuucccccucgcuuccccaguagccgacuuggaguagcuuguagugggguuaggguggggcccuugggcucuaacccauucugaaguuuuugaucuuuuuccuuuugccuuuugaauagagaugccauggggguggucaggaaagaggcugggcucucuggcugacugugggccugagaaauugggacaggaagccaggaaaaggcccuguuggcuuguuuacccucaggcagccauagcacuuuagcccccaaaaaggggggcagagggacgguacagcuucugcauugguugcccucauuccuucagugugugaagcgagacucgcuguucuguauguauuagaacccugcgccgugcugccucugccgccaggcagggagcaggcgggcuuugugggcuuccuggcaacccacgauggguaggcuguggggcaggggagauuaggaaaggaagauggguugaugggacaccuagagguggggacaggaugcugccaccuugguccuggggagaggggaguucugagcaaggguuggguggggauaguaaguugggucuuacuuagaauggacaagauaacugcagccgauauggaucaguguaaaaaaaaaagaggucugggaaggagaagccagacuccgccuccucugagaugugggcuaggaggagagcuggcguggaggguuaauuuacccacagaacgaugcugauaggaagggaggccccuguggguuugaacuccuggguuggaaugaggauaugcacaggcuggaagggccugugaguccucagaagcggguucacuucgacacuucccuuaguggugugugugggcgcgcgcggaagcuuucugagaggcucuuccuuaagcguucaauucguauucuuguguagauugugcuggggcagugccucuuguguggcuugcaugugaauggucaggaggccaccuccacauguggucaguggccuccacagugcuacaggaucucugcccaaaccaggcaguaguaggggcagcugcaggcacuguccucagcccaaagagaggcaggucauggagccugaggcuaggccgagaggagcugucucuccacucgcugggucgacuggggcauguuccuuuggaaacgcguggcuacccaagcccucucccagggaggggcuggagggaggucacucaccuguuugucccccucccccucauucugaacccaguguaucauagggaacuuucaccuucuggucuuucuaagcaaagugugaauaggauuuuuacucccuuuguacaguauucugaaaaaaugcaaauaaagagcaacauguucuguuuaccau

SEQ ID NO: 6353 - RNA, 1298 nt, Mus musculus
cuaauaugucacucuugugacacgagugccagccaggccgccucccugguguuuaccuggccucccuuggcagucauacagguacuuagaggacaaaaauguuuauuucaacgaaggaaaugaagauucaagcagaagaaauagcuuggacaggccccuugggcccauuucagcagggcaaagggacagaaggaccucacagauuaaucuagaaucaauagaacccaaacguuccaagucuaagggauuccuucccccgggguccuguugaagagagagagacagagacagagacagagacagagacagagacagagacagagacagacagagggacggucggacagaccaauggaccuugggcuaagagagcccugaaaggacaggcuuggguccagagaggguccacugagggacucuagcaggagcgaguuucagugggacguagaauucuaacuuugcucuucugucguagguucgucuauuccccagcuucuccuccacuccaggauuauguuuaucugcgaccaugccccuacuagcuccucgccuccugccccuccugcuggugauuggcaccgggggcucugugccccgcccccuggcacugccccagggcugcuacguagcagaagaagccggggaacagacauuccgcugcagccgggcuggucugagugccgugcccaacgguauccccaacgacacccgaaagcuuuaccuggacgccaaccaguuggcaucagugccagcuggugccuuccagcaccugccugcccuggaagaacuagaccugucucauaacgcucuuguucaucucucaggggcugcuuuccagggccuggagggcacucugcgccaccucgaccucucugccaaccagcuagcaucugugccuguggcagccuucguggggcugcagauccaagugaaccugucugccaacccauggcgcugcgacugugcccuacaggaagugcucaggcacgucagguuggcuccaggcuccgggacaggcauugugugugguccagaagcccgaccagaucucgugggacacgaguuccuucugcucaccagggaggaagagcugugugggacaggacgaggugggacccgaaggagcacggauguggcccuguuagucaccauggggggcuggcugacacugguaguggcuuaucugauccgcuauguguggcagaaccgagaugagacgcggcgcccggucaagcgggcuccucccgcgcagccugugcgcucagaggacuccucuacacucagcacagugcucugag

SEQ ID NO: 6354 - RNA, 1298 nt, Mus musculus
cucagagcacugugcugaguguagaggaguccucugagcgcacaggcugcgcgggaggagcccgcuugaccgggcgccgcgucucaucucgguucugccacacauagcggaucagauaagccacuaccagugucagccagccccccauggugacuaacagggccacauccgugcuccuucgggucccaccucguccugucccacacagcucuuccucccuggugagcagaaggaacucgugucccacgagaucuggucgggcuucuggaccacacacaaugccugucccggagccuggagccaaccugacgugccugagcacuuccuguagggcacagucgcagcgccauggguuggcagacagguucacuuggaucugcagccccacgaaggcugccacaggcacagaugcuagcugguuggcagagaggucgagguggcgcagagugcccuccaggcccuggaaagcagccccugagagaugaacaagagcguuaugagacaggucuaguucuuccagggcaggcaggugcuggaaggcaccagcuggcacugaugccaacugguuggcguccagguaaagcuuucgggugucguuggggauaccguugggcacggcacucagaccagcccggcugcagcggaaugucuguuccccggcuucuucugcuacguagcagcccuggggcagugccagggggcggggcacagagcccccggugccaaucaccagcaggaggggcaggaggcgaggagcuaguaggggcauggucgcagauaaacauaauccuggaguggaggagaagcuggggaauagacgaaccuacgacagaagagcaaaguuagaauucuacgucccacugaaacucgcuccugcuagagucccucaguggacccucucuggacccaagccuguccuuucagggcucucuuagcccaagguccauuggucuguccgaccgucccucugucugucucugucucugucucugucucugucucugucucugucucugucucucucucuucaacaggaccccgggggaaggaaucccuuagacuuggaacguuuggguucuauugauucuagauuaaucugugagguccuucugucccuuugcccugcugaaaugggcccaaggggccuguccaagcuauuucuucugcuugaaucuucauuuccuucguugaaauaaacauuuuuguccucuaaguaccuguaugacugccaagggaggccagguaaacaccagggaggcggccuggcuggcacucgugucacaagagugacauauuag

SEQ ID NO: 6355 - RNA, 13360 nt, Mus musculus
cagucauucccucacccuauagacagaacgagcucugguuccucaccacacaccagcugccagacaggauccagcaucacccuucccugguaagaucaaugauggcugaggaggcagggggacauucuggggaaccaggggaagguuggggccaaaugggcaugggauuucuuauccuuuaucauggccauaaaucucccugcauuuuacuggggguaggacucauaguaggccuuagagagaagagaggcagcccuuugagugccacucuggugaaggguagguccuucuagguacacucaguuggucucuggagggacauaggccaucccaacccuuccaggaacaagggcuggaaaguauauuguagauggcaggauggccccaacaucucugugugcuccuuccuguuucccugccucugucaaguacuacagaaaggugaggcccauggaggcuagcugaugugucugaucucuuccacccaccaggaaaaccugggugugucuccuggauccccaggugagauaccucgacuucaaagacagaguccuaaacugucaaacuugugauccuugcaggccccacauccucuuggucccucucccuccagcaugucucccaggaccaagcucacucuuucuauccuuguuucuaccagacauggugcugaugcuguagaggugacucaggcccauuuccugcccucaggaaagucacaguugaguaggcaaggcagucaggugaacagauggaugguaacaagaugaauuagcagguguuucagaaguggauauacaagaugccuugggaaugcaggcagagucaccaaaaugcccaaaggaguaaaggggugagcaggugacaugaguugagucuuuuuuuuuccuucuuacuccaguccugcuugcucagaguccaaagauugauugauugauugauugauugauugauugauuauaaguacacuguagcucagaucucauuauggaugguugugagccaccacgugguugcugggauuugaacucaggaccuccagaagagcagucugugcucuuaacugcugagccaucucuccaguccuucaguugagucuuauaggacaaauacgaauucuuucuauuggaaaggggauauaucguaagcagaacuaacaaaggcaaagaaguaguugggagagaggaacuaggaaauuugcccacuuauacugguguugcuaggaggugggugggaaggaaauggagggugcaaacaaguguagccuugccaaggaaagggcaacuggggaagcugcccagcucugacugcccaggcuccugggcccagugcgguugcuucuuucccuaguguccacagguccuaguuucaacugucccuuagugugacaggacacuucccuucccuugcugaugacagacucuaacugggcucuguucugugaagaagugaacauggaaugagaaaagagcccuuggcaaagggaaaagccggcaucuugugucagccaugugaacucuagagcucgggauuguccaucacaaaagaaggacuccgugggcuccuuccaaauccaacauccagaugcucuaauugucuccccucuacucuaggagugaagccuggugacagccucuuacaaaguccuuaccaggucuugacgaccccagcggcugccuggacauuguccaucucuuucuccacagagacaaugacuauguuugagaaugucacccgggcccuggcuagacagcugaacccucgaggggaucugacaccccuagacagccucaucgacuucaaacgcuuccaucccuucugccuggugcugaggaagaggaagagcacacuguucuggggagcccgcuaugugcacaccgacuacacucuccuggaugugcuggagccgggcagcucccccucaggucagccucucacccagagcugugaggccagggccagccauccugaccacagggaagauucucaagcucuccccacugauaugguuaggggucaccaagcccagaguucucucugggggugcugaugaguggggguaccucucagcucagcuacuucugucuuuucccucccacagauccgacagacaguggcaacuuuagcuuuaagaauaugcuggaugcucgaguagagggagauguggaugugccaaagacagugaagguaaaggggacugcgggucugucacggagcagcacacuggaggugcagacgcucagcguggcucccacggcucuggagaacuugcacaaggagaggugagagaggacgaggcugaggggcugccaggaugagguuaggcaguguguggaugaugcuuugagucaccuguggaaggguagacccccucacccuggccguuaccaaucccugaagagaauacucccugggguggacagaaagcacaguggugaggagccucaguugucuucucuauagcgugaugggaauggaggacagguccuaacauucucucaauccuaagacugaaaugcaauggaaaaaagucagaaguuuguagcaacuguuccuuacagagacuguguccggcgcucuguucccacaaaacaagcuucagacuggcuccauccauacaccuagggaacacugccccagcagacaagggguguggcagaaccgguguucauacaaggcucuggcacgagucugggcugacuuuuaaauaauuaaguagugguugaaagaagcaggcgaggacuugaggggccggaagaggaaggaauugacaagucacccaguaaacauuuacaguuuucacugaguguaaagcacccuacuacgugcuaguguaccuagaaugucuacauccaagaaccuugagguguaggagggugaaaacuaccauguaggaguaauuauccggggcuggagagauggcucagagguuaagagcacuggcugcucuuccugaggcccugaguucaauucccaagaguaauuauccaguugggcagugguggcccaugccuuuaucccaacccuugggaggcagauggaggagaaucucugaguuugagaccagccuagucuacaaagugaacuccuggacagccaggguuacacagagaaacccugucuugaaaaccaagaacaaaaagaguagcuauccaauucgagaggcaaugggugcauggcaaacauuuggcuggacuugcaagggggcuuuuucuggcugggggugugaggcaaaucucacgcagcaguggucuuggguuuagccuugaaugauggguauaguuggucaugcagggaaaggagaagggccuuacagagacauacaggugagaugucucaacaccaauaggaaucaugaacuagccagcacacagaugcaaaggagggacaaauggaggguagacccagagcaggugggagccagaaacaggaaaaggagcccaacaaguaggcgccagggagagcccgauucccugaugcugcucugauguguguccgugacugacuugaccagauggaagaagugcauuagagagaggaagguggacagaaacacacugucccgcuauccaucagagaauuaaaauaaggacaagagcugggaggcguggccgggaugcagggaggcguggccgggaugcagggaggcguggccgggaugcagggaggagugggcaccaggcuuauugcaaaggaugaugaacuggguuaaacucagcagcugauugcagggugacagauuuguuaaagaugacugacucugagucuugaccuagguugugucauuacaagacauuaaaggugacaaacaggaaggcuagugacagguaguuacguggggacgguugucagcuccuuucacaacggagcuggaguacuguucaauggauagcaggaaagggggcuggaacuucagagagcucaggguaaagacgcacacgugggggucagcaagauccagacuaagaugcuaggaaucaggugcggggaggggaugaggaagcuggagaacgcucagagagaggaggcauaaaaacagaaucucagggaccagagagguggcuuaguggcuaagagcauuuacugcuuuugcagaggacccgaguucaguucccaggucucacaucacacauuagugagcucacagcaccaguaacuccagcuccagggggucugaugcuuucuucugcaugcuccccacacgcucaugcacacacauauacaucacacacacuccccucucucucugucucucugucugucucugucucucucucucugucucucucugucugucugucucucucugugucucugucucucucuccgucucucuguuucugucucucucucucucacacacacacacacagacaccaaaaucucagaggacauaaaauauuaagguucuaaaucagcuggaaaagggaguccgugguauguacaugguuuaggagccagaaagacaggagcagaagcagcgugcaauugggagccaagauaaggcaggaaggcacagaagggcagaagauccagugugauccacauuuagggggaucacucaguuuagugagugggggagggggucacugugauuucagcagagugagauuccaauggggugaugaacacacaaaccaugaguaugguucaccccaauuugagacauuugccaguaggugaaggagagaaauagggcagugacuugagggagaacucaggaauaaaagcagaugcuguaaggacagagauguguuuucauacagaagcaaaggggaggaggaaguggagaugccaggugaugagccuccagcuguuugcacaguuuaucucagcacccugggagguaguuggcgucaucucuguuuuauagaugaggcaacucagacucaaagcugcugcccuaccaggaagcagaagucugaguuugcauuguggccggaucugagccuucaugccuucccuggcaccauacugucuaggauugacagauugaaaaagaagacacuaaaauaaauaaauaaaauaaaauaaaauaaaaauaaaaaaagcagacacugaggggcauaauggcgcacaccuuuggucccagugcuugagaggcaaagacagguggaucucugugaguucaagggcagcccuggucuacacaugacagccauggcuguacagaggggacccugucucaaaauaaaauaguacaaagcacaggugguggcccuggagaggaaaugcugaagguggugucucacuguaucucuugccuuaggaaacugucagcagaccacccauuccugaaggagaugcgggaacgcggggagaaccucuauguggugauggaggugguggaaacccuacaggaagucacucuggagcgagccggcaaggcagagggcugcuucucucuccccuucuuugccccacugggacuacagguuugcuauacacagacacagauagauagaaagagaaagagacagaccacaccgcacuguccuuugcucagugguacccagcagaccaggucuccauaggccacugacaacacagagcaaguuaagugauacaggauuuguccucaccccugccccgcucuccugccugguaugguggugcacacuaguaaucccagcacucugaaggcagaggcaggagagucacggguucaaggucagucuggacuaccugguaagaucccaggaagagggcaguuuccugcuuucagaauguccuuacuuauagaugagucgcacagguaaagcccgguagaaauaagugcaucucuuauaaucuauacauacaucuagugaguauguucaagaggaaagguaugggauugggagccaggggaagacuuccugaaugagauaagaauggggcagcugguguggaggaaggaggaaccuggguuguggggcaggaugauccacaggcaggugcuagagcaggucuguccaguuccucugcuguccaauccagaagcaggcauagcuuguuagggggugaucacuagaaaugaaugggaagggggcuggagagauggcuuagugguuaagagcacugaccgcucuugcagaaguugaguucaauucucagcaaccacaugguggcuuacaaccaucuguaaugggguccgaugcccucuucuggugugucuaaagacaacgacaguguacucuuauacauaaaauaaauaaaugaauguauauauuuuuuuaaaagaaaugaaugggaaagcuucaagggccauaaguucagagcacagagaaagucaacuggagauccuacugaaggguuuccaacugcuuguguucucaaagacugccagaccuagcccuguaccugcauccugcuccucuugcuaauggaucucagagaacucacagacucucauuguguaauccuagggauccgugaaccacaaggaggcuguaaccauccccaagggcuguguucuggccuaucgagugagacaacugauggucaacggcaaagaugaguggggugagcagagaccaacauguucucuccucaagauaagggauggcugcauccgugcaguggcauccugguccucucuugccgugugaggggaugggguggggggagcagcaucuuauauugcccauugcuggagacagaaccaagguugcucuagaugaaggagaccugaguuccaggugucuaugguggcacuggggaagcuguggcgagugacccaaaagccaaaugagcacagccucuggccuccagaagcccaaggagaagacagauccuaacaccagcacuggcuuggugaugguguguggggggcagugcuauugaagggaagagcuuacagcuuccaacagugaaggucagguaaaaaauuagauggggcauuugaggagcuugggguuugaggcugaagaaaaaaggguguggcaagcuggugaugaccuccugaugccuugucuugucccuuacaggcauuccacacauuugcaaugacagcaugcaaaccuucccuccuggagguaggugcacggcuuacaggcuccccacaucuccugcucagaugauaucagguaaaggucccccacucuaaaauagcagcagcuccuauaaucuaccaacagagcaucugcuccuguuuccuggguccucagacagauagagguaugggauaaaaacacagcccagaggaacaaagagauaggggcugaagcacagccagaaacagagcgauuuggagacgggguguguuccaaaguuguaugggugggugugcucacagaaucuccauguuuucauagugcugucaugagacugucuuagccacuggcuuuagugaaaggcagcaaagaguuuguccugacagauguucuuuuuguguuuucagaaaagccaggagaagggaaguucauauguaaguguuccuuuuguuucacaacuuucuugacuuaaguucaaaaccuuagucuuccucccuccuccaugggacugaccgggaagacagugggacaguucucagcaaagagcuguccaucaacgacagcagaacuuccacuaagaaguuaggauaagaauaagaaguucaguuccaauaaaaacaauaggauggagagaucuguagacaaaaugcacaggagaucugcugccccagaccuuuguugucagcugccucaguagcugcaaccuguuccgcguguaucugcugccaguaacuggggcagcuggugcugagucacccagcugcugggugauaccaguucagccugagugcccuuuucacguugugucaguucuucugguucauuccugccuccagucucggggcuggagcaagaggauucugaagacaucugggaucucagaggggaggugcucucccauucccccuagggauggcugccauucuaaaggauuguguucuuauuguucuauuuaccucuuauuuucucagugauccaggcaucugauguugguaaggagccuugugaauuuuuucaagacuuugcuacacagguagggagaaaagcauuagaguggaagggaaaggcacaggcugagcccugggucuugggauuacagccacuuucaggaagccauucccuccaacguagaguagauguacuuuuaggauuccggccgcuaaacagacaggcugcucacagccacaguccauggauacagacccacugcucucugaaacagucccaauguccacuucauuacgucaaauuaugacgaauuugacauuaugucaaagccauuguuugucuacuaacucaaaacaaggggaaacaggcuuccccuaaaugucuggguggaguagcugaaaccagaagucaagugugcacagauaaaggaugaaucccgagaugcaggauuguggugguaacgguagugagauuaacugucguguuaguugaaggcagggggucuaguccaccucuuugcuccaucuugccuaacaaggcuuuagcauaacuucuuaaccacaccccuugggaaagaggaaaagucagauaaaagcuggaagcagggcaccggguccugaggaaggggucacgaagccuacagaacguucagggugagagggcaucagcugaaagggugccagacacauuaacugugccccuaggggagaugcacgaagacuucaagacauuaaaggaagagguucagcgagagacucaggaaguggagaaguuaaguccaguggggcgaagcucacuacucacuucccucagccaucuccuaggaaagaagaaagagcuccaggaccuugagcagacggugagaguccagagcacagggaguauggagggagggaagugugggugguggcagccacugcagauggggaggggaacugccaauggcacagugaccaaaggcugcggaauaaauagcagauguccuucccaaggcugcccaaguucauuucggcugcuggacuaccacugcccccuuuuaucccugaaagaagagcaucaguacaggguucccggaaguggugcgcgcccucugauggccagaggguaccauaagccuauggcgcccccugcuggauaacagcuuguacuuuccagaacucaaaacccagggaccaaggagccuacuaccuaccaguccagcacuuccuaggaccugaccacacacaaaagaaacagggagugggagagagucagccucggcucacagauuacugugugccaagugcuagguuagaccuuuaccgcaaguauuagucacccuguuuuccucacagcuugaaggggcucuagacaagggacacgaagugacccuggaagcacuccccaaagauguccugcugucaaaggacgcuauggacgccauccuuuacuuccucggggcucugacaggugagugagaagugagucagacgaguuucuuucuguuauaagaguaaaucgugugaaugauucccaaaugaaugaaugaguggaugccagguagcuuauaguguauguacguauauguguguguguguguguguguguguguguguguauguguguguauauguauauauauauauguguguguguauguauauauguauacauauguauguguauguauauauguauguguauguacauauauguauguguauguauauauguauauuuauauauuuauguguguauguauauguguguauguauauauguguauguguguguguauuuguauguguguauauauguauguguguauauguguguauauguauguguguauauauuuguguguauguauaucuauguguguauauguauguauauauguguguguauauaauguguguauauauguguguguauguauauauguguguauauguauguguaugguguaugucuauguguguguguauguauauauauacaaggcccugaguucaauccagguauuucagagggagagacaaaaaucaccaccaaauugguuucauuugguccuuuuuuuauuuauuuuuuauuuuuuugguuuuuugagacaggguuucucuguguagcccuggcuguccuggcacucacuuuguagaccaggcuggccucgaacucagaaauccaccugccucugccuccagagugcugggauuaaaggcgugcaccaccaugcccagcuuccauuuuuauuuuuauuuuuugcuacaucuuucgauccuucugcauggugcuaaguccaucacuuccacauugcugccugucuguuagcuuuaauucacagucacuacucuucugaucuugugccuguauuuucuccugaccucugcacgacacauuuucccacucaaggacaaaaccucugaguccuuuggacauaagcugugauguuugcuacuuuuuuuaagggucauaagaugacucagugagcugggcggugguggcccacgccuuuaaucccagcacuugggaagcagaggcaggcggauuucugaguucaaggccggccuggucuacaaaguaaguuuguuccaggacagccagagcuuuacagagaaacccugucucgaaaaagccaaaaaaggcaaaaaaaaaaaaaaaaaagauggcucacugaguaaggugcuugcugucaagccugacagugggaauucaauucccagacccacagugggaagaccgacuccugaaaguugucugcuuccuccauggcaugcaccugugugugcuugaacacauaagugcauacguucaaguguacacgcaacauauacacacauacaagugggggaaagcuaggcagaccgaggcacaccuuuaaucccagcacugcagggacagaggcaggaggaugucugugacuucaggccagccuggucuacagagugaguuccaggccgagcagagcuacacagugagaccccgucucagaaagaaaaauagugguuggucagugacgggacuuacugucaaaugccaagcgcagaggaaacccucagcuauggcuaucacagugugguagcuagcucaugccuauagucccagcacucaggaaacugaggcaggaggaugacuguagaucugaggccacacucgguacagagugccuaacuuaacccugggcuacagaaugagauucugucucaaaaacaaacagaaagcccaugacuucucccaaaacuacuucaaaagauuagaauuuugguggcuguuguuuuuuagaugaggucucacuauggaguccugguuggccuggaacucacuauguagaacagucuggccucgaacucacaaaguccauauagcucugccuuccagaauacugagauuaaaggugugugucacuuuacccagucaaaaaucacaacuuguuuuaaguuaauagcuagcaaagguguauguuauagaguagguguucaucuguggacagauggagggugggauggacagauagaugcguggaugcauggauuaauugaucagagugugcaaacacuauuuggagucugcaguucccucuuuaccagcaacacuuuuuuuuuuccucugcuuuucccuccagugcuaagugaagcccaacagaagcuucuaguaaaauccuuggagaaaaagauccuaccggugcaacugaagcuggugagaaaaagugacagaugccagagggcguucagggcagggugggguguaagaggaagagcuagaaccugugggaacaugcagaccuacugugcucacaggccccagucuuuccccuugagaaaagucuuccccucucccuaggugcuuaggguacucagccugcucugguaggagggagaaaggcuuuccaguuccccauuuccagucacuuuggucccuugcagguugaaagcaccauggagaagaacuuccugcaagauaaagaggguguuuucccccugcaaccugaucugcucuccucccucggggaggaggaacugauccuaacagaagcacuggugggacuaagcggccuggaaguccagagaucaggcccccaguacacgugggauccggacacgcucccccaccuuugugcccucuaugcuggccucucccuccuucaacugcuaagcaagaauuccuaaugcaccuucuuugccugcugcccuaaagccuucccagccuuacugugcuccaucuguaacacugcaagacacuacagagccuccaggcugaggacaacugaaaugccagcucaaaaaucagucuccaaguuccuucugccucaccaucuaucucucuccuucuguccuccagcucagcacccacuaagcccaucuccugaugcuuaaauccugaagauacagaaucauucaaacccuuacuacuuugagucacuucauuaagagggguuggggggaggcuugggguggugaugguggugguuauggugugaggcagaggcaggugaaucucuuaaguucgaggccagccuggucugcagagugaacuccaggacagccagggcaacacagagaaaccuugucuugaaaacaacaaaaccacauuuauuuccuagucugauccuucccaugugugccucaaaaaaaaaaaaaaaaaaaaaaaacuggucuuacaagaaugaauggagaauacuaugucaauccuagaagaagcugucuucugguuuuucuguuuaagggaauugucccagguaaagaaacagccaugauccauacauacacguuacugcccacacuguuccucaggccugcuggaaaaugcucccagugcucagaggguuagaauccagaacaucugcuguacacuggaaagaucauccaagcugccugaccucaccaaagcgcccauguucuccagcccuggcugagggcuugggagaggaaaggaaggucuaggggacuaagauacaagcagaaaacaagacaauagauuucauguugauuaaguagaaaaugaaggugagguucuuucucaaaauaaauaaauaaauaaauaaauaaauuagaggaagagggagggggcacccaagaauaagaccuaaaccuuuaaaucagugguuugaccugugagucgcgaccccggugggaggucagaugacucacaggaguugcauaucagauauccuucauaucaaauauuuacauuaugacuucuaacaggagcaaaauuggagcuaugaauuuacaaugaaaauaauucuaugguugggggucaccacagcaugaggaacuggaucaaagggucgcaguguuaggaaggcugagagccgcugcuucaguuuuguuuucaacccucaacucaggaugaguguggaugagcuuggcuuguauauuauaaucucauuaaacaucuguauauuauaaucucauuaaacgucugggaucucaucacccucugcccaacgcuggcuuuga

SEQ ID NO: 6356 - RNA, 1686 nt, Mus musculus
ucgggaaaggguuucuccguguagcccugguggucccggaacucacucuguaaaccaugcugagccucgaacucacagaaacccacccgucucugcuuccugagugcugggauaaaaggcaugcaccaccacgcugggcauguuggguuuuucaacaaucuuauauauacuggcccugagcaguauacaacguggacuccuauuauuaaauuugacuaauucuacacaaauacacacgacccccacauucccaggcugcagagaagguaugccuuauacucagcauuauacaaaaauuugacaaggaaguucggaugcccuggggguugagcucaguuuaucgaaagccaaacagccuagcuacacguccacaagcuccuuuucuuucuggugcuggaagcaucuggcgggcguugagagcacgagccuggcggauuucauuggggaccugacccgcgcaaacugggagagcuugaccggggcggggguuagggggguggagaggaaucugcccggcaacucaugaugucauccccaucugagcuccgauagguccuacccacuuacauguuagagucuguuguagcccagcuuggagucuaaagugaccucucgcggacauccaaagauguacacuagagaggaagauaaaaucaccacucucaggucccacaaauuccugcagacuccucccaguuccuagaagguccgccuucaucguuucuugaagacuccucccacuuccuagaagauccgccuucaucgugcaccucggcuguugauuuauuuucccucccuggacucggccaucugcucgccaugccuggcauuucccagaagccccagcgccgggaaggaguuugcagcugcucggucaucgugcggcccgacgcgagcccgcgcuggugugcaggcccggcucugugccuggucucuggugugaggguuuacgcgaggccccugcuucgguccccggacuaggccucgaccccgggcgccaugaagcaggagggcucggcgcggcgccgaggcgccgacaaggcaaagccgccgccgggaggggaacaagaaccgccgccaccggccccccaggauguggagaugaaagaggaggcagcagcugggagcggcuccacgggggagggagacggcaaggcagcugcgaccgagcacucccagagagagcuggacacugucaccuuagaagguacgggagcccacgucggggucgugccgcgaucaccggugacagcggccagggugaugcgacuucuugcugggaccucugcguagccuccaccuaccuugguuccuucggucaauggagcuggggucagaagugcccgcccaaccacccugacucccucgaccccagccgaugaccgaaccuguucuccagucugcggacugcucuccuccucugggguugcaucuuagucucaccgagccuuuucuucaguccuucccagugaucuacuccauccgaccgauucuagcgccuguuauugcuauguagaaaguagcauuuguauuugugucuagagaaaccaggguaacagauuacacuagccucuuaguuuaagaguuuauaaaaauggguucuguagcucuaggcuccuuuagcaaacucccucggagagccauuucuaccuucugccuuccuucuguaguugaagcaucuaaacu

SEQ ID NO: 6357 - RNA, 1686 nt, Mus musculus
aguuuagaugcuucaacuacagaaggaaggcagaagguagaaauggcucuccgagggaguuugcuaaaggagccuagagcuacagaacccauuuuuauaaacucuuaaacuaagaggcuaguguaaucuguuacccugguuucucuagacacaaauacaaaugcuacuuucuacauagcaauaacaggcgcuagaaucggucggauggaguagaucacugggaaggacugaagaaaaggcucggugagacuaagaugcaaccccagaggaggagagcaguccgcagacuggagaacagguucggucaucggcuggggucgagggagucagggugguugggcgggcacuucugaccccagcuccauugaccgaaggaaccaagguagguggaggcuacgcagaggucccagcaagaagucgcaucacccuggccgcugucaccggugaucgcggcacgaccccgacgugggcucccguaccuucuaaggugacaguguccagcucucucugggagugcucggucgcagcugccuugccgucucccucccccguggagccgcucccagcugcugccuccucuuucaucuccacauccuggggggccgguggcggcgguucuuguuccccucccggcggcggcuuugccuugucggcgccucggcgccgcgccgagcccuccugcuucauggcgcccggggucgaggccuaguccggggaccgaagcaggggccucgcguaaacccucacaccagagaccaggcacagagccgggccugcacaccagcgcgggcucgcgucgggccgcacgaugaccgagcagcugcaaacuccuucccggcgcuggggcuucugggaaaugccaggcauggcgagcagauggccgaguccagggagggaaaauaaaucaacagccgaggugcacgaugaaggcggaucuucuaggaagugggaggagucuucaagaaacgaugaaggcggaccuucuaggaacugggaggagucugcaggaauuugugggaccugagaguggugauuuuaucuuccucucuaguguacaucuuuggauguccgcgagaggucacuuuagacuccaagcugggcuacaacagacucuaacauguaaguggguaggaccuaucggagcucagauggggaugacaucaugaguugccgggcagauuccucuccaccccccuaacccccgccccggucaagcucucccaguuugcgcgggucagguccccaaugaaauccgccaggcucgugcucucaacgcccgccagaugcuuccagcaccagaaagaaaaggagcuuguggacguguagcuaggcuguuuggcuuucgauaaacugagcucaacccccagggcauccgaacuuccuugucaaauuuuuguauaaugcugaguauaaggcauaccuucucugcagccugggaaugugggggucguguguauuuguguagaauuagucaaauuuaauaauaggaguccacguuguauacugcucagggccaguauauauaagauuguugaaaaacccaacaugcccagcgugguggugcaugccuuuuaucccagcacucaggaagcagagacggguggguuucugugaguucgaggcucagcaugguuuacagagugaguuccgggaccaccagggcuacacggagaaacccuuucccga

SEQ ID NO: 6358 - RNA, 24848 nt, Mus musculus
ugguaaaugauuuccuuaguaggugucaagauggcgcugccuacgauguacaaccgguuuguaugguaggcuuaaauuuggggagaugguagauguaggaaaagaaggaauuacaacuucagggccgaggaagguagaggcaauggggagaggguagaucuggguuugggguggaaguggugaggaacgcagcuagagcgaagggcauaauuagacaaccggagcgggcuuaacccuuuccugcucgcuucagggcuuuguugacacuuucugucccaauucgagaaacgguuguucagaaaccgagaaggugacagagccgcuaacuugacgccuucuacucugccuaguuuuuuuccucucuguuuauuuuucuguuuguuuguuuguuuugcuuaaaccuucucgaauuuccguucuauuuaugucucccuuguucuuucccucagaacuccaguucucaucuggcuccguuuuuaaacucccaccuugucacucaucucgccuccuuggagugacaucaugaagguggugaaccugaagcaggccauuuugcaagccuggaaagagcgauggagugacuaccaaugggcaaucaacaugaaaaaauucuuccccaaaggagccaccugggacauucucaaccuagcaggucucaaguaaaaugggcaaagaaggaugggagggguguccucagaaaagcuguaaacacucagccuuacuuuaauuuuccuugcagaagcgcuccuggagcaggcuaugauugggccuucccccaauccucugauccugucguaccugaaguacgccauuaguucccagguaaagauucccgacucuuggcuuuuggaggugaaacaccuggagaacugacaguuguccauuuaggcuuaauuuauugcaaaaauaacacuccauuuguuguaaugaaugaauauuacauuuauuuacucucuccauauacauuuacaaguaaaacuuaaaaaaaaaacuacauguacuuaugggcggggagggcaugcacaucgcagaaugcuuguggagguaagauacuuuuguagccaggcgugguggcacacgccuuuaaucccagcacuggggaggcaggugcaggcggauuucugaguucgaggccaaccuggucuacaacgugaguuccaggacagccaggacuauacagagaaauccugucuggaaaaaccaaaaaaaaaacaaaaacgauacuuuuguagaguuuguagaguucuucccaccuuucuggggauuugaacucauauuagcacgccaaacaccuucaccugcugagccucuuugccagauccuuguuucuguuuuugagacaguguuuuauguagcccagaauggacuugaauuccugauuuuucugcuaccgccucccacaauugauuuggggguggguggguguugauaaucaaaccuaggaccugcagaugcuaggcaaguguucuaccuuugagcuauuauaaucccucucuggguguuugcaaauguuaauguuugucacacaaugguaaguccuggggauuugaucccaguacacaagggaaguugaaggcaaugcagacuaucgcuaaucguugagcgaugggguuuaugguaugauuagggcagaguauagaaaugaagagaggauauggaagugaugccuaguccugccugagcaaucacagaaggcuuucuaaaggaagugauguuuaaaccaaggucucuauggugaguagaaguuagccacacagaugaaugagaaugaagagcagagagaggaaauuauaauucuacacaggcugggcuggacaaauuauaaguuauccacuacugaaagugagggcugcagauacaguucauugguaaaguguuugcuuagcagggacaaggcccuggauuugauccccggcaccacaaaaaaccugaaggauauuuggcauuggugcaacagagcugaacacuacccagcacuucuguuuauuauaucacauaugugauaucauaggcaucgagacagaaauuuaagguacacuuacccagagauagggauggagcucuguuaguagugugcuugccuagcauggacaagguacuguuuuuguuuguuuguuuguuuguuuguuuguuuaugauguugcaaugcuauagagaaacccugucuccaagcugucucuguguagcucuggauguccugaaacucacuauguagaucagguuggccucaaacugacagauccaucugccucugcuucuaagagcugggauuaaaggugugcgccaccaccccuggguuuauucuuuguuacucuacuaaacuguaacagguaacaugagcugcaucacagaugacuuuaugcuguuacauucaaaucccuuggucucucuugggcuacucccccccccccccacacacacacagggcaacuuuauugagugguagcauggucacacccagcaaacguguucgcucucauucacucucucucucucacacacacagaccuugucacaguccaguucucagccacaggguggggaaccuccuggauuacucggcuccagaaguaacaggugcccgagggaggcucagggggaggaaguggggagggggugcagagagcaggggugggauggguugggaacacccaccagacagcuacacgaagagugagauuccccgcccugguggcuucagcuuggcugcacccccuucgaaggagccuuccaagguguggcugaacauucaggguuugggaagggcagagucccacuccguuuuaguccucucugcaggcuggggacuggagggcaagguugucggcugcuucagcucuggggcuucuucggagccucaccacccucuuccccagcacuguuggcuguccacagcgucagguugucucucaggagcugcaugaucagggugcuguccuuguaggaguccucacugaggguguguaggucagccaaggcuuugucaaagguggucuuggccagcgagauggccuccucggggcuguuggcuaucucguaguggaagacugaaaaguucaggcccaggcccaggcggaugggguuggaggcugauguccauggccuccugguagguugaccgcgcagaaucgaugaugcgcuucuugucaucgccaguggccaccucggcuagguagugguaguagucacccuucaucuugagguagaagacguggcucucugcauuggacuuuucuuccuugugcuggggauuaagcccaggaacuuacaggcacaaggugaccacccacgugcacccucggugacccuucuguacuuugagcugaucuuuuacugaaguguaguuguuuguuuuguacugagucugcuuauguaguucagguuggccucagacuccuaaaccucuugcuucagcccgccaagugcgagauuacagguaugugcugggguuguagaacuuugugcaugagcauugagcauugcaacaucaugaaaugguccucugggaaaugucugacugaguuauauagauaaucuagcuguugccacauuuaacuacacuguaucauuacaccucauugaaucucuggguacuccauugcacaacugugagaaaaugugaguuaggggguaaauuaucccuuaguauuauuuaaaaucuuugacauucagugccuuugugucucuguguguugagcaucacauacacacggaagucagaggacggcuucuggggguugaugaugugggucccggggucagacucaguuugucaugcuuagcagcagguaccguuaccuucugagucauuaucucagcuucauuuaaacauagcugggguuuccagucccucaaaaagguguuggagacccugaguaguccuugaaccauaccuugagauuugcuguguaguauuucaaggagacugguguauuuuuuuguuuguuuuguuuuuuguauuuucucuagacaggguuucucuguaauagcuccagcugccuggaacucuguagaccaggcuggcauugaacucagauaucugcccgccucugcugggauuaaaggccugcgccaccacggcccagcucaauucuuauuauuuuugagacagaguuuugaucuuuaguuccuccugaccuuacacucaauggcgauccuucugccucccaaaugcugcgauuacagguguaagucacuaugucaccugggguagaaaggugguuuggagaaguagagaucagauaccaggggcccugugguaaugugaggaaugugggcuuuaucauaguuacuaguagucauguucaggaagagaaacugaugagauuuuuauugucaggaagaguucccggggagugugucuguguguguguguguguguguguguguguguguguguguaggguagagaaguugaggacuuggagcucagauccccagaaccuaagaaaaugcugggugagcauggcagccagccuguaaccccagugcuuagaggguagaaaugagguaaugggccagcuaggcgagccuuacugaugaggccuggguccagccugcacaugcaugugcacauacaugcacagauaccagcagcacauagaggaacacgaauaugcauauauaccauacgcacagggaaacacauuaguguguguguauguaaauguguaaaauuaggauaaaauguacugauuuuguaguugugucuuucauagggugaacucuggggauagaaacugggucaugcacaagcaaucuuucauugccucaccuccagcccuaaaaugcccagguauucagugauuuuuaacaauucucuguauucauguuaccagugccccaaauagcugacaggcaagacauuuccauuccuuuagaaacuucccuugcacuuuuuauccagucuccauccccacaacuacccagugacuucugucggcauggaaacgcagcccuaugguuuguguggguguuaggggccccugccugcgaccaugcuucuucagcuggggauccgcuuucucugucccuggcagucugucugcucccccugucagcacugggacccacugcagucccccacugcucuuuuaaacuguuguaucauauuccccaucuacuguaguuuaaguuguucaucauuuguuuuuacugcaguaaacacuggagauccuucuuuuauacauuucccugcauaucucaaaaaaucucucuaggauggacauuucagaugggauuucugccacacaccuuuacacccagcaccaggguuucuguguagcccuggcuguccugggauucacucuguagaccaggcuggcuuugaaauaagagguccuccagccucugccucccgaguucugggauuaaaggugugcaccaccacugccgacuuggucauuuuuauuugcagauguuguguaugugugagcacucaaauauguguuccacugagaugugguuguccguugagaccagaagagggcuuuggauccugugaagcuggaguuacaggcuuuguugauuaggccauccuuuguccugucuucucuuagagacaagaccugauauauuuguccuuuuuuacacaaguacuuugcuguuuugucguuuguauuauuugguaugcuggggaucaaacccagaaccuuggguguguuaggaaagugcugucugaucuagagcccagcccuagcacugccugcugguuugauuacugugguuuguucuucugucugccugucuccucccucccucuccuucccuccacccuuccuucccuuucuccuuccccuuccuccccccuucuuccuuuccuucuuuccuucccucccuccuuucuuccuucccuucuuuggcuuuuuagagacacaauuucucuaugcagccaagccuaaccugggauucacucuguagaccagacuggccuugaauucagagacccagcugccucugccucccgaauguugggauuagaggugcaugccacacauccacuccaccuuuaugauugggggucacuacagcaugaagaacuguuuuaaagggucgagguguuagggaggcugagaaccacugguuuaggagguccaguugggagggcuuguugaucagcugggugaguggaggaaagaggucaaacgugagacccggauuuccgguuuggaugcugucagcauccugagggagggaauagagccggagugaagugugcuuaguguuggucuguaagugagggcagcaggugauucuggccuuuuacauucauggugccagacaguuagaaggagguggccauauaccuagaacuuaggagucugaaugugagcgucugguuuagcaguguguagucagugucuguugugacaaaauacuggaguuaaaccaccuaaggggagaagggucuguuuaggcuacggcuggccagcuuugccguuucuagguaguaaugaggcggagcagaaacagagugcuagacagaugcacaggaguaaaguagcuccuguccugguagcuaggaagcagcaaaaaguagaggaggggcuggggacaagauaaagccucuaaaaaacaugccgcucuuucuccaacuacccuccacccccaacagugccaucacuuuaugauucuguguaucgguucauccggucagcuuucaggguuauaucugucggggacaaaucauaacaaguugucagacucagauggcggugggggaugugugcauggaggacaauugcucagggaauaugggcaaaagaagugguuugugccagauuccuaagcacccagucccaucaaaagcacguggcacaaaucugaagugagcagaggaaacugaagaguggaucagguagacguauaaaggaaggaaaggcugaaaucaaggaugugcuagacgacaucacuggcagccaaaacuggacuccaucagaagcgagagcccgugggucuaacagcaagaguuaguugguagcugugaggacaagauuaaugcaggggucaggacaaaaguggucucaguguguugaagagcgagcagaagguguggagguaggaucgugagaguagagaacucuguugaagagaacagagagggugguuaagugaaauguggggucugugggaagcucucuaaaauaggaggcucuugagauacauaaacacugacgagaaaggcaagcucagaaagacugaauaucuucacggccugucaagugcuaugcaaaauuaguaauuuauucuuccuccagaguuaagaggcucuuuggucgggugcugcgcuuggagagggcacuuaggagugguuggggguguuggguaugaagaagagcaagaggauuagagacgccuggcaggucagccugggcuagccacgugugcagacggccacgccagccuccagccucgaggucuuguggucagcucagagcgucuaguugguggaaucguuaagacuggagccgacguaggcccugcugggaggaacaggucaccauguguaagugcuuucaggugcgucugauacacuuagaagcaaugcacagaacacaccgugugaaggccauagguucugacuuaacagccuccauaagaacaugcacagccggggcucucucuuccuggugugggguccacguuuuuuauuauuauuuuuuagguugaaccauccagcucccccuacagguuggcauucagcaggguucaguucuucuccaagcucuugcuauggggacauugguuauaaauaaacaaacacuggccgggaacggcacggucauucugcccaggcauucucccaacuuucugcucacugucagacacucacuuuggcuucacaguguguccugcugcugacggcucugaaugcuaauugucuguguuuaaguccugccugugcgcagcucgugcucagccacgaggucugguuuaaaugucugagccggucugcucaggugaugcccgccaucaucacuuaccacacacugcaagcaugccauuacuguuaccauuugcagugcaaacccggggccuaagcaggcuggccuagcacugagcuccguaccccucagccuacuaaauuacaaguuuaaaucugcucagaacaaauuaguucuaucaagcugguucucuaugguguugaguauauuuacuaacagaaaugugauggcaagguaaaauuuuuuuagauugcauaaauagaacucaguuacuugaagcaaugaaaauuuccuaaggacaaguccaaggccuggugcuggagaaacagauaugaauguacaauuaucuauaucuacaaggaauuuacuguccagauagacuuucuaaaauauguauuuuggaacuccuacuuaaaugagaucucaugaugaaaugacuuuggaggcuauugcuugugcaccucugggaagggggcgugugcaccaugguguguggaaggaaggcagaggacguguuggggguggggguggggguggggucaguccuuccagcuucuggcuucugggaauugaucucaggucaucagauuuggcagcaagagucuuuacucacugagucagcucucauuguuuauaaaugcauuaugguucugagaagucuuacaaugaggauuauguaauuaucuauguuuuuaauuuagguuuugaaaucauauaucacacagaagguguguucaugugaaaaagauucccuguuugcaguguggggguagaagccggggccccuuaaguacaugcugcuaccgcugaacggcucaccaaccccuguaacgggucuuggugucuccaggaagcuuuggagcacugugauucucuacaguaaagaacuugcucuuuugugcugacuagcucuguacugagggucguaugcuggaggaguaaaguuuauuguggccagagagauggcucaguagucaggaacacuagcugcuggcuaagcacaguggcgcacgccuuuaaucccaacacuugggaggcagaggcagauggaacuccgugaguucaaggccagacuggucuacauagugaguuccaggacagccagggcugcacaaagaaacccugccucaaaaaaaaccaaaaacuggucaccugucccagucucaggggaacccaugccccuuuugacuuccugggcacugcaugcauguagcacaggcauauaugcaggcaaaacacauguacacauuaaaauauaauauauaaauaauuaauuaaaauauaauaauuuuuaaaauuauggaauuauuuuacaguacugggaugaaacauguacauguuaggcacauacuccaccacugaacuacacaccgaacacggggagccagaguuuuccuuucauuucuuuguuuuugauuuuugagccagggucuuacuauguagcccaggcuggcuuugaccuuuacagcaguccugagugcuggcucucagguucagguguauggcuggugacuuucuugcuagcagagcagggcagaucuaaggguaugcuuucauguauucacucuacaaaugucaggacugcgugauuacugacagugguucccugauccguggaggcaguaggcgccucuuguuuccuggagaagauguuugucaguccuuguccaaaucagauaacucacacccgugucucugcugacucaaagcuuugcugugacggucagacugaugucacauucaaagacucagugggucuuuagucuuagccucccaaguagcugugacuacgggggcugucacuguguccuccauggucacuguuguaauuuuucuggugcuggggcuugagccccaggucuugcucaucuuggcagguacucuacugcaguucccugccgagcuacaccucagccuccacucaucuuuuuggcugguggguugguugguuuuguaaagacaggguuucucuguguagcccuggcuguccugggacuugcucuguagaccaggcuggccucaaacagagcugccugccucugccuccccagugcuaggauugaaggugugugccaccaccgcccggcacaguuaaucuugauaaaaggagcaaugggccugauuaguguagaggcucaaauaguucacaugcacacacccgccucugugcuucagguugaaauuaggacacaugcuaggccggcacugaccaccgaagugcaucuucaguccagcagagucacgucuccacccuugccuagcaggcguggggcugagcuucauccccaggacucccugaccccauacaagacaagaccgucauucugggugauucuuuugcccacuaguggccaguugaacuucauuuaguuuuggaaaggaacagcauaaagacaaggcaggaugccuuuggguacucgaaacccucucauucggcuuauacgcaugccacuugcacugagucugauggaagcagcgauaaggacagcacauguuacugugggccuuuuaaugagcugaggaaaccucuugaagggaagggguuggggaccucacgcuguggcaguuuaagcaucagugcuugccccucccaaguagaugacuugucucaacguccugugucuuccuucuuucuagaugguguccugcuccucugugcucaccgccaucaguaagguaugacuguggcucucaggagcugugggagggggcaaauaaggcuaccagccuggccacucaggucauguguccccugaggcuggauaggcaacaccugaugccccccgcccaggaaggagguccuggaaauuaggaacacauuuccauguggcaagucuguggcccagggcuuggggaggagagguagcagagcuugugagagguagugcugagcccccuccauugcucgcuguucuuucugcaguuugaugacuuuucccgggaccuguguguccaggcucugcuggauaucauggacauguucugugaccgacucaggugagagauggauguggaagcucagagcauugcaucauccuuucagugccgaggaaagcccagagucuaggggacggacugagaccagcucugggucccaggcugcuucugucugccugccuucccaccuccagcuucuguuuccuuaagacaaagugccucuucucuauuuggaagagcuacucuaagaucucgucuaguggaagcuggcuagacuaggugucuuaccuaggauucugccaacuuuccaacucuguccccuaguaguguugugccagagacucugggggaacauugguguggguuggauuucagcuuuuggaauagauacaaauuuucauccuuuuuggguaguugccacggcaaagcagaggaaugcaucggguugugccgagcgcuccuuagcgcccuccacuggcugcuucgauguacagcagcuucugcggagcgacuccaggaagggcuggaggcuggcacuccggcccccggggagaagcagcuugccuugugcuugcagugccuggagaagacccucagcagcaccaagaaccgagcccugcuacacaucgccaaacuagaggaggccuguauguccccugacucccccacacccugccugcugcugcuucuguagcugguccuuugauugagaggggagaggcaggaugccaucccacuucuuucuagaaggauccgaaaucaucccacuuccuuuuuucucuccccauaagcauugcauacaucccagggacuugggcaggguggcacccgagccaaucaaccaacagguauuuacugagccuucucguguguccagcacugugccaggugcuggagggggggaugggggcuuccaaaggagcauguggcagggucccugcccucagcaagcuuacacacugguggggaguaagauuggaaugccaugcgccuggagaaauuggaggacaagacaggcacgucgucugcucuugucugucuucauguugcucgccuagaagcagaugacucaggugugacccggaacuucaguuaaacucagugccugucagccaugacuggaugcuguucucucuuaacucaaguucuguuaagcauuggcaccuuacagauuuauaggagggaagucuucaugaguccugagccccagcagcuagggccaccuaaggguucuccauugacaggaaugcuaaaauaggugacacccaugucuucagggcucagugggagagguuguuaggggauuagucucucugggaaaaguccagaaagagaccgaucacugugucagaaugggcugcucggacagcuuuucuucaucugcuuucuuguuaguguuggcagugccuugccuuccugggcacuugauaaauguuuauugguagaaaaguagaugaauacuucauuuugauggaucucaggucucaguugucuuucucuugucccugugcuacauggagguuaauuggcuaacuggugccgucauucaucauuugacccuuugggcuuguaacuaggauaagugacuaguaauuaaauacuaaguaugugcuguagaccgugagugcggccauuuaagagaguguccagugggcuccaccagcuggguaagcuauucaaagagcagaaacucaaaagcuguguuggcaagguauuuggagcuagaguagaagugacuguccccgcuuggccacuggaugcuguacccaccccugugccuugcucccauugcuugugugucucgagucaguuguguguagucacuggaagucaggcccuugguaugguugcuaggggggucuuuguucccggugccuacuccccuuacccuacccucaggacucugccuccucguccucagagguuccuugcuggaugcuuucacgguccagggagcgccacggucggggaguguggaccacgcccugccucuccuucccagcaguuucugccuugcuuuuucuccaccagccuccuggacugccauagagcauucucuucuaaaacuuggggagauccuggccaaucucagcaacccccagcuccggagccaagcugagcguugcggcacacucaucaggagguuagguuucugccggagaugggaagaugggcuccauggucugugugugugugugugugugugugugugugugugugugugucccgcugucuccucaguucccaacacguccccaauggugucucucuucagcauccccagcaugcuguccgugcacuccgagcaacugcacaagaccggcuuccccaccauccacgcacucaucuugcuugagggcaccaugaaccugaccggggagaugcagccccugguggagcagcugaugauggugaagcgcaugcagguaggcguggccaagcaggguggguggccacuugggcuaagagggaguaggcugguacuuaagaggaauagcucuuuuuuuuuuuucugagacaguguuucucuguguagccuuggcuguccuagaacucacuuuguagaccaggguggccucaaacucagagauccaccugccucugccucccaagugcugggauuaaaggcgugagcucuucuugauucccugguggaccacagaugccagucucacacaguuuuugccaucugaccuccagaucuugguucugagcuggaacccugcuguguagucacagccugguucuuggagccuguagacggggaggagccucuuacaucacccuuggauuuccuacagcauauccccacaccucucuuuguccuggaaaucuggaaagcuugcuuugugggacucauugagucccccgagggcacgcaggagcugaaguggacagcuuucaccuaccucaagguaccuggugacgugggagcugggagaaccaguugagggacagcucucaggagaagcagcagcgugcuggaucuuugcccugugugucccccugcuggcauuuagucuagccuccugagucucuagcacaggcucaguuggucagugucucugagaggcuuggcugcuuuagcuacuugggguucugcugcuuguucagcccguccuuagccagguuaguucuggucaccuaagagagccagggacgguggccccagauucccucuggaccucgauuccaauuugcuguuaggauuuccuuguugaggcagcagaaguggggggcccguguccuauaggccaagagacauagggugcucagguacccguguguaggcuuacaaauuauucagaguacugucugagccccaagaacccucccaccucagugcccacagcaggggaugcgcgggcuucugggauaagugaaagagaaaaaggccauugaugugccucucuucucccucugucuagauuccacaggucuuggugaaguugaagaaguacuuucauggagagaaggugaguuagagucuggugugagggcauggaaacgggaggaugagcaagugcgagcgagggucucucucucucucucucucucucuuucucucucucuuucucucucucucuccccucuuuuucuuuuuguuuuucugagacaggguuucucuguauagcccuggcuauccuggaacucacccuguagaccaggcuggccucgaacucagaaauccgccugccucugccucccgagugccgggacuaaaggcgugugcuaagggugggucuuuuaggcugcagcugagugguaguguguucuugugcccagaggaagcuguguggacccgugaaccccgguguauguccuugcacgugcaguagaguaaagaugguggcuuaggcuggcuccccuccuccccagcagaacgauugccugugaugaucuggcuaguguaauaaccacauagagagugcuaugccuccaacaucccacgccuccuuacugggggcuggugguggucacagcgggcuuucucucuuacugagcaagguguccuuguaacgcugcucuuccggguuguggggcccagguggcagcuucugguccuuuuuaggauuucacggaggaugucaacugugcuuuugaguuccugcugaagcucacccccuuguuggacaaagcugaccagcgcugcaaguacgagccccccaccccaccccgcucagcccauuuuacuggaaaguguucugaguccuuccccgcucacuguuagaugagccgcagggaacucugucuuucuguuggacucucccucuuggcagagguaggaggcaggaggcucauaacugccaaguacccagagcccuucuuucugccuuugggugcuugaguuuucuucacccugaaggagggaggagaccggacaggcaccccgugcgugccccagcucaccucaguccucuggcuuuuccuucauaguugcgacugcacgaacuuccuccuccaggagugcaacaagcaggggcuucugucugaggucaacuuugccagccuugugggcaaacgguauguugcgagcccccucgggccgccucccucuugccagacugguuccugguaucuuucccuucucuuugaagucugaguugccaguggcugaugccuccugggucggucuagggagcaggacugcaucagacgggaguuuacccuccgcggcgcugcucuuugacuugcccuccuuugugagcaaaggccauagagaaagucuucagucuuccauuagaccuaacugaacuuucaaaacggguacaacgauacugacaaauugaaacaaugguaauacugagaacagguuaacuaacguaaacuucauuaacucucaagagucuuuguucuugugccacgcuaaggguuaaacccagugugcugugacgugagacaagugcugcggcugagcuacugccagcucccaguuggcuauaugcuucugucuccucuccaccuuuguuucuagagucggauuagagaauuuuuuuuuuuccuuaaaaacgcuggcuagccucaaaugcagagaggucugccugcuucugccacucgagugguuuaagauuaaggugcaagcuacuacacacgguggauuagagacuguaucaagauuuuuuuuccuuagccaaguaugagccagguagcuuugagcuguaauuccaaccuugagagguugaaacaggagaaguaccuugaguuuaaggucggccugagccacaguaugagaccugccuucaaaaaggaaaaaaauccucuuuguuucuguuuucuucucugggugaugaccauagcacggcagaucgggacccgcagcuaaaaucaucagaaaaugcuaacauccagccgaauccuggccugauccugcgggcagagcccacggucacaaacauucucaaggugugugugugcacccugcccgugccacuguaaacucccaugcuucucuagcuaaaugaacagggcccacagaccucucugcucucuggggagagcugcuuugggaguggaacaaccggggaggugaaggaagcagccacugcugaaagcugacauugguugcucucccgcugugcccuaggugauguggcuggggccucuccagacaccaccccaugaaggcauagaagggaagcucccagccaaauccugucccccaccacuguaucccaccaccguaucccaccccaccacaccuguguaguugagcacaaagcucacagaguagggagagauuuuggcagugaucuuccuguucgagcaggaaguggcagauuauguuugaaggugcagugugccaaucagcggacacaggcagagagaaauguguuuaggcuguaucugagggugucuucacuggacucccgccuguccccagacaauggaugcagaucacuccaaguccccggagggacugcuagggguccugggacauaugcugucugggaagagccuggauuugcugcuggcugcugccgccgccacugggaagcuuaaauccuucgcccggaaauucaucaagugaguagagcuaugcccugcugugcgaugggaggucgugugaggguggagaugccuggauauggguuucccuuugagguguacagaccagggcagaacauccuaacuagaaacugugacagacgugucacucgacugagaggucuucucucucucacugaagauggaauaaagccgcuugcaaagauaaugaggccuguggcagggagaggcugaggucuggagagauggcucagcauuugagggcccugcugcucuccaaagggccuacuuggcagcucacacuugucuguaacuccagucucaggggcuccagugcccucuucuggccucugcaggaucuuguacacacaugagaugcauagcuaacacagacaugcuuaaugcacauaaaaauaaaagauagggggcuggugagauggcucaguggguaagagcacccgacugcucuuccgaagguccgaaguucaaaucccagcaaccacaugguggcucacaaccacccguaaugagaucugaugcccucuucuggugcaucugaagacagcuacaguguacuuacauauaauaaauaaauaaauaaaaucuaaaaaaaaauaaauaaaaauaaaagauaaaugaauuuuuaaaaauaaagcauugaauaauaggcauggaaaaguucuuuggcccaguuauuuauuuacuuuugacaugggagcucuuguagccugcucuaucuaguuuauggucuucguuuuuuguuuuauuuuuguuuuuucacuguguaacaacccugacuguccuggaauuuacuuuguagaccaggcuggcaucaaacgcacagaucugccucacucugccuccugagucuugggacuaaaggcguguaugaccacgcagcuaauaauggguucuuaaauucuguaacuuuuggggggcuaccugcaauuuuguguguagaacaugguuccuuacaaaucuuugggucucacuguguaguccaagcuggcuucuaaugcuccguguguuagccucuucaguguugggguagagugugaggcaccauguccuuuuaauacuagugauuuguuucuguaauuauaauacucauuuuauauuuaagcuuauaguugagguucuagggcccacccucugaauguguagcccccucccaggcccuacccccuucuccugugacacugcucagcccucgcucugguugaugcuaccugucucuguccuuccuacagucugaaugaguucacgacccacggcaguggagagagcaguaagucugugucuaucugcagguccuaucugcccugaggagggaaggaagggaggggcugcgucugcucauucuggggaugaggguaauccugggaagggacucugccaaaaccacccucugcccuucucccagcuggaccaguuuugacugguuuggguucuggaaauuguggauuccaaggaagggaugauguucuuaauaagacccaagaaaaggauucugagccucagagcuuugaaggaaccgcuugcucccugaccuuccuucaggaaauccugagcugggguguagccuccacacuuggcuacugugcaugaggccuucagucccuggcaccucccaaucuauacagggcuuggggcuccugccccgggccgagcuuggcaucuuucucuuucccacagcgaaaacagccucgguccgagccuugcucuuugacauuuccuuccucaugcuaugccauguggcccagaccuauggcucagagguaagugaugagugcuggugacaggaagaggccccaagugaguggggcaaagaggaaggaaacgccaguaacucccuuacucacccuugcccagacugaucucccaagccagccuguucuguugucuucccaugucaacagguccucucguggcaaauucaugcugaccacuagguggcagcaccgcucccugucugauuccccuggacagauuuagaguugacuauggaaagggaauggcaauagagcccagucccuggcuagcucuggcaggugccacgcccucuucucucagcuggugccccucugucuuacccaggugauccucucggagucgagcucaggagaagaaguccccuucuuugagacuuggaugcagaccugcaugcccgaggagggcaagauuuugaacccugaccaucccugcuuccgcccugacuccaccaaagucgaguccuugguggcccugcucaacaacucuucagagaugaagcuagugucagugguuuagguccugaccucgggugguagggaggggcauuccaaggcccuccccccuaaucccaucucaugcucccuugccaugauguucuccuaaucuucucuguagacagaugaaguggcacgaggccugccucagcauuucagcagccauuuuggaaauccucaacgcuugggagaaugggguucuggcauuugaguccauccagguagcucuaccguuccuugagucucucugccugagacacggggcuggucacugagagcuuguuauuuugcauacaaacaaauccucaagcuggagaucauguucugguguuagucuucuauaguauccuccucuuagccacuucauccuguccaggugucuuugagaaaaucaaguuuauguugcaaaggugugaaauguaccuugggauagcaccugugacccccagcugcccccagaggccgugggagucauggccagggagaggaagagaguccccaagucauucccuucuccuccccacagaaaaucaccgauaauaucaagggaaagguaugcagucuggcggugugugcuguggcuuggcucguggcccacguccggaugcuggggcuggaugagcgugagaagucacugcagaugauccgccaguuggcagggccacuguacagcgagaacacccugcaguucuacaaugagaggucagugccccggccucggcaggugugcggucgggagucggcaccaccaggaacaaacaucccaccccaugcucucggccuccgcuucccagggagccgcucagcaaccacuuccuccuccauccaggcuccgaccagcccaccgugcuuagcugcugaggcagugcacauucaggguaguuggacucucgcucccuccuucgccuuccccuaccacucccucgcauucuuagucacacauucacucagcuggcucagcagauguuuggugugugucucuguaucgagaggguuuuaaucccuguacuugccaugcgugggaaauacagaccccagacagcuugaccuguguccuccaaggcugcaaguuccagaaaacuagcugaggccagagagcaaagggauugugugacugugucacugucgaggaacucugaggcaucugcaguuuuuauggcuucccucccccacccccagcuguccuggugaccauuucaaguacuggcucuucagggacuuccgcuacacggggcuugguggugucuguuuauucacccaacugauaaguuguuuggccguugguuuuuaaauauggcaagaaacacaauaggaaauuuaccauuucaaccguguuuauguauaucguucaggauaugaaacguguuggaauugugaaacagacuuccaggcguuuuucaucuuguguaucuaagcuuuuagccaauaagcaacuguccaccuccccuucucaguuccuggcagcuaccacgcgacucucuguccuucugagcggccacgcuagauacuucguauaacuagaauuacguaauaccugcuuuuucaugacugacggacuuuacucagcauaauuuccucaaaauucauucauacucuggcaugugaccggauuuccuuccuuuuaaggcugaguaacauggcauauccaugccccucggggcucccaacccacccucaaggggacuuggagaguggugccaugacuguggggaggaggcuggcuuacaggauagcugaggagggugcuuucugggggacauguggaaacagcugaagcaaagcugggggaggcucuguaagaucauauuugggcuccccugccugugggacaucauccaaaucaggcgcauacgugcgcacgcgcauacacacacacacacacacacacauggccacaguggggauccuagcucccuugugaagguagaggaggggcuaugcaagucaaggcugccuucccugcccuccugacaucccagcacucgguacuuagaccccagcuguggucacagccccagauguucccaagaggguuccaggcuauacacacuuugcccagcuacccggggccgggaagugucuugcggggcggucuaaaggccucuccuggaaguuacaguguacuuugggcggaggccagggcuggguuagacccuccuccccccaguacucagcuuaaguggaagugauuguguuuuacuuaugacccugauuuggcagagcucgggccugggggaugggaaaaguuggcggaggagagggagaaacagaauagagucugaauagauugauggaaccuguaagagaagaaaucucuggccugugccucuccuaggcaucuugcccggccaguaagcucuucaucgguaguggguuguauuguugugucucccccagcgugcggugggucucauuccucagccguguuuccguaacccaaucccagggguaaugccugcauguacccucccugcuccccuaggguggugauuaugaacucaaucuuggaacacaugugugcggacgugcuccagcagacagccacgcagaucaaguuuccauccacaggcguggacacgaugcccuacuggaaccugcuuccucccaagcgccccaucaaggagguccugacagacaucuuugccaagguacuggagaagggcuggguggacagccgcuccauccacauccuugacacccugcugcauaugggcggcgucuacugguucugcaacaaccugauuaagguacuugggcugggugcauguggacagccauguggauggggugguagacaugguuggcugggauaggccaggcuucucugagagguugcuagaaacuggguggucuccugaggagacagagguaggaccucaccucagagaagcaccuuggggguuggggccaaaagcaccuuuggcuggagggguggcuagggucugagccagcagccccucaguagccacuugccugccucucaggagcugcugaaggagacucgcaaggagcacacguuaagggcgguccagcuucucuacuccaucuucugucuggacaugcagcaagugacccugguccugcugggucacauccugcccgggcugcuuacugacucuuccaaguggcacagccuuauggacccuccuggcacugcgcuggccaaguaggguucucuccagagccuuccugggguccccccucgugccccaagcaucuagcauccagauucagucacgucagccuuggugccacccaggcagcugggcugugggugggagugagggguugaaggggcuucuucaccaugagcguggagcuucugggcccagcuuaacuaugccuuccuccuggcuccuuuugcuagacuggcuguguggugugcccugagcucuuacucuucccacaagggacaggcguccucccgccagaagaagagacacagagaggacauugagguaggcugcugcuggcuuggucauaugugcacgcagcaagcauuuucugauggcuuaaaguagaguugccuugccaggcagagguuggggcuaaggucagcugugcuuggccugucugauuggucagggucuagaggagagacuugagugggccccugaguguccuugaugggggaggucuuuuucugcucaccgggcagagauugggguaugggaggggucaccacugguagcgcuggccaaggauuguagagagcucacuucuccagucagaucugcccuccaguccucuccagcuccuggagaccuaggccgucaggcaugugacagugacccaugucucccaggacuaugucagccucuuccccguggaggacaugcagcccucgaagcugaugcgacuccugagcuccagugacgaugaugccaacauccugucaagucccagugagugcugggggugucccgggccugccuaggacucaccccucccugacgagcugccuugguuucuggcugauggccgucuggcugucagcagagcaggagccugcaccucucugucccuagucggggcucugucgcuugcuaguggggacaggaccugaagcuguccuccaaggucccuccaaaccccucaggugcuccucccuugucaccacuggaaggguggcgaggcacccagugaguucccagcuuguacuagugacucacccccucucccuuccuuccuaacccagagagacaugcccuguggcugaauaccggccccaccaggcugcaaccuggggcugccuucccgccuuccuacucagagggcagcccaugucauccucugucagacuuccuucugccaaaaacucuuguguggcauccaauuucucuuguuuccagauuucuccugaacccuagaacuuucucuggagcuuuguagggaccaggguucgagccacacgcuuguguaaaggaaagauuagguugcccaccuaugaccugagaccuuagcuaggcccuuagcaaacagacuguguaagaugagcucugagcaggccgggcagccugaggagugccaggauuggucuuugauggugcucagcagaccuggcuccccagauuccggcuccccccuacccucauguggcagacucccugguggaagggacagggaagacucccuuggagucagagcugacacagcacccucccuuccucccucucugcagcugaccgcuccaugaacagcucccucucagccucccagcuccacacagucaacaugagggacccucugaaccgaguccugggugagucuucccgcugcaccuaccugcagacggagcuggaaggagcccccucaccagaggcagggcugggucucccagaaggggcaaccugcuccaccuccacaugccgucccccccucacuacugacagucugccuaggguagucagcccccuuuacugccaucucccgcccgggccugcugucaccgccucucaccuucccucuccugucuaaccuguucgagaacugugugucuuguuccccucugcacagccaaccuguuccugcucauuuccuccaucuuggguucacgcaccgcuggcccccacacccaguuugugcagugguucauggaggagugugugggcugccuggagcaggacagcaggggcagcauucugcaguucaugcccuucacuaccgugagugucccagggggcugcagggcgacccacagagaaaggaggggucuugcuccucgggagucaccccagaagcuaccuguguccaucugucuguggcagguaucagaacuggugaaagugucugcuauguccagucccaagguuguucuggccaucacagaccucagccugccccugggccggcagguggccgccaaagccauugcugcacucugaggagcuccguguggccugcagugggucccagccccaucauccaagcagggagccaggagagugagaccuucccaccccugcccugacucaucauggcccuacacaucucccaguggcuuuuguaauuucuguccuuugaaccagcacccaaagacucugagcagucccuauggucaccccaaguagcuguaccuccaggagggacuuuauagggccacaguguguauauaaguuuuauuuuuauaacccaugaauggggagucccccuugguuccucuguaaauaaagauccuuguggcuguggcuguguu

SEQ ID NO: 6359 - RNA, 32770 nt, Mus musculus
cuguggaggcagggcuccgcccugggagccgugggaaggcuauggcccccgcugguaaaacugggcuaaugauagcgggggaaccggcggggccagaggggggugcuaggguaauuagaccucugccuggcgguaguagaucccaagaugaaaggggcucuggcgucacuggcaggguuuuauguccacgaaugcagguguguguguguauguguguguguguguguguguuguguguuuugugugugugguuggcgcacgugcgcgcgcgugcgcgcgcaaggguccggaacuggcauggagaccucuccuuugagaaaaggaguccaccuauuugcagccacucuguugcuuagauuggcccuugaaccauuuggauuuugaugguauacacaggagaggaaauaucaccucugagaagcugggagauaaggggcuguagcgagucuuguccacccccauuccccaagcuuaguauaggaguauauuguuggggaauggcuggugggcagugacuagaaagagcuuccauggagaacagagacguuugcaagaggagacaguggauucagcauuaauguuagaaacgagagaggaggcacaauguggaacgagccuccaaaacggcuagaaauaggaugguugaaguuaggaggauuucagaaguaaccuguccaaccuuuggauuuugugcucuuacccuggaugcuguaauguguucaaggucacacagggaguuguucgcaaagaagggacccgaacucugaaacuacccuuagcguuugguaucuggacuuccucccggauuuauaaggugcagugaucuccucgguccuucucccccuaccccagggugcaaaccagaaccccccucccccaauucuccucgcaaaugaaagcuauuuuauuugaaaaugacaucuuucucaaaacgugucaccgaccgucgcuccuggauggagccguagggggggcgggggugaggugggcgagucugagccugguaggggccaaggcgguagaggggcugcggggcggccggccaggagcuggggagcggcggggggcgaggggcggggaccggcgacugcgaggcggccugcagggagcagccgcgagccggccgggcgcgcggagcuggagccccagccggagcggggcgggggagggaggagccagagcggccgccgccucugccggaggagccgcggggccgccacacucgccccccgcccccccgcgcucacucgcacucacaccccggcgcuggaggcgggcggcccgggccccaccggccccccauggacgcccccggcacggggcgcugagacccccgcgucguugcucagcucggaccagcgcgccaagccgagguaaggaggagggagcaagggggcauuaauaugcaaaugcaucgcgauugauuaugcaaagccgcgggucucuggccagcuuggaggcgggcugggggcgcccaggggguucccgccgccgaccucagucuuuuccggcgcccgggugacccugucacagcccgagagcuagccacuuacgcccuggggaaagaaggugcuguuaaguggucggugggccccgggguucgcccagggagauggcgucugggccuccccuucgagggcccgccccggccucuguccggccggucugcugcgcauucccggguugggccccgcugccugccgaggcucccccgcccgccccgccgcgguuuguuuacggugugccagaagcuugucguguccccccacccccccagccaaagagaccgaauggccuuugcaaagcugucucuagcuaggaagggcaaugugggugcggcaggguggaggggcuugcaugggcuggaggagagagaagccccccuccccuccccaccucuccaguugagcauggcuuucugguugcaacacuccuaauugcaaaaacgcggcggguggggugggguggggggagugugagcuuguaguaguggggguguacuugauggucccuagaugauuaggagaauuguuggccugugguuggggaagagaggaagaaauggacccguguucuguguguguguguguguguguguguguguguguguguguguccgcgcgcgcgcgcgugcaugcuccccguuucccucccuugcaacgugucucuggugccccuuuucuaucuugggcccucccuuguccagugugaaaagaaggccugggaagaugucagaggcaaugaagagagccacccauuuuagggacuggaggggggagcacacagaaggaaagccagggagacgggaggccugccccugaaugcuggcucuggacccaggagggggaggggaugaagggggccauuguccaagaugaagggggaggcaaaggugacaugcagacaacagauaugccuacacagacagcuacaugcucacucggggacauccaggcagauucaaggacaggagcugcuggacacacccacauggggacaagggaagaggcaggccuccacugcagaguggagcucaaagggugggacacacccacgggagaccaagagcagggcggagagacggccuaugcacauacccacgcauaggaucacagggagaugcugucacacagggguaagaaggagucauugucacccacaccgagaaagucacuaucgaaugcaugcaugcacacaugcacacacacagcaauuggacacagucgcacaaucauaaaagacccugucauucagaaacacacacauguucacauguguccagucauguagccgucauugcuugccaugacgaucacugucacucaagcaaacaaacaaacaaccgaagcuacacaucaauacauguguacagaacuuagcaacaaguauuuuccuggauuuggcuggggagcugagugagguucuauagacaauaaaaucucugcuaccgagaaaaucaaauuuaucuguauuaaaagacccuucugcauaauggcgcaaagcaugcaguccugauaauagagucucauuacugucacuugcuauaccaccccguuacuagauggcaagcuccuuaagacaugggagaaucucuagaagagcccuggaucccacccagagccgagcacacuaugagcucuguaaacacuuguuaauugauugacugugggaacuccaggcacaggugcacgucuuuacaccuagucucacaggugcagaggccgugccaagggcuccggcugcagucacaagucccaccuggcaguguccagauaacccuguagcucgauacauuguagcuggggcaggaaugcacuuaaaugcacauaaucacagacuuuuucccuuuggcuucuugcuaucuuuuaggcucaggcacuguguagcaaugggcuucccccuccucuuuagagagacagagaaacaagagcaaagugggugcaaggggguuccagagggccgagucacagcccugcagcaggguccagugacuuccagcagcuggguuuguccugguugcugggggaggggcgucuggagaagaguugggaguggcucucuggcccucucaucccuagccuguaagccaguguggaccugacugccucugcaugggguuauuuggcugggccuuuccuggggacccuaaguuguccccagcugaauguuugccucccacugcgaauccaccccuuuucucaccucuggcccuccuguccaaaccuggaagcuuuccuuaggaggcguaagcuggcaaguggcugagugagugagguguauuuuugacuuggaauuucucucuuaacucugucucucucaguugcugucuuggggugucuggcucuccuugugucccugccacuuuguaacguuuuuuucucucucucccccugcgcuccucucuguuucugccacagccucuuuucuuagagcuggcagcaacauucuacauacuuuuccaguuguuaauacucaaauucaggcccucugcacaacaucccccccccccagccuuccucuggggucaguaugggggggugcucagcuggcugcucaggacauccugcgcuuccucagcgcugcagcuguggcuggccagcaaauuuuaagggcugggaauggggagggaaggggaauaggacugacugcugcuuguguugacccucaagcuggcaggcccauccagggaaccuuagucaauucggugggcgcgccuuagguucaagcuacagcucuuuaaggagccaguuaggaggcuccuccccuaacuggauccaggugggaaaaccaugcccccaccaccaccaacacaccuagugcaguggcaggagcuggcaggacccagcugggucugaauuagaacucauggccuuucuucacaucccuggucacugagacccaccuuagagaugugccaacagcugugucuucuuugcccaacuucaugcuugguucugaggguacagcuguuuagacugugccaauuuggggcgggggggggaacuguagcccacacauagcccacacaugagaacagaaagaguggcucuuuuagggaggaaaguugaacagaggcuacuggcacaagaggcccacagccugggguggggguaugcaugggaggggggguuacuaacaugccuggccaugcucccucuagccuuggccugcuugcauaagaauauauucguaaugauucugucauagaguacucaggacuucaacugaaagaugaacugagguuugucacgggggcuacauagccagaugaaaggacaagguaucuuuauucuagcaggacauugcaggauuuauguugucauugguuaaaagcgggauuuuguuguuugcuugggaguucagcugccuagguuugaacccuaaaugcugcuugcuaauuguguaaccuugagaagacuuuaauuuccuucuugccuugucuauaaacuagagaugauaauaucuaccucauuuagcuuuugacauuuauagauauuagaugcuugggaagcugaggcaggaggaucaaggccacucuuaccuacauagagaguugaaggccuuagcuccguaagguauugucucaaacagauagacacauauauacugcuuuaaaagugccccuuuccuaaccagguguagugaauggcacaaagccacuggcuggaaaggcuggggaagaaagacuaggaguucuaagccagcuuuggauacaaagugagacuuccccauaaagcacuuaguucaugccuggagacccuggguuucugguagaaguuggguagagauguacaucuccugaccacugcagggauggggacagaagugagggagcagggaggguccagccaucucaccucucuugcucacagguuguuuuuuucuaacaagacucacagcaggccuuccugccccgccuccucugaccccucaccuuuuaacuuaaaaggagcccuuggcaucucagccugggacacaccuccucggcuaagggcacaugcgugaaugcugggugucaccacaucucucuugggacaaaccucaguguuggcaaugagagacacagagagaaagagagaacacauacaugaacaaaggcaggggguggggggcucugucacccuagaaacuuggggaggagggcagcucucuucuuccuccuuggggggucccaucacccuagcuaccuaccaggaccuagucguggcucacagaugucagcuuccucuauacacaguguccacuaguaaaaggugguggcagagaggcaauggaccagaacauagcaccuggagaucccggaucuguccccgugucccuuacuuggcugugggucuaaggaucaggauccucuuucccacaagccccauuuauucagccccugcucuucaaggugaaguaaggacaaugaaggagcggagcggugucuguuaguagauugacucggagcccuuggugugagagacgaucucaauuccaggucucauggcugccgaggcgcuuaggggaacuuuggagccucuuaaggggaggcaggugugguguguggacagaauacuggcugggaguugggggcuggguuucugccacucaccaguuguauaacuuggggccuggcuuuuuaucauguaguaccugcuuaggguaagggucaagaacauaauagcauaauauuggacauagagcuguagcuugcuagcagagcucuugccuagcaugcaugagguccuaaguuugaucccuagcaccacaggaagaaaaggcaagacaaauaaggcaagcuguuagcaugcacaaucugcgggguaagcuguuccuguggauuucuuucuccuccccaagcagagaaugcacgcacgugccaccaggaaccagagacaguuccaucucucacggagacaucuguggcucucguguagcuggacacguguccuuuugccugaagggcaaagagcuggggguacccauagggaccuccuuccuguuugucagagaggucagaaguucacagguagauggggagacaaaauggauaguauugcacccggaaauacuguccugucucuuugcuuuggaggugggcauucgaccuggagagcagggaguuaggguuuacaguuagguuagugcuaggggcacagccacacccacucagcaguaucgaggaguggugguuugagccaagcagccgcccaccuucucgucuuccucccccuccccuuccucuugugaggaugagaugagcuccuggcuccaaagcccuggcuucguguuucauuuucucuuuuaccaggcauggggaggaggaggggacgagcuuuggugacuauccgaauuuucauacacaucagugaguggguguguugugcaugcauccaugugagaguguuuugugcaugugugggcaggguagggcucugaauaucuccuggaacggguacuggagcccugcagcucugcgcaugcggggugaaugugugagucugcacguguccaugugugugccugagacucagcugcgucugcuguucucccucccucccucccucccucccucccucccucccucccuuuccucccucucucucucucucucucucucucucucucacacacacacacacacacacaaucucucccccuucuauucucuccuuccuuccuuccuuccuuccuuccuuccuuccuucucuuucccucucucccccucuggguuuccuaucaugcucucugccccccucccacugccucugccaguucugacugggugggggcuagcuuuugccucccuggggugccuagaagaacauccugucuuucuccccuccacauacacacaccauuccuucccuucugaagcgacacuuucuguggcuggcagacaauuucuucugcuuuagaagaguagagugcaggaguacccccaagcccugugccccugaugccaucugcugcaagcgccuuggccccgugacauucaugccuccagcguucagcugccccagcuuccagcuccaauuacccuuucggcuggggguggaguggggagaauauacuaugcccaguuuuuuuugggggggggggugcuccuaacucugcuuucuuggagacuuggaucuccugcugcuuucucugaggggaauuggggaaaaggguaugaaaucugguggaggcuggguacucgcccauccaucccuucaaauguggaggcugggcauaaccagggaggugacccuagaccuagcaccuuugauacuuuauggaacuagccuggacuaggggaagggagaagaagcaggugagaaaggcucuagggguguggguugggagcacccucuuugauguuaauacugggcaucuggcccaagacaggcuacuguuuaugucuuucugucuuugaccugcaggggggaauuuccuguuauauuccuuguggugguggcggcgguggaggggggacagggaggauccuuuguuuaagcaaccagucuccccgucaugcacaucccccaucuaaucucccauucccugguguuaaggccuccaguagcuaggaaaccugacuucuugguucuugcucuggaguucuagaaucccaagcaagaucccacccagagacucugccucucuggguccccacccccauccccaucuauaaagcugugccuaagucuguguguacuucuuugacaccugccaaauagucccugccuucccgccuucagucucuccuggcaccgggauagccgagaauuggguggggcaauucugccuaguccuuaccugagaacagaacaggguaggggucugugaaggagggagaggucccagccccugggaggcaucugucucaaaacauaggguguguguugcuaccacagguccucaaugaccauagauacccccuccccacucuuagguugguggcuacuugugggaacccacguuggcaccgggcacgucugcacacagauggcuaugugccugugcaugcccguguauguuuagggcuccuguggcugcccuggccucuccacauuacccuugaugauuccauaguaugggaucgggacaucuaugcgggaugauuggaaguuggggagggggguucuuuaguagcaagcagaggggaaggggagagggggugugaaccuacccacagcacuauuaauagcccacaugccaggccaccaagaaccagcugucaccguggaaaccauuucggcuccccccaucccccauccuccauggggugggacuuaggccgggcagaagcaucccccacccaucuuucuuuguuauuucccuuucucccuuugucucucucuuucaucgaccucuccucccuuuauuuguucuuccuaucucaccccuuccucuccugccugccuucucauuccucccuucuuucuugcccccuacuuccuuaacaucccuggcucuacccgcauccucccugccuccucuuuguucuucccuuuguauuuuuuuuccccuuuugcccauuuuuccuauucccaccccaccccaccccgucucuuccucccuuuucuccccucuuuacagcaagcgcccuaccauaugugugugugugugugugugugugugaaggauggcugggcuuucuucaaagccuuaaggacaaaguucaggggccccagaaagguggggccaaagccagguacagaugcugagaggugugccugcuagccggcuaggggagaggcccugcuggcuucgggaguccuuuggggguaucccagggaucuacggaguagaacaggcagcagugggaaccuggcacagugcccauggaugccgcauuggcuccuuguccccauccccucauugcagaaucacuuaagcuuaaugaaaugcuuccccccccccccacccuaugggcaucuuucccgugcugccacccaacagcucuuauccaacuaagaaagaguggguugccaggccaacagacagauggguccugcugucccguuguccaucugagugucugcaucccauuguucuacccacucugucucucuggcucugagcucuccacaucccccugcaaaaaaagguacuagaaaugaguugaacuggacuccagaaagaggggcgagaggcugcucuucagaaugguuacccuuggcauaacaacacccuucuccacgaaccuuuuccuacccguagcuagcuagccuagcguggacucacaugguugcaugcauggccgcuacacagagccccauauguccuuggagagguuuuuagguguccccagggguuccagagucuugcuaggcgccaaacaaaugccuuaaguagugaagguagcaccuugccccucuuccagugccaggagauaaccauaaccugggcuacaucacauggcacugggacacauucagcccagcacagagguggggcagagaaggacucuccccucccucugugggcacgugcaagcccuuggcagugcccagacacauuuggaguuaaggcugggccagggaggagagaggggaaauaaacaggguggcuuagauuggcacuaccccaggucugccuuguagcaacugguaguggugggauacugggggaagggcaccuccagagcuauggccggaggcaggaacuucccaugccacacucacuccugcugggguucccugccaggcccugcccacagcugcuaauacccauuccuacacaccccgcaccccggcauucuuugccugcccccaaggcccguuccccagggcugccccucucucugcuugcccacuccugggucugccuccucccuucccugggggcgcuugggccucgggcuggcgaguggauuuuuccagcuucuguaaacaagugauggcagcgugccaggcgggcaggagacaggcgggggcagcaccgcagccagggugugccaagcacugaggcacgguggggaggggggugcggggagggagacacccagacccaaagagagagagagaaagagaaagauucaggcagucagacugacucaaugaagccguacuggacacagagagcagugggagacagagcagucagucucuauuguccagccccccagaaugcuccuugcuguugccccucuguucuagccuagcuaagagcaguaggccccagugcccggcccugggcauccccacccacuucuucuccucccccaccuccaccccuuagggcuggcuaugccauuauaaauuuauaacaggaauuucuccacaagccaagaaaaacuugaccuacuuucuugacggcucccugggcuaagucuccccgcucaccacccccaacuccuguccagccccaagugcucaguucuagcuuugggggggguugucagagacagaacgggcccccuuuucuguacuccuccuauucucuccacccagggguugccugagugcagaggccuguccugcuguccugccccuacccagugcccugccuuaucucugcccccuccucucgccccaacuggacuccuuaucaacucaaggggguggggcagggggcccaaggcaaggucucugauacagcagccacgugauggaguuguacaugggagccauacccuuugucccccucccuuaugccugcaccugccugugugcauacacacaggauggcacaggccuacagcagggucacaguggcuggcucagaggaacuggaggugggggguuggucuagcaacccccccccagcuccuaguagcuaagaacggcuagguuucaagacaggcuguggaguuguuaucccucagccaccugcuuucuagcugcaugaacuugagggagucaccaaguuuucugggacucaguuuccccaucuggaaaguucauuuuauuauuauuuuuugauguuauacaauuuuguuucugagauaggggaucacuguauagcccaaacaugccucggauuugugacaguccuccugucucagccuccugagugcugggacuauaggcauauaucaucacaucuggauccaucugggggaagaaaguuuuguuuuguuuuguuuuuuauuuuuaaagaugagguccuuagcccaaacuggucuuaaacuuacuguguggcugaaaaugacccugaacuucuaauccuccugccuccagcaacuaagggcugggaggacaaacaugccuggcccuucuguuugcagagcuccugugcccccuucagaaggcacagaucuguucagucgacaucgucacacaauaguuccuucuccuuuccccaucccggugaauggcagcugaucaccuaagucagcuaauucuuguccugaaacuggacagugggguuugggacuuggcgagagggauuuacaaacccuuaaaggagcaaggcauggugguacauacccuuauuccccagcaguccagaagcagagguagguggauuucugugaguucuagaacagccuggucuauauagugaguuucaggccagcuagagcuaccuagugaggccuagacucaaaacaaaacaaaguccucaaggggcaggaaccgggguuucauuaaugcacaggaagcugagagucaguucucauuggcuucuguugucucguuccuucaagacccuagcguggggcagggauauaagccagagguagaacauaggccuauccugcccacaggagacacuagcaugaacauucacagucccuauacgcucucccacugccccacccugccuuuguggggaccccuaugccugugcggcaaacuacuugucucugcuccccucuugcccuaucacacuggugaauccuaagaaaccuugguuaaagggugguaacuauagcuaauguuuaauaggcgcucauaaagagccaggcauuuguucaaaugugagaauccagacuuguuaccugcugcauagaugaccucauucuuucccuucaucccucacugugucucgggccugcgucguagcucuccaacugcaccugcgaugugauguuauucuggucccguuccuauaccuauccuccaucucuacugccauuuugcuacaggccccugaaaguuacuaaauacccccaccaaauccugcucagugacauaccucuauggcgacaacuucuuaccccugccucucucuucucuccacagguaucuccagacaggacaagucucugaagacuucccagccccuaacccaguaccuuugaccagcuugccccuagcucucccaccugccacucccuggccccucccaccaccagcccucccauuuuuuuggggagcagggcauggugugaaaggcugaguacugaggggguuacuaugggugcugugcccuagggccuggguggcgggggguggguggccugugggcgugggggggccagugugcccaccccagucucuuggcgugcuggagagcauccuggauggaauugaagugaauggaacagaagccaagcaagguggagugugggucagacccagaggagaacagguaacgaaugggccuggcaacccgguaguacggcaacagauauggauagcucucuggguaaaagagagauggucucuguuuuagacauggcuuuuaagcaccccuggacauggacauggagccagcaagccugcugcuuaccuuaguccagggauugagggcaugcucguauuucuuagggaaucgggcacuuagauugggauguucacuuugaaggaggaagcgguaggaaagggaucauuacagguagcagacacucugccccuuccuuggcagugcugggccaucucagcaccccccaccccuacccugugucucuucucuauuguuacccucacuugagcaugugugugaucccaguggccuugccauuuucuucuuucucccaguccauucacugccugaccacaaauaagcguguuauccacaagccauggugcauauaacauaacauuuccggguacaggcaccaauaacuauuggucacaacccacacuuauuuuuggaaucuauuggaaaccccacacacucuuccuuguucauggucaaaggcggggacugcuaugcagcuccucccaggaaguggaagaacacaccagcuaggaaggguuugcuuccucguggaugagacagacggccgcgucaccuugcacacaccacuagggagagguuaccccucauuugcacugcucugcgucaguuuagagggucuccgcuuucccugucugcucuaaguggcacagagcucuguuccauuuggcgugaugucccaagagcaggguacauccugugccuauggccagggaaauaguggggguggggugcucuggugagcaguguagcuaacuguugucugggagaucagguccugagccagaaggccagaagcuuggccaagcaaagcccuugugcccaagaccgguucuuuggagggucagaaauaguagaugggauuugugguuguguaagugggacacuggguaagaaagccccuucccccaaaacccuccucucacacuuagacuuaugagacaggcuguucucacccuguaaccgccacuuggauugccuguauuucccugcccacacuucuggaagagccugcucuuagcucuuguaaaaagauugaaaugaaguuccuagucccucagagcuguggcaccucuucgcccagcccuccccucccccauggccacgugccaucuuguggcuauguguggaacugcacccagaggcucugaggccugugauagcccccugcucaacugggaccaacgugaucccuacacacucacaccaccagaaggcgggaggcaagccuggccuuccagccuugguaggaaccagacagggguaauccccagggugugugaagcacaaggcugucugugaccgugacccuggccaaggucacugugucaguguguugggaacuguaucaggccuuagggggaggggcccuggaacaugguacacacagggugguuguagaagguuauacaauccuugcaugcguagaggcuuauguaaccuguguguccugagguuauguaacacauauauggaaagccuggcaacauauaugugcagugacugagaguugcuaaaaauaccaugcaugaagaaguucagggucuuuuuccuggcugauucuggcguggugucccagcguacaaaaggcccuuugguuuuccuauuuguuaacuggaggcugugaacaggguaacccugauauuuucaguccauguggguuauuuagcauguguacaugaccuagagauugaggaacauguucacacgggacagagggacgacaccauuaggugccuguccagaggcuuucuguagcacauggguaccuagcagaagucuuagagaaugcccagaaaauugcaugcaauuguagauccuaaggcuuauuaccauacuuggguuuaugcugaaggcugcauaguuauucacacucgugggugugauauugcauauauauauauauauauauauauauauauauauauacauacauuugaaagguuauauagauuuaagaauauuccaaggaguguccuauauauuguggcuggaauguauauguguguaugugcgccuuagagcagcgccuuccugugacgggugucuguguguuuggggacuuuugagcauugcuuaaaugugagauguguguguuuguguuuuggggucucacagcaauaccugucugugugacuguacugggcccucaaacaugguuuuggccccaucuaagccccuuaucucucccaugcagcgaccagauagcuagacccuuuccaagcuuugucagcugauauaggggugggggguagaauaagggcauaaggaggggggagaaaccaagccugggggaguggaaaggggugaagucucuuaggugggaagagacugcccagaggcuacucugugugauucugcccacuuugccccaugcagugccaggucaccagauggaaagcgaaaaagaaagaacggccaauguccccugaaaagcagcaugucaggugagccuggcuacaugugucccuuacccucccacuuccccuccccccacagcacacuuggccuccucccaggcuaggccuggaccuccugugucucuggagggaacagccuacagaacauggguuggauuugucugguggugagaauagugauucaaaaccuauucuggccuuugaggaggauguaggucaggaagggccucuuugacccucccaugaccuccucaucaaugguuccaccggccccagggcaucuguucuccuaagaugguugcuucuucuccaagucccuuacucuauucuaucacuuagauguaacguggaagaaaacaaaagagcccuaccuaggccaaguacaauggcaccuaccugcaguuagugcuguuugggauacccauauaggaggauggcuugaaccagggguucaaggccugccuggggaacauaauaagauccaggcucaaaaauaaauacauggaagugaguugggucccugaguggacagucagaaaaaaaaaagacuuccauuauauauaucugaagggaaagggaggggcaauccccacccccuccuccccugguacguccccaggguuuuuccuuucuacuuugagauaaggagccccucccuccguggugauggacugggagaggguugagaaaggccaaguuggguggguacaguguaggagcugcucugaugggcuccgccccaugcccacugccuucacccuuucccccucccaggguauaucccuaguuaccuggacaaagacgagcagugugucguguguggggacaaggccaccgguuaucacuaccgcuguaucacuugugagggcugcaagguauggaugagccgucucccguccgccccucucccguugcugguuccccuuugagucugauaccuggcguaauucagucacauguaaccuagaguggaccgguuguauccuuuucucuucugcauuuaucuggucacuuguucauucauaacccuugcugugacacucguagcugugacacucguaugccaugugucuaaccucucugagccuugguuucuucuugcuaccuucgucauagaguuaauaagcaaauuaaaugagcuaauucaccuggcacggcuuuaaguaacugcagaggggugggaagaggaucuggcagaggugagacucgcgacugugauagccuuuaauacagugccuagcgcugucauagggucagacaucauucauucuuaguguguuaggaaugaggggugugaggcuaaauguacugcacaccugggauucuaguaccugggagacugaggcauaaagaucaugaguucaaggucacccuggaaugucugguugguucugggccagccucagccacaugcccaguacaguagcacacagauuuuaucccagugcccugaaggcacaggcagccuaaugccugugggcugaagccaaccugauccacacagugcauuccagacaauccaaggguacacagugagacccugucucaaaaaaaaaaaacaaaaaacaauaacaaaaacaaaaaagagcaugguacacaguauacaucauacucucaaacuccuugcaaucuaccaaagaagcaauccacacaggaucagugucuuucagaacauaggucauggaggcuggggaguuggcccugugggaaagugcuuacuguacaagcgugaggaugcgaguucggagccccagcuuccacgcagagagcugagcauggcagcauaccuguccgugacccaaaacugugagacagaagcaggaagaugcccgaggccuccuggcuagccaguccagcuugucugucacauaugcucccuagugagacccugugucacauaaaaaaugagguccggggcuggugagauggcucaauggguaagagcacccgacugcucuucugaagguccggaguucaaaucccagcaaccacaugguggcucacaaccaucuguaaugagaucugacucccucuucugagugucugaagacagcuauaguguauuuacauauaauaaauaaauaaauaaauaaauaaauauuuaaaaaaaaaaaaaaagagguccgaaagguggagaaugauugaagaggacccuagguguugaccucuggccuccaagugcacauacacaggcacacacccugugcaugcacacgcacauaugcucuauacugaagauuccugggcuaccggcaguaguaaguauacugcagauucccaaacuguguguguccccuacuuuguccaaaccuuauugugguggagcccaggacucugcuuuuaacaggagucccaggagcucccaauguauccggaaaaaacuaggaccugugcugaagggucaugauggggacauagaggagaagauugccaaagguucuuuuuagcagaggaucaaaggccacagacuuggaaaagccuauuagauacaaccuguuucaaccuguauggcuuuucugggaccaccaccuccugcagguacaggucuuuccagaaggagaucauuuaaaagugagaccaggcaugguggcacaugccuauagccccauauucagaagauggaagcagaaggauuagaaguucaaggccauccuaaaccuaugccugggcuacauaagaccaucucucaaguccagcagugguggcacacacuuuuuuuuuuuuaaguuuuauuuauaugaguacauuguagcugucuucagacacaccagaagagggcgucagauuccauuacagaugguugugagccaccaugugguugcugggaauugaacucaggaccucuggaagaguaaucagugcucuuaaccacugagccaucucuccagccccguggcacacacuuuuaauuccagcacucaagaggcagaggcaggcagaucucugaguuuggggcuagccuggucuacagagugaguuccaggacagccaaggcuacacaggaaaaaacccugucucaaaaaaccaaaaccaaacccaaaccaaaaaaccucucucggacuaacacacaaaggcauacacacacacaaugcagaagcuugaaguuucucuuaaugucagccagaccaaaaaccagucgagaucccaaguuucauagccauguuccuagaaaugauaguagcaacauagccaagaacaagaacccucggcuucaaggacagacagcuaggucacaagggaacaugccccaaagacagaggugccccucuccacuucuagagcuugcuuuuauaaauuuagaaugaaguccaggacucuguaucuugguacaauaacuuuaauucacccuagaucuggacucucagaucucagugucuucuagagaaagcccaguuuugacguggagauuaaauuuaacacacaugaaaggcacgugccacaugcccaucacaaaguaagguucagcagguauucgaacucaccuugcucucauccugauucuucaagugcuuccuuuaaagcaaagacuaaugcaacaauuuaguaguaguaguaguuaguaguaguaguaguaguaguaguagaagaagaagaaaagaugaagaagaagaagaagaagaaaaagaagaagaagaagaagaagaagaagaagaagaagaagaagaagaagaagaagaagaagaagaagaaggaggaggaaagcuuacaagcaaugaauguucccacucugcauucucuugaauacuauuuuauaaauugcauuugcaaggguaauaggcaaaauggugucuaugagaaugcuuuugggaucagcauugccuguagagucauuaagcaagauggccaagauaugaaccggacuuucuagggcuggcgauguagcgcugaugguugacuguuuccuucgaguucacaaagccugggucccauccccagcaccacauaaaccagcugugauaacacaugucuacaauccugccacuccagaggucagaagcucaaggucauacuuggcuacauagcgagucugagugcagccuggacuucgugaggcucuuugucuugaaaaauauauaaugcuuuuuuuuuuuugguuuuccgagacagaguuucucuguauagcccuggcuguccuggaacucacucuguagaccaggcuggccucaaacucagaaaucagccugccucugccucucaagugcugggaugaaaggcgugugcuaccccugcccggcuauauacuacuuuuguuguuauuuugguuugguuuugguuuugguuuuggcuguucuggaacuugcuuuguagaucaggcuggccuugagcucauaagagauccacuugccacugccuucugagugcugagauuaaaggccuguggcaccacuacccugcauaauacauuuaacaaauucuuuagaguagacuucuaaggccucaccgcaucccacggcagcccaggccaggccccgugcugacuaccacacucacuguucuuacuucugccaguauagacaucccucaucccucugcagccugaggguaaggacaugggguucuuugggucucuuuggccuggcaggguccagcaauucuggccccacagugaccugaggaugccaggugacacugacuucccuugccccuccccuccucagucaccuguguaguuggcucaggagaggaagccuuacugaugcacccugcuuccgaugccuccacccuagggcuucuuucgccgcacaauccagaagaaucuccaucccaccuauuccugcaaguaugacagcugcugugucaucgacaagaucacccggaaucagugccagcugugccgcuucaagaagugcauugcugugggcauggccauggacuguaagaggcacccguggggcaguggagcugggcugagggguagcggccgagggguagccaguccagguuaggcuucaucccaaaucccauuugguacccucauaccaccaaaagaaauagaaguccuguguagucuuuuuuuuuuuuuuuuuuuuuaauuuauuuuauauauauaagugcucuaucuguauguacaccuguauaccagaagagggcaucagaucccauuacagaugguugugggccaccaugugguugcugggaauugaacucagaaccucuggaagagcagauggugcucuuaacugcuaagccaucucuccagccccuccuguguagucuagaugcuucuugccguuugaagacuuuagaaagggaguuguugaguaaaaacuccugugcgcugagccuaguaagguuccugcuucccagggaaggcacauccaaaugaggaagggcucuuuccucgacuguagguugguuagcaagucccccacagcucaaaucagaaccugucuuuccuuggaccaaccuacuuggaguugacuuggucccagugauuaaacaugguuuguauugugccacccuauugcuaagugauuugggaagucacuugacauuuguacuagaguguguaauuucugagcuugggaggggguuugccaugcaaagugguuuuuuuuuuuuccauaaacagugguucuagaugauucgaagcggguggccaaacgcaagcugauugagcagaaccgggagaggaggcgaaaggaggagaugauucgcucacugcagcagcgaccagagcccacuccugaagagugggaccugauacauguugcuacagaggcccaucgcagcacuaacgcccagggcagccauuggaaacagaggcgaaaauuccugguaagaaggcaugcgcauugaaaauucccuuggaaaccuugguuugguucagcccaaagcugguacucugucccuguuggcaguuuagaguuuguacacuuguacacaugccuuugcuuucuagggccugccugucccaucuaauggggugcuccaugagaacuggguccaauccucuagauuccagggcggggcuaacccacagggacugaggacauagucacauaacaguauuaugggacaccugcaggguccagguguuguauucaacccucacagaaccgacugccaagugggugaucaguuuggaaggagaugggccaacggggccugguucccuaguagagaaugcuaagggauggaaaaugcacuaaguuacccaacaccaagcagauguguuugcaaaggacucguugugugacucuggccauacaacugagcuaugcugaacccagaaguguuggugauucuguuuuccauauagauuugcagcaaggauuaaaaggagcuauguagagccgggcgugguggugcacaccuuuaaucccagcacucgggaggcagaggcaggcgauuucugaguuugaggccagccuggucuacaaagugagcuccaggacagccagggcuauacagagaaacccugucucgaaaaaacaaacaaacaaaaaaaaccaaaaggagcuauguagagcaggcaaccagccuacagccugguaucaugcuuucaggcaugacggcuguguuuuuauugcaauuuauuaacuacuguccacaccauuaucagcauuaguaagucugaaaugcuggcucuggucuauccucuuccccuaauguugaagccuugaggcagaggcagagcugucuagcaggcuccgcugggacuuuccccccccccaagcugccuuggagcucccccugguggguagggagucuccgugagcgggugaaaggggucugcagccccagcugacccucgucucucucccucuagccggaugacauuggccagucaccuauugucuccaugccggacggagacaagguagaccuagaggccuucagcgaguuuaccaagaucaucaccccggccaucacgcgcgugguggacuuugccaaaaaacugcccauguucuccgaggugaguggcagauggaaggagagacuuguuagagagagucucgggucacuucccaggucacagagccucacuggguauucuucucauguucucuggacauggagugauucuuauagaucuauagauauucagcacaugcguguaugcacacacacacacacacacacacacacacuccuauucuaucugcaggcagcaugacucaucucuucauucugccuagcacuaacuagaaacaggcugcuguacuagcugugggaccuuggccaaguuaccuacguguucuguacuucaguuucugaaggagacugggagaaugaugggaccacacccuuagacauagcugugagguuuaagugcaacagugcaggaggggcgggcucagcccagcacagggugggggagacugugggguguggagaggaugcacugaagugcucugugauccugcuguuccacagcugccuugcgaagaccagaucauccuccugaagggcugcugcauggagaucaugucccugcgggcagcuguccgcuacgacccugagagugacacccugacccugaguggggagauggcgguuaagcgggaacagcucaagaaugguggcuuggguguggucucugacgccaucuuugaacugggcaagucacucucugccuuuaaccuggaugacacggaaguggcucugcugcaggcugugcugcuaaugucaacagguaucuugcuguggcugagaggugccacaaguucccagggcucuugcuugccucucuccuuaguuuugcauagguucugucucaccccuucccucccaggcugacucucuaugaccccuacaauccccugcccugcuagccuaugcucuauucuauuuucuuugcccuccuguuugguuccaggcuuacuuauugccucucacuaccaauccucucucugcccauucguuuucuguuuccagccucccucuccucucugccgucuuucgauuucacuaucuuccuuauggauugcuucauggccgcagguccucagugucccucccugagccccagccaccuccuccugcuacuacccucgucccucagugcuauuuucuccccuugaucccucccagucucucugccucaguaucccaucaugcuuucuccugcggcuuuccuagacccucuuguccucgggccucaugccucucuuugcucccugcagaccgcuccggccugcugugcguggacaagaucgagaagagucaggaggccuaccugcuggcguuugagcacuacgucaaccaccgcaaacacaacauuccgcacuucuggcccaagcugcugaugaaggugacugaccuccgcaugaucggggccugccacgccagccgcuuccuccacaugaaagucgagugccccaccgaacucuuccccccacucuuccuggaggucuuugaggaucaggaagucuaaagccucaggcggccagagggugugcggagcugguggggaggagccuggagagaagggacagagcugggggcugagggagaacccccaucucuucucuccuuccucccauccuuggauagaugcagcucccauacaccccugcacugcccagcccccucagacccuccagcccuuggacagggccauaaaugaacuugcuaugaaaggcaguaugggaggcuaggacccaaguucuagagucucugggaccccaaccucuaaaaaaaguaggggaagggaaguaggaagaauugagagggacaugccaucuugacuguagggucaggaggaaugaggaguaggggcaggugcccuuacucaccccuauacacacagagagcccugccaaguuccuuggccuagauuucccuucaggccacaggucucuacuuccccaaauaccuggguccugggugcaaaggacagcuuggcuuggcuuggcuuggcuuagcuccuccccuggaggcuaaaaaaaaaugguagucauccuaacugcacuuuggaaaccaagcaaggggagaauauaaaugaagaaaaacuagacagaaaaaaaaaacaaaaaacaaaaacaaaaagacaaaaaaagagagcguuagagagagagagcgagagagcgagagaugauauuaaguuauuagcugaggcuggcccaaggggaaggauucccccccccuuaacccugcccuucccacccccaugcacuuugagagcugcccuuccgacccccagagagaaaugccccaggcagaccuacagagguagggcugccgcccagagcugugagaggauacaacagggucccggcaacccccuugccuugccccccacccucgugccccuuuggcaccgcaccccaguacuucugcucucugccacuugugcccgcugaguuccaucuaccucucacgcuggaugccagcuggccccucaccagccugcccuguugcccacacagcuccccuuucaagugcccagccccaggggccuccuguccccccaccccauaccuugacacccacacaggaaaaacuguggcccgggcuccuucccucuucauauccugcaguauuagcuacaauccagaugcugcuguugggguggggugggguggacaugugugucucccagaaccuccaccccugugggacucuuguuuccugucugucuucggggcucccuuugcucuccuuccugacucccacugaugcgcuagccagacauagggcagguuggcaugcagugggggguguuucuaucaguggcacuuagcuggggcccaggggaggagacaguuggcucuccucccauuuuuuuugaagcucuuuaggccagccaccccucugccccugggaaccccucuccccucuucuuuucuaauucagggacuuuggcuugagccaccucccacccuuuggugaggagugcucuguuggucugcacuugggugagcugccuccuccuccuccuccuccuccuccuccucccuuuggcuaacagcccacuccucugcagagagagagagaaagagagagagggagggaggagguggcccucccagaguggaagggaagggaggaggaggaggaacagagcagaccaguggcccugggcucagggcugcaugucggcagggauggauggguggacauagaugccccccggaagccauggggaauggggcagggggcgggggaggggugccagggcuuccugcgcuuugcacuauuggggcaaaaaugucuuaagcaguggggaaccugccaccccacucugacccucagccugccacagccccuacacacacacacacacacacacacacacacacacacacacacacacacacacacacacacacacacacacacacacacacacguggaaggcaaugcuuugcuguucccaggcaguguccuuugccacuguucagguguuccaacugggcagagggccuggaggagcaucuccugucaccugugcaugugccugccccacuccuuggggccccugggccaccugugcuaucuucaucucuaucuucuuuucucucucucccgggguacugauuucuguauuccuccagucccauggauaauacucucauacuucccucccauaccuggggacucaguggaguuccugaccugccugcugucucccuucuuccccugacuccacuccccuccauucccauucucagccauaggcauggccucuuauaggcacuugggaauuccccccuccccccaaucauaugagcugugagccccugccccucagcccuuccccucccccucagugauguggaguguauguguguguuccuucgugugaguggaugagugagucuacguugugggaggagccagagagacucaggagugccacgcaccugcucuagagaggcagcugucccagucccugccauggaagugggggacagggcccucuccugggggccauuggugcuaauggggggauggccuuggcaugggugcuuagcaugccuucccccaauguuggcccggggcacuagggcaggccggguggggcagcaggugcaguauugaugggagggguggguugcugggagaagguugggggggccaggccaggacaagggggugccagagccaugaccacuacccugcccuaccacugccucuccaucucaguauucccccccccccaucacuuauaacacacauaccucauccagccuccucccugcucagacuuggggagggugggggaggaggagccccuaccccuuccccgggcggugggcugggagagagcagggcgugugacauggacaccguccguccauccauaagggggaaauuacuuccugcccuaggaacuccuggguggaggagggggacacuacccagaggcgcuacugaauguaugagaagcuggugcugagguggggggagggguuguggcuagaaacagggaaggagauagguccuuuccccagagaugggugggaccggcaggggugacuugaggggcuccuccuccugccccacaguugacaaucaguaugucuguuaugugcgaauuuuucaccccguuguguuuugggucaggauuuuaaagaaagauauuuuuaugguaauuguugcucgucuauuuuacuauauauuuauguaauaaauauaugaugaaaauaacccccuugggcacccccccuuagacuugcgugcuguuuccccauauucucccaucugcuggcagaguacccaccccacaagcugaccagauggagaggugucuucccccccccccacacccccuuggcaguagucccccacccccaccccaauuccccaaacgagcacacaucacagaagccagcucagcugugaacuauuggauuugagacaggaacagaacaaaucgaggggccagaggaggguggagagagcaagagugguuuaaauaggggaggaugggagcauggcggugggggugggggaagaguuauuuacaagaaggcucagggggccagaggcucaucuuggaauauuuuauaacaauauaaauaagauucugguuugcuuuuccuuuucgucucguaaaggagagagaagugcagaguucgauucuguacaagggggcagcggcagaaggccggccgggcgggucacugggcguccacccggaaggacagcagcuucucggaaugcauguuguucaggguccgcagguccggcagcuugagcagcagcuuggugaagcgggaagucuccgagggccgguucuucagcaccagagcccgaagagcccgcagcagcgucuccuggagcugcuccaccgaagcggaauucuccauucccgagcggucuguggggaagacgacagcagugaggcgagcucccugagcuccuccucugacacggaggacacggaggucugcgaggaccaggcaggcaaggcagccucucccugaggccccucggagggcaacgggaaaggagaaggagggcgcuacuccuucucccuggggggccucugcccuagagcggggccacgcccacacgcugggagcauggccacaggcuggccaccucccacuccucgagcccacccuccuacccugagcaugccacucguggccaagcucccuuguuauuugcucuguaguucccucugccugggaugcccuucccccucucuaugccuggcaguuaucuugucccuuugaggccccacaucaagugucaccuccuuccccagcucucccgggcagaaauagucgucugugcuuacuugguucaugcuucuugugugacacuucucgcuguuuuauaauuagucgggcaugagucuguuucccaagcuagacugugucugaaucaugucuguagcccagugcccagugcugggccuggcauagaguagguucuccauaaaagguauguugaauugaacugcgugugccuccuccagggucaggggagagcuuggcucaccugcagagacaagcaccaccgcggugaauaggcccagcuccuccucgguaagugccagggaguugagcuucucgcugaagucaaacauggcauugagcaggucgcccaugcccauggcaccgagcuccugcagacuguagguugugcggcucaggaacaucacugucugguccuucacguugaacaacgaugcaaagcgcaccaucagcaccugaagggaggguggacauuuuuugagugagaugggaggggcauuuugccaaaugaccccuagagccugcuaauaacuuugagggguguuuccuuagauugucaguaagggggucagucucugauuggucaaugagggaugcaggugggagugcccgccacuucuggaauguaauuuaaccgaaggucaccagcuccggccuagaguagaggagaguugucucuuugguuacucugaugcacugaguuuggaggcaacaccagccuagaggauagacuucccacagacccugaggugccgagcuagcgguguuacaaguucuaucuccucagacagagagauaacacagggccaaagacucugggaagcccuucccacuccagucaccacacuacuggggcccucccacagucaagagcagggaacauaaaaguaccgcucaccucaaaggugccagccuuaagcagggucaccuggucgugcugagaaaggucacggaagccugggauguguuuggcaaacucuaccaccucccgaacggcaggcgugaagcucauagagaagucuucccagaucuccugcacaguccggccgcugcguccauggggauacauguucaugggacaugccuaagaggagaauggaguaaggagggacauguuagcugggugggcuccccaacaggacugguuccaaguacugucugggcuaagagcuguggcccuugagaaggggucucucaccuaaaucgguaaucaggugccgaauggugauuaaggauucccagguaaaacccagauuuugggguagaauguccuuuccuggacagaaguccccacccccagccucuaggaacacuggcugucuuucucuagucccaaucuuccaaggcccccucgcucucuccacacuggcuccaugcccucaccagcagaacauucuugguguugccuugccguagacuguuggcaggugccuccccuucuggggccgaauauacguggguggggcacagacggugcccauugcuguuagguugguggcagcugugguggguggggccagaaggccagguaggcggguaggaggaagggcccuggcguagaccauucagcgcuucauuaugacgcugagccgccaaaagguuguugucguugggggcagacgggcaucccugacucucccagcgguguggaguuguagcugaagggcuaccugaugcaugauuggcauugaaguuaccaggugaggugccuaacuugucaugggcauaggugaagauuucucgaugggcccgggcgaccugggauaucacauccuccauggugggcucagggcugggagaccuggguggugucagcuguugugggaacugagagaagcccaccaaaggugugggggcuggugcaggaggaggugaggggcccauggagccagaggugggauguggaguaggugaggucucuagagggcacaggcugcucaguugguuguuggccaaguucauggcgcucugcaucucggcaagcauccguugcuucucucucuuggggaugcgcccaaaacgcacagcugcaacagggcgagaaccgugucaggaaguccugacauacucacaugcgucucuuccuuccuuccgcccgaaagggcaagcaagacccuaaaagccugggggguuccacaucaaaacugaaaccagcaaagccacacccauucagggggugugagaggagaugaccaggggguggggguggggggggauaugaaugguagaagaguguguguuugcccaagagguuagcaccuggguauccuccauguaaacaacacucacaguaccauccuucucaacuugaggcucuuucuuaaacggagggauuaaggcagaagccggguggaagaaaauggggcgagaaggagauaugggaauacugccuuaccaucucuagacaugccaacggagagacacuucuugaagcgacacugcuggcagcgguugcgauugaugcgaacgauggagcaguuuucguuuuucagacaccguuuguacuggauauucuguuggaugcuccggcgaaaaaagcccuggaaggcaggggcgacgcaugaaugucuucaucuaagccgagccugugcaugcauccccugcccagguccucaacccuaacccgccucaccuugcagcccucacaggcgugcacuccauaguggaagccugaggccacguccccacacaccuuacacaguagcaccaugccauucagcucugugggaagagacaggcagaggguaauacggacuccuucugggcucaagguucuaggaggggaaagcugaggggcucucacgucuaggugacuggacuggacuggauaggagcuggcacaaacucuuaagagaaauuccaaaggccagagcacagacccccauccccucccaccuccccaagaguaacucucagauggaaaccaacucuaucaacuacgucugggcucacuuccuuucccccuacaucagcugggcauugacuuacugguaauguugcuugugcccuugcugggggacacucggcugcugucuuccauggccacuuguagacuuccuggggggcucccguuauagaaggaggaggaggaugaagaggaugacgaugaugcagaagaaggggagcuaucaucacugagacuggguggcgcacugccaaaagagcgggcaggguccugggugagggagccaguaggugauggugggaaguaugugggacaaccuugagucagggacuggaagcugccauuggagcugucacuguagagggacuccgggcugguccggcucggggaggagccacuagagccaauguaggugauaacaccaccuaaauaagagaacacaaggggaggguaucagccaucaagucugucauucacacagucaucaucagaacauuagacccccuaaccuuggaguaagaagcaauucucccacacagacuaaauauagcacggccggucaaccuagucguuauuagaaacucuccaucacaugcuacuuaugauaaccaaguccggccccaaaauacccauggccauugcuuugcacaauacauuaagcuucugguuugggugggagguguaacuccaguggccaucucauacaugggaaccccugagcuagcugcuuccuggggaguacugacagcagcuagggucuuaguuacaagggggguagacuugggaaggagauggacagcugacaguuauucauacacacacacacaaaaaaaacuagccacuaguucuacacugagaccuuuccagugauggacccugcagcgugauggguagcuagccuagugcgaggaaaauggagguguacaaacguaaaacggucacaccuugcuuucaaacccaaagacauauucucauagaguacugcagggaaggacucucuguucagccuggcucuggccucugagagaugagucacaagagacuuagaaaugugacagauaagacucagaugaguugcaggagaugaaagggagaaacaaaguauccauucuagggauuuaggaauuccccuuccuucucagcccggugguaacuuuagcucuauagccacucagccagcggcucugucccucugguuacauugcgggccaggugauucggcuccugugguaugcacagaagagaagggccacuugucugccacaccucugccaaguacuuagccuggccggccauggguggaguggggaaaggggaggauccucagacacgugugugaggugacacaugccaugccaccgagucgacagaagcacaugucuugcucacccacugacacacacuaaaccaggcagggcaaccuuaaaauagcucaagguuggucagggugaacccugccuguaaaauaagucacagaaugguuacccggcuaugguuucacggcuggguuggaggauggguuauuuauguggaccuaaaugaacuugaccuaguuaauccugaaagagggcaugagaaagucacuaaaaaaaaaagucuuccaacuuugaagugaugggcaaugcucaaaagacccuagcucuccaucuagauguguauugcuaccgauuagcuuuccaauauagaggaaauca

SEQ ID NO: 6360 - RNA, 7448 nt, Mus musculus
cucagcugugaacuauuggauuugagacaggaacagaacaaaucgaggggccagaggaggguggagagagcaagagugguuuaaauaggggaggaugggagcauggcggugggggugggggaagaguuauuuacaagaaggcucagggggccagaggcucaucuuggaauauuuuauaacaauauaaauaagauucugguuugcuuuuccuuuucgucucguaaaggagagagaagugcagaguucgauucuguacaagggggcagcggcagaaggccggccgggcgggucacugggcguccacccggaaggacagcagcuucucggaaugcauguuguucaggguccgcagguccggcagcuugagcagcagcuuggugaagcgggaagucuccgagggccgguucuucagcaccagagcccgaagagcccgcagcagcgucuccuggagcugcuccaccgaagcggaauucuccauucccgagcggucuguggggaagacgacagcagugaggcgagcucccugagcuccuccucugacacggaggacacggaggucugcgaggaccaggcaggcaaggcagccucucccugaggccccucggagggcaacgggaaaggagaaggagggcgcuacuccuucucccuggggggccucugcccuagagcggggccacgcccacacgcugggagcauggccacaggcuggccaccucccacuccucgagcccacccuccuacccugagcaugccacucguggccaagcucccuuguuauuugcucuguaguucccucugccugggaugcccuucccccucucuaugccuggcaguuaucuugucccuuugaggccccacaucaagugucaccuccuuccccagcucucccgggcagaaauagucgucugugcuuacuugguucaugcuucuugugugacacuucucgcuguuuuauaauuagucgggcaugagucuguuucccaagcuagacugugucugaaucaugucuguagcccagugcccagugcugggccuggcauagaguagguucuccauaaaagguauguugaauugaacugcgugugccuccuccagggucaggggagagcuuggcucaccugcagagacaagcaccaccgcggugaauaggcccagcuccuccucgguaagugccagggaguugagcuucucgcugaagucaaacauggcauugagcaggucgcccaugcccauggcaccgagcuccugcagacuguagguugugcggcucaggaacaucacugucugguccuucacguugaacaacgaugcaaagcgcaccaucagcaccugaagggaggguggacauuuuuugagugagaugggaggggcauuuugccaaaugaccccuagagccugcuaauaacuuugagggguguuuccuuagauugucaguaagggggucagucucugauuggucaaugagggaugcaggugggagugcccgccacuucuggaauguaauuuaaccgaaggucaccagcuccggccuagaguagaggagaguugucucuuugguuacucugaugcacugaguuuggaggcaacaccagccuagaggauagacuucccacagacccugaggugccgagcuagcgguguuacaaguucuaucuccucagacagagagauaacacagggccaaagacucugggaagcccuucccacuccagucaccacacuacuggggcccucccacagucaagagcagggaacauaaaaguaccgcucaccucaaaggugccagccuuaagcagggucaccuggucgugcugagaaaggucacggaagccugggauguguuuggcaaacucuaccaccucccgaacggcaggcgugaagcucauagagaagucuucccagaucuccugcacaguccggccgcugcguccauggggauacauguucaugggacaugccuaagaggagaauggaguaaggagggacauguuagcugggugggcuccccaacaggacugguuccaaguacugucugggcuaagagcuguggcccuugagaaggggucucucaccuaaaucgguaaucaggugccgaauggugauuaaggauucccagguaaaacccagauuuugggguagaauguccuuuccuggacagaaguccccacccccagccucuaggaacacuggcugucuuucucuagucccaaucuuccaaggcccccucgcucucuccacacuggcuccaugcccucaccagcagaacauucuugguguugccuugccguagacuguuggcaggugccuccccuucuggggccgaauauacguggguggggcacagacggugcccauugcuguuagguugguggcagcugugguggguggggccagaaggccagguaggcggguaggaggaagggcccuggcguagaccauucagcgcuucauuaugacgcugagccgccaaaagguuguugucguugggggcagacgggcaucccugacucucccagcgguguggaguuguagcugaagggcuaccugaugcaugauuggcauugaaguuaccaggugaggugccuaacuugucaugggcauaggugaagauuucucgaugggcccgggcgaccugggauaucacauccuccauggugggcucagggcugggagaccuggguggugucagcuguugugggaacugagagaagcccaccaaaggugugggggcuggugcaggaggaggugaggggcccauggagccagaggugggauguggaguaggugaggucucuagagggcacaggcugcucaguugguuguuggccaaguucauggcgcucugcaucucggcaagcauccguugcuucucucucuuggggaugcgcccaaaacgcacagcugcaacagggcgagaaccgugucaggaaguccugacauacucacaugcgucucuuccuuccuuccgcccgaaagggcaagcaagacccuaaaagccugggggguuccacaucaaaacugaaaccagcaaagccacacccauucagggggugugagaggagaugaccaggggguggggguggggggggauaugaaugguagaagaguguguguuugcccaagagguuagcaccuggguauccuccauguaaacaacacucacaguaccauccuucucaacuugaggcucuuucuuaaacggagggauuaaggcagaagccggguggaagaaaauggggcgagaaggagauaugggaauacugccuuaccaucucuagacaugccaacggagagacacuucuugaagcgacacugcuggcagcgguugcgauugaugcgaacgauggagcaguuuucguuuuucagacaccguuuguacuggauauucuguuggaugcuccggcgaaaaaagcccuggaaggcaggggcgacgcaugaaugucuucaucuaagccgagccugugcaugcauccccugcccagguccucaacccuaacccgccucaccuugcagcccucacaggcgugcacuccauaguggaagccugaggccacguccccacacaccuuacacaguagcaccaugccauucagcucugugggaagagacaggcagaggguaauacggacuccuucugggcucaagguucuaggaggggaaagcugaggggcucucacgucuaggugacuggacuggacuggauaggagcuggcacaaacucuuaagagaaauuccaaaggccagagcacagacccccauccccucccaccuccccaagaguaacucucagauggaaaccaacucuaucaacuacgucugggcucacuuccuuucccccuacaucagcugggcauugacuuacugguaauguugcuugugcccuugcugggggacacucggcugcugucuuccauggccacuuguagacuuccuggggggcucccguuauagaaggaggaggaggaugaagaggaugacgaugaugcagaagaaggggagcuaucaucacugagacuggguggcgcacugccaaaagagcgggcaggguccugggugagggagccaguaggugauggugggaaguaugugggacaaccuugagucagggacuggaagcugccauuggagcugucacuguagagggacuccgggcugguccggcucggggaggagccacuagagccaauguaggugauaacaccaccuaaauaagagaacacaaggggaggguaucagccaucaagucugucauucacacagucaucaucagaacauuagacccccuaaccuuggaguaagaagcaauucucccacacagacuaaauauagcacggccggucaaccuagucguuauuagaaacucuccaucacaugcuacuuaugauaaccaaguccggccccaaaauacccauggccauugcuuugcacaauacauuaagcuucugguuugggugggagguguaacuccaguggccaucucauacaugggaaccccugagcuagcugcuuccuggggaguacugacagcagcuagggucuuaguuacaagggggguagacuugggaaggagauggacagcugacaguuauucauacacacacacacaaaaaaaacuagccacuaguucuacacugagaccuuuccagugauggacccugcagcgugauggguagcuagccuagugcgaggaaaauggagguguacaaacguaaaacggucacaccuugcuuucaaacccaaagacauauucucauagaguacugcagggaaggacucucuguucagccuggcucuggccucugagagaugagucacaagagacuuagaaaugugacagauaagacucagaugaguugcaggagaugaaagggagaaacaaaguauccauucuagggauuuaggaauuccccuuccuucucagcccggugguaacuuuagcucuauagccacucagccagcggcucugucccucugguuacauugcgggccaggugauucggcuccugugguaugcacagaagagaagggccacuugucugccacaccucugccaaguacuuagccuggccggccauggguggaguggggaaaggggaggauccucagacacgugugugaggugacacaugccaugccaccgagucgacagaagcacaugucuugcucacccacugacacacacuaaaccaggcagggcaaccuuaaaauagcucaagguuggucagggugaacccugccuguaaaauaagucacagaaugguuacccggcuaugguuucacggcuggguuggaggauggguuauuuauguggaccuaaaugaacuugaccuaguuaauccugaaagagggcaugagaaagucacuaaaaaaaaaagucuuccaacuuugaagugaugggcaaugcucaaaagacccuagcucuccaucuagauguguauugcuaccgauuagcuuuccaauauagaggaaaucaacucuugucucuuggucucaguuuuccuuucuaugaguggggggaaaaaacccugggcgacgacacaaaguaguacguugucaaccuugauucuaagguauuccuguuugggggggagaagacauucauggcaugcaaagucauacucggagaacaguaaacuuuggaacauggaaaagugagucugaaugcagaaaaugaauguaggcaugauuagaauaaagggguauaagaauaaucuggugugagguuuagcugggacguauaaacuugaggccaaacaagucaggggugcccccauauuacucaagucucggucauagaggguaagggccaggcagucugagaggaaaagaagccaggcgggggcggugagucagcccagcuucacccagaucuaggcggagaagggcggggcgggagccuggcccucagcuggccucacguccccacuccacgugugccccucgcacguggcaccccaacgaggaaccccggaacucgaagcaccgccuucuccgcuucccuucugucgcaaggaaaaccccgcccucgccccgccccucccgggcguccugggucguaggcuggcccuaaaaccaagcugggccgggacaacugaggggaggagagaaggcgacaagcguugcuccggcaacuugaggggcggagcucauuauguaacgaggccgggaggcaaugaccaaugagauggcggccacggcuucuacugaaugaaaacaaaugcagcacgugggcccggcucugcagccaugugagcccuccccaggcuaagucgcugugggugcccugccuggagaugagucccaagcacccgacuccucaaaugaagcuccccacugccgcugaggauuccccugugaacucugacccagucacgcaaacccaccagcccggaucgccccacuucccaagacuaccuggaaguaggcuagaacuguagaaaagggaaaagagacaggcauacuauagcugcaaggagugggcaaauggggacguguccagagacugcuucaaaaugcugagucucccuaaacucuuccacucgccacugguauccacccuccauuucauccguucucggacugaggggaacucagggggugcuagugaugcguuuuaggcacauucccagccguaauaacccucuuuagaaaucuuaccuaguggcuuucaucuuagcacaguaacaaacaccagccagagggaauccccaaucccuuacaaaguuccucucauaagccuuggauggaaauggagacagugacagagcaaagauaagaaucucaguaccuguguuguuauuggaguccagggucgucaugucuucaccagcugaaagcggucauucaaacuggaccuugacacaaacuggagguugugauggccucucucgcccccugggcaauggcugagggagacgagugagccccgcaguucgcaaucaggauuccaggcacugagcaguaaggucuugggguggcuauacugcagcccuccagaaggguaggacgcugaggcaccugagaucugauuugcaugggaagagcagagagugugugugugaagaaucagccugcagcaguucuggcuauaagguagcaaggagagucgggucucugcagugcaccggaugccacuccugaaggcuccgcagugaagcaggguaaugaaucuggagcuccgggugcaaaagucccaaaggaagagaagcugcaaccaggaaguaaguaggugauggagaaaugaggcaccaggacgcaaagagagacgugugcccugcuacguuuccucagcaguaauauuucacucugccaaucucaaccgccuuuugcccgagccuuucccugggacagagggcucugcgcaggcgccagcagcccaggguucccgggccgcacgcggcacuggagcagguaccaugugauuccagggagcgccucgugccccagug

SEQ ID NO: 6361 - RNA, 1939 nt, Mus musculus
cugcucccugguuauccgugaguagagucacuguggacugaggugcagagaagcuugugggguguauaugccugaggaggcagagugccucugcgccuuucuuaucuccauucuaagcggcaccucaaaccgucucuggaucaagcauccgcuguucuuugggccucuguagaucucugugcagcugcuuagggaacccgaggcucaugacaguccucgugagaaggauggacuugggagaaacuggggccugggcaagcacugggggccguguguagcuucugggaggcuuacauaaacacuggcuaggaugaggagggaaaggagggugcaguggcugcgggggggggguggggguggguagggcuggggggggggcgugaaagaauaagcaaccucugccccgccagcucagcuuguguggaaggaauaaggcucacguucccgguccuccucccuugguugcagcuguugguuggaaggucugcaguaugaugggggagggaggagggagaagaugcuacuucacaaauuuaggauccuucccacucuucuaaguggggggaggggcaggguuugaugagauuuuucagugcggcaggaagaagcuuuggcucauuagaaugcacagucugcacccugagagggggggaaaaucugugcugguugcaaaaaugcagacguguguaggggcccaguggagagauuugaaaaauaaaauaaaauaaauaaaaaaaaaauaaaaagcaccagcucugcaaugcagaagcugcaaaguuuucuggugugcgaggaaaugugggucgcucucauuucauuugcuuguuccugcuaaccuacuguccgccugacuccagcagucuuacccugcagcgcagaaacagggucaucagugggcagggggcaggagcugugggcugcaaguaggggcucugggguuacagggccugugagcugugggcgggggaggggacguuucggugagggaugaaagcuaaacuuguccuuuuacccugucgcuuguucuccaggagucggugugacagccagccuuucuaggucuccagcgccuccucaacacggacuagcaaagggacuuccccuuacaauccauuggccccacagacccccgcugcaaacacauucuuagcauccuguccccggcucguaaaucgcugguuucuccuuguucuaaucuuggagugggcacuauucuuacaaacgugugacaucguccuuccuagaaagaggggacagggaagccugguuagaugagcccaggcuccaggaaaagcaggucucagcuuuaagguggcuggggugagagaugcugugcuccugacccggagaggcccuuuguuauccgggggggauuugggcucuggguggauguaaaugcuaaacggcugccuggguggugagcaugcuggagaacccuggcuuacuugcugcugacugcacuaccggugguucaggagagagaccaaaguacauaagcagaaaacagggcagcagauaacaaggcggcccaguggccuuucacuucuucccccuuccuucccuccuguuccuccggccacuggaggacagggccgaguguguuugugcugucuugaagcucacgcgggcugcccgggucacauggcacgggcaugugcagccugcuccauuucuaccacaacaacucgcucauaaacagcccggcugcugcggcgguggcggcggagacaugugcaagugaggggguggggcacguggcccugcccgagccaagggaaggacuggauugcucagcgcugccuccaccccugcccgcacugggcugccuagccacaggaaauuccuagugcucccucgccguugcaaaacauguuuugggggaagugacuuucaauaaggauggaguuaauggacuaaauaaaaagagcacagauaaucg

SEQ ID NO: 6362 - RNA, 12839 nt, Mus musculus
cacucagacuccucggcgcucuuggcgcccccgcucuccacccgccgcaggugaaggcccccgccgcggccgccgcgcugagaaggcagcgagccacugccgccgccuccgacgcucccgcugcagcugccgccgccccgcgccggagagccgcugucggaacccgaagccccggauuccucguccuccguguccugggaagcgcgcugccgccgccgguccgccaucuuacggagaacggccaccgcuggucagcuccuuacgcaccacgcccgccgcggaggcugccgggaagcucgagacuccggagucccagcgugcuucacguccagggagggccgcccuucuuuccgcggggcggggccugcacccugcggcacguuuucuggagagcgagaugacgucugucggugauguaaggaggcguggccuagcgcuuuauuuccccacacccccacaccccuagccccggcgggcggagggcgccugggagcggggcuauugcauccucuucggguucuuagcucggccaucuuggacuuuccuuggggaggguuucgagcucuucuagcuccagugcgacguuggagcaauugcaugauuuucguuuuccauugcucgcuuuccccugaauucuauacagaacauuuuacuguauuccuucgcaugguuaaaaaucacgaguccaggugaaaaagccuuuaguccugcgucaguugccagcucuucaccucagucuaaauuuaggggaaaggagaaacugcaguggggacagaacuuaguauugcgguguuuccuggguguauucaaaaucuccuuucuccaugugucuuccuaaccuaguuaucucauuuugagaacugaagguuggaaggacacuagucuuacuaugcuuuuaaaacaucagagcuggaucacccuugacuaguuaagaggcuaguuuuggacccucucugccccuucaaugucucgagguauuaguuucaaauccuggugcauuguuacucuacagagaaugcuuuggguaugcauuuaucagcagugaaagaaaacucagcacaacuaccuugcagcaacauauaguuuguaagcuaauuuauuacugcauauuguuaauauacaucaaauagaugaguuaagaggacucugagcuguuuucauaaauagcuaaagguccccacugcuuaccagaucuauaaacaguaugagacuccaaggaaucaugacugucugcagggacugauucaacuggugacagguggccaaauguaucauggaguucagcuccagaaacaacugccugaacucaaaauggaggaugcaugauuuaauaagugugaaaggcauaagaaucuuauccaucacaaucuaaaauggugcagcaagacugccaaguugagugucuaaauaaggacaaggauagcaugccacuuuguccuuuaguuguuuggucggaauccagcuugggauguuuuuuuucuuuuuucuuuuuuuuuuuuuuuuuuaagaaaaucuaugaccucaagcuagccuuuucaucacucgggacccaccagcuucagccuccccagaugcaggcuaugaggggacaauaccuguaauccugcucuggauccuacuuucuuuuguuuuuugagacagggucucauggaagcuaggcugaucuugaaccuggggcucuccuggcugugugggugcuugggauagcaguccuccugagaaacaguugugagaaacggucaauguuuagcaugaauagacagauggucuggggucccacaugagucuuauuagagaaguaaggagcuaagagauugaucuuucuauaucauuguagucacaaaacaagagccagugcuuucaaguuacaaugaggguuuucaagcauacagaagauguguguaggaagacacuguggucaagcggaucuggacuucauuuaucuggacugauauccagggaaaaucauguaucaaacacugaguaggugaccuauaaagucuugccuacaagcuuuguaauuugccauuuauguguaaggaagggcucaggacaaaggaacauacagacacacgcuagagucugacacaauggaugagccccugauuagaagggcggugauguauuucucuauuucacuuggguuaauaugaagauucuuucccauucuuucauauauacaagcagauauaauguuucccaacaaaucuaauaaaaugaggcaaaaguucaaaaguuaacggccacaauaguuuauuuacaauugaacucuuuauaagauauuuacaagacagccgacuuuacacaucagaaaugguaucaaaaguaugaauuacagcacagacaacgauaugaaacgggcauaaaauaaagcugagguggagagacaagcaauuucucuuuuaauuuauuaacacuagcuuaaacuuuguuaaagaaagaauaaggaacuauguuuucagagaagugcagggccucucuuucugcugaagacugaaucucacaguguuguaccccacggaggggaagcaggugacuccccacgcuccucacugugcucucaccccagccuccucagcauccccaaaccaaaggacaucuaggagaggacauaaccaaauaguagguccucagggaaaggagaaccaaagcaauagaauccacuucaguccugccagauagcaccucauggauuccucucagucuagcaaaaacaggaucugaggacuccucuguguagggcagaaaccuggugguuaaaucuguuaacccauacccaaauuaggaaucugacaaaucucguugucaagaagaaacugagagggaucaagaaacgaaguaaagagacaacugauugagguuauuauuuuugaggagcauguuauaaagaaacaacacaggucagaguaggagcacuaaacaguuggccucauuaaaacaacaacaacaacaacaacaacaacaaucuggcccaaucuuucuagcuauauccccaucccuaaggugugagaugagagccccuagcggagaaguccccuuucucucuacauccucgcugaggugguuuauggcagcuucugucacagagagaccacgcuccuaagcagauggaguuacaagugaaaacccagagccacacacacacacacacacacacacacacacacacacacacacacacacacacauacaaaggagaauuaagagcagcaagaucauccaagaacacuacauggacugcuggaauaauuccuuucaaagucaaacccagggagcaagauaacgucucaaaaaagcuuuagcagugggaggccccugagaacgucucuucccacaguggcaaugccauucucgcaugcucagcagaugggccaaccacacacccuacauaccuuggcuucuccucuaaaagugcuaauaauuuggggccauguucucuucaaggauaagagcccuacccuucuagagauuagaccccaacuuguuuuuauacaauaguccugaaggcuagugaaaggcaacuccuauccagaagcccacaggccucggcuccauuucucuuccagauaguuaacagggaucuuacacugagaccaaaguggccugggagugcuguccugauuuuuuuuucuuuuuucuuuuuuuuuuuuuuuuuucuuuuuuaucuuuucaguaacaaaacaagggcaggagaugggaaacaagaugguucguguauaaaucuauuuucacuaaacgaauaaaguucauuagguacaacuguuuguuucaagcuguagacaucugccaggcagaggaagcauauccuuccauacccuacccccggccccaccccaaaucucuaccucaccaccaaaaguuuggcuaauaggaucaagccccacuaaggaauccuugaaaagugacaugacagagacaucucuacagacucuggcaugccauccccaaaugagagcucuaucgguuuagcacuguuaacuaguuggaaacuuacacucccaaucucuuuucuaaacaucuucuuuguugggggugggaaggaacuucaguuacccaucaacuaagaaagugaaccagcugcacgucuccucccacaugccacugucacagagcaguuuaaagagaacaaacuuucagguaaaacucugcaguuucccccucugaggaaugucuugcuucauuacuucaugcuauuccucgggcccuaaaguucacggugaaaccuacuacacccacacuauucagaaggcgcaccagggaggcacggggucagggcaggcacagcuccuacaggaaggguugcuccaucuuagacacgcuaaugaagagcccuuuaccccguuaggcaggcaggugaguuacaaguggccccugggacccccaagucucccccuauaggacgagcucaagcucaucuccccaaaaugggaaaagccgcuccaguaaccccuaauucacaaucagccaacgcaagagcuuucuucuguuuguuuugugaaaucagaguaaagaaaacaaaacuaauauaaagggaggauggaaaggcauuaccagugaaugauaacagacaugagggcacaggucacacauacaggucucugcuauucucucggaacagcaugcuacaacuaucugaagacaggcuaccgccagcacagcuacuuccuacagguccggugaggugugugcuucuucuggaucuccaaccugcaacggcuucgcucauccaaccaggguaguucaaaguuccuggcaaaaagaaagacagcaaagugacaaggcuacuuccaaggcaguagucagcugacacagucaccauccaaauggcaaugucaucuaccucagauuaaagagcauuccuaaagccgggcgugguggcgcacgccuuuaaucccagcacucgagaggcagaggcaggcugauuucugaguucgaggccagccuggucuacaaagugaguuccaggacagccagggcuacacagagaaacccugucucgaaaaaccaaaaagagcauuccuaaugagaucugacgccuggcuucuagcuugucaucagacaaucauggcuagcccuaagucacauguguccccauucuaucuaggcuuccauggagccugaaaaggagguacaaacuaccugaaaagagaggaacaaucuauuuuacuuacuguggagcuaauuuuggcaauggccguccaaaugcuacaacaggcaagaaggggguaaucagcaaacuuucaacuauggaagaaaaucacauggagccuuguuagcaaagaggugagaaauauccaaccgccaccgcugccaccaccaccaccuccacagcacagcucacccgucacaagcagcugugcuguggagacuugcacucuuuuuccccccuugaaaagucugcaauuguaaauuuuuuauuugcuuuauuuuauacgauuuuguguuucugucccuguguguggauuuguacaugugaauguagugcccuuugaggucagaaaagggcaucagguccccugcaacuggaauuccaugcaguucugagcugcccaaugugggugcuggaaaccaaauuuuggucuguccaagaacagaagugcccuuaaucccugagcuacacuucgucagccccaaaguuuacaguuuuagauagauaccacuuaccaucaucuggcucagggaaaaaugagguaaccucaggcucagauuccugaauuccuuucuuuuuauacauucugagcugcagucgcuguaaaauucuuuguucccugauccucugaauaucccaucugggaaaaaccagacaaacacaaacaaacaaaccaagcauuacuacucaccuaaaagcuguccuacaaaggcaguucccacucuccagagucuagaagguccuugaccggguaaagggaacugacuaccaggcugaggaagcagcacucugcauuauaugcugguguuccaaagaaaguaguacugagggagggcauccacaaaaaggccaacaugugugccuguaaggacaaccgcccuggcuaacugugacacuagugccuggcccaggacucucccagucacaguccuaaggcucacaugcuccugggaugggggucuuggucuuaccguuuucuccucuucucgucuagcuccaguuuugcaugccucuuugaaaauacacugucauccagguucuggaagaggaacaauagggacaagcaaccuaugagcaugcuggaguaacaguuuucaggaacacgaaaucauucaccucagguucuaaaaauauccaggucuauaaauaccacacacaccucugaguaaaagaaucaauaagauacacuucuguccuuacccuauccuucccggcaucccaagcuucaaaaugaauuuuccuaacuuuucaggguaaacaugucaaacaucucugagaggacuauaaaucuccccauuuauacuuuguaagaaucugaguucaaaauaccaauuuguuuuucaauaagcaaguaaguuuggaacauaggauuguguugcugaguggcagcauggagucccuuagcuuggaacaccucccccacaacacugauuagugaccugacuauuccaaaccaggcuuuucucauccauaagaugaaagauauagacccaauaaccccaaguuccuuucuugucuuaagaguucuuuauaggggcuggugagauggcuuaguggguaagagcacugacugcucuuuagaaggugcugaguucaauucccagcaaccacauggcucccaaccacccguaaugagaucugacgcccucuucuggugugucugaagucagcuacaguauacuuauguauaguaauaaaucuuugggccagagcgagcagggccgaccauagcgagcagggguccuaaaauucaauucccaacaaccacaugaaggcucacaaccaacuguacagcuacaguauacucauauacauaaaguagauaaauaaaucuuaaaaaaagagagaguucuuuuuaauccauccacagcuauuagaaauauucaagcaagccucuccccccaugccccacgcccaccccauggucuuugagacaagaucucccuaugauaccuacagaacccuccacaucuucaaucugagucauuccuugccucagccccugaguagcugggacucuaggugcuaacaauggccaguuguacauccccauauucuacuguuuccaauccccuuaacagcucuggguacucaccuccaaaaugucugaaggauuugggucccuuagaggcucuacugaguggucccuccaagaaggaacugaaaaaauaaagaaaaagaagaagaaaaagaggaggguggaaccacccuuaaauccaaagucauacaacuguccaacuauccacaaggacaagaggucucuccccagauaagacaguuauuaugugauaggaauccauacuacggccucccucaaggccauagucagucagucaguguccucacuaugguauacaagaaccuaaagugccauugcagucugccaaacucagggucaccaaaaaaaaaaacccuaagccaacaccugacaauccacauaauggaugcuccuaacguuccugaaaaacaacugggaugugugguuguguugaugccuacaguaguguuaucaaacgccaaggacucucacuguuccacauccaacagaugagaacgcagcucccaaccagccaccaucccaccaaaccccaccccaggcccagccagcaauuccuaaucuacucaccagccaagacugaaguuucuccugcaacacuugauggcaucagacacccuaaauaauguaggaaagaagaaucaucucaguguaaaaagaaaaaaagcccacacccaaaauggaagaaaggauccucucugaugcgcucgcuaggaagccauuuugcuuucugaguuguucuuuugagaauuucucucuggggaaggggaagagggaacaacagacaaaagaaaagaaaauaagcccaccacuuuuuuuuuuuuuacacugagacgacuucuuuucuucauuauuuagggugguuucccugcaacaguugauggccaaggauaucaaaccuuaaacucagaacauggcaggugaguaaaaguugaccuauuuuucaaauaaauagaucaguguucuuagcacuuacagauguagucuucuuacccagucuccuccucccucccuccaaacuaccuggcugcuccagccugaacaacaugcacaaagacuuuggcuuccuuagaauaagucauugagacuuccucuugagauaggagcaucaauaacagaaggacucacacacuugugcagaacucaggcuccucaagagacugggauccccccagucacacccccucauaguguuaugcccacaaucucagacguguuuggaacuugcucuacuagaguagacaggguuuucaaaaacagccagucacaaagaauaacuccagaccaagccauuuccuaauuccggaugggaaguugcuucaugguuucuccuaaauuguuacacagcauugcuauagcagcaaaaauuaacuauuaaaaugaaccuguucaacugacugaaacaacacugaguaucuaaaucuaggucaggacccugcucugucuugcguccucagugugaggccuaauaaagguuagaucgguucuccaucguccccacugggauuugccacaacaugcagacaaagccuggagaaugcucacaucucagugagggauucccauccccaucccugcuggaggaaggcacaggaguagaaacuuaggucuaaggaucuagcuaagaaagcuuuccccaccauuacccaagaguacccacaaugacugucacagacuaauauuacacacuugaagacacauuauaguuacugguucaaauggaagauggggaucaucucuguggaagccauuaagaaauaaacaagaauaaagaccaaguccccacaccccacacccuccccaagcagcucagauaucccaagauaguccuuauuguuugaaaaauaguuuguagaccauuuuauuuaaauauaugaacaaccaaugggcuacugcaauccaagugaacucuccacaucuuagaaccuugugaagugcaguaaaggaagacugucggucuuuggcagauuccuccugcccccagcccgggacagagagauacagauaaauguuuauguaguuagagagcggaggcccaggugaaacuccccaccccaagcuggcuccccaaccaaaaauuaccauuggccccugagaacacccaaagaccacccucccagguuucacacaauaucaauugcaggaacagucgugcacggcaaaguguaaguucuaugcauuucacagcacagaaaacccuucuuucagagggcaugcaaguugccggagauuacaccccccaagucuggugcucuugugaugagcaacuuacuggcaaacacaucucccaguguugugagcagacacauacauugagcacauuuugcuguaauuccaucuauuugcaaugccugcacagugucugucucuggcuguuaacuuacucauucuugacagaacucugcuuuauugauugcacuuuuuaaaaaaugccaaaggccuuucacacguguuagcgugaccgccaccacuagguaaagagcaaguguucucuaugccuuacuugcuacagucuccuccuucuuuggagaggauucccguaaugguaacggugaugggggaggcuggugccaacgacacaaauacauuucugugguggaaagguacggcaaaucuuccaucucacuugagaaggcuuucuccuuggggugggugcugggucccuuuuggggagucgagagucuuggugggguauccacugaagaccggggcuuuucugggguuucuuggcuccucaauucacguuuacaaacaguuucugauauggaaccacaggguuccucuuuaaugggagagugcuuaggaguuuuuguuuugacuuuugaaaauucaggagccagcuuuuuaacaggagucuuucuuucuguauuuccaaaugggguuuuccuauuagguaggaaaaaaaauguuauaaaaauuaauugauuucagggccaggcagugguggcacacgccuuuaaucccagcacuagggaggcagagccaggcagauuucugaguucgaggccagccuggucuacagagaaacccggucucgaaaaacaaaacaaaaacaaaaaauuaauugauuucaaauaaaauuugauuugaauauauuugagggcaagagagguauccagguaccuaaauaucuacuguucguuuggaagccaugggcagcaagggucaggcuucaaaguauacagagcaggccucuggggagugagcuggcacccgaguacuuaguacugugaccaagaaaaugguucaagaccauuucucaacacagaaaccuggaagcuuuuuguuuguaaaaaacagguucccuacugccaggcugaccuugaacucacaacagaucucuugccuuagcauccuaagugcugugauuacagggguaagccaccaugccccuagaauaacagacuucucaauucaggguaugguugcuauaaugccaauccacgaaccccaagcucauauuccaucaccauuagcagcuccucaucguuuuucaguaacagaauaaagugaccagcacaccuuuugugucccuuuccacuccggccacaugagaaaggcuuggaaggcagagccugggaggucucgcaaagcuccggcuggcgcuccaauuuaauuuucucagacaacucugcuuccucucucucuucagguucauagcccuggagcagcuugugccuuuccuucucguuaucccucuucaccagcugcauccgccuuuccauacguucaauccgagcaaggagcuggagggaagugacaagguacagacuuacacaccaaaguuaaacgccgguacuuagccccauuuaggaaucagcgaucuucugcgugccgcuauggucccuaccaauucaacuuuuacucugaacuggcaggcacgaaucugaauagcuucccuuaaacccaaugaaggcaaaagacaacuaauuguaauuguaggaguuggucuggauggcaagaagcuagggcagccugaagcucuuccuucugaaggaggcccuucccacugggcagccugaagcucuuccuucugaagggaggcccuucccacugggcaggagcggagugccuuuuaauggcaaggccucugccacuuggcuccaagucuucugggacccccucaauuuaaccuuguuucuguucguggucgucgucugugcugcuagggauggaaucagggccuccugaccgugccuggcaaacacucuaagcaucagcaccacugagcuacauucucagcccuguguucuuuuaagguguccuacgguuguccaaauucuaucugcucuauguucacuccaaaacucuagacacaguggaauguuuaaacagcacaaugcagaagaaucaagggcucacagagcgucccuagggauagcaguaccacaucaaaauguuaugauugcguauuugagggaguaauucuaaaacauacuacacugaaaagaauuauaaucgacgccaguaauauaaucccaacacacaugacauauauagauucugcuuuguguuggagauaacgggaaaauauuaucuaaauauuuaucaaaauuacauucuaauuaaagagaaccacaaaaaucaaacaaaauggaagucuauugucaucagaaacuugguauuaacucaguuuugacaaaaaggugacugugcugcuuauagcacaagacaagaguuuugccuugguuagugagugacgucacugcugcucucuuacugccauggcauugacuucagcagaggccaaacaaugacuagaauaagagcaggccuaagcagggcuaagacuguaguacaugacagaagccgugaaugccaagcucagaccaaugccuuagcauuaacucaccccacuuuuuccuaccuugaaaagccuaugaaggaggccaaagaaggcaucaccucaagaacucagcacaacccuccagcugcaguaguguccccccgcccccugccagccacucgugucaccuguguucugauucacagccuuagcauuacuuagccauguuucgugggugacauagucuucauuucuucuccuuuacugauccuucucuucccacccccuucccaugaaaggaaggauauguuguguuuuuacggcagggccaucacaccguagacugcaguacagugcugagcagugccacuccaugcugaguuacuuccacaaagcaacacugagguauuucaacaagaccugccccagcuccuguuccaccuugcagaaggcacucuccaaucaaacagaggccugauggcgacuuauuuaggaagcaaacaaaaugaacagcucuucugcucccaugcucagccuguggugcgugaagccccagaguaagaggagccaggagggagggaggggggagcagggccugagcgcacuguagaagccauguuuauuuuuaggcgucuaaaagguauguuaccacuguagcacccaccaccccagcggcccugaggugugagggagugugcuuaacaugugugcccaaggcugcugcucaugcaagcaagccuauggagucaugcuuuccaggaguacaaagaaauaaccaacaacuuuucuaauaccucaagauucaaaaacaggucugggagguggaaggguuuacagaauacaucgaa

SEQ ID NO: 6363 - RNA, 16144 nt, Mus musculus
cuggacuuuggcgggagacgagaaggcugaaguagagcggcuuuggcgcgaguugacuuugcagcugcuguagaauuuguggcgggagaguuuuuacgguggugaucgagacgcgaggagugugcacugagcgacacggcccugaagagugcaaagcuccgcgaggucugguguccagagaggugaggcugguccgagcaaggccgguggagagcgggaaaucgccuggggucugaggcugggucagggaggggguugugagcucuagaagcgguucgagcacgccgcguugggaaggagagagcugcugggaggaaacgguguaggguggggucgggaguuugguggagugcuggcuaguuuugagcagaggacgcagcugcccuugcccaggacuugggagagccuaaaggugacggucuggaaccaaaccagugcuaaagacgucucacaugucugcagggaaggagcuaaaguauuauagaaauaaauggagacagacuucuggcaucauacaaguguaagaacuuggcuucuggucccagggugcccagggugauagccguguguuucugugacuaucucuuuaagagagggcuaauagugucuacauuugacguaugguaagacuguaguguguaauauguguauaacggaauguuacacguacuaggcagacagacguuacccuuuauuacauagauuugcaugggaagcacaacuaaauguuaaaaaugcuauguuaacgugauuuauggagugcugguccccaauauaauuauuuauauugcucuguguguuuuucucuuugcucuccugauuuuccuuuguauccaguuguguggccaucaugccucaaaccagaucccagacacaagcuaccaucgguuuuccgaaaaagaagcuaucuaauacccugaagaaacccaauucccgggauugugaaguaaaacuuagaaacguccagccuguacccaccacuccguguguggacguaaaacuucugccucucaguccccgaaaacgucuggguaagcccuccgcuuugugagugcgacuuugugacugagcucucagccuuuccugccuugaugcugaggugccuggcucuuaaaaccagagcuguauuugccuucauaauggcugccaaguguguaccgaauuucacgguugagccguacacuagagaucauuugcuaaggaaccuagguuugaucuucauuuccuuaguucuguccuuuacauuucccuugaaguuauaguguuauggaacucgccugcgugcuugugaaauuaagaggaaacaaauaacccgggagguggugagcuugcuuuuaaucccagcacucagaaggcagaggcaggugggucucuugaguuuggggccaaccugguccacagagugaguuucaggccagccuggguuaacccagagaacuccugucuugagaaagaaaaauuugaugagauucuuaauauuuuuuuaauuuuugcuaucaaauaguacuugacagccauuuccgguuuucgauguguuugguguuuuuggagaaaugaucucuaacucaggcuggccuggaacucgcuuuuguagcccaggauugccucagacuugagguccuucccgcgcuaccacgcauacugugugugguaauguugcagcugcuuggauguuagggguugaacccaagaccuuauaugugcuaggaagugcuguaccaccggcccuacgugcccagucuaagagcuucuguacugguguuauggguagauguguacagagagcgucuguugugaguggggggugauuuggccauaucugaagauuguucccguugagggggugguauuggaaccgugaguaagagcuaaccaggaugcugggcauccagcagugcacacaaacagcucccuauagagggagcuuacuuauccugagaugucgggagcgccaagguugaugaggcuuauuuaaaaagaaucuuacaguuucacaccacuagaacucauuagguugcuaccaaaugauaagauucaggggugccaucugguggccacaucugcuccuuggugagaaguuucuuuugugguucugacucggguagaaauucaccucuugccggugaugguggugcacaccuuuaauccuagcacucaggaggcaggggcaagcagguccuuugugaguucaggggccucccggguuaccaggacagccagggcucugaggagaaauccugucucaaaaaaagaaagcgauucaccucuuucugaucgugggggaggucuuugugguucuuuuuccugcccuccgcagugaaggacagacaguguuuuagguggcugacagcaucgcucugacugagcaugucugcuucacguuucaggcgaugacaaccugugcaacacuccccgguuaucucccuguucuccaccaaagcugggcaagaaagaaaacggacccccucgcucacauacguggaaggggugcagauuaguauucgaugaugagccgacauuuaaggcuucccccccaaaagaacaagacagaguucgccaacaccagauacguuccuccuccgcucaaagaaguccagagagcaaagcagauccugagcagaaauguccgccggagaaggagucuguguguauaagacuguucaagcaagaaggugaguccuuacgugguagaguagccaucagggaccgugcuggugggucugaaugaaacccagucaccuucggcuuugucuuuaauuguucauuuguccgacacaggcacuugcuaucagcaagccaagcucguccugaauacagcugucccggaucggcugccugccagagagcaggagaugggugucaucaggaauuuucugaaggagcacaucugugggaagaaagcuggcagucucuaccuuucuggcgcuccugggacuggaaaaacugccuguuuaagccggauucugcaagacuucaagguacaccaagcaucugaauuauggauauuuuugcugagauaauauaucaauuugugugugugugugcgcgcuaguaagugcacacugguguucugcuuguauguauguuugugugaggauguuggaucccccuggaacuagaguucuagaccguugugcccugcaaugugggugcugggaauuggaccugaguccuuuggaagagcagccaccauugagccaucucuccagccccaacaauugacuuuucuugguuuuucgagacaggguuucucuguguagcccuggcuguccuggaacucacuuuguagaccaggcuggccucaaacucaggaauccgccugccucugccucccgagugcugggauuaaaggcgugcaccaccacgccuggcuaacaauugacucuuaaagguucaggaagaauagaugguugggagauugacugcuuccuagaaguaaguaauuuuguuauuucaggguauaaaucuuuccaaagaaaguagagugucacucuuguguccuguuugcucugagauccagucagguuugaggaaaucauugucugaagaugacauaacuccgguguuuguuuguuuguuuuaaccuagaaggaaguaaaaggcuuuaaauccauccugcugaauugcaugucccugaggagugcccaggcuguguucccagcuauugcucaggagauuggucgggaggagcugugcagaccagcugggaaggacuugaugagaaaacuggaaaagcacuugacagcagagaaaggccccaugaugugagugccugccugucugucugcugcgugaugcucagugaaagucuguaagggguuaccgagggaaagaacuuugcucugcggcauggguacaugugcuucaagaaaagaaagauaauacaguuucuaauuuauuuagugguggugcuagggcucaaauccaggguucuguguguguuagauaagugcucuaccacugagucacacccacagccccugaacuuucugauuauugaguuuaaauuuuaacuguuuuguuguugcauuggggguuuuauuguuucguuugggaugcuuuuguuuuguuuuuugaaauggggcuuuuuuugcguauucuuggauguccuggaacuaguguagaccaggcuggccuuacacucacaagagaugggccuacauuaugcaucaucacugccaggccuaguuuaaaauguaacuguuuuuaaacuaguuccuugaaaacaacuggaugauguuagugaugggggcugucgaccuaccaaccuaaggcaagcaacccaagggguagcucagauccaaucuuggaagguugagaaugugacuacugguacuaauucauucucuuuuuccauagcguguugguguuggacgagauggaucagcuggacagcaaagggcaggauguauuauacacacuguuugaguggccguggcuaagcaacucccgauuggugcucauugguuagugcucaguugcuaaugugaagcuuuguuaguuguuuaguagcugugugugugaaguauguugguguagagaccagagguugacaucauaggucuucauuuuuuauuuacuaagggagagucuuuugcuggaccuggaacucacuggccagcuuguccugggcaucuuagcuccaccuucugaggucugaagccugcuccuugugccuucauagccagugcuuaguccauuguagcugugagcuuucccugugcacauuagugaccucuguuguuuguucauuuaugugcaugaguguuuugcuugcaugcagcucugcacugcuugcaucccugguacccauggaggaucauaagccagcuuucugucuuagcaaaauaagaaaauuacugccgggcggugguggcacacgccuuuaaucccagcacuugggaggcagagacaggcggauuucugaguucgaggccagccuggucuacaaagugaguuccaggacagccagggcuauacagaaaaacccugucucaaaaaaaaaaaaaaauuaauuacuaugguaguaaguuaacauaacaugacauugauuuuuuuguuaggucggaauaaaaaugacaaagaggccagacgccacaguguauuccuauggucacagcuguuugggaggaugaagcaggaagaucaugauuuggggugucauagcaagcaaaaggauuaguauuaguguaguauuacugcuauuacgacuacuaaaaaauagggguugcuguuggagagauggcucauugggcaaggugcuugcuguguaagcaugagagauccugucucaaaaacuaaggugcagaacccuaaaggagaacaucucacaccaacuugggccucaccuacacucacacagaagugcauauacucaugaguguuuacaugcaccgcacauaaucaugcaaaguaacauaggcagugaggggugugaguugcugauagagcaugagcuuagugggcacaaagccauggcuucaguucuugucauguauguacuggaaaaaaaaagaaccgaaugccucauuuugaaaugauagcuuugcuuuuuggucugucuugguuuucaagucaggguuucucuguguagcccuggcugucguagaacuaacucuguagaccagacuggccuugaacucagauccaccugcauccagagagcugugaugaaacaggguccggagggcaggggugggagggucaccaccacgccuggcucaguagauuuauuuuugaggcagggucucgcugcagcccuggcuagccuggaauucaacagaaaucucuuuucuuacccccuucuuucuggagacaaggucccuuguccaggguagccucacaccugugagccuccuguguuagucuccccagugcugagacuaugagcguguuucacaauaccugucuaagcacuccaucuuaccuaguagguccaucucagcuugcagcaugggguauggggcaaguggaagcaacaguugaaaugcuggguuaagccagggaaucuuaaggggcuuaauuuccuuuuaggaugguuuugcugcuggugguaauuguuauuuaucuucucagguauugcuaauacccuagaucucacggacagaauucugccgagacuugaagcuagagaaaacuguaagccgcaguuauugaacuucccaccuuauaccaggaaucagauagcugccaucuugcaggaucgacuuagucaggugagugccggcuacugugccaaaaucuguggcagggauaauccccaugauggagaacuaaccauagguuuaaaauauuucccuuugauugcuuuauuaaugguguggccagcuccugcggaccauaaugagugagagcauuuuuaugugaauuucugcacgcgguagcaugaauuggcugcuucgcuggugaaauaagagugggaauuagauucaaacgcuucccuaauggcuuuuaaaaaguggggcccgggccaguguggcucccaagguaaagacaccgguccccagcucugaugaccugaguucagccccggaggcccacaugguggaaggagcccgggaguuguccucugaccuccacagcugcagcccgcauguucugccccacccccacucgaaacagaaauaaacaaaugugauaaauuuugaaaaguagggccuaugagcugcgccuggcugugaguguccacuugagaaacagaagcaggcagaugacugagucggaggccagagaaugcuuaaauccgugcaauguguccccuagaacuaaaaaggaggccaguuagauuuagaccuuugcaauacugagccuuaaacuuggagcugugagcauacauucccacucccaaaauuacuuagucuaugaaaauacuuauauaugguuagaaucuaauuugcuaagagaaacuuuuuuuuguuguuuuguuuuucgggacaggguuucucuguguagcccuggcuguccuggaacucacucuguagaccaggcuggccucaaacucagaaaucugccugccucugccuccaagugcugggauuaaaagcgugcaccaccacugcccagcaaaacuuuuuauucuauuuauuaccaguacucaggcuaauaauaguaaguguuguauacugagcucuguuuauuuugcauuucuauuuacuauauauuuauuugagucagucucacuguguuaacuugacuuuagauccuccugcuguagucuccuacuaguuaggauuucgggccaguguugacuaagccugacucaaauuugucuucugggucuugucugaaggugucaaaagaccagguucuggacagugcugcgauccaguucugugcccgcaaagugucugcuguuucaggagacauccguaaagcgcuggauguuugcaggugaguuauagcacuguugacuguuuuuauuaaaaaagaggaaacauugucggugaccuggugucgcucagaugaaugugacuuaagaggcuccacacugccucuuuccauccaugcucagaaaagaggacuuguuucucaguggggagcgcugggucuccaccauguuaaugucugagacauuaucaguccauuaccuacggagggagaaauaaaugagauguugccggcacuccccguggugauuauagauugguuaauuacauuuguauuaaaaaagacuccaguuugcuuuuccauucgcuggucucaagcagguuuauuuauggaccugaaccaucuuugccuucagacuuucuuuuuccucugcuuuugugggcaccccuuccuccuuccaguugguggucccgcaaguccuacccuagaccucuuucucuccucugucccccagccccuccugcuggggaaagccucugugcugacugaugaaaguuuuuccucccgguaggggcacuggguccauuaaaaugauccuugcugugcuggcccgcuggucccacuucccccuauugccuuacagaagauccaggucugcccauggccuccugugggcaaagcacuuuagaaagaacagugggagaggaagcucucccuguugcuagauggcaugaucuagacagaaaguucaccccagucagcaaacuccuugaguaaagacgacagcuaugaguaauggccaugcaggccagcaagauuagccaacauguguccuauaucugagaacuccucuuuggggucugcugugugggaaugcuguccagccuccacacugccuaucccgucuacccggggcauuuuuccucaucuagaauguuacuggcucaguguaugacagccuacuugacaucuguaaaagcaagaaggguaguaguaguuccgaaauucccagcauuuuuauuuuaaaggcaggucagucucccuuaggcuacaacauaacccaguugauuuucaggcagggucucccagguaacuuacuggucuggaacuuacuauguaaacuggccucuuaagaccuuuuuucuuuuuuaaaaaaagacuuauuuauuauuauauguaaguacacuguggcuguccucagacacuccagaagaggacaucagauuucauuauggaugguugugagccaccaugugguugcugggauuugaacucaggaccuucggaagagcagucagugcucuuaaccacugagccaucucuccaacccaccccuuaagauuuauuuacuuuuguuuuguuuuguuuuguuuuagcugugugcauguauacugugacugugucuguauaguauguuuaugcgguaccugugauggccagaagagggcaucaaauccccuggaacugaaguuacaggugguugagagcuugccuuuuguggcaccaaauuuguaagggaccuuaauuuuuuuucuuuuuauuuauaugagcacacuguagcuguuuccagacacaccagaggagggcauuggaucccauuacagaugguugugagccaccaugcgguugcugggaauugaacucaggaccuucggaagagcagucagugcucuuaaccgcugagccaucucuccagcccaaccuuaauuuuuuuuuuuucuuuaauguuaauguuucugguuugggguuugguggcuuggugugguauuugguuugggccauacuaaauuaauuuuaggaaaaaaaaauuuuguuuguuuguuuuuaggcgagcuauagaaauuguggagucggaugucaggagccagacaguccucaaaccacucuccgaaugugaguagcuuacccuuuugcugucggccuuucuaaacagagaccuugaauugacuugaugaggagagggaaagauaggcagacacaguuaaaucugccuucacacagcagguacaagagggagcagggugugcuagauguaggucauuucagucuugccugucagugucaggcugugugguacuggcugugaguccccagggguguucauaaaugcaggggcucgaggaguaagguuuuuuccaaggcucugggaacgaaaaggagguugcaagguugagccgccuucucucugggccuguugggugcccuuuagguccaucuguaggagaagguaaugccugguacguagaagggagaaaggaaaaaagaugcuaugagcaagcaucagaucaggaguucgucucggggcagucugcaaagcagagcacaaagaccccauggcugucacggacaacgcugcucucccuuugcuucacuggcagaugucauccggcuguggccuguauacuuaccaguguuccguguccaguguuaaucuuuagaaacaaggggaucugacuuguuccuuccuucuaguugggaguucaagauagaaacuuccucuuuuucauccgaauuuacuagaagagacaguuuaaaggguuucaaaaaguaaccagcauuagugcugggacagugagugggcagugcagcccgaucuguagacugagacugcucucucuggcuccucagguuaucccguccuuacaggcucccgucccuuagcaacgacacacaggcuugucagcggcccugggaucagcacuggcacacgcugcugaaagagcucccaggucuagauuacagaaguaaccugauccccucuuuugacuucugauacgcauuuaggacugguuucaguggccuugcuguauaguaagcuauacagacggugacuucaacuaaauacaaggaauguucuaaugcacagaaauaaagguuccccagcacugaagauaggcaacaaaaaguuggcgagacguccaggauggugggccauaccagugauuccagcacucagcauggucacuacaaguucagggccagcacaggggacucuuaaaccaugaaacaggaaaaugggguaggugucgugcugggauuguuuuagagggggcuuugccauuguguggggaguaaggagagacuuccaaguucccuucauugugggacuugugcuccuccguuugggagcucugguuucucuauuagccuucugcagcuuccugcuugugguaaagcaaucgaagcagauugguguggggcaagugcagauggccucaggaaguaacugcaggcauggguuguuagagagcaagcccugucucucacagcagugcuucuccaaacaguggggccaugggccucugugugcucaccgcugugcucagcuuccggcucuggggaggguagguacuacaugcuaggcuagcccguggcauuuucucaaguuucuugccaaauaguuuggacacugugacugaaccucagaggucauuugggaaagccgucugggggcggggccugaggugggacugacuuuuccuggccacgcuuacccgcccaucugacucauaucuaauuaaaauauuagauaauuuuuccaacuguuccuuuuccuuucguaacgaucaggcagucgucuuugcuucagagucuuaggcugaggauuaacugaggguccuugagcaaggcaagugcuauggcgcccgacuucacuccccggccaaccucugaggccguuagccaggcuugcuggcaucugucuggguucuugcuuauucaggaggguagauucguuaucuucucaacacgaaacuacauccgaaaggacaagaugacugggucguuauuuccuagagaaaaggcaagccugcuuucuggaacugccuuuucccucaccuuccgccccagaaacagaacucugcugugccguuacgugggucuggggguuuccuuuagcuaaaaccugcaucaugugucuccgcacauacacaggcgauuaucuucgaaauggaguaaagugccagauggugguggugcuagcacucaggaagcagaggacagauuuugaggacagcuacacaaagggaaggagggaaggaaaggaacugaauuggacaaaguuugcuuacuuugcagguaaaucacccagcgagucgccgguccccaagcgcguuggucuugcucacauaucccaagucauuucggaaguugaugggaacagggugacuuugagccaagaaaacacacaggauucccuuccucuccagcagaagauccugguuugcucuuugcugcuuuugacccggcggcugaaaaucaaagaggucacccuggggaagguaagcuucgcgucucagcagguggggcugaggcuuugccaaagcuacuuuccaaaaggcccugggaauuaacgaugaguaggaggcagggccgaguggagcuuuugcuacauuugacccagagcuuggucuauguagggaauucuaggccagccaaggcuacaccgucgugagacauugucucagaaacaugaguugaggccaggcggugguggcucacgccuuuaauaacaaaacucugggaggcagaggcagguggaucucugaacucugggccagucuaauccuagugaguuccaggagagccaggcagggcuauacagaaagauccugucucaccacccuuagcccccuacccgaaaauuuaaaaacugaguuagccaugaaccagauagagcgguaccauacuuguaauccugguagcuaggaggcagagccagggugauugccagccagggcuguguagaacccaccuuugucuuugcaucuaugguccucccccaaccccuccccaaacuuacguaaagucccguuccuaaguucuaccuuagaguaagaaaacugggcagucacuaacaacugcuugugcggaagacccagguuccauccccaacacccacaugguggcucacaaacaucuggaucuguaccuuuagugccaggggauccaacaacucuucuguucuccgugggcaucuaggcaugagcaugguacacauacauaaaugcauggcagcaaaacacaaaauaaaauaaaucuggcucagcaguuaagagcauugacugcucuucugaagguccugaguucaaaucccagcaaccacaugguggcucacaaccacccguaaugagaucugaugcccucuucuggugcaucuggagacagcuacaguguucucacauauaauaaauuuuuuugguuuugguuuuuggagacaagaguuucucuguguagcucuggcuguccuggaacucacuuuguagaccaggcuggccucgaacucaaaucugccucugccucccaagugcuaggauuaaaggcauaugccaccacucuagcuuuuuuuuuuuuuuuuaaagaagaaucacauaaaguauuggggguucggaaggucuguugccaauucgaggggucaguaaaagugggaggggagauauucagauaacuuaagacacaguuucugggcuucuuucuuuuuguuuuucaucuguaagguuaugagauguggcuuguaagugacacuuguucucccucauuuccucccaguuauaugaagccuacaguagcaucugucgcaaacagcaggugacggccguagaccagucugaguguuugucccuuucaggacuccuggaguccaggggccuugugggauuaaagaaaaauaaggagagccgccucaccaagguacaaguaauggcuuuuugugcgugucccugcuuuuaauuguccugucuuggcgagcguguccucugccaaaguaacgauuagaagugacuagugaacaguuugcuuuucugccagcuagggcuuaggaugugaggacaacggagugaugugauucgggccauugaggauggcagcaguuaaccuguccauuugaggagaauggaauaugauagggggguguaacagcgugugcgccugcaagugugugcaugcgugagcgccgauguucgucaucacagaaagaccucuucucuuuccaggugucucugaagauugaagaaaaggaaauagagcauguccugaacggcaaagcuuucaccgggaacauccucgcugcuggucugcccugaauggcucuuacucauggcacuugcaggugucccucccacuggcauuugagagcccccagaaucuucauuuuaguaaggucguuuggaaacaguuacggccuuuuuuacuccgcaccaguaaauuuuaguguauggauucaugaguguuagcgcuggcugauaucuuugguucuuacugguuuuacccauaaaaaugaccgaguagcuggguguggugacuuuuaugccugugaucccagcacuugggaaauagagucaagaguuaaaggccauccuuugcuacauagugagcuugagcuggccuggacuacaugagacucuguaagaauaaaaacaguggcccuuuuuaaagcaauguucaguacuuuuccccuuucacauuccuaaacacagugccuacgaguauauacggacuuguguuggagaguguguguauguauuaccucugucuacaaaggauauauuuuguaaagaacuuugaaguuuagaaggaugaaauggaaugauccaggaaaauuuacgagccuccguggaagggcauuguguucagaggaugccucauucaugugacagguguugcugcccuggacuuuuuaaggacugaugaagaaucucccgugcuccccaccaguaugggggugacgaggagaauaacuacagauugugaauauauuuauuuucaaguuucguuugucugggcugcauuuguugucucuggguuuucgggcacauagguguucauauccgagucaagcagcaggagucgcuguuugccuucuacgguguggaccgcuaggacugagcucgggccaucaaacuuggcuggcgaccagcgccuacccuucaagccauuuuauggguuuguguucgucuuuuuaagcagccacacuccaugguagcuuagguuuucagagguuaauaagaaaauaccuucucaucgggccuugguaguacacacccuuaaaucccagcccgcaggugauagauagaggcaggcgggucccuguguuucagacauguuccaggacagucuggucuacagagacuccagaaacaacaacaacaaaauuaaaaauaacuagcaaguggaaauacucucucacacuuugccucaggguuagcuucccucagacagagccauuguuucaauaggaugcagcuccggaugaauuuucaucugagccccucuuucuaggcucccuagagaaguucaucuuccuggcaucaaguggcaguuugugacagggacaccagagggcaccauuacaacgccgcuuugaaaguguggcccgggcaagggugguuuugagggaaggggcaggaaggugccugaguccgacuuguuugggagguugcugaugcauucguaccuggcuaagugcuugggagcaaaccaugccugggaugaacugucugagucuuugcuuuucuccaggcgaggcugcugccccgaugccugauccggccccgagcuugggaaucugauauggguacaggagaucuguuggccacuguuugaugcagccugcacauuauccuuguaaagcgaucugaaccccacagcaggugggaugggaugggaugggaugggaugugcugggaugagauaggagggcucgcucgacgcccucugagaugcacacugcccacugcagaagacuguagagaggagauuggaugccaagcacucacucauagaauacacauucccucuggggcggugcacaagaccauacucucccaaggaguuuggagagagucuggaacuguaaggguuaacgagcacaacuguaaagauuguccgaagacugaugggaagcagagaccgaaugggauugagaacagaugugaggcuugauuuaaauuacauuuuauuggaugcugcagccuuaagagacgugacugcuuuacaguuuguuuccacacugugggcagcugcugucuguucuguguccauaguaggauccugcccaaagaggagcggccuccccgccuccgauguaguugaggcuuggcgccuuccucuuaacugcagggcuugagucaggaacaggguuugacucucagugggacugggcuguauccucccuggcuucuagccaagauugcauuuacagauucaaaggggccaaguuccuuccccucucucugucuucuccccauuuggaaauagggcuuucuguggacuguuuuguuuccuucagcacacacacacacacaccccacacacacugucgauuucuaggucauugcuacucuuaaggcuucagcaauuggaacaggguggguugugucagugaugcgugaagcagacuuagagucccugcuuggcuuccgcugcccuugugggagcagaggcugauguauguuugucagcaaagucuuaaguguaauucagacgccgaggcggaaaggaggagagaggccuuuccuugcugcuuuuucucaccgaagcuggaagcuaugggaagguggugggaguuuaaguggaaagggaugggccugugguugcuaguuuuugccaggaucuuaggccacauggcguaguggcaaagaugcugaccuacauuuccuccuuuugaagacacugggguguguguauccugguuugucauuauuauuauuguuauuauuguuguuguuguuauuuuaagaaccagauuaaguuuccauagugucagguaucgcuauggaaagaacauagacucaauaaaguugguaugaauuccaaccccaag

SEQ ID NO: 6364 - RNA, 13403 nt, Mus musculus
aggguccagcucagaggcucuccgcgcgcaggccaccgcuuccaaacugcgucgcuuucuucggcggggcaaaggacuuucagauguuguagcgguggcggcgacucaggccagcgcccccuccccccuaacggccucuucucccgcuccauugcuccaguucccccucgcccuccccugcucucccaccucggggacggcgcuggggguguggccagggggccgguauaaagucccgggagccggucccgggcagccgcucagcccccugccccccgccgccugcugggccggccgaggaugcagcgcagcgccucgguggccaggcucgcucugcuccagcgugcuugcuaacuuccccggcuccgucucugccugccggggucgccccgugucccugcgcccuccgggucugguucucuaagcucucugggcgcugccuccgggucccuugcagcccgcucgcgagcccgcgcuccccuccugcgccccacccucguccucgccaugcugcccuucggccucguggccgcccugcugcuggccgcagggccucggccgagccugggcgacgaagccauccacugccccccuugcuccgaggagaagcuggcgcgcugccgcccccccguggguugcgaggaguuggugcgggagccaggcugcgguuguugcgccacuugcgcccugggcuuggggaugcccugcgggguguacaccccacgcuguggcucaggcaugcgcugcuacccuccccgggggguggagaagccccugcguacauugaugcacgggcaaggcgugugcacggagcugucggaaaucgaagccauccaggaaagccugcagaccucugguaagguacaccuaccuucccucggccacauuucccaaacacccuccucccugcaacuuaguucccauucuggcuggccuggaaggcccgucaaugcccccugugaguugaggagaagggagguacguggcagagcuuagaaacagccaagaaugcuggcauuuaaucccagcaccaguugccacuggucgagggaaaccuaccccaccucuucaucucaaaccuccuaaguacuucuuugggaagaggggccuuggccucagugguaagccuggcuccugagguaaguuaaaugaccugauucaguuacauuugucaucuagaguuagaugacugcgaugauaaggugugcgugcguguguguguguguguguguguguguguguguguacaugcacaugugcauacgugugugcaugugucuguggggggugauaaggaugguguguguguacaugcgcaugugcauacgugugugcaagugucugugggggugauaaggauggugugcuugugcacguuugugugauaaggaugguauguguauucgagcgggaggcaguguguguguguguguguguguguguguguguguguguguugggacgguuccuuucuguuccugauccagagccugauccacacacccagucucaggugagaggugugaggagccaggggcugggccuuucacucaucacccuggggugaagugggacauacaauucagaagaaccucugggguaaagaacaugcgacuuggacuucccccaaaggcucagaaagcaaaggaagagaaggcagggcucuuucugccagguuggcacauccagguuucuugcuccuuccuucuggcaggugccaucugaggggguuggagggaaaugcugguugcuggucccgaguugcagaccccuuggguauaugggacugagaagagaggagggcuagacagacagaucuugcauuuauuccuucuccuuuguccacuugucgguggaccuuucuccguuucuucuuggaaccuuucucuuguccgucugcuauuuccugccguaucucucaacuuccaguuucaccaaacagccccgacuucucuuuuucucggucuccuugagccugacuaguuuccuucucuugcucugacuucguuugguuuucugcaguccuuccacuuccaucucagacgcucucgcucuuuugauguccugacagugacuccuucugcguguucugccuuucacugucucccugacucugguuauugucccuccucugacagccaggcucucugaaccaccacagagcuucucucuugccugauauucgaauccuccauuguugcaguccggaugcugggacuugagccccaagcuuccugcucugggucccaggccacuccacuuccucaauccucaacaguuuguuagucugaggaaagcaggaugcagggaaaacaggaaggagauggacuccaggggugccucucugcccuuccugcuccuggggcaaggagagaugggucagcagaaaauauucugggagaaaugccagccuggcaaccagcuuugcuggaggaggaggaggaagaggaggaggaggagggggaagaagaggaggaggagggggaggagggggaggaggagggggaggagggggaggaggagggggaggagggggggggcagugagaccuggagagaggguugcauuuuuaagaugcccacuuugagucuuugcucccuuccagcuggugggcaucuagccccaggugaagauggugaguagucuuuccccucuccccaacuugagcccaagccagaagagcucaacaagagucuucucuucugguugcauaggagcaucccugcuguguggaggaaaaccagauccccuggaucuggaaggccuggcacaguuucugauugcucgguggaugugagguuagccagcuucaagaggugucuaggaauagggugccaauacgucuugucuuggaauucagaucucaagacgcuaauuccccucccacuucuugaccuugucuucuacgagcacaguggacacaacugucugaggaaggcaaauuuggucacaagagggcagaccuuagucacuugguuggcaagcuauggccaaugcuuucuagucaucagaggaguacguccuuguugagcgaggccuggaaccuuugcaucaugggaagaguaccuauagaacuguaccagccuugcaggaucgcuggugaauuacugagcggggcucagcccauaccuuacacugucaguagaacuuugucccuuuuaggucuuuagguuugggaccagaaauaaagggcauuauuuucuuuaauaauaacuaguaaagggcacauaagucuauuguuucuguucuuuccucuuggggcugagcuucagcugacucuuuaggugaguuguccuuugguacagcucucauuauguuuuuuucccuagggguaggcuaucccuucucuuuccagccugccuugcucuccccucugacagguuggcgaucaguacaaccaaggccaccagagguggggaugggcguaugcaucagaagucuacaguuucacaucauggacuuuugaaauccgagaggguguucgauggggaggucaagcuugggacagggaguuccuaaaccaggcucuagguccccccgggacaggguuaaggaacaggcaggcuggguuaauuuuuagucaacauagcaaauauguucccuccuucaguacugggaaucuagucaugucauggaaacugggcuuucccagacauucugugcuuuaggggagagagguggaagaacauggcugccuagaguuuuucuuuaauauugacauagccuaaacuauugguggcucaaguggccaaagacacaucucccuuccucuucuccacguaggcaaccacaguguccuccucugucaagugucucaugguucugagguguuugacauagaguguaucuauaagguucauagaugggcgugguggugaagguggagaugaaggagcugaagcugggacuuuggagaccauaggguaagagagcagaguuggggagagucacaggagaggagagggguuucuuuggcuuugcaaugaucucuugucacauuagaagccagcagcgaggaacaaccaugaggggcacgcaccccuugagcaaaaucucaaagaaacagccugauaucuguccuguauucuccagcuagggucuuggggaugaaggaagagagaggcuuuuuuuuuuuugugggcaguuaggugacccucuggagcauggcugauacuucugagucuggcugucaggauccacucaguucuuagccugggugucuuagagaggggucaggggcuggucuugaaggagaaaucauaggcguggaaaguaggcagugggaacuuugccucuacuggggccagagcuguacacagcuucucccugggggcuccuuguccuucucugcaguggagugaagagcaagacuucugccauggcuggguggcagucugcccagcucuaagcaagaacuagaugggaagaccugcuucacauuggcaacuccaccuucuagacaagcucuuggagaccuagcaagagggcgaagggucugcuccccacccccaccccaccccccacccccagcuccugccucgguguuaucgggacguugguagagggcauuugaagcugaacagugcuaggaaguuaauguuuuuugagaggcucaguguuacaccccucccccaccgaagcucaguaccuagagguggauuccaggaugaguccuuagcccgcuaggugagcacggaugggucggggagaaguuacagauuaaauggagagucaacaaaaccaugaugagagagacccggauauuaggguguccuggcuuggucuguguuucugaccagggcagggucagaguacaugaggggguguagacaggcacaccuggaugagcaugugucuggacaugugauuauucguaaacauuugugauucugcgucuguggguggauguggacuuaaucuaucuuaugacccuaggcgaauaagaagcuguucuuccaagaugguguuuuuuuuuuccccacuaaguguagauucaaaccaggguucucugagaagacuaugcacacucagaggcuggcaggcugcuggugcagcugugcccaguuaaggcccucuucaacauggggccauuuaauucugacaucagcauaagcuauguuucugggcuugcucuguguccuacgcuguuguagguuucagcaagcuauucaguuguucucguuaauggugaccaucuuaaauacccacgaauaagcccuaaggacuccuguuguuggcuucuauucacagaaaugccgcauugggaagccguguuguggucaagucucugggccauauuugucugcgcucuugagagcucauuguauucauagcuuugagacuguaggguggaggggaagguguucucuaucucccgaggcaaccucuuucuuuaaaaacuccuaaaacaaaacuaagaaauaauuugagagcuaggagccagaugugguggcgucugccuauaacccaguacuucgguggcaaagcuaggaggaggggguauuagaggccagucucagcuacauagaaaguucgaggccagccugagcuaugugagacccugucucaaaacaaaagagaaagaaaagagauauuaaggcugggauaguagcuuagagguagaaucuuugccuagccucgaauucuuuacugccgaaaacucuucuuuacggagaagaaccugagacuggcauagccauucuggcugaaaagacaacaaaucagagagaauagauucaugggaauggugugccuaaagucaguccugagauguguuaugugagucccagugaucuccucuauccaguuuagcugacuuucccaugcuuggugcggcucuggggccucccugggacuauccguucaucacauaagcaaaaggcuggugguaucuaucugcucugucuauucuuguucuuuaauuugacacuagcacuucaaucaacacaaaauuuguccauagugaaucaguauggaacuuaacgaaaguuuguuuguuuguuuguuuuguuauguuuuuuuuggaugguuuagaucccuucuugcccggugucccuucguuuaugugccucacuucccuuguccccccaaacuagaagauuaaaacaaaaaccaacuccccagcuuuggcuaggcagagaaauaccauuugacccagaggcagcucugggacuguugccauguauggaggaaccugcucaauccucaggaaaaaaaaaaaaaaaguccugacgcaaaccagauguaaccuccugucugccugccaacaucuggaaugcuggcagggccucugcacuugggcccgcauugagcugccaagucugaggauuucagagguggcucugaugugcuuucgagaagccucccagccucuuucuccagcucagcccugcguucuggcccuggcaagcaagagugagcagcaggucacacugcagggccuucuggauggggcagcucacauagagccugcaagggggggggggagggcuaugcagacggggucugcccuccuaauuugcauuuccagauagcccauugccugcuucugguugacuuccauggacacugaaugggggcucaaguuuaagguugugagacguaaagguagaggcuggagaaaugugugugguuguuuucuuuguucuggggcuacacagggucuuucuuggucucucugucucucucucucucaugcagacacacacacucacagaugcagacagugggagaaccuuuggggccagacuccuugcucauggaaaauaugauuuuagcccuagggauccccggcaggcucagccagaugcugaaaaagcagagaaggagacaggaagagugagcagauggagagggagauggugggaggaguugaacagagagggagaagauccaguagugccccccuuccauugccugccucagaccucccugcagggcccaagggacgcccccccccugccaucugggcaguuacagcuggugauucaucauggugaccuggguggggagaggaacaaaccaaggacuucaagaggaauaugcucccaaagagauccagaggagugggguggagguggggggugcuccuauuccuuacuucucgcccugagacucagcgagacucagccaugccguggagacucccugcggaggaggaaccugggggcucugugcuggaggaggauaaaccucuguucugaugcugaccucugccuuucuuggauggcccuacagacaaggaugagagcgaacaucccaacaacagcuucaaccccugcagugcccaugaucacaggugccugcagaagcauauggccaaaauuagagaucggagcaagaugaagaucguggggacaccucgggaggaaccccguccuguggugagcaccucugacccacagaugugcaugcuuauagauaugucacaaugacuagaccugggcuauguucaccuagcaaacacugacgcucccuguguguaacaggaccucaucgguacccuggaaggaguccucauuucucucugugauuccuuuuguguucugcacaugaguauuggcacagcaaguagacugauaaagcagggcccaagcucccuaguguuucuugguccuuuuuguuugguuaguugguuugguuuuucaagaccaguuucucuguguagcccuggcuguccuggaacucgcucuguagaccaggcuggccaugaauucagagaccggauugccucugccuucucuaguacugggauuaaaggcacacaucaccccagccuguuuuuuguuuuguuuaaugguuauuuauuguaagacaggguuucccuuugcagcccaggcuggccuagaacuuccuaaauauaccaagcuagccuugaacuuggaacaguucuccugcuucugcuuccagagggcaggcguugcagacgugugcccccaccuccugccucuuugggacugccgagugucaaaaccuccuccuggauguccacuguuggugccugagucugaguuucugguuucacuucuugagccccuguccagcacccaggccuugaucuuccugccuuucucaugugcugagcagugugcacuucuguccccagccccaggguuccugccagagcgagcugcaccgggcccuggagcggcuggccgccucacagagccguacccacgaagaccucuucaucauccccauuccaaacugugaccgcaacggcaacuuccaccccaaacaggugggucucccuuccugcugcucugcccuggccucagccuggggaacuccuagcucuccgaaggaugcucccaaagggaagcucuccaaaucugauccaaccauuugggucucgcuaagcucuguucuacucucagcauguucuguccaccucguuccuuuuggagaugagagacagacucagaaaggauccuggccagcccaugucgcagaguggcagagugaauucccagcagaacuugauuuccucccagggcccuuugcagcuucucaggauccccccauugaugguguagacccuguucccugugcuuccccucccccuuuccucaaaguagugcuccccaucucugaccaucuggguugagagaaucccaaguuaugagaugucaaggagaaaauagcccacccuuccgcaguugagcucagacuccccaagugcagucaagaaggaaguagaggcagguuugccggccugagacugucacguggaaagaggggucaggagagaaggcagcagguagcaugucccacucccucacugacugagaccauccagcaugcuggcugguguauacugcaggggcagccuguuccaucucaucucuggcccaucaggagggcggcagguccaggcagggagcuggcguuggaaugccuugugcugaauauggccuggggagccuuguccugcuucuccucuagguuaggggagcauagacaggaauguugcucuugagcuacggacacauccucguagugagcugccaccgaagcagcagaggccuugucaggaggaugacacaacuguccuaggucuggacagggcaagaugaagguguggaguugugugaagguguagaggaauggaggcuccuuagaaccagugccuggccuaucuucagccuucaucccaacacacauuucaugucucauuucuggauaccccucgcccuuaaugaaacaagcaaaacccaaagaccugacuguuggguuuguggaaaaaugaggagaaggcgcaggauaauuaugucccccgccugugucgcaguuuauuucaugacucacgccuuacuggauguauuggaugcacuugauuauugauuaaaguucaacauuuauaccaggauucauuuuuccuguuauaucauguuacauguauuuuuuuuaccccuaauuuuuuuuuaagauuuauuuauuauuauauguaaguacacuguagcugucuucagacacaccagaagagggagucagaucucguuacggaugguugugagccaccaugugguugcugggauuugaacucaggaccuccggaagagcagucaguguucuuaaccgcugagccaucucuccagccccuaccccuaauuuuuauugcaacaaaaacuaugacaccugcugggcugacguggugguggcacacgccuuuagucccagcgccugggaggcagaggcaggugaaucucugugaguucgaggccagccuggucuacaaaacaaguccaggauagccagggcuauacagagaaaccuugccuggaaaaaucaaaaacaaaaccagagucuaugacccuugacccuuucucucaaaacaaauucugcugucuugagccaaccuucauucugacuuugagucuggcuuagaacuagacuuuugugcucugcccacgcccacccucagucuaauucugaccucaauucuucugaccuugacuucugucuuuauucugacuuaagcuugcaacaauccuccugccucugcuuccugaguaucaggguucuaggcauugugccaccacaucuaauccaacugcuucugacuugggcucucaaugucaccuggcuuguguuuuaaccauaucccuaaccuaucuucaucugugguccugaugcugccucugcugucaacuguaaucccaugcuucaagucccagcccagccacaacaagcugaaacaucuccagugaacccagaccuuacaucuaucaguuuaagccuucucagauccugccucuggaagcucuguagaucucuuccuugaacgagucucccuacuccagugagcuccaggaacuggugcucaaaaagagcucuugccuucagcuaucaucuugaaggaacaacugucugaccuggggccuaggcuggaggugguguggacuaccuggucucuuugucugccugggaccugaccucauacccuugucuuggcagugucaccccgcccuggacggacagcguggcaagugcugguguguggaucggaagacaggggugaagcuuccuggggguuuggaacccaagggggagcuggacugccaccagcuggcugacagcuuccaagagugagaccugccagcaggugggggacucagugcccccuacuaggccccuaugcucugggguuguagaguugaccuggcuuggagucugaguccuggcugucugccucuggcccugcccaaaauuucccuuugugugugugugcacacgcgugcacaugcucguguguguguguuuauaggaugugcccuacaggauaagccugagccuucucgugcccaugaugggcuuagauacccccaagaggucugaguguagcaauaggaauucccagugugcuuucaaaucacuauggaauucauucauucauucauucauucauccaccugaaaacacguauugaaaacauacuaugugccagcuuuaguuuucagcgccgggaagccucguugugauuuccuccgauuguagaaugugacgagguguucucaacucaaggcccacgggagaagagaaaccucauucuuggagugagagagaaagaaaguggugaacauugaacgcccucccucuccaucuuggccagagcguaggaagguguagaguagaggcucacggcuccugagacccaccucugcucugugcugcugcguagagcucucuccuuggggccuccagggcacaagcuugagggacagggcccaucuuuggucaggguauucggucauccgacaaugccuugcagguagaucucugcugugggaaaggaauggggugaggaaggccggaaggacagggggcagggaggugggcucaucacucugagccugcaggagagaggaaagaaugugagauuggauugugugugucugaggaauggccccauucuggucccuauuugugguuauuggucaugaagucaccaggaugacucuaucuuucuaguugcccaccaccuguggcuuugccuccguccccauauuucccuacccuuauaccuccuaucccgccaucucuaccccccugggcauuuucuggcuugccuggauagauuuagagaccugcuuguuggcuauaaugucuuuucauucuuucuucuuccuuuuuuaaaaaaaucagaacaaaaccaaaaaguguccagaucauuguguuuguuugauuuauuuacgguuagagauggggaugaaucagggguggagggaggugagacauuucugcuuggugagggacugcugcaaaccaaaagcccucucccugagugcucucugaggaccccacccccuaccccagccugcagucccauugccccaguggagugggguccugugguuuuggaggccaaggaagccucgugcggcagcggcauuggcuucugaaucggggacacagcagagcuggggcacagccuagaguuugcacaggaugaguucagagaucaguuugguuuauucggauggggauggagaggauacucugcacuugggggacuggacaguggugguaagcgcagcaagccccacagcgccaguguuucuguucuugacugggggaugggcgugcaccaacgcugaauucugagagccugguuggaugagaaccuuugacuuuaagcucucagugucagccugcacuuugggacuuguuggauucauagacacguuuccauggcuucugcuuccacacgggugggcgugugugcaugugucaccuggugcucacuggugcucucucccucuccucucccucuccuuccugucucuucucuucucuucucuucucuucucuucucuucucuucucuucucuucucuucucuucucuucucuucucuucucuucucuucucuuccucccucccucccucccucucucucucucucucucucucucucccucucucucucugguguaguuugcgugcaugcgugcgugcgugugcgugugcgugugcgugugugugugugugugugugugugugugcugauaauaucagaugaaagucucucccuggaggucaaaaguggccuagagacucuguauugagucucuugccccuugaggaauaguggcuugucccuguccuuguccuccaguccccucccugauccagagacucacaggcuccugacuucacuagcuuccaacuuccuuacuuaccuggacuuucuacagaggccucuagcuuggcuuuugccugcagcaggagagaauaagguuaagaauggucccuucagccccuggccggcuccuuuuggggcccaggccaaggcauguugagguaguggggugguguagccucaagauuaacuuucggguuucuuggccaagggcauauuucuuucccuaaggcacaccuucgaaccccugcuucuuuagccccucuggagaaaaaaaaaaaagcagagccaagcuuauuaacacauacagaggcucaugucuguauguacucugugugugugugugugugugugugugugugauuguggcuuagugauuccugaacuguggaguauaugcuuuuuguuuuuuggguuuuuuugggggggguuguuuuuuguuuuguuguuuuuuuaauuuuuaaaaaaauauuuauuauauguaaguacacuguagcugucuucagacacuccagaagagggcgccagaucuuguuacggaugguugugugccaccaugugguugcugggauuugaacucaggaccucuggaagagcagucagugcucuuaaccgcugagccaucucuccagccccuguuuuuuguuuuuugagacaagguuucucuguguaacccuggcuggccuggaacucacucuguagaccaggcuggcuucaaacucugaaagccucccgagugcugggauuaaagaugugcaccacca

SEQ ID NO: 6365 - RNA, 22446 nt, Mus musculus
caguccuauugauacugacaguucaugaggcaagguuccuaaaagugacaucuuaugaccauggaucauuccaugaugucccuguaucauagugaccaaauuaugucuacauauuaucuuccacagugcaauaaaaacacugagaccuuugucuuaauuucuuuauuauguuuggaccuuuaagaaacauauaccaucauauauaccacuauucaguaaaaaucuauucuagauuuuagggagcacacacuacaaacuaucuuguuucuagucucuaagaccacuacagggguuaucaaaaaaguagguucggcucugaucuaugggaucucgagucuugagguuuucaucacugugaaguaugcucacauggaugaacagcauucccauuuuccuuuuggaaugggccaaucacuuugaagucuguaguccauuauaagaacauuccauuccuuaagcucugccaucuaucgugucuuuggaaagccaaucugguaaaaaaaaguguuucuuuccccuguacaaaaaggaugaauuucccagaacacaucccagaucgacuacacugaacagcacucuagauaagcaggcgcagcucucaccaacaaggaauccacagaaagaacaacuguacucccccugcucccccacccccagugcccccagaggcaucucugugaucugugucucaccaguuucuggcuacacccuacccuguaagagaacuccuggugucugacaugggacauagaaagggugagugaagagacccccucaugauuucaagagggcacucuguguaaguacacaagacagggacugggaaagcuguggaugggcuggaaggguuuaaagcuauggcuuuggugagcaccacgugagcugaaggcagguauuuggaagagucgauucugcagcagccaagguaguucucagagaaugaugggugucuugauuaaucucagcucugagguuucagacguugagagcuaagaaaggugagcggcuggcauuaggcuaugaugcugaggguucaaagaccuucauguuguaucaacggaaaaguaaauaauuaauacacagaccacauaacaccauuaaaaccaaaaaaaaaaccacauuuuuuuuucauuuaaaaaaguuuuaggucacauaaaacaaggcaacauuuacuccuucuucucgucuucuggcacugggucugugggcggcuccuccacuguggcgcuguugcucucugagcccguguuacugucacuggucccuuccaccuccaugcugucaacccccuccugcccacucuccuuguccucaggaguagacgugccuucuucaccauucugcuggcucucugcugugucuucaaggugugucuccucugaaaccauacauuuaccaccaucaguuccaagaaaaacauucacucuuaacuauucugauggcauuggacagccacacguggagaagcccugagaugaccuaauaugauucaggaguauuuaccaauauuugagacagcucaggguacaaaaaucuacauuuuuaccuacaguauuacaaaauuuaaauacauaccaaacacauucguggugagaauugagauuuugaaauuaggaaguauaugaaaggggcuggagagguggaucagugguuaagagcacuggcuacucuucaauuggauccagguucaguuuccagcacccacaagaucuaaauaacuuuaaaagucccacagucuuuacauauucuuaaaauuucaaucucuuuaaaauacccaucucuuuuaaaauccaaagucuuuuuacaauuaaaacucucuuaacuaugggcuccacuaaaacaguuucuuccuucaagagggaaaauaucagggcacagucaaucagcagcucacaacugucuguaacuccuguuccaggagauccagaccaacacuuacacagagauacaugcagucaaaucaccaauguacaucaaauaaaaauaaauuauuuuuaaaaaguauauaaaauacacacuggauuucaaagcuuugcuacgacaacagaauguaagacagucacagccuugcguguguccgugagucagaggagacaaguucugcuccucagucacugugcacguuuuugagacaggcucucccacugaccuggaagugaccaggcaggcuaggcuggcaggccaacgagccuugggagcugcccaucucuaucuccccaguccuggaucaugagcaugcgcuaccaugcuuuuuacauaggagcucagguccaaucuacucagcuuucucucuagccuagaauguuaauaaguuuaaaaauauugauagauaacacugaaauauuuucuggagacuugguuuaaacgucacauuaaaaggaagccagaagggcuggugagauggcucaguggguaagagcacccgacugcucuucugaagguccagaguucgaaucccagcaaccacaugguggcucacaaccauccguaacaagaucugacucccucuucuggugugucugaauacagcuacaguguacuuacauauaauaauaaaauaaaaaaaaaaaaaaaaaaaaaaaaaaaggaagccagaagcgagaggcagcagcagcagaagcuucagcuacucggaggcugaggcuaagauugcccucaggagucugagggcagccuggacaacgcaguacagcaagacccugccugaagcacacaaaauaaaggcacagaaagaagcugagccacuuucuuaggaagcugaauacaagguucugacaucuccaauuuuuuccuucgguuccuccuccucuuucuuuuccuuaagcuagaagacggacaucggaguaauaaacacccuaaacauccagaugcugucagaauagacagaccucauucggggcagaacagacucaagacugagaauauggccuggcugcaaggugagcaaggaaccacacucugauuugcaagcgucugcgguagccacaaaaaugugcuucagccccaaauuuaugguugggaaaaaaaaaaaaaaaaaccccaaaacccccccaaaaacaaaaccagguucacaaaaccagaaaggagcccagacaaugcugauuaaaaccagacugucugaaaagauaaccugcugaguuaaacaaauaguguauaaaugcaugguagagauucucaaguuucauuaaacauugccaggaguugcuguuugaguacagagagaguaugcccgugucccuuuuaccagcaauugcuaguguccccuaacuaccuuugaccugcucauguuuauccauuaucagggucaauagugccaacaggcaaggugaucucaaaaacgccaagguuaaccaaagucaucaguauuugaucuaaguuuuaccuuucuuuucuuaaaaacaaaaaccaacccugaaccaugaggaaugccuuuauucaggaaaaccaaaccauuguucuagggcgagguuggucggcuaccaacauguaaagcuuagacagucaucacuguaggcuuugugggccaggaagucugucucaagucccaaaccauacacacacagguacagauauguauuaugcauacauguacacauguacauauacacauacgucuaugugcauguauacguguauauauucauguacacacacacacugcugucuccucaaagcugucacauacaguguggcagucaaacuuuacuuacagaauuauggaguaagacuuggcuuacugcuuuacuuugcccaaugccaucuuaggacaaagacgacauaucuugggaacaauguuauauuuuauguaaguaguagccguaaagguuaaaauauuauugccuauuauccuaugucaaauccgcagcagagugcacucauggaggcagguguuguucaaaugaggagaugagacagaaggcucaguaacgucacugucagcaacgggcacacaggcaggacccuccacgucugucucucuaucugcagagccacacccacccaccuggguacgacaggagcucagacaacaagacugacaccacugggcugcacuguggagccagcaacagcagcagugaaucuacuauggagaaagaauaagacuggagugucgcagggaaugacugaagggugcagacuguugaaaggcauccaggcaggacagccagaaggcagcugucagggcccucaccccuccuggguguggaggaggcgguuaccugucuccaucgggaugcucuccucaucuuucuucuccucggcuuuguucgccacuugcucuuccucaggggccaugcugcucugacugcgcucagccugcucugcugccuccuucucccucuccucuugccucuugcgggcuuguuccuccgccugugcgaucucagccgcaaucuucuccaugucuacuuccaccuucagaccacauaacugguugugaagaacacaucagugagcucagcauguuuucuuccgagaaacucagaauuaaguaaguugucuccuggcuuauguaauaguauuuacauagggaaaaggaaagcaauggcuuguccugaagcgacgggacaaaagagcugaucuagccaccaucaggcaugcaggggcaggggcugcugggccuucuaggacucggcuagccucaggaccuccacucacaccucaguuagcaaacuugggauuuacuuauuuauucagucauugaauuuuuuggcuuguuuugcuuucuugagauauauucucucuauguagucuuggaacucacuauauagaccaggcugaccuugaaguugaauccugcuuccucugcuugggauuaaaggugugugccaccaugcccagcgagacuuacucaaaaugcaacugaacuacaucuaaugaagacaucuaugaauaaauuacaaaaaagugaaaauaaauuacaacuacaaagauuuuaacaaagcacuggaggguucuauuaccugagggccuagucuuuauauguauacaugacacugcuaauuuauuauaaagauaguagaguuugugcugugauguuaguauuguuucaaagugaccaacacucaauagaaacauuaagaaaaauagcaacuggcgcaugauaaagguagucagugaauggaacggauacccuuuuaaguucauuguuaaaggaguccgugcuuuccaggaauuuccucuucuuuuccuggugucguuccucuaucugaaggagcucggcuucuaguuuccgcuguaaggugucagaccagauauguaucguuaugaguuuucucuaaggcagauguaaagugcagagagcaugccauuuaaagauauuacuuucaaguguaauuugacauuuccaucguguguacgugcguguggguacgcacaccagcgcaggagcccauggagcccaggagagggcaccgaauggccuggaucacagauggcugugaaucaccuuacaugggugcugggaacugaacucaggaccugggcaagagcagaacaugcucuuaaccacugagccgucucuccagcccacuaauuuugcauuacaaaaugaaaucuagcuauaauuuuaaaagucuagcauagaggcaugcugggauugauaagauguuaaugaauaaaucuggggggcauugaauaguaauguagcaaaggcugaugggaucccuaaauccuccaguuugcauccaucucuuaauagauauacaugccaccacaauguucuauuacaguuuuuaaugacaaaguuguuaagcuuccugaaugguccccuccuuucagccucagguggcucuacuucacaggucuacuuaugacuauagcagagucacacagcugcaguuagcucugaggcuauuuguaauuugaugcuaauucaggucuccugugaggggcugcacuuaggugauuuccugcaaaccuucuucccaccuuaauuggcaaaauaaaggcuagagcuggugauugggcaaaaaaagggaagguggagcugaaaguugagaggaggaggaggaggugugggagagaggagguagggaagaugggaguguagcgguagaucugcccaaucuaggggcacagcuuguauuccuauuaaucgaguuguguuuucauugcuggggcauauuaggguuggagaauuaccgcaacaucacacuaucugggaugugugacacagacuccuucuaguauaaugaauguuuucugaacuuaccugaugaaccauuaaagacuggaccugucgcuugaggaccugcauucuagcuguugugacaaccgaccgcacaucagguaccacacucucacugaggaucucacugaugagacggugguuucucuggaaacgggcaguggcugugugcuucauugaaaagccaucaucauagucuagaaugaaugaaauguccuggaaauuagugaccacuuaucacaacacaaugugaacaagcagucacucaguaagugugguccucaguguccuagcaggugggccugccuaacaucagaggcaucugggcaggcuaugguaagaaccacagagacagaagauacaacccacccaaguguuguucucauaaacccacuaaggcagugguucucaaccugugggucucgaacccuuugaggaauuaaacaacccuuucauagggaguacagguugcauacuggauaucugacuuauuagauauuuacauuaugauuaucaacagcagcaaaauuauaguuauaaaguagguacaaaaguaguuuuaugguuaggggucaccacaccauaaggaacuguauuaaaggcuugcagcacuagaagguugagaagcuauagugaugugugcugggcagugguggcgcacaccuuuaaucccagcacuagggaggcagaggcaggcggauuucugaguucaaggccagccuggucuauacaguuaguuccaggacagccagggcuacacagagaaacccugucuugaaaaagaaaaagaaaaagagaaagagaaaaagaaaaaaagaaaaagaaaaaaagugauguggugauguguaucugauauuugguuaaaauaccaacaacaaaugcucacaucucuuuuaguccuaggauccauguaacaccuacaugugauggcagaacuugaaauccugcccaauguuccauucuccuaguaauuaucaaaggcauuugauagaugcuacacuauaacugggaaguaguuuuaucaugguuguuaaaauuaaugaaaauauccauuuguaaaaauuaacuuaucaccaucuucucuaguaauauuuaguguuuucagguaguuuuuguuuuaucacauuaaaaaauaguaaagacccaaacuaaucuuguagaaaacacaacuugauuuaaaggcugggagaugaagcauuugcugggcaagcaugaggaucuaaauuuggauccuaggcagcauccaaguaaaagauggguguggcagaucuggagacucauuggucauucuagcuaaaauagcaagcucuaguuucacugagagagacucugucuaaaaauagugcagagaagcaauucaggaaccaucugguugucacucuaccuuccacauguaccuggagagggaagcauagugcauacaccgacccaaccuuaucacaagagaugaggaaggcacccaacaccaacacacacacgcacacacacgcacgcacacacacgcacgcacucacacuacucacagauacuugauucuaaacuuauuuuuaauuuugccaguugauacuuguacauggcuuguaaaggugccaucuaaacuuagguacauauagcacacauuuggcuuauauguuuaugugugggaguuguuauuuuuuugguguaaugcaugcaugugguuuacaggugugcacacacauguacauacauguggaggccagaagagguaacacgugucuucucuaucucuuuuugcuuuaucccuuuaagucaacaccucucacugaacuggaagcuuaccauuuuggcuagguuagcugcccacggaagugccagaaucugccuguuucagcucccagugcugguguuacggggaugugccaagccacgcaauuuacauggguccuggagaugugaaccgaaguacuugugcucacaccgcagggggugugaucuuuuugagacaaaauuucacuauguagcccagucuggcuuugaacucaaagcagccuuacuuccugcccuagucucuugagagucauuuaaaaagcccucucuaucugugugaaucuugugcugggaugcugagugugugccaccccacccagcauggaugcucguuuccaguaaccccagaguauuuccuuuauccugcuguccccuccauaugcaugguagcaaccugaaucaguauuugcugaauagucuuuuuacacuaacucauuaaacaaagcaaguguuuuccuccaauauaaaucaaaacaaagcuugucucugaaccaccuaaucccccuuuaaaaaaugauuuaugcacaaaugcucuuaucugcauguacaccugcaugccggaagagggcaucagaucucauuauggaugguugugaggcaccaugugguuucugagaauugaauucaggaccucugaaagaccaguugguguucuuaacugcugagccaucucuccauccagaccuaauccuucucgcacuucagacagaugcagggaccgugcuuuaggaaagaaacccugcuacauacagaggcuugcuugcugcugaagaaucauuuagaaagcccugacuauggaggugugagucaagguuagucuuguggaccuucugacacuccucuaagaagccaguggaugcugcccucacagacaaggccagacaaggcuucugugucuugguuuucugcacguuuccgucucucauguccuccuagaacugugguguaugacccagguguaugucgaacaacccuuccacagggcugcacaccagauagccuuuugauuuggaaagcauuggaaugcuuuaaguggggcuuaaugagccauccuaguaggaauauggaagacuguugcugagagugaucugaacuaugcggaccuggcccaagggguucaguggagaagaauuucaguauguggccuagagacuguuuuugugguauuuugguaaagaauguggcugcuuuuuugcccuugccugaagagucuaccugaggcuaagguaaagagaacuuauauuaacugcacugacaaaggaagucucaaaaagcccaguagagacuuuguucccugguuaagucucaugaagagcauuuugaauaagggcagcaagcuuagaaaggaaaaacaugaggagggucugggggacuuuugggauagcauuugaaauguaaaugaagaaaauaccuaaaaaaaaaaaaaaagaaaggaaaaacauaaaauauaugguucagguauuaaagggacaccaggaagucaaauggagcugaauuguauguucuaggaaauaagacauuaagggauuuggggguaaaaucccauccagcuaaauuuagauccaagcauguugguacacaccuuuaaucccagcaucacaggagacagagccauggggaucucugccuucaaggucaaucuacagagcaagccaguaagcagcacucauuccucuguggccucugcaucagcucccgccuccaagucccuguccugugugaguuccuguccugacuuccuuuggugaggaacagcaauguggaagcugaauaaacccuuuccucuccagcuugcuuguuuugugcaggaauagaaacccugauuaagacagggugugucaccugggugugguggcgcacgccuuuaaucccagcacucaggaggcagaggcaggcggauuucugaguucgaggacagccuggucuacaaagugaguuccaggacagccagggcuacacagagaaacccugucucgaaaaaccaaagauagggugugucagcaaaaauuuaucccagaauuuggaagcugggacuggagaaucagguaagucugggcaacacagugaggcccugucucgaaaaucaaacaaauccucuauucugaguauaaagacuuugauaaguaauaaauacagcuuuuuuucuuugauaauuuuccacccuguaaggaguauuuuuuccaugagaaagucacacgcaaaaaucuuacuacuuaaaaucuuacuacaacaaaaagacuuaaaauuaugcuuuuccauuuaaaagaauaaaaaugccuugaacuaaauuucuuuucuaauucagagagaauacauauacaaagccccguuuuccaccuuaccgucuggauccucagcaggcugaaugcucauguaagguucuccuuucuccaugcgagacugucucugucgacuuucuuccucuaaugcagcuuccgcacgacuuuuugcauuaauauaggcaagguacgcaggggaauuaugguaggccuucauagacucauuguacucuaucugaaagucaaaggggcugguuuuauaauguccauucuacuccacaggccaccugcacugucccucugaacaucagagggagagguaaaacaggaugucgggacagaacaaagaaugugccacucagaugagugaagcuugguggacaaaacugcaguguggcucagccaucuggucacgcuugguuucuuuuauaaauaauaagccaaggcaguccuccuaccuuuucugcuucguauucguuuaaauauucuugcuucucuucaucagugagaucucgccacaugccaccaauaaucuugccaaucucccacaacuuuaggucaggguuggaagccuuuacuuggucccagaccuuaaaaagucaauaguugaaaauucaauauuagugccuaaguauauagucauuuaaaaacacucuaauauggaaacguuuaaauacaagaaaaagcaaagaagacaguaucaaacuccuuuguagcaaucagccuguuucaaaacugccaacagcuggcuuaccccaugcccuccuuaucccacuggaucuuacucaccacugucaguugcucauaaauauuugaaacugauuaagcuaagggcaccacuaaucacugcucacacucguagagaauuaaaugaacucuaagucucuaacuguucaagucaauucaagguaguuaauuugucauacuaccaaacacauauguauuaacuaugaucaauauuuuuacuguacuuaugaauucacuugguacucuuggaauugaaccuaagcgcuuacuguagucaggcaaguguucuaccacugaacuacucccagacuuauuauuauuauuguuauuauuuuuugguuuuuucgagacaggguuucucuguguaacccuggcuguccugggacucacucuguagaggccucaaacucagaaaucugccugccucugccucccaagugcugggauuaaaggcgugcgccacuguaagauauuaauauauacagucuuauacucuacuuucuauuuaacauucuucucauguuuuccaauauucucaaaaagauaucacuuucauggcugcagacuaaucuguuuaaaaagauuuuagcaguuaauuuaaccaugcuccugaguucuggauuucugaaugagaaugaacuacuuaaaaaaguacaaguuuuaaaauucuucccucaaauauguauaaagaagacggcaagccagccugaaauugcacguaaggccauaggcggagcucuccggcacccaccuuucugcuguaccucauguagggcaucagcggcuuaucugguggcuuuggaggcuuuggaaucguaaugccagaggacgccuguaaaagagugaaauauacucauuauucaacugcaaggagcucacugccaccugaaaagaaagucccuuaaaaauucuaaugcgccuuucuucuacucguccauggauacaagauccuuauauuuccuccaaagaaaauagacaucacugcaaauucagaaauguuuuuaucagaagaaaaugacuuuaaacacaugauauuuaacguuuuacuuagcaguuaauugccacuguuuugacaagcugccugcaagaauaaaauauuauauaauaauccauacacugaaaauagaaguuauaugccaaacaccucacguuuagcacauuaccugguauccuuuuauucugcucaguaccauuacacuuacagucaacacugguuuaucuguagacucugagcucuuagcacuuaccauacacacacugucuacaggggaucuuguuaacaugucaggaaugcacucucauacauacaacauaaagaccaucucccagguuaaaaacaucaccaauaagaaacaggcgcuaacaagaaaucuagcaaauaaaaaaauuuaaaaaaaaaagaggaaaagaaaaaaauuuccuuuagaaauagagauuuaugucuguuaaacuuuuagucucauaguuuucuauuucugcagucuuggggcauauuuuucuuacaggggacaagcugugugaacucaaguuauacuucucuugucuucaugccuauggccgcagaaacacagagccaccuuaagcccugagcacgggacucccggccuugcuaucuuacuuaugaggcccaguccucaaugcugcuucuguggaaaagucacaaggacaaggaaaggcaggccacauggaaaaagaaaauacaagcaaaggggcuaaaauguuuucagaaugguaguggggaaguuggugagagaguuacgugcuagcuccugccugugaggaaacaggccaggagacaucagggacuucagcagaagucccauuuaaagcugcuacuccaagggcaacugguucucaacuuuucuaucuccuuguuuuaucagugcuuugauggaggagccaaaauaagaaguaauguguacuauccgacuugacaucacuaggggagugaguccugguccugacccucuugcaagaaugggaaagaggagugcuuuacucuaauuagcaaaaugcacaugggcagauccuugcugcucugacucacagacagaucuggucuuagccagcagugggcaguggaauggaaugagaccuggaggcagaaacugucacaguggcuagagcagccaccagggaagcaggcaccacaguuggcaggacucagagucaucaguaacuuuacaccauggaagccugcuucucaacccaggaagugacuagaaaacauuuucaauccagacuccacacgaacuuuuggaacacaaaguggguuccaaaaaagaagaagagaaaaaaaaaaaaaaagaaaagaaaaaaguugugccaauauuugaaggugccaaaauauuguuaacaguuaaaaauuuuaacauguguacuuuuaaaguuuuaaguauaaauuaaaacauuuaaaaaacaaaguuaguaauauuugcucauauauuccaaagacuauuuuagaacauuaauagauuugcuaauucaccccccuucccaaagaaauguacucaaauaauacugaauucauauuauuauugcacuaucaguuuacaaauaaaaaacaaaacaacacaaaacaaugcucucccauucccuaagaauaaguuccaguugguuugaagaucuuuaucaccacacaugaccaauuuacuuaacaucucugccaucuuucuaacggccucaaaaacauuugucugcucucacugagcaccuucaauccuuucuugguaagacucaacuagaaacagcugcuguugugugugcugugcucccgaguggccccggaaggagauuuuuggagagaccagcuucgcucugucuaugaggagcguuccuuacugcuaugaggacacccacccucagcgccgcuucuccaucuauccaaauucugucuucccaguccuaugaacugggcgagaggaagcaaauacuuaugcuugauaaaacuguccuuaucuaaaaguuagguccuaggcaaucuggauaaaguccacaaucuugugauugauucaucuuggacagugcaaaaaaauguuuuucuuucucaauucuuagcuguuucucugguaaggucuuauuuaugaauuuucuuugggagagaggaguucuauuagcaaggaguaaaggcugcuuuucacauuuugccucaaucuguuuacaagccuguguaucagagaacacgaaccaucaccugaacagagugaucaggcuugggcuacacucaaagcuguccuaaguccuccaaagguguuaaucugguaccuaagugcuuauuuucugaaaacuacccacauggaacaaagcucuugcuuaggguugcacagaaucauuccccaagucacuguggccauuuauagacaacaguuuacucaggaggaacauuccccaugagugcgccauuggggucauucucuacaaacaccuuuuauaagcgagugagucccaaaacaguaaggauaaaagagaaugcaaaccccugggccucuagcaguuugagcagccuucagucuggugauaacaggacaaaaggacaagaauacaaggaaacaacuacaaagaacggaaacaccaaacuucuuagccuaaccucuccccgauaucgaagcuagagcucaauuuucugaguucuuccauccccaggaaggaaagggaugaaaacagaugaccaaccuaggcccagacaaggagucuuucuccuuuuuucuaguuuccacuguauuaucuaacuuuaugucaacagagaagucucacagcuacauacaaacuaagagcuggcuguuuauacaaacgccaaacuaaguuacuguaggaucacauggauacuccugucccacuaacauggccaccaagagcuuuaaccguauagagcuagccuuucagaaccaucuucuuacucacuauccauaaauacauuucugcauuaacacaaaagaucucaaacuaacugugcuuacuguaugaacuauaaugcucuuuaucaucugauaaccuugccucucauuccaucugggaaacaauacauuuagaccagggaaaaacauguauugcugcacacagugugugcagcgcacaaugcacgcauaaaaaaauuuuuugucagaacccuuuucaaauacugugaaauacguauggcacauagaacuugauaugcuuaugaaguacaaauuaugcaaaaacaaugaaaaaauuagacaaacaaaaccuauccagcuaagcaauaugcuuaccaggacagacauacaauuugagagugacgaguuuucagcucuagcuucacuccagggugagagggcuuuuuuuaugaauacagaaaaugacaaccauacuaaaaaaaguacuaaaaaguuuacagccaucuguguuguauauauucucaccaauaccacauucuaauggagguauuugacuuuuggauuuauuaccuuaauuuccuuugaguuuaagauaauuuuaaaauaaaagcuuugaaguacaauauccaauuuugauuaucuuaguugaaucacugaaaugaaauuccccaaguuuuaagaaucaucugucuacaauggauuggaaagcuauacuuaacaccuggaauuaauucuauucaagguuuauuccaaaauuccuugaggugacaguaaaaucuuuuucuguauuaaacuggaaagaaaugagucucagauaugucacuuacuaaauccaaaagacaaaccacuaagaguagaagguugacaggcaggucugccaaagcuuucaguccagacaaagccaggccuucaaagucccagcauuccuuaagaaacuauguccuugagaauaacgccaauuaccuucaacaaugaaagauacucuucaugccauaaaguauuuuaccaaaagaauucuacauuuguuuacauauauaguaugagcauuaaggguccaaggcuuuaucccuacugaucaccaaguagaaugggauuucuuuucuuccagguacauauccagacugcacuuuuuuuuucaguguaagacuguacaaaauaguugaaaagucagguuaaauuuuuuaaauggcugugcuucugauucaaaaggaccuagcucuggaggcauuucuggucaauuccaguuguuugccggaggcuguaauaguugauucuccuaccgugacccggcuguuggugcccggguucccucccagccuguaguuguuguaggcgagaugacuguauggauuguaucccacaaacccuggugugcugggcauuugcugauggaaacaaaugagacaaaaacacgaaugagaaaugagcucaaacgagggaaacacagaaaugaaaaaugaucugcauauggcaugcaaaagcaaccugaguuuaaacaagcaaugaugguucuaacugguauuuguuacuguuucuuuuuuccacugugaacccagccugcaagucugcacgugcaugcguguaugcaugucucuucucuuuccugcuuuuccuugguggggguuagggaugcuugggagacugaguauguucuguuucguucugaggaaagcaucacacuaccguugcaaacaucuacaacuauuucauggucaacaguaugagauaauuuagcaaucugugauguuugagauaggaaagcuucaaguaugauaaacuuuaaagucugaaaacacuacaugcaaacaaaacaugauuuauuugacaguuauguggaugucaccagugcccucauuuacuaaaaacaaaacaaggaauggaucugcuuuuccaagacagcguuaaauaauuuucuaugugacaaaugagaagagacugaaaucaggaggccaggaacugucaauaggauagaacauaugcucgauucaauggaugucacaugcaugguuuuaaaacaaggacuuguaagaaaugcauagaucucauaauggugcuaucugaucucuaaccacgucauucuuucauagacuuucucuuccaucucuucuuugauccaucuuccauagguaaucaucaacaguuuaugaauuuaauuuuaauaguaacuacuuuuuuuacuugacagacuugaacuuucuuuuucaucugauuuccugaagucucucagccuuuccaaauacaacugcucacugcagcaacaaaacucuugauuuuugugaauuacauguugauauaaucaccaauggguucuuauguaauuguggccuuguggcuaauacaaugacauccaguguucauaaaaucaaggcaaaaugcauaaaaagaaugugguaaagaagagaccaaaaguguaguugacuuagugacacucagucauaacaagugauagcaaugccauuuuuacaugcaauuaacguaacucuccucaauucuacaaaaguacacgucacacauuccagcuaaacuuaguuguuucaaaauaaaugccauuccuaaagcaugcccuuguauauagccuuaguauccaaagacacucaagcaggcagcacguguggcacuuuuuagaggaagacaaagugauccauuauagcccauauaguuaggaaagacgcaaauuaagcauauuucaguagcaaaacacagaugaaaucguaaaggcacagaaagggcguguuccacggggaguggcucauuggagagguggcaguggaagggguggguggugauaauggugguaaaagcaaugacauuuaaaaaagagaaagauuaacucauuucauauccauuuugcuggguguuauaaucccuaguuucuagauuuuguguauaaaugugaaauuaugaugaggguuaaacaaggaucccuuucuuuguaugaaaacucagaaggggaucuugguuuuuaaaauauuuaguuaaaaaauaauagcaaguuuguucacuagacacuccuggagguaguauuuauauaaaaaugacaccuccgaacacugauuaaagaacaacauaagugaauaggggaauuuaaaaaaaaugaaacuaguauacugcaauuacaccauuucuaaaguugaggggccugcuucuguuuuugaggugagacuuuuaaucacucaacuaaaccagcacacaaccaugaguggaaugugauggagauggggguaagaaauguucuuuaagaaagaaaaaucaugaagcacacgacuuuacaguccacuggaagcgacccugcagacuguauauuacauggagugaacuuaagaauguaugguaggccuuuuaaaaggagcaucuaaggagaaacaaacuguugauaaauguaacuaaaacaaacaccuauggguuaguaaaucagacuaguuaguuaccuagcagagaaaacaaacaaaaaaggaaaagacacaggaacucauuaguaauaaaaguagacuagccugcagugaguugguagagggaauggaaggaagagcuagcagauauuaaagaauuaauuuggggcugggcaugcugauaaucccagcguuugggaggcugaggaagaaggaucaccauuuggaagccagccugggcuacauaaagacccugucucaaaacaaaacaaaacaaaucaaaauaauccugauucaaauuuuguaggacgugguuauguuaaguggucuuuuuguuguuguuuuaaaaugguaagaaagccauuucagcauuucagcaagggccuguacaguuugcuguuaaaguggacuugugauuggauaguuauuuuacaagcugcuuaagcugggaagagcuuguuggguaaaaacaguucacaaccauuggacaccuucaaaacagaucagccggcaagccaaaacagaaccaaauccaguagcaagagcugacccauggguaacgaaacccuggccugagcagcuuuaaaauaagacuuaugagcguaacuauccuuagaacaagaaacuuuauuuaaugugaaauuuuuauaugcugacaagaaaguuuaauuaaaaaagucguguugcugggguuccaaccuaggacacgcuaggugagugccuugccacugagcuacccagcccuuacggugagaggaaaauguaaccgguugaagguuaggcuuaaaaacaacaaaaaagaauaaaggaugccagaacgagcauuuacucaauaucaacggaaagacccuucaccagggaaaaacggcaagaacggaguguuucacugaugucccguuaggaaacaaagagcacaggaggcuggaagcucacaguauguauuuuuaaguguuggguuuggcucagguaggaugaaaggaguuauuuuauuugguaggaagugcuguuuuuuagcugaauugucuauccuguggcugugaugacugagugacugucaguggaagacaucuggguuuuuguaucaaggccagacuuggcuauuacauuaacaagaaaauuaaaacuuacuguugcaggagcuggggugggagguggggcauaagauggucuuucuguuugaaagaaaauaaauaacuucuuguaaacaacugagauauaauacuaugcaacaaaacuaccaaugguccugcuuugaagaaaaaaaaaaaugagaguauuuuggaauucccauuugcuagggcauuagucucguauuaacacagauugauaaauauaaaaauugaaacuuacuugacauuuuggaagauuaaguucucaguuccuuaagaaugaaucugagacacuaaaauaaaaaaaaagaaaaaaaagaaaaaaaaagagaaucaaaacucagcaagcauaagagaauguuuuccuaaagaauaggguaguuugguauuucugagcaaaauuacuucacuauuaauugcuaguaaucaagccuuuugcauauuuuuaacuaguucuuacauucauuugauugaucagaauuaaaugaugaaaauaaauuacugggaaauuuagaguuauauuagagauggauuuuuagguuuuugcuuaugauacugagagcagcgucuuguauggaaaacauuuugcugaugccaugcaaacgauuacuuagacugauaaaaaaaaauaaugacaauagaaugugauguauuauccgggugaccccaacaaggccuaccagauacugacaaccccugauuagaagcucugccuuauuuagggaacaucuuucauugaaacagagucaugucuuauuccuggaggcagugugaaagguaagucaguaugauaacaaacuuuacauucucuuuuguugguaaauaguuucauaagagccgggaacaauuuucugaggcuacuuacaggacacauguuguuccuuuacagcucauuucagaaauuaucucagguacuuucuugauacaucaucgggacagaauaaauuauaucucgucucuguauuccuacauggcuuacaaagaccagcggcacuuucccuccaacaacaugugaaugugcuagguuuugccuugcaagagaggagggauggucuaauuuauuacuguauuauucaaacauagcucaagucuucauaaauuugguccuaguauggccagcucgaaacauggacauaucugagcuuguuccuuacucaacauagaccacaaaugguaaugcauaagagaugaaaacuuauuuuuagaaggauggugaauacacuuuuuuuucuccuaguuuucauuuuaaggaagugccucaaaucaucaagguaagaguuucugauguggaaauagcuaaguuuuuucaauucaucucuuuuuuuccuuccaucaacacccaguaggccuugcuguggggagccccgacagaaacugugacagggucccugguaccuuacacuucacugcuaauacuuacaaaugauugcucucccgggcuaagcauauaaacucuaguagugaguggaucuaaccauugugccugggacgcaacucuguauuuauugaauuaauuaccuuacuggucaggcuuauaacacagucuuacucacuagucacaacgacccuacccgaugcguaugacuguccccauuuuacaaaggaagaaaacagucucggggcgauuaagugucuaaggccagagacccggaauugucagagauggguuuaaacccaacccacaccgucucagacuucacuccaggccaccccgggaauccuuaagucgcugccugaaccaaauaaaaaauaaaaauaaacaaagggggggggggacgaccaccuucguggugggugaggauccccgcuggccuugcccagaggguuuccggagauccuuucccuggaguuuuguggcgggcggagggcgagcuuuucuggaaacuccccugcaggggguugugcauuggugcucaccggcgucgggagucccgcggaaagggacuaccggcgccuccgaggagcuguuccggacgggguugccccgccgccgcuaggccucaccgaggccgcaccggcucuagcucccgccucgcagccgaggccgaaccccagcaccccgcgggagcucggggucccgccaagcagaaacaccaccgcucgccacccuuccccgaccggguugggcccacugggaaacacucacccgcgggccgagcaggcgcccgcagcuccggcuucgcuucccuuugucccgcgcucgccccgccccucgcgccggagcuuccgcgcucgcacuuuccacacgcucccgggaauugucugccggccgcggccggcucccggcagacgaacagcccuuccagugagcacgcggcgaggcuuagggcgccaaggauuuuuaaaaaaaauuucgucaggcuccuggguuuccucagaagucuuccaauuuggaucccgucccagucgggcgccgauucgucacggcgaggagggcggagaaggcugggccgcguugcgggcccugguucgcggcccggcggcaggaacugcgcagacugcgcgcccggggcuucacugaggcggugggcgccgccgcgugaggcgggcgccggaggggaaaggcucgccggagccucucccgggagagggugggacgcaguucccacacaccaugcacucuggcuuuucccuucgcucuggucuucaguccuccgcugauggacguaugaauggagaagauggagaauguaggcggggaggacccgggucgcugcguuuagguccuugcuggcgcccagcggggcuccccugccuccgccuaagcgaaaagcaacacgggaguuuuguaguuuucccagauguuucuagaggucgagugauggcggcggguuucugcgccuaggguccucagaugucagcucacuccuuccagcuggcauaccugugacaauucacaucccuucccaggagggccaguucagcucagccucgcuugucuuuaaacaguucaguguuucuuugugaugcccuccuggaacuuucccaagccgguccuguaucugauacccucuauaugggauugggccaucugcuaucuuggaaagucuugaaaacaaaguuuuaggcaucuggaccggacaauuucau

SEQ ID NO: 6366 - RNA, 1813 nt, Mus musculus
cgaccuucuguuucugccaaggaggcuuccagcgauuguuucugagaagaaggguuuauuaaggugaaacaugggauucaggaagaccucguagaaggaaaguaaauuaggauucgugcuaggcugcacugccaaaguuugagcaggacugccuccaugugagcaguucuuuuuuuuccccccacacgcccacaagcugcaauuucgauucuaauuucuugcccccaagucauuuuuagcaugaacaauugcaggauaaaauagaagccagguuauaagauuuaacguaccagggccagcugggacuguaguucaaucuccagacccugaacaguacgucucaauucagugauuucagacuuauggcuggacauuuguucaauguugcugucgauuucuguggugaguuccuugcucuagaggaucaaaaaaaaaaaaaaaaauagggaaaagaugagaccauuugggcaugcuaagaaaagcuccaugggcuucacuaagaagggugauuggcuaguuuaccuucugauugaaccacucuucagcauccuugcgauucuuuucugcaaguuguucguauugguuucucauguuguucagcagcugagucaggucaaccccuggggcagcguucauuuccacauucacaucaccaguggacacauuuugaaggucucucauuuccuguuugaggagcaguuagauuuaauuagugaguacaccacgacccagaugagcuuuuuuuuuuuucuuuaaaaggggggaauguaauuauguaaauuugugucaccucuucgugguucuucuuuagguaggccagcucuucguucagacuuucgaucugcauuuccaggucagacuugcuaagggucagcucauccaguacccugcgcaggccauugaugucggccuccacgcucuggcgcagggucaccucauucucguaucugaagcaagcaagauacaaacacugaauauacaggaggaugacgguauaccuggauauacacggacuacagugcagauacagauuugguuucaugucauggcaacauucauaauacacgaauucauguaggaauauuaauuaauauaguuugauuugaagaaagcugucacuuuaaaacacacccuccuuuaacgauugcccaaaagauaugacaauuaaauuaaaaaaaaaaaacaaacagcuuagcacuguuucacuccagaugaguucaggagaguguaaaagcuguugugggcauccaggagcauuguuggaagccccugcugugugugcaccacauccacauagcuuacuucagccugaagucaucagcugccaggcgggcauugucaaucugcagcagcacguuggcauugucaguugucagggugaggaucugaggggagagacacacguuauugaaaagaucaggugggcuucuggcuucucagguuagcauaggugaguugcauuuuagauaguucucugacaaacuaaacauggacugucccagacuugcccauacuuccccucaggucuuucaggaccuuuauggcuaugguugcuuuuugagcacuggcugggauuguacuauuccugcagccgacccuuuccuuuauaguaugugauuuguuuguguugcagcuaacuuuugagugacucauguuuguaucuguuuaacuuguuauaaauacuucuaggggugaauuuauacauaucuauacauauauaugcauauauguaacauacucauuuaaaauuaucuuagcucccacacuuauguaugaccuagccuauuuuaacugugaacucgcauaugugugu

SEQ ID NO: 6367 - RNA, 1813 nt, Mus musculus
acacacauaugcgaguucacaguuaaaauaggcuaggucauacauaagugugggagcuaagauaauuuuaaaugaguauguuacauauaugcauauauauguauagauauguauaaauucaccccuagaaguauuuauaacaaguuaaacagauacaaacaugagucacucaaaaguuagcugcaacacaaacaaaucacauacuauaaaggaaagggucggcugcaggaauaguacaaucccagccagugcucaaaaagcaaccauagccauaaagguccugaaagaccugaggggaaguaugggcaagucugggacaguccauguuuaguuugucagagaacuaucuaaaaugcaacucaccuaugcuaaccugagaagccagaagcccaccugaucuuuucaauaacgugugucucuccccucagauccucacccugacaacugacaaugccaacgugcugcugcagauugacaaugcccgccuggcagcugaugacuucaggcugaaguaagcuauguggauguggugcacacacagcaggggcuuccaacaaugcuccuggaugcccacaacagcuuuuacacucuccugaacucaucuggagugaaacagugcuaagcuguuuguuuuuuuuuuuuaauuuaauugucauaucuuuugggcaaucguuaaaggaggguguguuuuaaagugacagcuuucuucaaaucaaacuauauuaauuaauauuccuacaugaauucguguauuaugaauguugccaugacaugaaaccaaaucuguaucugcacuguaguccguguauauccagguauaccgucauccuccuguauauucaguguuuguaucuugcuugcuucagauacgagaaugaggugacccugcgccagagcguggaggccgacaucaauggccugcgcaggguacuggaugagcugacccuuagcaagucugaccuggaaaugcagaucgaaagucugaacgaagagcuggccuaccuaaagaagaaccacgaagaggugacacaaauuuacauaauuacauuccccccuuuuaaagaaaaaaaaaaaagcucaucugggucgugguguacucacuaauuaaaucuaacugcuccucaaacaggaaaugagagaccuucaaaauguguccacuggugaugugaauguggaaaugaacgcugccccagggguugaccugacucagcugcugaacaacaugagaaaccaauacgaacaacuugcagaaaagaaucgcaaggaugcugaagagugguucaaucagaagguaaacuagccaaucacccuucuuagugaagcccauggagcuuuucuuagcaugcccaaauggucucaucuuuucccuauuuuuuuuuuuuuuuuugauccucuagagcaaggaacucaccacagaaaucgacagcaacauugaacaaauguccagccauaagucugaaaucacugaauugagacguacuguucagggucuggagauugaacuacagucccagcuggcccugguacguuaaaucuuauaaccuggcuucuauuuuauccugcaauuguucaugcuaaaaaugacuugggggcaagaaauuagaaucgaaauugcagcuugugggcguguggggggaaaaaaaagaacugcucacauggaggcaguccugcucaaacuuuggcagugcagccuagcacgaauccuaauuuacuuuccuucuacgaggucuuccugaaucccauguuucaccuuaauaaacccuucuucucagaaacaaucgcuggaagccuccuuggcagaaacagaaggucg

SEQ ID NO: 6368 - RNA, 1135 nt, Mus musculus
caaacucagaaacuucuccucacagaacaaccaaauugacuccagacaccauggccugcugcgcuacuaguuucuguggcuuucccacuugcuccacuggcggcacaugugguucuaacugcugucagcccagcugcucccaauccagcugcugccaacccagcugcucccaauccaccugcacccaguccagcugcugccagcccaccugcacccaguccagcugcugucagcccaccugcacccaguccagcuguugucagcccaccugcacccaguccagcuguugucagcccaccugcacccaguccagcugcugccagcccagcugcugucagaccagcugcuguggaacuggcaguggccaggaggguggcaguggaggccugagcugccguguuagauggugccgcccugacugccguguggagggcaccugccugccccccugcuguguggugagcugcacacccccaaccugcugccagcugcaccaugcccaggccuccugcugccgcccauccuacuguggacaguccugcugccgcccagccugcugcugccacuguugugagcccagcugcucuaagcccagcugcucugagcccagcuguuaagaaccagguuccugaauaguuagaaaugcaacagaaagcccugaagaauuguguggacugcugaggauguguucugugugguggaugcuaaguaucuucauguuguuaaccuguuccuggagguggaacucuucaucaggauccccaaaggcgugcuggaauuaguccacugaacacgcgucucaaucagcauguuccagggacccuucuuugcuuagaugaugcacaaaggaugcagcaguacaucauuccagugagguguggacuuuauucccuaguccucgguccccacacgucuuccaucaagcuuuccacuugaagagaccccgaugcucucaaauaaaguguuuugugcacaagugaauagauuucugugcaucuucuaauuuuaagcugcccaucuauagaugauaguaaucuucaggcauaggcacauaaucuaaagcaaaaugguuguaugaaaauuaacuuauguuugaaucgucugcuaauaaaauguucugugcauuaaauaauau

SEQ ID NO: 6369 - RNA, 1213 nt, Mus musculus
ggggggugcagcaaacuuuauugaugguauucaagaggguagggagggcucccuaggccccuccuguuauaaugggggucugggauggaaauugugagggagaugcucaguguugggggccggguugggauagggacucaucagcaaccgagggccucucucuugcucucaguguccuugcuggggugggugguccaggguuucuuacuccuuggaggccauguaggccgugaggcccaccacccuguugcuguagccauauucaucgucacaccaggaaaugagcuugacaaaguugucauugggagcaaugccagccccggcaucgaagguggaagagugggaguugcuguugaagucgcaggagacaaccuggucuucaguguagcccaauaugcccuucagugggcucucagaugccugcuucaccaccuucuugauaucaucauacuuggcagguuucuccaggcggcacguaggauccaugacggacacacuagggguaggaacacagaaggccaugccagugagcuucccguucagcucugggaugaucuugcccacagccuuggcagcaccaguggaugcagggaugauguucugggcagccccacgaccaucaugccacagcuuuccagaggggccauccacagucuucuggguggcagugauggcauggaccauggucaugagcccuuccacaaugccaaaguugucauggaugaccuugaccaggggggcuaagcaguugguggugcaggaugcauugcugacaaucuugagugaguugucauauuuaucaugguucauacccaucacaaacaugggggcaucagcagaaggggcggagaugaugacccuuuuggcuccacccuucaagugggccccggccuucuccaugguggugaagacaccaguagacucuacgacauacacagcaccggccucaccccacuugauguuagcggggucucacuccuggaagauggugaugggcuucccguugaugacaagcuucccauucucagccuugacugugccguugaauuugccauggguggagucauacuggaacauuuagaccauguaguugaggucaaugaaggggucguugauggcaacaauuuccacuuugccauguggagagcagaaggcagccccggugaccaggcgcccaauagggccaaaucuguucacaccgaccuucaccauu

SEQ ID NO: 6370 - RNA, 914 nt, Mus musculus
cauuacaugugagccaucagacuaauggaccuuauacuaguauagggagacaaguuaugccacaaaggaaguuggaaacauggguugugaauacugagaacaucaggugucgccuccaguggaagcaaaaacaagccaaaguacuuagacuuuaggcaccauugaaacugauuuacuugcccuucaagagaagcaaccuaugaguugcauucuccuugaauacugacucaagagaagaguccgaccucuuuugauaauuuauuuauucacaauccaucagaaagaaggaaugcugcaaguaaagagaguggacccucuggcacgauauaaaagcacaccuggucagagagauuucgaaagcauccaagacaccuucuuacaaaucagacuggccuuccagccucugacaccaugcaguguuguuguggaacaugcugcugccagccaugcugcugccagacuaccugcugcuaauccugcuguugccagccauguugcugucaguccaacugcuuccagucuggcugcugcuagaacaccugcugcaacaacaacugccauuugaccugccuguuccugcccaaccuguucuuuuaggucuugcucuggaccauguucacacacuuuuguccccuauagcaucauauagaccucauuuaggugacuuguacccuagacccagauggccauuccacagaaucuucuccaacugauauccaacugauacugcuuugguucaacaaauauucuguccaugacuguguuugacaucacugagaucuacacaucccugaauguuacuguguacuggggaaucucucaucuugcaauuaugaaaccuuaugacuuuuucugauuuuguaaacuggaaguuaucucuuaauaaauaaaugugaccuagguacaaacaccca

SEQ ID NO: 6371 - RNA, 2217 nt, Mus musculus
gggcguccgggagcuugacuccauggguggggccgagacgugagggcagcgcgcuggcgucacaggggcggcuauauaagugaauacaggcgccgccccuccgccccagucacugagccgccgccgaggacucagcugccucccccucgagcccccucgcuucccgacgcuccgucccccccgcccgccuucucccgcagccgccuuccgcaggccguuuccaccgaggaaaaggaaucguaucguauguccgcuauccagaaccuccacucuuucggugagccuggggaaggucgcgcgggccugggggggggguggcggggucggagcucggagagccgccgagcgcggcgagcccaucuuagcucgggcuggagggguggugaugcccguggaaccgagaucugcgcccagggucgaccucugagggugcccggaagaaacgggugggaggugagcccuugggcgggcccggcgucucggguggcgcauuuacuaauggcuccugccucucggcgagccacacccgcccccucccgccaccccugcgucauguccucuacgucaccgucguugucucggagcugggagggaaggccccgccucgggagccuggcuuccgguagguugcaucagccggguggggcgcugccugcccacuaggucucuccagcacgugaucagccuuggcgggagggcuggccuagagcagaaagcuagcucuaguacuggccaguucccggagggacaacaaaggacaccuccggauuauuucuucacagaccccuuugcugaugcaaguaagggugaugaccugcuuccugcuggcacugaggauuauauccauauaagaauucaacagagaaacggcaggaagacccuuaccacuguccaagggaucgcugaugauuacgauaaaaagaaacuagugaaggcguuuaagaaggugggucugcuguggagagagcacguuguauggucuaccaagggagagggugcaaacgucaagggaguccguguugauggcauggccucuuagaugcugcauccuuuuguccuugcagaaauuugccugcaaugguacuguaauugagcauccagaauauggagaaguaauucagcuacagggugaccagcgcaagaacauaugccaguuccugauagaggugaguuuaggccgcccucaaugcauuauggguuuccugaauuucuaauccuuacaguugagcuuuuaaauacauguagacauucccacuuucaaacaguacuuggggguggcauagggaaguuuuaguaacaguggucaauugaaccauugugucuacugggauagacugaaguacucuucuuuauugggacuccuugcaagguguauaugggagaaucuguugacgucauguaaccugucccucucccuuguccucuuuuugcagauugggcuggcuaaggacgaucagcugaagguucauggguuuuaagugcuuguggcucucugaagcuuaagugaggauuuccuugcaaugaguagaauuucccuucugucccuugucacaaguuuaaaaaccucacagcuuguauaauguaaucauuugggguccgcuuuuaacuuggacuaguguaacuccuucaugcaauaaacugaaaagagccaugcuguguagucuugaagucccucauuuaaacagguugagcaguaagcccuggcaguguccacccuggaacaaagcaaugacaagguuucagccaagccaagaaccccaagaucacaggaggcuaugucugaccagaggcuccuuggggcucccuggacagaguccccugcccuaggagagugucaccacuugaacagaauggguaacacugccccagcuaugucacuagagggagucucuggcccugguaucugaccagguagaauucagaaagggcuaccuuuccagagaagucauggacauuuaguucaccaccaggguggucuuuugaagcagaucuauccuagccgggagguguugcgacaugaagggugaggccagcccggaacaaaugccaagcuggugccauuggcuguguggcuagcuguagaggcuucaacucaguacgagccagugccaugugaaggaacaagcuggucuuuugguuuucuuucccccuccaguuucaauguuauguaauguauuuaaauccuuauuuaaauaaagcuuguuuucagaaacgccu

SEQ ID NO: 6372 - RNA, 8819 nt, Mus musculus
caguggagcccgcuccgagcacagguuauaaagccccggcugcggcagcggacugcggagucaagaugcgcccgaaagagcaggugcagagcggugcgggagacgggacagggucgggggacccagcagcaggcacccccacgacccagccugcaguuggucccgcuccggagcccucggcggagcccaaaccugcuccagcgcagggaaccggguccggacaaaaaucaggaucccgaaccaagacaggaagcuuuugucgguccaugaucauuggugauucggacgcaccauggacccgcuacguauuccaggggccuuacgguccccgggccacuggccugggcacuggaaaggccgagggaaucuggaagacaccagccgcguacaucggccggaggcccggcguguccggcccugagcgugcggcguuuauucgagagcugcaggaagguaaacugagucucggggaucccgcauugggcacuauuugggcaucuccagguaggagggggugcaccgacucaggcgccccgcccccuuguggcucuuaguuccaccuuuccaccacccccgcgagaccacagucugcggugccgguuugguuucucuuuccccaucucccccccccccuuuuccgguuucccgauuauugugggugcgucagguccagagcucucucgcgcucuccgcccgccucuucgcgccuguugcuguggcagaucugcgcacucucagugcccccuccccgucuaccgcagugccagcagaggggcgggggcugcgggugcgcuuugagccugcgcuagcccgcaggaaccagccugcguggguggguagagguguguguguaggggagccuuugaccacuacuuguccucagggggucugggucguacuuuuccgaagcuggaaugaagagggaggagugggcggggcacugggcuucugucccuccucuucugggcgggggcaauuuuaggcucaggugcccgcuucugggugcugaagaagucuacuuggcccuccugugacaagcaacagguuuaggaugggugacugcauuuguuuuuaugaucgaggagacuccagugauggcuaagaugccgauugggggugggcaugaugagcccaguauuuucccugacuucuuaucucgaggggcccagagacccaggggucuugagaguccaguuccugagcccagaggaugguuuugccuuuacagcauccaggccccuccugagaaagcaggaguggggagauccggagcuguggagaggguguuagggccagauggagugcagucucacaaucuuuguugugagggguguaguggucuaugggcagccucggcuccuuucccugacccacuugggccuuuccuccugcagcguuguguccuaauccaccacccacgaagaagaucaccgaagaugaugucaaagugauguuguauuugcuggaagagguggguaccgccuuccucacucaggccagcccucauuuuaacucugcccuacaggacuucgggcuuuugucuguuuucuucuugccugggagccaacuugaaggccccuuuccuggaaggcaaguagauuacagaggaccaaucuggacugaucuuaucagacccaggagaugguuaauagucuuugguacuuggaugacugggugcuggagagauagucuucuugugaccuagcccugguuucucccuccuguuugggaggucccggaaacuucgaaggaauuggaaugguuggcucuucuuuugcagaaagaacgggaccugaacacagccgcccggaucggccagucccuggugaaacagaacagugucuugauggaggagaauaauaagcuggaaaccaugcugggcucagccagggaggagguaucuggguuccuaaggaccagggagaguuccguguguccccuccccagacuagcacccguucugcccccuugugcucaucuuuccguggcuucucuccccugcccuagauuuuacaucuccggaagcaggugaaccugcgagaugaccuucuucagcucuacucagacucugaugacgaugaugaugaggaagacgaggaagacgaggaagagggcgaagaggaggaacgagaaggacagagggaucaagaccagcagcacgaccaccccuauggugcccccaagccguacguguucggccuuugugcccgggaucauccguucucugagccucaguugcucguuuauaaaugggcaugggccugcugacacugucauugcuggggaagccuuggggacugggauccuccagcccuuacagucugacucucaucaucgcccuccccccccugccagacacccuaaggcugagacagcgcaccgcugcccacagcuggaaacccugcagcagaagcucaggcuucuggaggaagagaacgaccaccugcgagaggaggugaggacagugaggagggcgcgcccuugggcaggggauggugacagccucaccccuuccuuuuucccuuccuccaggccucccaccuugacaaccuggaggacgaagagcagaugcucauucuggaauguguggagcaguucuguacgugugacaccguuaauucagaggagggcacugucccaagagaugagaggaugagcuaaggguuuggagccuggagagcagagcugagguccuggcucugggacuuggccgcugugguagcccagacagauuccuugguuucccugaaccuucaucuuuagaaugaggacugauagccacggccugcuccucaucuucucaggguuuugagaaccauuguugagcgugguggaagcucaccuggaaccucagcacucaggagucagagacaggagggucagguguugaagaccaccuaaugugggacucuggagagaggggggacaggcggggagagcacgcgcccaggaaggguagagcacugcagaacacauagaggccauuagggucugucuauuauuuggaacaguccaagcuggcaggguggacaggauggcagggaggaagccaggagcugccagagccugggcacuuagggcugagacaguucacagucacacacugauucuaggcugugccuagcaccaaguuagccuucgucagucccugaggaccucaagccuacccacugagaugcagauucaaagggauauauagcaucuggcuuaugcucuuuccaaaucucaucucuguccuucuuuccccugcaagccacagcuggcaagucucagugucucuagcccaggacaccucauaauauauaauggggucucucuacccauccaggucccuuuuuacccagccaggaugaguuucugugacaaaaauuccaaaauggcuucccauugguccaaggauaacggcaaccccuucccccaucucugcgaucuggucucugcucacugcccugccccucccccuccccccugcccauucccugcaucuuccuucucggugugguggggcuuccauagccagaggcuccuuccagagcccuucccagauucugcagcacugaguuggucacaugcuccaccucugggacccuuuccucuucucuucccuugacacuggcuccauuguaccucauucuauugggguugagagugccugguguggacaagggaucaggucuuaccaagacauucuccaguccccugcucugugucaauaaaugauucuccaaaaagaagaccugggggaagaaugccaaaguccagagggaccucugugggggugacgggaccgagacucagagccaggcugaucugugcuuguccuauagcugaagccagccagcagauggcagagcuaucggaagugcugguguugaggcuggaaggcuaugagaggcagcagaaagagaucacucagcugcaggccgagaucaccaagcuacaacagcguugucagucuguaagcugcucugucaggcccaaagcccuucccuguguaggcaucagaguuggcagagaugacgggagagcuguucauccugcccagccacgucccuaaccaaguccacccagagagaauccuacacacucccaaaaccaggcugcaugacccccacuuuaugacuccuguuccuugugacugucagagacucugauaugggaagacuggugggguaggaggugcaggagugggaggccuugggggggugugucucacaccucaugguuuuuuuuacaguauggggcccagacagagaaacugcagcagaugcuggccucagagaaggggauccacucggaggugagguucuaugauuccuaggcaaagaucuggaaugcaggccccccggagggacaacuuggcucuccaaagaagacaagcaaguugcaggcagagccuuacugcccuccacccugacuggcccacgguccagcagauaucagcucguuugaggucuggagaggguagagaucaggaucuuggccagggucacccagaaucgcacuguuugggucuggagcuggggucguugcuugugccuaaagcaagagcaggcagagugccugacuggaaaccccugguccuagcagagccugcgagcuggcuccuacaugcaggauuaugggagcaggccucgugaccgccaggaggaugggaagagucaucgccagcgcuccuccaugcccgcaggcucugucacccacuauggauacagugugccucuggugagggugcucuuuuuaccucggugugcccuggguuucagcccugcuggcugauuucugccuucagauuauuucuucugaguguugggguggaaugucuccccucuuugcuguaggaugcacuuccaaguuucccagagacacuggcugaggagcuccgaacaucucugaggaaguucaucacugacccugcguauuucauggagagguguguguagcugggauccucaggcuugccugguucagccaugcucacuuugguccacccagugccaacuaccuuuucugaguggagaaugguugacacuaauguucugaccuccuaauguucaggcauccuuccugccuccuuauccugccucgcucacacugccuagcucugcggacucugcauggggaucagucauuuccaccugagacuuuuuucuuucucuuccuuccuuucuuucuuccuuccuuccuuccuuccuuccuuccuuccuuccuuccuuccuuccuuccuuccuccuccuccccucccuccuccccuccuuuccuccuucuccucuccuccccauccuccuccuccccuccucuuccucuuccucuuccucccccuccccaucuucuucucuuccuucuuuuuuuuuuuaaagauuuauuucuuuauuuuacguauaugaguacacacugcagcuguacagauauuugugagccuucaucuuguuguugggaauugaauuuaggaccucugcccacucuggucaacccugcucgcucugguagacccugcuuguucuggcccaaagauuuauuuauuauuauacauaaguacacuguagcugucuucagacacaccagaagagggcgucagaucucauuacgggugguugugagccaccaugugguugcugggauuugaacucaggaccucuggaagagcagucagugcucuuaccugcugagccaucucaccagccuucuccuuuuugaggcuggauuucucuguguagcccuggcuguccuggaacucacucuguagaccaggcuggccccgaacuuagagaucugccugccucugccuucccaggacaggugccaccaugccugugcucccugugaguuuucaauguuuauggcccaaggaauuugcaguuugaguuuccucaguguuccgaagguccugaucucuguuaaggauuuaaugagaugguuggugggggggagacaucaaacguggggugaccuggcuaagguccccaccccccaucaucugucuucacauuucagccgccagacaaccccuuguugcugguucuguaagcggaaaaacgcugagaaaucuguguuuuuuggggggggcggcugcucaucugcugguuguuuugggaauggcugugcccucuccauucagaucucaccuucuagguggcuuuuuacucaauguggcuggagaugaaggugaauagcccugggacccagucccaguuuggcugcuuuggguucuuugggcaagccaucugacccaucugagccuuacuauaauggauuuauuucuaugacaacuggcucugggaugagauaucccaguugcucugcucuaggcugaagggugggagugaagaggaaggaaccuccuugguauugauaacccucauuccuccugcugggggcgugggcuggcauuuuggaagccuccacaaugaugcccucuucccucacuccuagcugggacagcugaggugggggacuaucaggguguguggagugaaguguugggguggcccguguggaaagacgucacugucuccuugccuagacgugacacucacugcagggaggggcggaagaaggagcagagggcgaugccacccccaccggcucaagaucucaagccaccugaagauuuugaggcuccagaggaguugguuccugaggaggagcugggggccaucgaagagguggggacagcugaggaugggcaggcagaagagaacgagcaggcgucugaggagaccgaggccugggaggagguggaaccggagguggacgagaccacaaggaugaaugugguggucuccgcccuggaggccaguggccugggcccuucccaccuggacaugaaguauguccuccagcaacuguccaacuggcaggacgcccacucuaagcggcagcagaagcagaagguggucccaaaaggugaguguucccgcagaggacacccuccugccagugggacaagcuuucgaucaucaaccauaugagaggugagaguaggugaacauccacccccuccccagugaucgcuuaccuuaacuaggucccacccagugugcugauuugcauggacuuugcauacgauuuacauacuauuuacauaguugccuccagucccccuuggcuagaacugcugccucaguguuuauuuaugcaaaaucugcuuacaaguccagcuguccguccaccuucuuccuuggggggcugaacugggaaucaggguugggcuauacacaccuuuguaccucaacuuccuaucucugcccuauccuucaucccgaauuccucuacccaccaagacuccccaaccccgcagcagcaaacaaacauggggggcgggauccuggagcagcagcccagagugccgacccaggacucucagaggcuggaggaggacagggccacucacucucccagugccagggaggaagaggggccuucuggggccaccuaggccuggaacgaaggccucugccagcaagggccacaguuggaccauucccccgggugaguguggggcuccugcagggugguaggggcgggucaggguucccucagcccaucuagaaaccccagcuuuggggagcuacgugcucugagggcaggccuuuccggcacucccucugaggagcugucugggaaaucagaugacuuagcaucggaucuucuuuuguguuagcuccuuucgucuucauggcccuguggguggguacaugugauugugcaccauuuauuagaagaggaacccgaaguucagagaucugagaugacuuggccaaggucauacuaggagcagaucugagcccgugucuaugaguucugaaccccuggccuggucucacugcuguccgcaccuccugcucccaucuuugcguuccaccugaaguuuuggcagccuccuucagucguucugaugcccccacccccguuuuggggugcaccaauggguggaacaucccuggcugcggcacaguaagauggcgcagguuguaagcugggucagcacuuccguggcugaccacgggggaccugagugagggccaguggugguuuucugucgucuccucugucagggccgacuggguuugaggguggucuggcuccugacucccauccacccccuucucuucccgggcuugcuguuucccagcagccggaagaagccccacagacagcuugagacccccuccuucugcugccuggccaagucccacccuuccuuucuuuccucugaaacaggacccuaccccccgccccccccaugucugccagaaguucucccucuccuguccugguagaccugucuccucuuguaggacaggcugaaagaaccccggucccucauucugaaacuggggccaaagcuguggcugcuggaaccccagggguggaagcaaacugggcagauuggcuggcuaccagauccagcucugagaugggugugagugggcgugucccuaggguaggcaguuauuggggggggggggguccucucuaucccuugaaccucucacguaaagggacuuccccaguccugguuggcuuuuugaaccugguccuuuucgcucuuuuuuacccuucuccguuucuauuacugugugugacguaaaguguaucugcgugaggguugugucccucugcccagugcugucucuguguccuguggccugugaguuuccuucuagaguucugccuuccuccacauccgugcucacacagagcuguggccucagcgccugcccugcuucugcagcgcuucauagucuuguagcuagucagccuuuguauugauguaugugccaaugugggaaauaaagaacuugugagauaucugc

SEQ ID NO: 6373 - RNA, 759 nt, Mus musculus
ugagggggagaccaagggcuaaagcugggagauugaaaaaugcagaccaccaaggcacugcucauuucuccagcucugauucgcuccuguaccaggggucuaaucaggccugugucugccucccuccugagcagaccagaggccccaucuaagcagccuuccugcagcagcuccccucuccagguggcccgacgggaauuccagaccagugucauuucccgggacaucgacacagcagccaaguucauuggugcuggggccgccacaguugguguggcuggaucaggagcuggcauuggcacaguguuugguagcuugauuauuggcuaugccaggaacccaucucucaagcagcagcucuucuccuaugccauucugggguuugcccugucugaggccaugggacucuucuguuugauggucaccuuccucauccucuucgccaugugaggcucccuggggucacccagccgucccugcugcuuugacuccaugccaguccuggugcuggagucuacugagcuuuaccauuaaacaacaacaacaacaacaacguuucucuaaaccaugugccugugccugucuuucuaccccggggguaggcggcgucuuuggaauggugagaagugacacuugggucagccuuggugauaaggcagaguguggaagggucccaccgucucccaggaggauaugaaauagccuggguaaugauguuggugcuuugucacuuucaaguuuagcauacugacaggugcc

SEQ ID NO: 6374 - RNA, 6765 nt, Mus musculus
ccaguggugguguaagcauugcuaguggucgagggccagcccacguaguggacucgagcgucaacugacgguccuagagaggcauuccagccucccggcucuagccuagggcccggcgcuaagacccagcaggagcuccggggguugggggugggcugggcuggagcccgagcuggcuggagcccgacggucgccggcugcuccguaagccuccgggcgcggugcgggcauggcucgcggggcgugggggcugcuguggcugcugcugggcagcgccggggcccaguacgagaaauacagcuuccgaggauucccuccggaggaccugaugccacuggccacggccuacggccacgcucuggagcaauacgaaggcgaaagcuggcgcgagagcgcgcgcuaccuggaggcggcgcugcggcugcaccggcugcugcgcgacagcgaggccuucugccacgccaacuguaguggccccgccaccucucagccucggcccgcguccggcccggacggcgaccacgacggcgauggcgaggacugggcucgcgagcugcggcucuucggucacguccuggagcgcgccgccugccugcggcgcugcaagaagacgcugcccgccuuucaagucccuuacccaccgcggcagcugcugcgcgacuuccagagccgccugcccuaucaguaccugcacuacgcgcacuucaaggugggcgcggccggggccgccgucgaguuucccuagaacgugaggcccgcggugcguccgaggcccccacugacccacuccccacgcuccucaccaggcgaaccgacuggagaaggcgguggcugcggccuacaccuuccuccagaggaaccccaagcacgagcugaccgccaaguaucucaacuacuacagggggaugcuggauauuggagaugagucccucaccgaccuggaggcccagcccuacgagguguggagagagugggagggauggcuagccuugguacaccuuccuacaaccucuucacccaacacacacacacacacacacacacacacacacaccuuaugagccuucggggucuucuugacuacccccgccaugcaccucuccaggcuguguuccuccgggcugugaaacuuuacaacagcggggacuuucgcagcagcacagaagacauggagcgggcccuggcugaauauaugacggucuuugcucggugucuagcuggcugugagggggcccacgagcagguagacuucaaggacuucuacccagcgauagcagguauauaccauucagaccacugugagguaucccucacccacagugcccuggcuucccaggccuucuaaggccucuuaaugcguggcuauguccggugaccgcauucaacaggucuagcaaagugcuccaaagcuacacacgagucaggccuuuucugucuccagucugaugagagaaaugcugguauacauagcaaauucugggucagcuauauagagaaauagauugccucaaaaaacaaaagaacagggcacgguggcacaggccuuuaaucccagcacucaggaggcagaaguagacugaucucugugaguccaaugccagccuggucuacagagugaguuccugggcaacugaagcuuuauagaccuugucucgaacaacaacggagaugaggaauugacuccaggcaggugugugcagaaagcagggcuggguggaggaaccacagcuagucuuuggauccgugaccacaaggcccuucaagggagguagcggugaggcagaaagaacuauuaucaggaccccuauucucccagaacacacacucucucucucucucugucucucucucucucucucaugucagacagggauucgguuacggggcaguaggaaacaagugcuucuuugccugcacaauauacugugugacaagcauuucauacauguuaacccaggaacucuggacaaggaaagcaggcuccauagcagaucuuggucuccaccagggaucaggguuagcacacaucgcuuccuaacggcugcauccuuccuagaucucuucgcagaaucccugcagugcaagguggacugugagaccaaucucacccccaacguagguggcuucuuuguggacaaguuuguggccaccauguaucacuaccugcaguuugccuacuacaaacgugagcuuccgggaugggcuggguaaaggggugacacuaguggguaggagaggacaguacacggcggggguggggggauggcucccagaagcaugaaaaugugccucucagaugaaagacuccggagaaggggaggagaggcuaagggugguggcgacaugggaaggaacccaggcaggugagaggccucaagaaagagucagaggccccucucgguagacuaggucggcgacacugcucagcacugccccacuagcaucaugccaaggacauuccuagacccauucuucagauuaaacugagguuucuaaaggacaagagacuacuagccccgugacuagggauucacagggagguccugccaucaccugggguuaggcugggacaauccagaguuccuacaacucagagauguaacacuucaagggcuaagagcugugaguagaggggccgaggucagggaccaggaaacucuuccugaagacuggcaaagaugcugagggccuguaauuccccccaacagccgucucucucuucagcaguaucgccacaagcaguuuaucuaaucccccugugcuuccaauccuuugucuauaaaacccaacugauugagagugucagugacucacacugccugguacgagggcaacacccagggccugcuggguuauguucgcuugggcggggugaggagccagcacauauucugagaggcgucugggggguugguagaggcuguggguuuagguuggaaggugggguggggugaguggauugccuuuaaaggaaaacaucagggucaccccuuccucucuccugccuucagugaaugauguacgccaggcugcccgcagugcugcuagcuacaugcucuuugaccccaaggacagcguuaugcagcagaaccugguauauuaccgcuuccaccgggcucgcuggggccuugaagacgaggacuuucaaccccgggaggugggcauuggucucaugugcaguuuugugguuugguuuaaaaaaaaaaaaaaaaaucaaaaaaaccuuggcuuccuugaaaggcuggagaggaaggggaaaaaaugaauauggucuguggcuagagucuaggcuucagcaugucugggauguggaagggaugccaauaggugcccacacaugccugcuuccaccucaguacuguccuuugaguccccaccccaccccaccccaccccaccccaaccccaggagucuguuaaugaacgaaugagaaaaccccaugggagguuagagcaaggcuggcaaauacggaccccaugguaccaucccugccucccaugccuguggcagacauuacuaauguauugaugcacucuuccuccuggaauccgcagaauccuucuuaauccaguguuccgaguagcuaggauuauucuaugagcugauccauuuuccccugauccuugagcccugucuuccugcugucuggcagcaggguccaccuuacccuguccuucccucuuccuaggaagcuaugcucuaccacaaccagaccucugagcuccgggaguugcuagacuucacacacauguaccuucagucagacgaugaggugaguggcuuccugugagaggcuggaccaugauggggacauguuaggcuuuuuuccugaggccacugugugugacagcuccaggcuguggugaagcaggaguuucccgauccccaucuguaucccgcuguaccuuaguguuccuacggcucuuucucugccugucccaggccuacaacacuuccuggucccccaccucccugcucaaauguuagcuccucuagggagcccuugcuggauguccuggcuuucuucugggccuacacuggcuuccccgccugccuggccaccuggccugagaccuggaguuacucauaguccucgaccauuuugccuuggccagcugaccuccuaaacaacuacaucccaggauaggagacuaaauuauccccagcuacaacaucuggcuuuuccucaugcucagaaacugagguugaaccaguggacgaaugaauaaaugaaugauacuguggagagccaauucagagugaggguuuggcagccuggguauauuauuauuauuauuauuauuauuauuauuauuccaagcauugguguuuugccugcauguaugccugugugaggauguuggauccccuggaacugcaguuacagacaguuguaagcugccgugugggugcucggaauugaacucaggccaucucuccaucccaugaccugggcuucuuaagggauugcugugugguuuauuuauucaguacuuaccuucagugaacuugggagcagacuucaucgucacacauggcugccuuagauguuuguccucccaguucugucauuugccagccguuuggccuuagcgucuccaucuuaaguaacauagcaaaacccugcuuuuuaugagaagaaugcccuuugacuuuuauuauggugacaauuaaaugagauuauuuaaagcucauaguacgugcagcuggcacuccgaagaugcucagaaccugcagugacggugaugacugucacucugggucugcuguuugccagaugucaggcuuggguugcaguaaguggcugagagaaacagucucccagagguucucaugaggggggcacagcuacagaggccagcaugggcaccagugagggugaugcuugaaggccucagucuggaguggacauguggcuuugguggaauccacgggcccauccaggucagggcugccaaggcauuccuggcaggagaggaagagccagaagacaaaaugcacagacuagcaguguucucacuggguguggggcugaagguggggcugagguacaggcggugcugacgcuagcacccugccugccucugcugguugagccccaagugucacucagggaagcaguuucagaaugggacccagcaggagaaacccugacauccuguuagaugcugacacuggggaggggaggggaggggaggggagggucaucuggggccugccugcccaacucccgccaggaccacaccaggaaaccugcuaaagugggugggggcugaaagaugggggcgggaguagaggguguucugaucugaaggggagccuauuugcauguggguuugcugugacucaguuucucccccauccccgggcugcucuagauggaacuggaggagacagaaucacucccagagccugaagaaccucuaucugaugcugaguucgaaggcgagggcgacuaugaggaaggucucuaugcugacugguggcaagagccagaagccaagggugacgaggccgaggccggucaguacuggauugugccgaagggauaggaacacagcuugggaugggcacuggggacaggguucucucccugggcuauagugccaggggaaugcaggugggugcugucacccuucucaagggugcagccuguuagugaucuaugcuccugcuagggugguauucagacaccuguugcaauaggcaggacuaacucuugcucucucuuuccuuuucagagccagagccugaacugacauaaggcggugacauggcgcacucuucaagcucaggacaccuggcugggggcaagaacuauuuauuaaaacuuaaaauagccaggugugguggcacacacccuuaacccuggcacccgggggaggcagaagcaggcagaucucgggaccagcccagccuacacagugagauccuggccaggccaggcuacauaaugagauuuuguuucaaaacaaaaacaacugaguguggcaucacaugccuuuaauugcagcagcugggaugcaggggcagguggauugcggugaguuucaggcuagccuguagugaguucuaggccaguagaggcucuguuguaagacccugucucaaaauaaaacaaaaggaaaaaccuuaaaagggacacaguugaccuaguuuccacucagccuccaccuuagcucucucucucucucuugugucuuugaaccgcagacugguagccauauugcugguugggaagugagcucuugggggucucugucucccuuucugcuccugcggaaguuuucagcuuccggcuugagucucacaggaccaaggccagccagguggcgguugugucugagcugcagaguggguugugaagaacauugggcuuagagcucugcugcucaauaaauguuuauuguugaaaugaaucauaacaccugaggccagucugcaagguggaggugucuggguacaggcccucgccucccucucucugccaaucuucccuucucuguguaaugccaguugguguacccuauggccuuggcagguccuuuacuccccugacaucugauagagagcuggggauccccgugagcuguaaggaaccucagaccugccaccagggggcaugaagacacaguauuccagggagccuuuggaggacggugguuucggguuucuaaucggggaugucuguauuuuucuagucccaggccacucuucuugguguuuagagggauaugaagaggggauuaaagacauucacuacac

SEQ ID NO: 6375 - RNA, 9355 nt, Mus musculus
cugggccaggccccgggucucagucccggauggaguuuugggggagggagacucagagaucuuuguggcaaauuccuuggacuccagagacucucaaccuggcccccaccuccuaguucaccauaaaacaucacccugcccggccagcucauucuccccagcccccauuccacguggacccgccagggcgggguggggagagaggacaggaagggggggagucagcucugagaggagggggaaggaggcuagcggcuggcguccgcucucacugccggcgucccuggucugggcaccauguuccuugugggguccuccagccacacccuccaucggcuccgcauacugccguugcuguugcuucuacagaccuuggagaggggacugggccgugccagcccggccggagcccccuuggaagauguggucaucgagagauaccacaucccucgggccuguccccgagaagugcagaugggggauuuugugcguuaccacuacaauggcacuuucgaagacgggaaaaaguuugacuccagguaagagcuugggcacucccggacucagcaccacuuuccugagcuuccagagaauguugccccuucuaagguuugcauuccuguagugcuuucauaauccuuugccacaaacagcauccuggggagagcaccucaaaggaugccuccuaucuucaauaccaaauuuucaauuccuaaaauauucccgcccccgcccacgacccccuccuagcccccuggaauauuugaugcucaggugaagcgccacauauacuuaccauaacuuaaacacaaaugguacccuggcacgcaaucuuagagggcaaagagacugugccuacuacacguaaacccugaagugaguggauggauggucugccuggugccgccucccuuugcacacacucuggcucccugucuauuucucucuccaguuuucuaugccuuugugguuggagacuggagaaauaacauuuccuugaggguguagggcccuagagcagcuagggagggucuuaagcagagugggcauuauaauuuggggguagaccauagcuggugccgugaccaaacuguccacgugucacaaagucugacaugccauccuggggacucuuagugccuccuucuccaagccucugggaacucaguuccuccaucuuagcuuuagcagccaacaccacgcuccaaugccagccuuggcuugacgggaccagcaucuuccauucugauccaggaccuuggucggccagacagauacccguugguuuuggggggcagaucagagcuguguggcagccucuuuccaggcuacaagguauacuucaggcccuaucacacuugaaacucuacaccacaaagacaaguugccuuucggucuccucucugaaauagacaguucagcccacaggcaauuaguggucaugacucuggagggagauuuuuugguacaguggauaagaaugccaucuccauauuuguaaggcccuggguuuaaauucgggcugugacagaggaggagucuuaacuucccuugucugaaacaugggaugggaacacuaccuacauccucagguuugaauggugacaaugaaugacagugacuuccacaggaccuccaggccuccaguggguucaggacauaauuggcguagacucuggcacaaccauaagucugaugguguuuaacucauagaaacuuugugcucagcauugguuuuuuguuuuguuuuguuaaggggguggaggaguggaucaugacaagguuucucuguguagcccugacuguuaggaaacucaugcugaccuugaacucacgaagauccacuugccucugcccccaagugcugggauuaaaggugugcaccaccaccauccaguaccauuggcuuuuauauagcgcuguaaaggaaauagaccagacauaaagccugcccugugggcagaugaggaagagagcugggagcacagcccaguaaguagccuuuggaagagauuuaucuuaugucuaugaaucuuuugccuaaauguagguaugcauacugggggcaugccucauguuggaggaagucagaagagggcuggauggcugugagccaccauguuggugcugugacuugaacucacauauucugccaagugugacaagugcucuaaacucugagacauccuccagccucccuauuugagacaggaugcccuggcugcccugagaaucacuauguagaacaggcuggucccaguuuacagagauuggcauaccugucucccaagcuaagauuaaaggugugggccggguggugguggugcacgccuuuaaucccagcacuugggaggcagagacagguggauuucugaguucgaggccagcuuggucuacaaagggacagccagggcuacacagagaaacccugucuugaaaaaaccaaaaccaaaaaaaaaaaaaaaaaaaaaaaaaaaaagauuaaaggcguguaccaccaugcucagccuuccagcaauagugagaugggagcuggggguaucuuaccugguggggacuucuuaagccugucuugggcacaguuucuaaauguugaaacuggaaaacuuuuuuaguccuuggauaucuucaaccaaaauagaaucucccagccuuggagagauggcucaccacuuguucuugcagaggaccugguuuuuguucugaaaacucuuuuuguuuuuuuuuuuuguuuguuuguuuguuuguuuguuuuuaagauuuauuuauuuauuacauguaaguacacuguagcuauccucagauacuccagaagagggagucagaucucauuacgaaugguuguaagccaccaugugguugcugggauuugaacuucggacuuucggaagagcagucgggugcucuuacccacugagccaucucaccagccccuguucugaaaacucuuaugguggcuuguaacaaucuguaacuccaguuccaggggaucugacucccucuucugcccuucuuaggcaccagacauggcaugcacauggugcagagacauacagacaaaacacucauauacauacauacauacauacacacauacauauuuuaaaauauuuauuuauuuuauguauaugaguacacuguagcuguacagaugguugugagccaucaugugguugcugggaauugaauucaggaccucugcucacuccggucggcccuacucccucuagcccugcucacuccggcccaaagauuuaauuauuauuauauauaagcacacuguagcuguuuucagacacaccagaagagggagucagaucccauuacggaugauugugagccaccauaugguugcugggauuugaacucaggaccuucagaagaacagucagugcucuuaaccgcugagccaucuuuccagcccgacauacaucuuuuuaaaaggauuaauaucccauucuuggggcuggaaguguaguuccagcaucccaguuguaaucccagcacccaggaggcagaggcaggaagaaccuaaguuuagggucauccuuggcuacauagaaaguuccaggacagcuaguacuacaaaugacaccugacuccaagagcagggaugggagugacuggaacgauaguguaaugguuaagggcacuugcuguguacaaucaugagaaccugggcauccugugcacacugagucaaggagauaaccugccuccaacgacgagccauagagugauggaugaggacauccagugcccuuugggugccucugcaugcacacaugggugcacacacaggugugcacacacucacagacauacgcacauauacaaaucucucuuuccuuuaaagaaaagaacucucucuugacuugugaaaacagacaagggcuggugagauggcucaguggguaagagcacccgacugcucuuccgaagguccagaguucaaaucccagcaaccacaugguggcucacaaccauccauaaugagaucugacucccucuucuggcgugucugaagacagcuacaauguacuuacauauaauaaauaaauaaaucuuuaaaaaaaaaaaaaagaaaacagacaaaagccaggguaaguuuaggaugggcuuucuuccgaggaaggcuguucucugccucgccggggcccgcccacuucugcuuccuuggagaaaggaugcucagaaggagaaacagaggagcugugaccugaguuggugugaugaguccgcaaagccaaacagaacagcuggagucgagcucagcagccuggggcuggccuggcauauaugggagacccuagauucucuucccaguaucagaauaaagaaaagggaaagaaaacugaaaaccacaauacccacccccacggggagaaaaauucagugaaaugaugaaugcaaagugccaagagcuuaauuucacauacaguaagucccgagcuaugcuaucagaaguagcaauagguagcacacaguucggucugcuccacuccacccucuugcuggggaguaaaugcuccuggccuccucugggacuuccuucuucuaauagccuauuauuaauauuaauauuaauguuacuauuaauauauauuuuuagacaggguuucucuauguaacucugauugcaacucccuauuuagaccagacuggucacaaacucacagagaucuacccaccucugccaccaggcugcugggauuaaaagugugagcuaccauacccagccagccuguuauccuaagaggggcauaagggcuagcccagacaagagaguuggaggggaaaaaagagaaaguuaggaaugccuguguccgcaucguguccuguguguguaggagacugagcggcgggcauugugugacugcaugcaugcuuaucugucccguuuccuccuccagcuaugaccguagcacccugguggccaucguugugggcguaggccgccucaucaccggcauggaccggggucucaugggcaugugugucaacgagcgccgccgccucauugugccuccccaccugggcuacggcagcaucgguguggguaaggaggccaggggacggguauaagguaugugagcaugggggcaggaggcagggauagacaagaugcugaagcucaaagguucugagugacuaggccaaggucauacuguucaccaucugauuggugggagcuguggccaucaguuugcucuggaaugagaagaguuggauggauacagaguccuguguagagguacaggagucaccgcuugguuaggagagaggguagcuggagccagagguacagcagauagaguaggagucccacaucuaaguagugguauggggaccuccagcugggcuguggacuuguguaaaccccaccucugcugcuuccccacagcgggccucauccccccugaugccacccucuauuuugacgugguccugcuggacguguggaacaaagcagacacggugcagucaacuauccuccugcgcccucccuacugcccccgaauggugcagaacagugacuuugugcgcuaucacuacaauggcacucugcuggauggcacugccuuugacaacagguagaagcuaggggccguccuaagggcugggaacugggagcaagagaagggagcccuggugugcccugccucucuggcuucuaaccacaggaucucugccuuauucucugcagcuacaguaggggaggcacuuaugacaccuacaucggcucugguuggcugaucaaaggcauggaccaggggcugcugggcaugugcccuggagagaaaaggaagaucauuaucccucccuuccuggcuuauggggagaaaggcuaugguaagggaauccucugaaagaggaaaagccaggcuccacauggaagugugcagguuguauacugucgaagggcagccagccagccagggaggcaagcagagaugaaauuccccucccuagacaggauggcuuuauucugauucacauagaggcucaguacggguuggugacagguuggcgacggcucugaggacaacccaaaggaggagaauaggcaacagaguugguccuuuugcaugaggccccuugcugugccugggcuugcuccccacuuguaugguucaagcccugugccuucccccagggacugugauacccccgcaggccucccuggucuucuauguccugcugcuggauguccacaacccgaaggacacgguccagcuggagacgcuggagcugccccagggcuguguccggcgagcuguggcgggggacuucaugcguuaccacuacaauggcucuuugauggaugguacccucuuugauuccaggucaggggguguccugaggugggaggguggagacugaggggcacucugaacugccuggaagggguggggccccuuugaccccccuccccacccuuuccccuguauuacagcuacucccgaaaccacaccuacaauaccuaugucgggcaggguuacaucaucccugggauggaccaggggcugcaaggcgcaugcauaggggagcgaaggaggauuacugugcccccucaccuugccuacggggagaaugggacagguaggguuugguccccaggcuacccuuaugcuccucugaaguguaccccugagauugcugucccucuuguugcccaaacaugugaagcuuaaacucggucacccacuggaucccuaccagggagacucuaugcuguuccuccaaggcaggccccaacccccaauagugaacaaggacagcaagccugaguuuggggacagaauaguuaaggacacagagucuagccccacugagcaaagaggucuuguauuacagauuuugggagccuccggcucuucacuaaugcacugcacaucacucauggcaggguguuacugggagccugcaaguuguuggguggaaaaggguuuuccuguuccuugucccuuuccuucaacagcaagauguagguagugggaagcacucauucuggaacaugccaucugaccucgcaugguuucuugagauugggaggagguauccagccugggccccacggagauagugagaagcccccacccagagcccucagcuaacugugccccaucuggccucaggagacaagaucccuggcucggcugugcucaucuucgaugugcacgucaucgacuuccacaacccuucggacccuguggaaaucaagacgcugucccggccuccugagaacugcaaugagacauccaaaaucggggacuucauucgcuaccacuacaacuguucucugcuggacggcaccaggcucuucucgucguggguucuugggcagggccagggcugggcugaugguggguuuaggugugggugagcuugccaggcuucuucuccucucucugggucucacagucucuuacuuccugucucacugagccucggggagcuaugggugugaaaugcagagaaaugaggguguaaagcuggaggaagugagaacugccauucuagaaugauagagauacugaaagagacgagccuucagucaccccugcugcugaccuggaaauccacucuccccacagccacgacuaugaggccccucaagagaucacccucggagccaacaaagugaucgaaggucuggacaggggccugcagggcauguguguaggagagaggaggcagcucauugugcccccacaccuggcccacggggagaauggaggugagagacagagacccagauucuaagucuauucccaugguuugccccuauccaucucaggccuuggccacuggugggugggaccagggaaacuuuuaggaugguuaaacaccccgugccccuuccauaagagaaaacggaggccugcguuagggcucagcuucaaaccucacuggaauucuguucucuuugcccuccaucucuccagcccggggugucccuggcagugcugugcugcuauuugagguggagcugguaucccgagaggauggccugcccacaggcuaccuguuugugugguaccaggauccuuccacuagccuuuuugaagacauggaucucaauaaagauggagaggugcccccagaagaggugggucaggaacucagucacaaccccaacccagaagccagcaugcucacugcccucuggcugccuacuuugcuccccucugcugagcuccaugcauucccuccugcacacugugcaugcagccuguccuccuccuaccacccuccaucucagacccaaauccucuggguaccaggcuggggggugggaacaaugugggccagcaccuggggccccuucccaaggccauccgcagcuguugaccaugagccucaccaccucacccuccucugcucuccccucccccaguucucuuccuucaucaaggcucaagugaaugaaggcaaaggacgccucaugccugggcaagacccagacaaaaccaucagugacauguuucagaaccaggaccggaaccaggauggcaagaucacagcugaggagcucaagcugaagucagaugaggaccaggagcggguccaugaggagcucugagggccagagugucaggccugaccucagacacaaaggccccucggcuggggggcagugggcauggagcuggccugcuaacagccccccgauccgucagggggaauaacucugggagucacuggauaucaguggagacuacuguggucuucccacgcaugggccguggcuuucaguucucagcacagacaucuguguuuuucucguccaacccuaagccucuuccuuaagguucuugugacagauccaguucagggaggaggcacugagauuugguuagggccaucgcgaaccccacacacccauccucccaucucacgucacuaggcacggcaagggugagcuucuugguccuucacuuucccagacgugcccuuuauuuguacuguccugucccaucucccuguccccgccuguccccguccccucugucauggcagcucugcaggggcaugaaucugagugacgagagccugcguucuucugccucagcucugcuccucaggaagggguggcuccagcugcccaccauucucacucuucuccucccaagccaccggggucaggucucucaucuuaagaaguucccucuaaaaugaaagguuguguaagaggaaagccugcucaggcccaaggguuucgagaaccugcacuuggugcuaaucugaggggaggaaggugggcagggucuuggacucaaaggcuaaacugauccaguccuuucuccuuugugucaauaaaaggcuaaacugaagaccuccagaaguggac

SEQ ID NO: 6376 - RNA, 9355 nt, Mus musculus
guccacuucuggaggucuucaguuuagccuuuuauugacacaaaggagaaaggacuggaucaguuuagccuuugaguccaagacccugcccaccuuccuccccucagauuagcaccaagugcagguucucgaaacccuugggccugagcaggcuuuccucuuacacaaccuuucauuuuagagggaacuucuuaagaugagagaccugaccccgguggcuugggaggagaagagugagaauggugggcagcuggagccaccccuuccugaggagcagagcugaggcagaagaacgcaggcucucgucacucagauucaugccccugcagagcugccaugacagaggggacggggacaggcggggacagggagaugggacaggacaguacaaauaaagggcacgucugggaaagugaaggaccaagaagcucacccuugccgugccuagugacgugagaugggaggaugggugugugggguucgcgauggcccuaaccaaaucucagugccuccucccugaacuggaucugucacaagaaccuuaaggaagaggcuuaggguuggacgagaaaaacacagaugucugugcugagaacugaaagccacggcccaugcgugggaagaccacaguagucuccacugauauccagugacucccagaguuauucccccugacggaucggggggcuguuagcaggccagcuccaugcccacugccccccagccgaggggccuuugugucugaggucaggccugacacucuggcccucagagcuccucauggacccgcuccugguccucaucugacuucagcuugagcuccucagcugugaucuugccauccugguuccgguccugguucugaaacaugucacugaugguuuugucugggucuugcccaggcaugaggcguccuuugccuucauucacuugagccuugaugaaggaagagaacugggggaggggagagcagaggagggugagguggugaggcucauggucaacagcugcggauggccuugggaaggggccccaggugcuggcccacauuguucccaccccccagccugguacccagaggauuugggucugagauggagggugguaggaggaggacaggcugcaugcacagugugcaggagggaaugcauggagcucagcagaggggagcaaaguaggcagccagagggcagugagcaugcuggcuucuggguugggguugugacugaguuccugacccaccucuucugggggcaccucuccaucuuuauugagauccaugucuucaaaaaggcuaguggaaggauccugguaccacacaaacagguagccugugggcaggccauccucucgggauaccagcuccaccucaaauagcagcacagcacugccagggacaccccgggcuggagagauggagggcaaagagaacagaauuccagugagguuugaagcugagcccuaacgcaggccuccguuuucucuuauggaaggggcacgggguguuuaaccauccuaaaaguuucccuggucccacccaccaguggccaaggccugagauggauaggggcaaaccaugggaauagacuuagaaucugggucucugucucucaccuccauucuccccgugggccaggugugggggcacaaugagcugccuccucucuccuacacacaugcccugcaggccccuguccagaccuucgaucacuuuguuggcuccgagggugaucucuugaggggccucauagucguggcuguggggagaguggauuuccaggucagcagcaggggugacugaaggcucgucucuuucaguaucucuaucauucuagaauggcaguucucacuuccuccagcuuuacacccucauuucucugcauuucacacccauagcuccccgaggcucagugagacaggaaguaagagacugugagacccagagagaggagaagaagccuggcaagcucacccacaccuaaacccaccaucagcccagcccuggcccugcccaagaacccacgacgagaagagccuggugccguccagcagagaacaguuguagugguagcgaaugaaguccccgauuuuggaugucucauugcaguucucaggaggccgggacagcgucuugauuuccacaggguccgaaggguuguggaagucgaugacgugcacaucgaagaugagcacagccgagccagggaucuugucuccugaggccagauggggcacaguuagcugagggcucugggugggggcuucucacuaucuccguggggcccaggcuggauaccuccucccaaucucaagaaaccaugcgaggucagauggcauguuccagaaugagugcuucccacuaccuacaucuugcuguugaaggaaagggacaaggaacaggaaaacccuuuuccacccaacaacuugcaggcucccaguaacacccugccaugagugaugugcagugcauuagugaagagccggaggcucccaaaaucuguaauacaagaccucuuugcucaguggggcuagacucuguguccuuaacuauucuguccccaaacucaggcuugcuguccuuguucacuauuggggguuggggccugccuuggaggaacagcauagagucucccugguagggauccagugggugaccgaguuuaagcuucacauguuugggcaacaagagggacagcaaucucagggguacacuucagaggagcauaaggguagccuggggaccaaacccuaccugucccauucuccccguaggcaaggugagggggcacaguaauccuccuucgcuccccuaugcaugcgccuugcagccccugguccaucccagggaugauguaacccugcccgacauagguauuguaggugugguuucgggaguagcuguaauacaggggaaaggguggggaggggggucaaaggggccccaccccuuccaggcaguucagagugccccucagucuccacccucccaccucaggacacccccugaccuggaaucaaagaggguaccauccaucaaagagccauuguagugguaacgcaugaagucccccgccacagcucgccggacacagcccuggggcagcuccagcgucuccagcuggaccguguccuucggguuguggacauccagcagcaggacauagaagaccagggaggccugcggggguaucacagucccugggggaaggcacagggcuugaaccauacaaguggggagcaagcccaggcacagcaaggggccucaugcaaaaggaccaacucuguugccuauucuccuccuuuggguuguccucagagccgucgccaaccugucaccaacccguacugagccucuaugugaaucagaauaaagccauccugucuagggaggggaauuucaucucugcuugccucccuggcuggcuggcugcccuucgacaguauacaaccugcacacuuccauguggagccuggcuuuuccucuuucagaggauucccuuaccauagccuuucuccccauaagccaggaagggagggauaaugaucuuccuuuucucuccagggcacaugcccagcagccccugguccaugccuuugaucagccaaccagagccgauguaggugucauaagugccuccccuacuguagcugcagagaauaaggcagagauccugugguuagaagccagagaggcagggcacaccagggcucccuucucuugcucccaguucccagcccuuaggacggccccuagcuucuaccuguugucaaaggcagugccauccagcagagugccauuguagugauagcgcacaaagucacuguucugcaccauucgggggcaguagggagggcgcaggaggauaguugacugcaccgugucugcuuuguuccacacguccagcaggaccacgucaaaauagaggguggcaucaggggggaugaggcccgcuguggggaagcagcagaggugggguuuacacaaguccacagcccagcuggagguccccauaccacuacuuagaugugggacuccuacucuaucugcuguaccucuggcuccagcuacccucucuccuaaccaagcggugacuccuguaccucuacacaggacucuguauccauccaacucuucucauuccagagcaaacugauggccacagcucccaccaaucagauggugaacaguaugaccuuggccuagucacucagaaccuuugagcuucagcaucuugucuaucccugccuccugcccccaugcucacauaccuuauacccguccccuggccuccuuacccacaccgaugcugccguagcccagguggggaggcacaaugaggcggcggcgcucguugacacacaugcccaugagaccccgguccaugccggugaugaggcggccuacgcccacaacgauggccaccagggugcuacggucauagcuggaggaggaaacgggacagauaagcaugcaugcagucacacaaugcccgccgcucagucuccuacacacacaggacacgaugcggacacaggcauuccuaacuuucucuuuuuuccccuccaacucucuugucugggcuagcccuuaugccccucuuaggauaacaggcuggcuggguaugguagcucacacuuuuaaucccagcagccugguggcagagguggguagaucucugugaguuugugaccagucuggucuaaauagggaguugcaaucagaguuacauagagaaacccugucuaaaaauauauauuaauaguaacauuaauauuaauauuaauaauaggcuauuagaagaaggaagucccagaggaggccaggagcauuuacuccccagcaagaggguggaguggagcagaccgaacugugugcuaccuauugcuacuucugauagcauagcucgggacuuacuguaugugaaauuaagcucuuggcacuuugcauucaucauuucacugaauuuuucuccccguggggguggguauugugguuuucaguuuucuuucccuuuucuuuauucugauacugggaagagaaucuagggucucccauauaugccaggccagccccaggcugcugagcucgacuccagcuguucuguuuggcuuugcggacucaucacaccaacucaggucacagcuccucuguuucuccuucugagcauccuuucuccaaggaagcagaagugggcgggccccggcgaggcagagaacagccuuccucggaagaaagcccauccuaaacuuacccuggcuuuugucuguuuucuuuuuuuuuuuuuuaaagauuuauuuauuuauuauauguaaguacauuguagcugucuucagacacgccagaagagggagucagaucucauuauggaugguugugagccaccaugugguugcugggauuugaacucuggaccuucggaagagcagucgggugcucuuacccacugagccaucucaccagcccuugucuguuuucacaagucaagagagaguucuuuucuuuaaaggaaagagagauuuguauaugugcguaugucugugagugugugcacaccugugugugcacccaugugugcaugcagaggcacccaaagggcacuggauguccucauccaucacucuauggcucgucguuggaggcagguuaucuccuugacucagugugcacaggaugcccagguucucaugauuguacacagcaagugcccuuaaccauuacacuaucguuccagucacucccaucccugcucuuggagucaggugucauuuguaguacuagcuguccuggaacuuucuauguagccaaggaugacccuaaacuuagguucuuccugccucugccuccugggugcugggauuacaacugggaugcuggaacuacacuuccagccccaagaaugggauauuaauccuuuuaaaaagauguaugucgggcuggaaagauggcucagcgguuaagagcacugacuguucuucugaagguccugaguucaaaucccagcaaccauaugguggcucacaaucauccguaaugggaucugacucccucuucuggugugucugaaaacagcuacagugugcuuauauauaauaauaauuaaaucuuugggccggagugagcagggcuagagggaguagggccgaccggagugagcagagguccugaauucaauucccagcaaccacaugauggcucacaaccaucuguacagcuacaguguacucauauacauaaaauaaauaaauauuuuaaaauauguauguguguauguauguauguauguauaugaguguuuugucuguaugucucugcaccaugugcaugccaugucuggugccuaagaagggcagaagagggagucagauccccuggaacuggaguuacagauuguuacaagccaccauaagaguuuucagaacaggggcuggugagauggcucaguggguaagagcacccgacugcucuuccgaaaguccgaaguucaaaucccagcaaccacaugguggcuuacaaccauucguaaugagaucugacucccucuucuggaguaucugaggauagcuacaguguacuuacauguaauaaauaaauaaaucuuaaaaacaaacaaacaaacaaacaaacaaaaaaaaaaaacaaaaagaguuuucagaacaaaaaccagguccucugcaagaacaaguggugagccaucucuccaaggcugggagauucuauuuugguugaagauauccaaggacuaaaaaaguuuuccaguuucaacauuuagaaacugugcccaagacaggcuuaagaaguccccaccagguaagauacccccagcucccaucucacuauugcuggaaggcugagcauggugguacacgccuuuaaucuuuuuuuuuuuuuuuuuuuuuuuuuuuuugguuuugguuuuuucaagacaggguuucucuguguagcccuggcugucccuuuguagaccaagcuggccucgaacucagaaauccaccugucucugccucccaagugcugggauuaaaggcgugcaccaccaccacccggcccacaccuuuaaucuuagcuugggagacagguaugccaaucucuguaaacugggaccagccuguucuacauagugauucucagggcagccagggcauccugucucaaauagggaggcuggaggaugucucagaguuuagagcacuugucacacuuggcagaauaugugaguucaagucacagcaccaacaugguggcucacagccauccagcccucuucugacuuccuccaacaugaggcaugcccccaguaugcauaccuacauuuaggcaaaagauucauagacauaagauaaaucucuuccaaaggcuacuuacugggcugugcucccagcucucuuccucaucugcccacagggcaggcuuuaugucuggucuauuuccuuuacagcgcuauauaaaagccaaugguacuggauggugguggugcacaccuuuaaucccagcacuugggggcagaggcaaguggaucuucgugaguucaaggucagcaugaguuuccuaacagucagggcuacacagagaaaccuugucaugauccacuccuccacccccuuaacaaaacaaaacaaaaaaccaaugcugagcacaaaguuucuaugaguuaaacaccaucagacuuaugguugugccagagucuacgccaauuauguccugaacccacuggaggccuggagguccuguggaagucacugucauucauugucaccauucaaaccugaggauguagguaguguucccaucccauguuucagacaagggaaguuaagacuccuccucugucacagcccgaauuuaaacccagggccuuacaaauauggagauggcauucuuauccacuguaccaaaaaaucucccuccagagucaugaccacuaauugccugugggcugaacugucuauuucagagaggagaccgaaaggcaacuugucuuugugguguagaguuucaagugugauagggccugaaguauaccuuguagccuggaaagaggcugccacacagcucugaucugccccccaaaaccaacggguaucugucuggccgaccaagguccuggaucagaauggaagaugcuggucccgucaagccaaggcuggcauuggagcgugguguuggcugcuaaagcuaagauggaggaacugaguucccagaggcuuggagaaggaggcacuaagaguccccaggauggcaugucagacuuugugacacguggacaguuuggucacggcaccagcuauggucuacccccaaauuauaaugcccacucugcuuaagacccucccuagcugcucuagggcccuacacccucaaggaaauguuauuucuccagucuccaaccacaaaggcauagaaaacuggagagagaaauagacagggagccagagugugugcaaagggaggcggcaccaggcagaccauccauccacucacuucaggguuuacguguaguaggcacagucucuuugcccucuaagauugcgugccaggguaccauuuguguuuaaguuaugguaaguauauguggcgcuucaccugagcaucaaauauuccagggggcuaggagggggucgugggcgggggcgggaauauuuuaggaauugaaaauuugguauugaagauaggaggcauccuuugaggugcucuccccaggaugcuguuuguggcaaaggauuaugaaagcacuacaggaaugcaaaccuuagaaggggcaacauucucuggaagcucaggaaaguggugcugaguccgggagugcccaagcucuuaccuggagucaaacuuuuucccgucuucgaaagugccauuguagugguaacgcacaaaaucccccaucugcacuucucggggacaggcccgagggaugugguaucucucgaugaccacaucuuccaagggggcuccggccgggcuggcacggcccaguccccucuccaaggucuguagaagcaacagcaacggcaguaugcggagccgauggaggguguggcuggaggaccccacaaggaacauggugcccagaccagggacgccggcagugagagcggacgccagccgcuagccuccuucccccuccucucagagcugacucccccccuuccuguccucucuccccaccccgcccuggcggguccacguggaaugggggcuggggagaaugagcuggccgggcagggugauguuuuauggugaacuaggaggugggggccagguugagagucucuggaguccaaggaauuugccacaaagaucucugagucucccucccccaaaacuccauccgggacugagacccggggccuggcccag

SEQ ID NO: 6377 - RNA, 4578 nt, Mus musculus
uuuuuuuuuuuuuuuuuuuuuuuugagacauggucucacuauguagccuugguuggccuggaacucacuagguagaucaggcuuuggccauauauagauccugagggacaagcuuccaaggaccaagaagcaguuucagcagcagcuguuucuacucccuccaguucucugcuuuuguugagcugugacaaugauguuggacauucacuuccucuaauucuuuauauuuauuauuguuuucuagagcugcuauuuuauaguucauguucaugaucuuuuaauuuuucaguuggauuaggaauaucuuugcgccccauucucucuuaguaucugcauucuuuguugcauauggcauuggaggauuaaccauuuucuuuugagccuuguauagguugacauauugcuuuugcacuguuuuugauaauaaauuccuacucaguacauuggauuuuuuuguucauauguagauacuuggaauauacaauuucccauuuuucuaaucuggaucuaauuuguacuuagucucugaacucccuugugcggggcuuuagacuuggcacucucacccuuaagcuuuuguggguaaucuugaucuuguucugugacuauuucaaauuuugauaucauuuaauucuagauacaguauugauaaauauugauauauugauagauguagaaauauuuuuucuccuguuuuuguuuugaugcaaaucucaaauuagagagaccuucccucucacuuuguaugaucuaaccuguauucuugcugauuuuaucuuugauguuuuuguuuuuugagacaaagucuguuaucuuggcugaccuggaacucucuuuguagaccaggcuugucuggaauucacauagauccaccugccucugccugggauuaaaggcauguccugccaugcugggcuugauggcucuuuaguacacuaauuuccauuuucuacuucuucaguuuguuuuguaaguaguaguucaugguguuuaguuugucuuucauguaaauugacuguaucugggaccuuuagaaaagagacauuagcaccuccucaguuacuggcucagaugacucucauuggggucguccuggcucuucuuucuuuucugauuagucauuccuuccaacuuaccuguagauauuuucacucccaucacaucuuucuaaacacuguuaaugcuggauuggcucugagauugugugaauauucuucguauuaagaaaggauuuccacauugauauuugauauaaccuugaugugaucuauuguaaucaguccaaaaacaucuugcauaauuugauucauaagagcauucaugaaggcucuucucuccuuaugucaauagcuuguacauaagcauaaguucagcuauaauuuucacugacagccaguguaaugcagucuuuguuucuuuaguauucacuucauguucaaagguuuuguagauuggagaacacaguugcuuugagcauccaugauguuugggucagcacuguuccaguggcauagaggcacacucccuuuuugacacuguagagucuucaucagaucugugcagccacuauucaaggauaaucauacacacaagcaauauauagagcagauaggaguacagauaauucccaagaagcugcaucacugaaaagucccaucaugucuuggacuuugaccucaugggagucacauuaaggaauagccauuuuucugacuuuauauacacuccugagcuuuuuaugcaaguuagcauucaagcuaaaucuuucaacacucgguguagagagaagacuucuguuuuagguacuggagagauggaucagcaauuaaaggaacacuugcugcaauggguucccagggcccacuucauuaacgcagcucacaagccuaaagcuaccuucaggggaucggguaccuuugguaccugcacucacacgggcauacccacauucagacauacauacacauguaugcauaauuaaaaguaagcuuuucauuucaaaaaggcucuuguugaaguugguuauggcaguauuuaccuguaaucucagcauuugggaagaucaggaguucugagccagacuaguuagcauacaugucaacaacaaaaguguaacuaauaauaagaauaaaaacacauaaauaaaaaauuaacuccugauagcacuguaaauccaauuuuuuuuucuauaugaaugucuuuaccuucucacacauucuggacuauucugaaaaaguuuaaguacuaucaucugugccucccuuauuccauuagaguuaacuuuauuauaugauagaauaucagaaacacaaccagaaacuuuggcuguuuacuauaacacuaaaugcucuuggauuccauacugauaacuuauuucccuggaguuaaugcuaguguucuugccuaggauaaagguuuuuaauaacuguauuggaaaucugcuuuaaaaccauuuugagacuggagugaguaugggaaacugcaagucccuuuccacagaaagguucuauucuccccuuucccuaacucuuuugaaauguucauccuuggauuucuuuugguuggucggucugcagugcugggaacugagcgcagggccuuguacaugcuagggaaacacucuaccaacugaguugcucccccagcccuuucuguagcucccuucauuacaagucucugaauccuaagaggcacuccuuaguuguaaacuaagucugugcaacuaacagucuuugaagcucugugaaggaagcuugccuuucucucaguccacaagucauuuaggaucucaucaggaugccagcuuucuccgggaaaagauucauguauuuugauuuuggcuuuuuggucccagaguuguauuuugggacagucaccauuaaguuguuauuagagccaucuuuguguugucuuuucauuucauggcagacaguaugacuccuaacuugauugaaaccacugucuuuuuggcucagcaggcagccuaggcccuggcugaaugaagggguaaguccuuccuugcaugauggugugcagguuuccugacuaccaacuuucuaauuuucauaugugaauucacguguguggcuucaccaccauaacuugccuccuaaauacuuuuaacuuguuaggaaggaaagaaccuagacuugcuuaaaucuguucaaggcugacauucugaaauuuuaaacggacauaacagcauuuguaauaauaaucgugcaggucuaauguggcucuuugggaaagaaauuucuuuuaugaaaacaguuuuuuuuaaagccagcuuuuuaaaagcuuauucaagugaaccuuuguuguguagcuuuuguuuucuuagcuggaaaaagauuugauuacaccaaaaaguaagggugguccauuauugugaguaaggcuaacuuuccacauuauaaugggacccuuccuaucuuccuuucaaacugagaaugucagucaugaacuuuuaagcggucaucacuugcagcuguuugcaugauuagucuuguguauccugagagcuuugcuuuucugugccaguucaaaauaacauuuuugcuaagaacauuuaaaauuaacugauaucaguuuuguuuugauuuaccugguuguguguaguauuuccaggaccaaaaauuuaaaacucucagucuaaaaagccagagagagcauuucugugcuuuaauccugucacaacuaguagacagguucuugugcacaccuuccccucucugacugcagcauguguguguuugaaauaguuccuucucugcuucacgauucuagugucaacacuauaaguagacuggagcuguguuacauauuuuagcuacacagacuaauaaaauacacaggaccuugaacuaaacuuaugugcaaaggccauauuagucacguuucgugucuuugaacauguaugguguugugaaacgaauauucuucuacacuagaaaaauccggugcuucaaccuuagaauauuugagcagcaauucagucuguucuuagccgucaaaccuuuuggcacagcucaucaucuguuacuuucuugagaaaaaucgauuuuguuguuuuacuuacagcauauguucuggugauugaaaaccaaacaguuauggaggguuguaauacaacaauaguauguuuacaaaguggucuuuugcugcaaggacuucacuuagccaaauuacugcucacugcaacccucagagcuucccgcuuacucucugacccuugcuaggagggcgggaccuugaagcaccuguuaaucuucccccuccugcuuccugcacuugugaaauucaaugcuugcuagguguuugaagauuuuaccauccgugggcuggggcuuguuguguuaccuguaaaauaaguauuaguuuauaaacaguuuuuuugggcuagugguacccaggccccuuugcaagauuuaaucuugauuaucuccuuuuauguuagaggagauauaguauuuagaacacucuaagauauguuuuauguuccugaagcuaucuugcucauguuuaagauacuaauuguuuaaauguaaguuuucaauaaacguauuucuuuagagcugc

SEQ ID NO: 6378 - RNA, 10816 nt, Mus musculus
uguagaaagaaaugaugaagagucuauauaauauucagcggagcaaaaaacaaacugaaggcauccuguguugauugucacggcacacugcauccucaucaacacaaccauucaaaguguuucaaauguuuguucauuugcuuucucagcuacacugagcacuucucuucaccuguguaacucccucuuuagacaacuagacaaccagguaaacauuaauaccuucccaacuaucaucucaggaugauggcuucaagucuauaaacagcugugaaagaaaccaaacaaaccagaggacgugccacucacaaacuucucauugucacccuuuccaaugaacaaaaccagcauuugcagauacagcaaagcaucagggcuccauucugagaucauccuugcugaaacauugugcuuuaccuucagauccaguuucacuauugcacacgucucuccuacagaugagagcuuaacgcauaaauugguaucacugaaaacaaacaauccauaaaaaacuuaaaggagcaucaaaguaaaugugcaaauaacacuggugcuuagagccccacguaagucccuaagacaaaggaguuagugguuggcagaaaaaaggccaaguaacuagaccugcuuucccccacuucucuuuaauaagaucuuauuuaccagcacacaaacacaaaccaaagucaggacugcaaccuaacaaaaauuaccacauugaacugaguuucuauuuguuuuuuaacuauacuucuuguauauaggguaauaaguccaaguagaaaauaagucauugacauacuuuuccaaguaacaguccaggcauccccgccucacagaacagggagaacaguuuucagcugcaaacgcuggugagcucagcauucaaucugggaacuuggcacucuccgcauguucagggcgugccgauguaucucuugcaucugucggaugcgguccuucugccacauuaaauuuugaggcaugggguaucucugugugccauguaaguaccgguaagggauccugacauggcaagcaguggcccugcagcggggcugaggcauuggaggaaggagcauccaccucuuucucucagcacaguaucgguaggccucuuuccuguacuguuugucaauaucaucacuguuuuuccagccuccaauaaugaagacaucaucucuguaauagcaaauggcugcuccuucgaugcuuaggacuucuggaggcaagcuuucaaggaucucaucagacaccugaccggcaauuuuucuuacugcuucuucauuuucuaaggaguaacucuugggacagcaugaugcugucugauaaaaguuugaauugaccacagacaucuggaaaaaacaguaauugucaauaagcgguaaagauuccacaucuugccacugucgagucucuguaucauagcaaguaauuacagccuucaguccauccucagugucccgguccacgggcgugcgggcagcaauguacacaaaccgguccucaauggcuaaugcuuugacaucucgcagaaucuuuggugcugacucuaaguugugccauuuaucaagcucgggauuguaaacagucacgucuuuaaagccagggcuaaaauugccguguccuccaaugcuauacagcuucccuuugacuucuguuagcccaaaagagugcuuucuggucaucagacuacaaacauguucccauguauucagguuuggguuguaucuuuccacaguuuuagcaaacccugguuccauggagccagcaacauacacguaggacucuguaauugcgacggcauguccaucaaggugguuaugaauguggggcagauugacccaccuauccucaucaacaaaauaucccacacauucacuuaaguagucuccuccuuccgacacuccuccgauaaccaugauuacguccauguuuuguccauagcgagguaacagugagacuugugaagugggcugcugcaaugugccagacuguauauucucugcucugagcgcaugccucuccacugcuucugccaccagcuugacacaaacuucauuauuggccacuagccgcucugguuugacaugccguguaagguagguggguuucaucugggacaaucugagcaauuuaaaaagcucuucaaaguaucucucucucucuucugcauuucucugaacccacuucaaaacuguuucaaaaagaaccucuucagaauccacagugauuuccaaguccgaaagccagucccgaaugagauggaaagguaaaguguaaaauuccucauccugaaugacuuuauagaaauuucuccguaucauaucugcagcuuucagagcaagcuggcucaggguauacaugugggcuaagcuaugaauggccacacaauucgagagaugaaguuuuuucuugagaaauucuccacagaauucuuuuaaacgaauuaauaagaaucuagaaucaagaaaaaagagaaaagauugauuuuggaauauauauguuauauaguuguauguguaccugaauuauacaaauuaaaaugguaggauuaaucuuauaaacacaagccuggaaaaagacuacccucccucugcaaauuagcaaacaguaugcgggaaaguauuuuuaggagggaggguuugaaauaggucucucuaugcagauggcucaguggguaaaggcacuugccagaaaaagccuagagauuuuacaucccuaggacccauguugagguggaagagaaacucaugucacaaaauucuccucuuaccuccagaugugcacugugguacccuauauaucauagacacacaguaauacauuuacaggcaugcgccucucaugcuaauacucaggagacugagacagcagaaucacaggguaagggccuaccugggaaacuuagugagacccuuuucaaaauuuuagaaaaugagaaaagggagcuggaaggauagcuuagugguaguucuaaugaucuuuuuuauguuuuuaagacagggucucacuaacucuggcugucauggaacacagauccaucuuucuuucucugccuccugagugcuggaauuaaaaacaugugccacuaugccuggauucuacugucuauauauggguauuuugucugcaacuaugucuguguaccacauacauggcugguacccuuggaagccagaagaugguauuugaggacuugaguuugguuccuagcacccauauugaguuucucacaauugccuaacuucaggugggaagagucaaacaaccucuucugacauucuuguacaucugcacucagaugacuauacucucacacagauauacagacauguacaacaaggacaaacgccaauccaaaugccauuucugacauccuuucuaaucccuuugcagccauuggaaccuuuuauuuauuugccuuuuuuuuuuuuuuuuuuugagacaggucaggcaugcacuaccacucccaguuuuguguuuuucuugagaaagggucuuggugaagaagcuuuaucuaguaagaccauacagucuaaacuagaggcaggcaggaacuaacuuccuagagacucugcuuggucagauaucagaaagaacagaagccuaggagaaguucuugucucuuccaucuuuuuaggcaaccacaggaaauauaggaucuuuucagggguuuugcccaaggcuggcuaucauuaaaacaagacaagauaaacucaaauaucugaagccaagaaacaaaacagacacacaacaaaauguguaugcaggugucuuaguuaggguuuuauugcuaugaagagacaccaugaucaaggcaacucuuauaaaagacaagauuuaacuggggcuuggcuuauaggcucagagguucaauccauuauuaaugguagaugcaggcagacauugugcuggaaaaggagcugggaguucuauaucuuauuuggaagguagccaggagaagacuggcucccaggcagcuaggaggagggucucaaagcgaacccucagugagacacuuccuccaacaaggccauacuuccuaauagugccacucccuggggucaagugguuugauguuacuaauagaacauugcccacccaccuaaauuuauuuaaguuaaaauaaaacauaacaggguauuuauccaaaucauaaauuugguaguacuuagcucaaggguggucaauuugagaccaugguuauaaaagagaaagacccuuuaauugagaagaaccuuaaacaaucuaagaaugucaucaugaugacaucauuuccaucauucaucaugacaggcccauuuccauucaauaaugguuuauuaugguuacugugcuuaauaacuacuuaacuauaaauacagauaaauuaagauaaccucucuuaacccucuugaagaaacauugcaaccuuagagaugaaaacaaagacaaagagagugguaagugaagguucuaggcucuagagucuauaguaccccagacaagucugggugccagggccaccugauucccaggcugccucuacagccuauguuuagcagauaauucugaagcagauuuccuuaagacagguuuugggaaacauuacucuauaaaaacaauagcucccacacacuaggcauuguuguaugagaagcacugugcugagcauauaauauuuauauuuauuuauuaugauaauggggacuugugguuguuugaauaugguuggccacuguaaagcagcacuguuaugagguauggccuuguuggaggaagagugucacuauggaggugggcucugagggccugugcucagauuucgacuagggucaaagaggccuccuccuggcuguuuguagaugccagacuucuguuugccuucaaauaaagaugcagaacucucagcuccuucucaaguaccaugucugccugcaugcugcagugauuccugcuaugaugauaaugacugaaccugugaaccuguaagccagaaccuguaagccagucccaauuaaauguuugccuuggucauggugucucuucauaacaacagaaacccuaagacaggauucaacucaagccucacacaugguagguuggugcucuacuguacaaccccucucucccaccuucucuuuuuuauggcaggaucuaauaaguugcccagguuggccucuaaccugugauccuucugccucagucucucagguagcugggauuagaaugcugagccaagagacucugcuuacccuauuauuucuaauccaagugccauguagaccuagaucagagauguauauguagacagagacaaaugauccugccucagagaucacuaaaauaaguucaaucauuacagggcacuuagaauggugccuguagggcccagagugagagggagaagggaagcugggguaggagugugggaauggugccugugaaagauggagaaaauuuugauugauauauauauauauauauauaaaauacuauauuuuugagacaggcucccucuguguagcccuagcuggccuugaacucucugccugucucuccuucccuggcacccagacuugucugggguacuauagacucuagagccuagaaccuucacuuaccacucucuuugcuuuguuuuuaucucuauguguaaugaguaaagauuaaaagcauguucuacuacgucagcaaaguuagguuuuuguuuugguuugauuuggugguuuuuguuuuuuugguuuuuuuuugagacaggguuucucuguguagccccggcuguccuggaacucacucuguagaccaggcuggccucgaacucagaaaucugccugccucugccucccaaguguugggauuaaaggcaugcaccaccacuguacaacacaguuagcuuuaaguaaauugccugaaguagucucuccuuuccuuacuccucaaaaaggacuaacucugaaaaaagaaaaaaaaaaucacaggcaaacacaacuugacaauagcucuucuuuucaguuucauucucccagucuuauacccauuccauccaauccugaggauccagucugguacucugagaaaagaagcaauccuguggguagggguuuuaccuuuccaccaauuugucuacaguaaaguaagaaaauacacuauauuuucuuucccauuccacucaugguuuugagacagucaagacuccauguagucuuggcuggccuggaacuuaagaccuccugcugcugucucauaaaugguaugauuaaaggcaagagccaccacagcccagagucaauccuuagcauucaugagaaagggucucuggacuuuuuaguccagacugaccuagaucuccugccaagugcuggacacaggugugcaucauucagucucuuacuauaauauguagucugaucuaccuugauuuaaaaaccuccuguguccauuccucugcucuuauaguaucaguuucuccucuuccacaaucacuuucuucggcacaaaaacauguuccaccucuccuauuuuagaguuaacuaaguaggcacucuaccucaaauccaauccuuuuucauggaaacauuuaacucaaugaugucaucaccaaccuuuaaugauugaucauuugacaguagacuccacccccuuuuuaggccuccaugguaucagcucaauucacucugccggauucuuuaaugcuguacagacucuccuaccugccuucuuuccuuuauucauuuuuaauguguacucuuaaguaacuuaaucuauucuauggcuuuaauuauaaauuauaugcuaguuucccccaauuugcauuuaucuugacuuuuccaucuaaugccuacccuuuuuucuggcuuugagacuggaucuccuauguagcucugccuguccuugaaaucagagauccaacugacccugccuccuaagcacugggauuaaagguaugcucccaauuuuuuguuuguuugagacaaggucuuacuauguaacccuuggcuguccuggaauucauucuguagaccaggcugccucaaacacaaagauccacucaccucuguauccuaagugcugggauugaagguguauguugagccuccacugccaccaucucucuuuuuauuaagacaggauuucucuauguaacccaugcaggucuagaacuccuguuccuccuggcuaagccucucaagaguuggaguuacaguaaugugucacuguccuuggcucuuuuuccaguauaaucucaguguuuggaaacaucccuauucuaagacuauguuuuaguguuuugccugcauuuauguaugugcuccacacgugugccuacugucaacaucagaagagggagcuggaccccgaaagugaaguuauagaugguugugaacugccaugugaguuuugggaacugaacauaagcccucuggaagagcagccacucuuaaugguugaaccaucucuccagcuccuggaaauauccuuuuuuguuaacauuguuucuccuuguguuuucuuucacagcuuaacuggagaagcaauguccuucaaucugaagcuuacccaguuaucuggaccaugcucacugaccuuccugucauaucugaucuucuccacaucuuuuguauauuugaguaugaaugcaggcacaucagaugucuuuccuugauuaaucuccacccuuuuggaucuaaauuuuuuuuuuuagagauuuuauguuuaugaguguuuucccuacguguauauuuauguaccauguaugucugaugcccuugauggucagaagacaucagauccacugaaauaguagguacagauaguugugagccacaagguuggggcugagaaccuaaccaaccuuggucuucuguaagagaaacaagugcucuuaaccacugggcugucaguccagccccccaccuuauuuuuccagacaaggucuuucacuggaccuaacccauugugccagacuggaaucagucuguuucugcucucuuccccaaggcugggguuacaggaaugcacuaccaugcccucaucccugcagugcaggcauguuuuccacaucugggccaucucugaagccucuauuuuuuccauaucucuuuugaaauauaaggaggugggacaagucuagcugagcuggauauguagaccaggcuaaacuaaaauucaaagaccugcuugccucugcuucccaaggguguugggauuaaaugcccaaccuuuuuccacacuguaacaauaaucugaucuuuccaauugcuuggguuaaaaaaaauucuucuggcuggcuagucaguagaggcacaggccuuuaaucccagcacuuggggggaagaggcagguggaucugaguugaagucuggucuacagagcuaguucuaggacagccaacgcuacacaaagaaacccugucuccgaaaaaaaaauuuuuuuuccuuacuccugugucaagcccaccaguaauucaucuccucuauuucaaaacacagauggccugcagagauggaucagcaguuaaaagcacuggcuguucuucuagaggauccaggcuuaauuuccagcauccacauguccucuuucugcccuccuuaggcaccaagcacugauacuauacauauauacacacagguaaaacacccuuauacauaaaucccaaagcauacacacagaugacacaguucucaucaccucccuucuucaauccaagccucuaccacuauugcaaugaccuagucucugcuacagcucuugccgcacccuguccugcccuuuuuuugacauggaauuuauuaaguaaaacagaaucauucucaaugccuucuaauuuuagaaaggucagcuucuuucacaggcccaugaggccuuaaggcaaagguucuuaacauguggguugugaccccuuuggggaucaagcaaccccuucacaggggucaaauaucagauagccugaauaucagauauucacagaagcaaaauuaguuaugaacuaggaaggaaauaauguuaugguuggggucaccacaacaugaggagccguauugaaggguugcaguguuaggcagggugagcaucacugcuccaagggacccauccauccuccccaccacuuggaugcuuuugcuccucucauccugccuccuucaugcagcuauauaacccacgcuguuuucucccucuaccugaagcacacuaccuugccaccuauaugccuuugcuaugauuucugaacauucuuuaugugcccaauuuaaaaauaguuccucucagccuggucuauagauugaguuccaggacaaccagcauuacauagugcgaaccugucucaaaacaaagaaauaaaaaaacaaaaccuccucuccauuagggccuaugacgcacagucccacaccucagucugccucacagcuguaauaauuauucaacaugcuauauauucgcuguuaaacaucagagaguuugauaaggaaaaggauuuucauguguuuugaucacugcuggauauacccccucccccagcacuguaacgaggucagugucuagcgcuccagagguauguguuaaaggauuuguaacaguaccagcaucuccaccugccuccgaaccaaccucuguggcguccuuucuggcuccccacaauccauuuuccacaauccacuuuucacuuuugaaauauuuaaauauuucguauuuaaauauuaaaaucagauaaucucucuacccaguuucccauccaucacacucaauaaaauccaaacauuccucacacacacccucuggucuuuaaacccagcauauccggaaucgcuggauuuucuuuuuaacguccuuucuucucuaagccagccuggacccugacugaggccuuugggaagccuguaaugugcacccauucccuuuuguacggccaauuucucuugccacugcgaagcugguuuaaaugacauuuccuccgauccguagcuagcccuucaccguuuuuuaaaugucaucaucacaggagucgaacacgacccaccguuuuucaucgccuuugucccuaccaccugaaaucugcgcucaggggugcaaugcgcacaagcuagacucucagggggcauccucagugccaggcgcgguggcugucccgucgcgggcauaaugagggagcuggcaccacagacacugccccccaccccccaacccagcccucgcucgcccacggucgucucaccugucggccagcuccagcaccucgugcacgcugccggugcucacucggaugcggccgguguacauguacucgauaacggcuuccaccgugucagguucggguccgggcucugagcuccacuugcgcaucuccacccggcccgagcgcgauuccgaaaacugacccgagaguaagggcgugaaguacucgguggcagcggccagcaccgagcggugggcacggaacucgcgaccuccggccccgccgaagcacagggugaugucgcagaacaggccuugacgccgcugcucguucugccgccaggacaacucggagcagugagugcugcacucgaaguccucggccucugggcccggaucgcucccgcccgugucgacgaggguagagaugccggccccggucacgaagucuaccgugccacugccucggaccucagcggccaggcucgcggaaccggcgacggcagucuccaugcucuccaucuccagcacuugaaaagaugcagccgcggccgcagcggcagcugccgccgccacagccgccgccaucuugacgccgccguaccggcccccucagcuuccgaacggugcggcaagucugaugcgacacagaggcauucug

SEQ ID NO: 6379 - RNA, 41192 nt, Mus musculus
agguccuucuaaagggaaacuuccugacacaggcacccggggagcgccaguaaucgccccuuccuccuccccccagaaagcagagauccagagguaagccucaaaggggucccaagcagaaaccucuccaggagaguuuccugucgcucaucuccaccccguggugugagccuuuuaguaagcgacacucgagaggcugccagaggccgccgccacagaguaccccugaagggcaccccucagaaucucagaggcaaucacaggacaaccaaagugaauccgagacagaggccgcgcugagcccugccucccagcuccauaccucccggguccccgcagcacucccgcugaggugccccccggagugggccggaccaugggaggggcagcucgaccguaaagacggcccucuuccucuggguggaaggacugacccagaggucccgccccgcaacggccagccuucaagacaacuuccggcggcguaaagugagcgcggaucgcacagcgcccccagaggccggcggggaaauacccaccagaacuugugucugguuauuaagccgauguuccaggcucugacacuaaaauguucucucucuaaaagacagugaccagugacguuucguucuaucaucuaugcgacaaguuuucuuuuucuuuucuuggcuaugcuaugcuaugaauggaacccaggaucgugcacauacuaggcaaaugcucuuugagccucaauuuuuuucuuuugauuuucaagacaggguuccucuguguagcuuuggcuggccuugaaaucacucuguagaccaugauggcuuugaacucacagagauccaccugccucugccucccgagcgcugagauuaaaggcacaugccaccacgcucaacuaaccaugcaauuuuuuugaacuuagaauggaggcucacauuugaaucccagcacuugggagggugaaguagggagauuuucugaagacaacauagucuauacagagacccugucucaaaaacaaacagacaaagaaaccaaacaccccagcaccuacuuugucuuguuugugccuuaaguagggccauauacaaaggaaaagcuacaaguuagaaugauugaaccauaaauucauugucuagaauaauuagccagccaaaguaacaauuaaaaccaaccaugaugaaugcuguuauugaaguggggugcuaugggcauggcagaggggcauuuaacuuagaggugacagguaccaaagaggagggaggaaaggggggugucuguguucauguuugaagggccgaauagcacagagauuucugaagcagaggaaauacaagaaccaugacauuucuuguaucagucuggguucucuagagucacacaacuuauggaaugucucuauaaauuaaggugauuuacuguaauuacuuacagucuguauucuaacuaacccaauagugggcagcugugaaugagaaguucaagaaucuaguaguucucucagucccacgaggcucguuguuucagcuggucuucugccuaagcuggaauccugaaguaguagguuccaacagaugugcuggcaaguaagugcaagcaagcaaagaagagugaaucgcucuucuuccaacguccuuaugaaggccucuagcagaaggugugucccagauuaaaggugugugccaccaggucuggaucuggaacuugcuuuguugcaggcugaccuuacacugagaucugcuugccuccaucuccugggauuaaaugcauguaacuaccuuaccuggguuuaagcuuuuccuggucacuauuccucaagaucuccaugucaagauccagguuagaaaccuguguuccaaccucaagaucuggaucacaggugugcccugcauuucuggauuguaguucauuccagauucggucagguugacaagcagggcuagcuauuacacagaggaaauacaacaagguucaugacaguuuuggagccaggaaucccuaggggcucaguauugauugcagagacuagccaaauaaugaagaugugugggaggccagggaccaaacaccacaauagcacgccauugguaaguuuauuacagggaaaugacacacuccauccacuuuugcaagaaaggucauucucucggaagagccaaggcuuggcaaagaugaaacugaggaucaguuaggagacuauuugcagucucuaaguuuauuguuuaagaguuugggaugaaaagacuugggggaugugugguguggggacaaaaagcauugaugacaagguuucaagcuaagggcagugggucugugugauuuaccccagguuucauguugaacagaugaacagaagaaaucuaacauaagaaauucaggaaggaagaaaaaaauuguuucccccccccccguuguugaaaaaugggugaaaaauuaaauucguuaauuaaggcagugguucucaaccugugugggucaugacuuuuuuuggcaaaccucuaucuccaaaaauauuuacauuacaauucauaagaguagaaaauuuauagcuacaaaguagcaacaaaaaauaauuuuacggcuggggaucaccaugacaggaggaaccauauuaaagggucacagcauuucaauucacugagguccagcuaucauucucuauccaguggcccagguaguuuccacuccgucaguaaugauaaggaccuacaaauaagguuagggacuuugacacacacuuuccuuaagggaaauuuaaauuccauugucuuauuuucguuccuuuuggcuuuaaauuacaauuucaaggucgucuccuccccacauuuaaccucagagggccucaauuuaauccaacacuguugugugugguagugguacuacaaagauaauuaugcugucuucccaauccagacaacaucuggccagacaagcgugcuggguagaguuuaugagaaguaggaguacaggggacacugaggaaaagggaccucaccccaugagcugccuuauaaacuccggggcaggggcuggcgcgccaugucauccuuucuaggcuuaacgcugagauggcacucccaagcggcugacaugaaagcagccucauaaaaggguccgcgucauuggggugaugaaccaguuggugcuuagagauccguggaggaugaaaggagcagggugaagacgcccugcguuccccucgcuugguugggcagggcuuccaggaacugaugaagcuggggauugggcucaaaguagcucuucaugccuuuccagggaggaagcuguggacacacugcaaagucaggaagguagucuuggggggggcuuuucuuccucaagugucuuggggaccccgucuccacccaccagggacucccaagcguuaccggaggcucucuaggauugcuaguuguuauggcaaccgggcuguagggauacugaggcaagcuuaggcccagagaggcaaccuccuucuguacccuccuccuauucacggguaaaguggcgcccccuacgcacaggaaccgucccugggcccccgccccagcgcggagaccaccguggaccuccagggauggaaggccgcucuggccccaagcggagccucucguugguagacgggcucgagggagucccucugggcgcggcgccgccgagcggcucgaugcuccgaccggaagugcucuacaccgucugccucccacccggcucucuggucccggcgguaagauggcggcuaccgcggagugcgaugugguaauggcggcgaccgagccugaacugcuggaggacgaagacgccaagagguaaccaaccgggugguagagucauggaggagacgagcuugcagcucguggcuuggggcagguggacccgccagcgaggcagcccccagaugcagagacgauggcucuccugcagacaccccccgcccccaucugagcuggagucgaccgagaucccucugaagggguacacuuagggggucugcuguccccuucugcuuccgccuagcagggagcuugaggcauggucuuguucugccgcggggaggaagguggacuucaucguggaggccggguucccgggcgggggcggggggaaggguaggaaccccagaggucggcugcagagugggggaggcgucgcggcgacaaugacgacuuccuuaacagagccccgaccuccgcccgcucugguuaacuugugugcauuguugcccguccugacuggucgucuccgaagcccgcauucuccuccucacuucccuuuccucacuaaugacccuuaguggucucuagugugaggcugagagaauuggaugcucacuguauggaccuggucgccccccacuccccgauagccguagaaguuaagaauggauagacagaagggcgaaugaggagcuugucucuugcaguacgggggcagacgcuucuucgccauuccucccaagagcauucuuaagcucaaggagaacagcuguuuaaaugcaguuggcacugcugggcagcugcaguggcucgggauugcuagucuggccuagccuagggaggugcugagugagugguuuuucucgaacacuuggugaauuccgacaccagcuuaagaacggguuuucaaagcggggugggguggggugggguggggggguuagaguacgcuugggagcgggcgggacuuguucugauaccaaaggugaacugauucuuuuaucaguagcaugauuaauuugauccuuuucuuaggauggacuacaguccccuuacucuccuucccuugugguucauguucauaccaagccuguagggaaugucuucaggcugaauaauuugaacagagucaguucaggaggucuagaaaucaggauucugagggguuuacuguccaaguuagacuuauaagcgguacucggagagauacggggaauauuguagucaucagguguaugguaguaccugacuugaaagcugagaugcuagacaaaguguaguugaucaagagcuaucaaguuuagccuugccuccuccuccuccuguuugaguuuccaugucauuacagugucuggaguuaagcaucauccgcuccuauauaacuuaagguauugccaaaugagaacggaagccccucgcuaacacaaacagagcuuacauuuuauuuuacuuauauuuggaaagaauuuagugcuucuuacugcuauaaauagggacuuuggcuauaugucauuugaggaaucuauccuacucaaguguaaaucuccuguagagagugucacugauucggacuugaaacaggucucuauguagaccagccagucuugaacucauagagaaccguucaucugccucugccucccaagugcuggacuaaaggugugcaccgguuacacuaggcuaacuucuguguccccucucuaaagcaacuccuccuuaaaagaccagauuagcuuuagaggguauuuugucauaaauggucauaaauguuuauggacagauauauuaaacaaaggcugaguaugguagcacacaucuguaauccuugcacuugggagucaaaggcagaaagagcuggaauucaucagucuggguuuuauaaaaagaagcuagacguggugcucaccauaauccagcacuuggaggcagcggcaaucggacaaggucaagggcagccagauauccacaguuuuaggcuaggcagggguguguguguaugugugugugugugugugugugugugugugugugugugugugagagagagagcgagaacauaaaacaggaaaacaaauaguguuacaaugcagccacaucauguaaagcaugguauuugguuaacugauuuuuuuuuuuuuuuguggaauuuaauguuauugauuauaaaauaguuauugggacuggagagguggcucagugguuaagagcauugacaacuuuuccagaggaccuggguucaauuuccagcacccacauggcagcucacaacuguuuguaacucuaguuccagagggucuggcucucauagacauacaugcaagcaaaacaucaaggcacaaacaaacaaacaaacaaacaagcaguuaucuacuaccaagucaguauaacuguaaauaaaagugaaaauugcauucuuuuuuuuugggggggggggguucgagacaggguuucucuguguagcccuggcuguccuggcacucacuuuguagaccaggcuggccuugaauuuagaaaucugccugccucugccuccgcuaccacgcccggcugaaaaaugcauucuugcugggcggugguggcacacgccuuuaaucccauuuagcacuuaggaggcagaggucagcagauuucugaguucaaggccagccuggucuacaaagugagugccaggacagccagggcuacacagagaaauccugucucgggacaaaaaaaaaaaagaaagaaagaaagaaagaaagaaagaaagaaagaaagaaagaaagaaagaaagaaagaaagaaagaaagaaagaaaaaugcauucuuaacagacguguaauauauauuauggaguuuauauuuuagacguacuaaagcuaauuauuuaguuuuauauguucauuauagaccaguucuguauauaauauaggaagaaaauaacuuaaaucacuuagaccucuacugugucagaccuccuuaggagagugagcauuaagaucuauugguauggaaaacgugucauuuuccauuguugaagacagaguagggaagcuguagcaggugauggggaaggacguagcaggugauggggaaggacgucccccgaagcgccccuuuguugucuggcauuguuagaacccuuuggcuaagucucugguuauauccuucuacugccaguucacugaggaacacaucagccugugaggcccuuggaugguuuuuugaggcccaacagagauccuuccuuccugauaucuugggaucuaaauggaucuuacugcugcugaauugucacagucccacagaggggucagaugagaggaaccucgagacacaagaccucacgacugcagccuuuucugaggcugcaucuuauuucuuuaguuuuaauguguccagagagaaagagaccuuagguguuugcauguguuaguuugucacaagucccacagcagccacaaaagcagaguaaaagacgcauugaaaaaguguagagcaguccagaaaaaaaagccuccacucacucgugcgugcacgcgugagcacaccacgcacacacgcacgcacgcacgcacgcacgcacacucgcacacucucaggucccacugagacuccauuuguuucuuauuucacucugccccuuguuaguguugaguauggaagucacgucugguucauuccagguagucuaagcacacuccaaaauggaaguguguguguaucuguguguuggacaacuuuggaggcuaaagaacaacguuugagaauuucaacauugaccuaacuugaugccuuugauguuccugggaagcugcuggacacuuuuucuaauauacaaaaccugucuugaguuaaaggucucugguuuuuggucucuguagauaaagcuuuuaucaugacauauugauugcaagcaggucacuaaagaggaagcgugucuguuauucugagucuggugugacuggacauagaaauccaaaagagggcuggagagauggcucagcgguuaagagcacugacugcucuuccagagguccugaguucaauucccagcaaccacacgguggcucacaaccaucuguaauggggauccgaugcccucuucuggugugucugaagacagcgacaguguacucaaauacaugaaauaaauaaaucuuaaaaaaaaaagaaaaaagaaaaagaaauccaagagaaccagggagccacagaugggaaaauaaauaggacauccuuaaugacuucucugagcugauuucuuuucuuuaaauuauuuuauauguaugcgguuuugucugcacauacauguguccaugggggccagaugagggcauuggauuccuugaaacuauagcuacaaaugguugugauccaccagguagucaauaggaagugaacucagguccucuguaagaccagcaagugcuuugaaucacugagccaucucuccagcccaacaaucuguucucuauacauauuuuuauuuucacuaauguguguguuuugccugcacguauguauguguaccagauguguauaauaaugccugcagagguuggagagggccuugaaugaaugcccuggaacuauagaugguugugagccacuguuuggguguuaggaauugaaccugggggggggggggggcuggagagauggcucagagcacugacugcucuuccgaagggccugaauucaaaucccagcaaccacauggugccucacaaccaucuguaaugagaucugacucucucuucuggagugucugaagacagcuacaguguacuuaccuacagacaauaaaucaauaaaucuuuggggggggggcgcgggauugaaccuggguccuucuuuguaggagccagugggcucuuaacugaaccaucucuccagccccugaacuaacauuucuauaucuguuuuaauacacguaagcaccauuuuuuauuuuacacuguguguguguguuuguguguguguuuucaguuuucuccuuccacuguagggguuccagguaucaaagucagauugucagacuugggggcaagcugcuuuauccacucuccucuccucuccucuccucuccucuccucuccucuccucuccucuccucuccucuccucuccucuccucuccucuccucuccucuuuucuuuuuucucuucuuuuguuugcucuucucuucucuucucuucucuucucuucucuucucuucucuucucaucaaggccuuguuagauaguccuggcuugcuuaaaacuugcaguauagaccaggcuggcuuccaacucacaagagaucugcuugccucugccuccagaaugcuggcauuggaagagacauuccugcuaggcucuuguuauuuagcucuccugauuccuuuguggauuaggacucugucuuuuauuucucugucuacagugcugaguccacgucccagcuuuugcaguaguuauuauugguuugcuauugcuuuuuaagccuuuuugaacuucauaaccuuacuuaaucaaagaguugauaggaaugcuccaccccuuucaaccugauuaacauuagggauuuguucaccuucucauugaguucucgggcaaacagcuaggcauuucauuaaaucugaaagcugaaugggaauuuaucuuugacuuugaagucaaauuaaugagaaaaacaacucauaggcaugcuuuaagggugacucagaagaaagauggaagaaaugaauuaugucuaaggaaggggauaaauuuaggaauacagaauccugaauauaguaaguuauuauauuuuuaaagauuuauuuauuucauauaugugguuauacuguugcugucuucagacacagcagaagacagcauuggaugaucgauagagaugguugugagccaccaugugcuugcugggaauugaacucaggaccuuugaaagagcagucagugcucuuaacagcugagacaucucuccagcccaaucaggauuauuuuaauccugauauuaacauguagaagauuguuaaauagucauuaguagaacaaagguagaauauaggagguuucuuucccugaauuuaauuuagauuuauuuauuggccagcauugaguaaaaugagcaauuuuaggaaaauacugggccuggugaguggcaguugcucuagugcuuaguaacuuggcaacaacaggaauucugauuggcuugaagccuagccuuauuguacauuccagccaaucagggcuugucuuagucguugaagcuaguuuuuaaaaacuugaguacuggacucuuguguugcucuaggacuuuagaagccuggagaacaguggugggcugcugugugggcaccgucgccugucacagugcugcugaggacucauuguuucuucuuacaccaaugcuuccuccucauucuccaguguugagugauguggaaguuauguagacggcgguccagguauucuucagagccgagucucaucaguaggaacaggguucagagugguuuuucccgggggccauuguuuguacuggcguggcaguugcuuuuuccccaguagacaaaagcuguaguucugguuucacaccaugacgggcagaaguguguguggaugaguugagaguauugguguguagcagauacgacuuacgacuuuuccaguuuuaagaccuuuucuguugguguuugacgguggggaagcuagguggucagauaagcaguguugaccaucucugugaaucuauuaccuuuugacaauagugggagcaggaguccgcuguuuccugcuugggcagcuuacucugagaaaguuagcaccuguugaaaugaggacccaagagaacuuuguaaaagugccacugcagaguccauacugcccucuguuuccauauguauauucuguauccucccaaacaucagugcuugaaugugugugagcaugugugugagcgugugugugugugugucagucaguuuucuccuuucaccugugagugaggugaugaaacucacucagguccucaggcucagcugcaagucuuuacccacggaaccaucuugccugcccuggaagcagccguuucuuaauuguagauuguugagagacaccacugucuccaucaagaugagagauguuaccagcgcuguuaaggucaagccugggccuggcagugcuaacagcugagcucagccaccauccucuguagccaguuaaagagccaggucugugagaacagagagaggagguuuauucauuggaaccaucuugggaagaggagcagaugaagaaguucaguaagagcaugcauuacuaagcagucuuggugaaaguguggucccuuccaaagcugacccaucauucucucugcaaaguagucugaucucugagagacaaguuccucuucuggcuggcacuaggccuuagcauuccuucccauggcuuacaguuccugggggguucuaauccaugagacuauguuucagcaaauugauagcugcagaguggggagcaauaucucuuuagaaaauacucauucacuagaggauaucuguguugucauagaagagccacaagauggaagguaguggguucagggaucuaugaacagcagccucaggcugacugacaaguggauggcugugcucagaauggcuucagagaggcccacuacucuggagcucuccuucccaagcgugaagaaaggagaaggaaaugccagagcccugcggugccuguccuuaugccuucacugaugggaguucugucaagaugcggauuggagggguugguucaucacagcccugcuuccccuaagacguagccagcuccagccagugccuggugccuuucucuccuccagcaguagagagugcugcugccuugugaagacuuugccacagcuccccgugauguauuuggccuucugguucugucucuguugagguuucuccuugaauguucagaguacguuuugacucaucuguucaggaguuuacauuuuugucuuccaccuuuccucuuugggaauaagaggguuuuuuuuuuuuuuuuuuuaauaauuuauuuuugccuccaugugucuguguaaggaugucagguucccuggaacugaaguuacaguugugagcugccaugugggugcugggacuugaaccuggguucucugcaagaacaucuagugcucuuaacugcugagcuaucucuccaaccccgaauuuuuauuuuuuauuuuuuuugauuuuucgagacaggguuucucugugcagcucuggcuguccuggaacucacuuuguagaccaggcuggccucagacucagaaauccgccugccucugccucccaagugcugggauuaaaggcgcgugccaccaugcccggugaauuuuuaauuuuugagacagggcugcacagcauagcguagucuagccuagaacucacuguauaguccaggcuggccuugaauuuuguagcagacuaucugcuucaguauccuaaauaagccacuuuaucuuaccugagcaguuuuaguuauucuugaaaguaaaaauggaguugcuguuggaucuaugccagcuucccacaccgccgauugccugacacucaaaauccaucucagugcaucucuacugaaccugaaaagaaaaagguugacccuggaauauaaagaaccuugggauuuaaaaagaagaggaagaggaggaggagaaggaagaggaaaaggaagauagacagcuacuggguaaagguggcuuuccaguggcuagugcucucccugucucuagcugguuggaaagcauccagcacacaguaccucgcaggcaccccaguauuuauaaauguuuuucacaagucauaugacuuucacuuacauauaugaguguuaaauugaaauuuuauuuguagguuagaauugauuuaauuuuuaaauauuuguuagaaaaauaaagugaccuuguugguggcguggaguaaacaugcagcuauugggcucuuuuacuuuauuuucaugaaggucagagagaguacaacaugaacuaggccuugugacaugccauuggggacaagagguccgcggaagggggaggaggaaagaauuucuacucuaagacuggccaagauccugcaaauucuguaggguggaggauguguccagaucaacaagcagcucguaaguuugauugacuaaaagaaaggaggugucgcagucuagagcaagguaacauuguagaggacagugagcaugagagcaaugugugugugugugugugugugugugugucccgacuuccuggcaugcggcacacacugcaguccuagcaaccccgaggagaagggaaguauuccucacccacuagguuuuucucucaaaucaaagucuucugaacauuucuuuacucucaggaaauucgagcauuuuguccuuagcuguaauuuuagcaaaacuggauguuuugcuacagauauuaccugagaauuggggcuccuuuguguugguuuuauggcuucauagaugaaagauuuagaaacaggguggagucagaagaagcuuuaaauuugagagagaaaucacagguuaggcagaaaacacagaguaggcaagagaagcaauagagaucucugaagcagucgggguggggugcugcacacuauuaguccuagcucucaggaggcagaggcagaccuguucuacguuguucaaauauggccagggcuguguuagagaaaccccgucucaaaaaguccaaagcaaaaacaacaaaccucugaagcugccagaggaggaggguguggaagagcaagagagagaaagccaugccuuuugagcuagggcccaaaaacagccagcaaguuuguggguggcugguggcaagcagccacauggcauugcaggagggucuuuguaaaagaaugacaguguccagagugacauggugagcauacuugaacaguauccaaauaagagauuuaaaauaagaagaaaaggaaaaguacacuuuugaaguuagaacucagaacaacauagaggcuuagcaguaaagacccacaagugcgcuggacaaggggccucugugguguaaauucuauuuuaaggguaguuauucuccccuuuuagcauggccagugagucagcuugcuugagguguguucucugggcagucccucuuggauuaacuccuaagagaagguacagcagugucagcgggcacccuauaauggcaaauguccugagauacaacucaaauucuguuuugacuugcgagaaguaguuuucccauaauggguuucauuuaagcccuguuaccuucaccuuuuuguaugguauuuuaaauuaaggagaggcaaagcugaucaugagggagaaggcccaucuucaaugacuucuaacuugcuaauaugucugucuagcuacuuaaccagaauaaaaaauauaccaaggagugcaaaaacccagcaggucagaaaacucuggagugugugugccucauuuaaaccaccauaucucucuugaucugagucauuauuaauauaauuggagaaguucaacuugauuaaaaaauguuugccccaguuuauuuccuguugaugucauaagugccugacugaaagcaacucggaaggaaggaggucauuucacucagcgucucccaggcuacacucuguugcugagggagguggaggcagaaguuugggcagagccgugcacugagugcugcuuacuggcuugcucagccuuuuuaauacaacccaagagcaccagcaguggcgccacucacaaccuugccuacaggaaagucuuaggaaggcauuuucucaguucagguucccuccuccuagaugacuuuagcuuguaucuaguugacaaaaacaaaaaaagccuaacccauacaguauucuagccaaacacuugaaguaaaagucaaguugcaguguuuccuggguuacaaacgaucacaguaguuuccaugcagugccugaaguaauuuuucccuuccucccucccuuuagggaaaaaaaaaucuuaaaaugauacagcugaugaagagucuuaucccauagacaugguucagugguuaaaaaccucggcugcuuuuccagaggacacagguucugaucccagcacucagaugacagccugcaacugcccauaacuccagcuacaagggaucagaacucuccuggccucugagagcaccaggcauacaagugacgcacaaguacacaugcagaugaaaaaccaccuuuacacauuagaaaauuaaagagaucuuaccugugggguagcuguggcuguguguaaacacauuuguauauguauagucuguggcucacagguggaagucagaggacaacuuuggggagucaguuguuucucuccacaaugugggucccagggaucaaaaucagacuugguggcaaguuuuuacccccugagccuuccugauagccuaaggagguuuuuaaaaacugcugcucaaucaaucuaguaucugaggcuggcugaaguuuuugaauguuuuuguaauugcuaaaaaguuaaguugaucuaaggcagaauugcuuaagcauuuaucuuggagguauuuagagagaaaauaggcauuuguauagggcaucuguguuaggauauguuacagugucagccauguauuuuuaauuaauguauuucuaauuugucaagcuguaaaugugcaaaguuggguggggaucauaagcuuaaguugucugauucaaucacaugcuccugcuaggagcuuuguaaugauucuuuggcaguccuugugggaguaauuaguagcagcaaugaaugaacagcagauucagagaguauaccuacaaacuccggcauacaaauuuuaacagauguagcguggaugcagugacugguagaaaaagaaaaaacaaauacauauuaaaacaggaauguauacaaagagaagacuauucaguuugcccaccuuuguaaagaaggguacugaucuggggugacgauaugaaugcaugcaaagagaaucuguuugcagccgggcaugguggcacacacuggggaagcagagucaaaugaauaucucugauuaaaggguaagcccaguguacauauugaguuccaggccagccaaggcuacauaaugaggccuuauuccccacccaccccccaaaaaaaagaagggggggggagaaaauugugugugugugugugugugugugugugugagagagagagagagagagagagagagagagagagagagagagaaacacgccauacaucgguauaagugucacaggaaaugcuucucuccuuccgcguauucagcuuggugguaagcacccuuacuggaugagccaucucacuggccccguguuuugauucuguagccauuuucaacagaauugguccuuagugauucacaucagaaucauuuccagcauccuugaaucagagcuguugugcuuauaauguuugucguugacccaaggguuggaugggaaauuggauaagcuaauuuuauguagccaggucugguguugaaggccuauaaccugaguuggaguugaaggccaacuugagcaauuagugaaauccugacucuuaacaaguauaaggaaaagugugauauagcucaguggugcaauauuuuaguucccaguuuaaaaaaaaaguuguauggucauugcagugguauauacagguauugaaauauuauguuuuaccucauacauaguuaucuugggaaaaaaguaaaacguugaaaaaguaaaauuuaaaaagacaggccaagcagugguggcgcacgccuuuagucuuagcacucgggaggcagaggcaggcggauuucugaguucgaggccagccuggucuacagagugaguuccaggacagccggagcuacacagagaaacccugucucggaaaaccaaaaaaaaaaaaaaaaaaaaaaaaaaaaagaccaaacaaaacaagagaaccaaggacagagacuggguucugcaugcacaugguacugaguuacugaguuuaacccagcauaaauuaagagggguacaguggcacaacuuaggagguugagguagaaagaccagaaauucagggucacucuuggcuuugcagugaauuugaggucagccugggcaaagcaaauaaagcaaaggaaaacaaggaccugcaaaggcuucgagaaacugagagcugugcgguuacugugguaccuccccgcgucacggcggagcaugacugcuguuuucauuguugaaagacaaguggaaggcucgccacacacagcauugcuucagaaggccugugcgugucuugauugaaaguauuaaaagcacaagcaauguauuacaguuguuaacaccaucagaccaguucucuggaucuuuugcuuuaauauuuuagggucuaaucugaacuuaauuuuggguuuuuauuguuucuuuuuuguuguuugcuuuauuuagucuuuuuugagcuaagauuucacuagauagcccugacuggccugaaacuccauauauguagaccaggcuacccucaaacucauaagagauccacauacuuuugccugcugagcgcugaaaauuuaaugucauguccauagaaaaggaucucuccaggugggguggcgcacaccuuuuaucccagccagcacucgggaggcagaggcaggaagaaaggaaggaagggagaaggaaggaaggaagggaggaaggaagagagagagagagagagagagagagaaggaucucaagccguccuuucugggcacugcuguauuuuagcagguucauacugaaagcucaguuaccaaagaauuaauaacucuggcagcagugacagcugccaccuccagggugcccucagucccaggguuaacuagcucuucuuugacacuucauccugcagucucuuugcuguaagggcagcuugaacagcuucagcuuuucucaggauuuguuccugacguggcccugacagauggcgaagauucccguuuuccucugcuagucucagagcugguggcaggccgcuggucuuguguguuuggggagguccaaaaugaagaugauuccucuuuggacguaagaccugcauacagaaaaauaaauaagcauccggcccaaaagcaccaagugcccaagccgguugucucggcagcugccaaucagccgcguuucugugaaaauaaguccuuuucaugaagcugggggaauagcuaauucuggcccgauaugcaaugugagguuagaaacauggcaacuugucacaacgcgauucuuguucuuuuugcugugggcugacucuacauuacuugcuuuguuugcucuagaauggaaucuacucaccauuuacuaaaaugaaaugccuuucuugggggaggcaaaguccauccccugggucuugcaucuuagaagggaacuccauuccucugugacugaguguuaugggccucgcuaugcguuagcaaaugcagauuucaguccuaggacagauucuucacaccagagcuguuuugugucuugguuuaaaguuuuuuuuuuuuugguuuuuuuuuuuuuuuuuuugguuuuuucgagacaggguuucucuguguagcccuggcuguccuggagcucacucuguagaccagguuggucucgaacucagaaaucugccugccucugccucccgagugcugggauuaaaggugugugccaccacgcccaccuaaagaauuuuuuuaauuguccuugccucacuuccaguaguacagaucaguucuaaacuucucaguaucacagaagugagcauuagaaagcuuagauaguauauuacuuuggauucugaccaacuuggucacucccugaccuugagcaaauuauuuaaacucaagacuuacucaagggaggguggagcacagugaaauuuacuaacuuggcuaguugagcauggaacucccauggcucacauaauagugauguccacugaaaucaucauuugguuuccauuagaagccagcagcacacuaggcacaugggagggagcaguguugaggaaagaccaccaaccaguaguccauaacaacuacuagcucuggguccuguuuuuuguuacuaauaagcuuugugcugcuggcacagugggggugcuuugguuuuccucaaggaucuggcuauucuuagucacugcugacugacgaagcagcuagauuuuaguugcagauggguuaguaucuaugccagaguuuacuacauuucuucaaagugcuuuuuuucagcuucuggaauccuguuuagggaaagcccauggaaucucuuggcaugucugcucuuaaaacauacgcuuuuccuagaguuuuuauagcacuuugcuuaauuuauguuucaaggaauuuuguauauugcauugaaagauuucaguugagacucuuaaguguugcaggugagggaggcuguuccuggguucuuguaguagcagauggccuuuuuauagcauugugacaguuaguauaaugagauuuuucaggccgauuuccacccagcagaguuuaaaucugucagcauuaguaggucaccccauuuuccuccuccuuucucccagcagucuuuuuaugucaguggggcuuaccagagcaguguuggggacgaauggaagugaagggagcuuugccaguuugucguuugaaacauguaagaaaugaaccacaaaucucuccugugcugugucacaggaucaggcugcagucaguccccuaucaucgccaugaacuguugcugccagggaugcagucagcgacgcagugauguccacuggccuggcguguucagauccccggguuugauccccaguucuagagugggacaccaaaaacucugacuucugucucuccucuggcagccguggacugguuucccuuuugcauagauggcuauggcaaguaggaaaggaaacaaauccuuaaaagaaacaugcuucaauaguuaggcugcaguaaagaaucaucuaucauucaguuugggaaauaagauguuuugagguacuucuuguauuuuuucaucucugagacagguucuucuguguagcccugacuggccuggagcuuccuaugugcuguacagaccaggcuggccucagagucacagagauccaccugccucugccuccugagagcuggaaauaaaggugucugccuccacacccagcgacuuuggguacuuuugauagaguucucuugcuuguucuuuucaauacuguuuguccagucuugucuugacgccagcugguggguggacagcacagcguggugggcggacggcacggagagauaggcacuuccuccggcaucugacucccugcugucaacuuugcucugucuuccaucuuacacagcacacugucacuccuuggcuauacacuuugacuguucuuccagugacaaaugggcaaaugacucucaggaaacggaauuaagauucucaaggcugugucccguuucauacugagaagucaguuguccccaguggaaauuaccuacaaauguagacguuugcaaauauugacguaucacaaguuuauaauccuagcacuugguaggcuacagcagaauugccacaaauucaaggucagccugggcuacauguuaggacacugucucaaacucagcccuucaaaaaacaaaaaagaggccggaguugugacauucuggaaaauucagugcugccuuucaguggcucacuuacuaaguauaaguguguguuuauuuuuuaaagacuuauguauaugagugcacgguugcugucuucaggcaccagaagagggucucagauccuauugguugggagccaccaugugguugcugggaauugaacuaaggaccucuggaagagcagucagugcucuuaacugcugagccaucucuccagccuguguguuugguuuuuuuaaagauuuauuuauuuuauauauauaaguacacuauaucugucuucagacacaccagaagagagcaucagaucccauuacauaugguugugagcuaccaugugguuacugggaauugaacucaggaccucuggaguccugaguuuuaggagcagccagugcuccuaaaagcugagccaucucuucgguccguuuuuaguuucuggguuuuuuuuuuuuguuuuuguuuuuuuaaagauuuuuuaaaaaaauuuuauguguaugaguauuuugccuuugaguauggaugugcacugcuuauuccugaugccuuuagaugucagaagaggauaguggaccuccugcagcuggaguuacaggugguugugagcucccaugugggugcuuggaacugaaccuagguccucuacgagaggaccaucucuccagccccugguuuugguuuuugauacuagaucucagguaauacagauauccucagacuugauguguaaccaggguuggcuuugaaauccugaucuccugacucuacaccccauguguaggauuguaggcauuugauaccauaccuugugggguuuguuuuguauuacuguguugugguuuugacacagucuugcucuguagcacaggcuggccccaaaaucacagaaguuuuuuugucucagcuucuccaaacucugggauuucaggugugaacuaccgcgcccagcugagaggaguuuuccugauauuuuuuuaaugucucugaauagauugugaauggauuggauuauuucauugguccucuuuugggucgauuggccuguugggcagaucucuaaucauuuccaguauaucacacuaacaugaagcuggcgcuucugagcucaccccugagguauagugaugugacucuccuuuuccuuuucagggaagcagaauccuucaaggaacaagggaaugcauauuaugcuaagaaggacuacaacgaagcuuauaacuauuacacaaaagccauagguaagaaggguuacagcaggugagucaccugccagacauugcaaguggucccugccuaagaagcagcucuuagugagcugagcucacagcucacuccuccccaggaucagugauucugcccaacacuugcauccaaugauuggugcuuccuucucuaucucaggaaacagaaaugucuuaucuccauguucuuaacaugccagcauauuuuauuuaccuuuaagacaguuucauguagaacaccauugaacuugcuaauaauugaagaugaccaugaacauagacagcauugagcucacguaugucacaaacacaccauaguucacgaaacacauuggcccccucuacccccuaaaggcaguucaaagucguaacuuugauaacaagugccuuuaccugcugaggcuggcucugguuuuuaaaauuaguuucauuguuuuuuuuaaaaacgaaacccaaaaacacuuggaaauaaagaacguaccguugaaauuaaccagacccuauagguacaauagguauucugaagcugcgggacuucacauuagauuuuuauacuuuuguugucaaaauacauuaauaacccacuaccaaaaccaaaaaacugugugauacauuuagagcuagaaaagaacgaggcucauacccucuucuauagcucacguauuacuugcauucaguuucuauuaugugcacauuuguuuauguguguaaguaaauuauaaauuaggaucagcaugugagggaacccacaguuuuuucuuuuucugagauugugugaccggguauuacacauuauaagaucuuccaucuuugugacugcauuuuucuuaggagugaaacaggaucccauugcauucguguguguguguguguguguguguguguauauguauauauguguguguguguguguguguguguguguguaugcaccagauuuccguuauccauccguccuagauggauaucuggguuuaauccaguucuuuucuguggccaaguaagcaauaauaaaccugaggacacacaccuuuaucaugaaauguagaguuguucucuggguauacauaugcccgggaaagaaagagcuggggcuuguagcaguuacguuuuuaauuuuuuucagaacucuccaaauugauuuccauauuggcuauauuaaauugcaccccacccacagggaacagguuuucuccaacagucaguguccgcuuuguugaugacggccacuuucacuaggauaaggggauaucucaaaaucauuuuaagguuuuuuguuuguugguuuuguuuuuguuuuuuugagacagaauuucuccacauuuaauagcccuggcuguccuggaacucucaagagauuuuccugccucugccucugagugcugggauuaaaggugugugcuccuggcucugguauuucauuugagacaggcugaccuaaaacuggcagaaaucuugcuuuagcuuccuaugcccuuucccuucaacauguuuauguuuguuuguuuguuuguuuguuuugacauaauucucuuacucuuuuucuccacacuuuuuugguguggugugguuugcuguguguguggugugugugguguggugugugauguguguaugugcgugcgugcaugcauguggggggggggugcguuuguggggguguguguguguguguguccguguccauccauguggaggcccgagguugauguugggaccauccuauauuguguuucuguguuacucacacgaaggcugugucucagucgaaugaaucuggagcuaauuauaauaacugggguuacucuugauggcuaguucguuuggagguccccuucucccuucaaggcuggaguuccaggcaggccaccaugcuugcccagaauuuacuugcccccuggggcccuugauguguauacucagacuacauuacaaguuuaccuacugaaacgucucucuaggccucccaugaaauaguccuuugagagguagccuguauguaaggucaguagccugugcugaacuuuguuuugucucacuauguagccuuggcugccuuggaacuggcucuguagaccaggcuggucuuagacuucuagaggccugcugcgucucuggaaugcugggauuaaagugugacccacuauacccagaugaacuugcuuuuuacacaguugauuuuuuuauguguuuugaguguuuggcauguauguauaugcaccacguucguguuugguaaccacaaacaucaaaaagggaguauuggaucucguagaacuggcauuacggaugcuugugagcuaccgugcaggucaugggaaugucgaguccucuguaagugcucuuaaccacugagccaucaucuuuccagcucucugcgcugaacuauuuuauguccuauuaucuguccuguagauauguguccuaacaaugccagcuauuacgguaaucgagcggccacacugaugaugcuuggacgguuccgggaagcucuuggagaugcgcagcagucugugagguuggaugacaguuuuguccggguauguaauggagcucuuugguggagaauguuuuacaguaucucugcccuagagcugcuaaccauuaggagcauuuccucuuuucauugugacagccacaaccaucuccuaauugugacaauguccccucaagaucaagugcucccucugagagcauuguucugccuuuucacugcaugcugguguguagacuguuuuuuugguuuuuugguuuuuuugggggguuguuuuuuuuguuguuguuuuguuuuuuguuuuucgagacagaguuucucuguguaguccugguuguccuggaacucacucuguaaaccaggcuagccuugaacucagaaauccuccugccucugccucccaagugcugggauuaaaggcgugcgccaccacgcccggcuguuugcuguuguguugaccugugcagucauauuucuuuccucccucugugcuuucuucuagggacaccuccgagaaggcaagugccaccucucacuugggaaugcaauggcggcaugucguaguuuccaaagagcccuagaacuggaucauaaaaaugcccaggcacagcaggagguaggucugaucuguuccuaugagaggugguggugcggugggucuggaaagaagagugaccaauaaggcaggacugacagucucacuucaccagcagccacacuuagccaacuuuagguaaaucucauagucucugcgacuguuaccuuaacuguuaaaugaguuuucaguauguaaaaaguggaaagcuucagagaugacuggguagacgcauaaugcuucaggaaggaagcuaaggaacgaaauuaaagcauuugaauaaagucagagcuaggguguagcucaguuacagaacauuagucuagauguucugagucucgguuucagaccuuggguuugucagaaagaacuggucuaugcucagauguggcuuaagcugguagcacacgucuuucaguuccaccuuuguaguaggugccuggacacaucugagugagcaucucaaaacugcccaaccccuggcuuaugguggccauauuuuaugucuccugucuuccugacaggaagucaacauuaaacaagaaacuugggucuugaccuuuucuguuuucuuuuaaaagauaggguuucaagucuggaaaugcaccucacuggacagugcuggccuagcgugcgugaggcccucgucucaguaaagccuucugugguagugcacacuuuggaaucccauuacuuagacaauggaaacugaaggacaaguucaagaccaucugcagcuacauaacaaguuuaagcuagcccaggcuacaugagaccuugucuccaaacaaaacaaaaaaugggucuccauguagcccaggcuaacuggucucgucugucuugguauuggaggggucuauuugucacuaauuuuauguguauugcuaugagaguaucagaccuucuggaacuggaguuacagacagcugugagcugccaugugaguugcugggaauugaacccaggaccucugaaagagcggccagugcucuuaacugcugagccaucucuccagcccgucaccagcuuuuuaaggaaauguuuaauucuuauuuuccuuggaguggggguuugguuuuuugaggcaggguuucucagugugucccuggcuguucuggaauuuguacuguacaccaggcugaccucgaacucacaaagaccugccugccccugccuccugacugcugggauuaaaggcuugcaccacaacuguggcuccuuuuguuuuguuuuuuaaauuuauguguauauguacucuugugcuuucguuuguaugagggcagacuuguacuggcuguggcagugauguuggagaucaggguuauugccuggaagaucaugucuccuguucugucuugcuuaaaacagucucucuaguuuuuuugucuuugagacaagagucucacaugucugugaaugcccuggagcuggauguauagagcaagcugcccuuugcuucucaaguggacauuacacugaccagcaagauaggaucucuugcuugcuugcuccauacucacucucagcuaacugacacuccagcuacuggagagucuuauucccaguccaucuugccuuggcagcacuggguuuauauauacacacugccaugucugguuuaacauggguuauggaauuugaucucaggucgucacacuuguauggcaaguguuuacacacagagucaucucccucaccuugauuuuguuuauauauuguaugcacgcaugccaccuguauaccugugucuacagaagccagaagagggcaucaaaucccccugaggcuggugcuaggacuaaacucaguacuguggaagagcagcgagagcccuuaaacacugagccaucucucauguguccuacccuaugaguccacacacccccuuuacuggguuucuagaucaggucucuaucugauacacuguguaauccagguuaaccuugcccucgcuauucccccgagugcuggcguuacagacauguagcaccaugccugcugcuuugaugugauucuuuuuuuccuucuuucuuuuucgagauaggguuucacuauguagcuguguagcuguggcuggcccuaaacucacaggaauggaccugcucugucucucucuguguuaggguuaaaggugcuugccaccaugcccagcuucugugguuugaaaaaguuguguuguugagaccgucuuacuauauagcccuggcuguucuggaacucacuauguaguucaggcuggccucaaacucaagagaucuaccuccugagugcugggauuaaaggugugcaccaccauaccccgcuccagugauauucuugaaagaaggaauucaucagggucuuagugacuuuuaugauuguucaaccuaaacuucauuuuuuucccaugguguaguucaagaacgccaaugccgucauggaguaugagaaaauagcagaaguggauuuugaaaagcgagauuuccggaagguaaaguagaagcgacuacaaccuacccuccucugugcugugauaauacagagcggucuagacuaguacauugucauucaaauuuggcuuugaccuuuucucucuuaaaaguauuuuuugcuaaguugcuuuauuucuuaauuuuauuuggcuuuucaauaaggagcaaaaaucagcuugcuuauauucccguuggcuaugucagguaguguaucucagaucugugcuaauuaaugaaagaaaagucagcuggaaauaaauacuggggcugaguaauccauauuuaucugauuaacuugcuucugauggaguagaugcuauaaauaagggugggagacggaaacccucauuacauuuuuggaguguguguaaccuguuacaucaccucucucugccgucugucagccucggcuucaagugcuaggauuacagcaugagccccugccaccuuuuugauguuauuuugggucuuguguguagcucaagcuggccugaaaguuggcaguccucugcugccgcuauacccagcuugguguuagaguuuaauaaacuucacaguaugugguagguuuugacaaucuguauguuaaagggguugauguaucugaaauagggaacaaguauggaaguuccaggauuuuucuagaacuuggaguuaagccugaaguauagaucucccuauaguagauaguagugagaacuagcuuucacuaaagaaucgaaguaggaagcagaggauuggcagaggucagaaauccgcaucaggagauuuaugcgcuccuucaaccaggugauuucaguccaagggaggaguuguugcaucguauguagggauucgcguagggcuuucaguagcagguguucagaaauguuugagggggacaaguaagcaucuuuuuugaguuuuauacugugagcgcuuuuauuugggaauaaauauaucagacuaguuuaugcagauuugcaacauuaacugucuucugcccauggguuuugauaauuauaauguuuuuguaguucauucguguguguguguguguguguguguguguguguguguguguguguuuggaaagcaguucuaacuacugucacggcuuuguccugaaaggcagucuuuuggguuucuuuucucucuugcucacucuggagccagaauccugaguuugugacagaauccucuguuugugacaucccagcccccccacuguagcucauggugaugucacaaaugaagaauuaugauccuggcaggggaaacagaugaacuuagaagaaacaaagaucuucuuugccugcagcugucccuacuggggacgugguuggggguggcaguaagcauugcugagccucaacugauguuccucacgaugagcagagccagcucugcauagaacguugagcuugugaggccaagggcguggcuacuccgcugucccuggcuuuuccucguuguaccucaguugucauuacuguccuuagaacuuccagugaccugugccacuaaaggagugccauuguuggauuggcagggcugaaagugucagugagcggcucaguguuuucuuucuugcuugcuuguggguuuucuuuuuugagacgaagacucuauguagcucuggcugcccuggaauuagcuguguagaccaggcuggccuugaacuugcagagaucuguuugccuuuaaacccaucuugcuuguguuuuuaaucucaguuuugaaaaggcccucggugcaaauaaaaagcauggaaagauauuuagugaugagugcuccuucaagcaggcccucuggucucucugcuccccgucuccagugcuaggguagagcucagggucaaguucuaccacugaauacaucaaauacagauuguuggauuuguuugcaugaaagguagugcacuguuuucccuccucugaauaaggcuuggaggucuuucuacaguaguaaauggaauauuagugcauucuuuagaguuauggaguaugucauuauauuagucuacagcgaugaaaguuaccuuuccuugcuuuuagaauucauacuuggagucugagagguaauggugucccuuaauugcagauuucuccucugguccguuauucuuagggagaaggggauugagggaggauaucccaggaguagcagcuaaguaagaaugagagcucagagaacaaaguuguggagaaagggaugaguuucugagagcugugugacugacagggagcacgcuguagcuuucguagguaugagugggaaacuggcuuggcauuuacacagagcagcccagugguaguagucaugugacauccauuagaauccuuauagauggcuaguucacuguggaauuucuauacugaguguaacggaccaacccaguaguaagaugugcuuuaaucccagcacccaggaggcagaaguagcuagauuucugugaguucaaggccagucugaacuauauggugauuuucaggccaccuagagcugcacacuaaaacugucuuuuuuauuuguaugaauauuuuggccccacauaugucugugcacuaugugcauaccuggagcccuuacaggccagaggagagcacuaaaugccuuuuguuuggaucccuugggacuuugcagacaauugugagccaccauguggguucugggaauugaaccgaagucuucuggaagaacauccagugcucuuaacaucuaagccaucuccaggcucaccccuucccuguugucacgggaaaaggaggggcgcagcaguuucuguucugugugcagcgcugauucuugcugguguucuuaucguacuuaccagcuaaagccugacagauaaugaaaauaguaaauaaugguguuugcaagaagaaugugagcucugaucauagucacugugggcucaccauggaggcugcuuucugguugagguuagugcucuagcguccuacuguauuuaagauggaacuuggugaccuagagccuugcuuuguucucuauucauuagucucucaucacuaaaagaaagguagugauauuacuuacuaacucgaugggguauugguguacuuacugaaugaacgaacguguagaagcuuugauauugcaccaauaagcaaugaugucuugagcaaacucaagugaagacauuucuggagucccaguugaagagcucacuugcuuuccucuucccuuagguuguuuucugcauggaccgugcccuagaauuugccccugccugccaucgauucaaaauucucaaagcagaauguuuagcaaugcuuggucgauacccagaagcacaguuuguggccagguacgcaaucuggccaauucaugacugagacgcagaguggacuucugacugcuggcuggcugcuugcuacacgggggcugugggugucgguuaggguuguuguucaugccuuccuggagcuuaaagccaaagguuaaagcagguuaaauccaagacccacaagguauauaggaugcagcuguguugccggugcucgagccuugugcgagagagcuuaaugagucugaguuuguuuaaccucuguuuucauguacucugugggaguucauucucuccuuccaugcugcagaagguuuuggggacugaauuuaggucaucaggcuuggcagcaaucucacuggccuggguuuguuugaaugcaguucuuucuacuccaggaaacucuuuuuaucuauccauauuguaacucuuguauccuuucuuggucccuggucucuacugcaacugcuuagcucuguccuaugccguagugcagaagcagccacagauaacagcugaguuaguguaaaccagauuuuagggaccugacccaagguugggauauagcuggauuggaagaugcuuguguagccugguuucauuccuuaguaccauggggugguacagaggcaaugguacaagugcuggccugcugugugccucauugguagaguuugugcuuagcuuguacugagccuucaauccagucccuauuacacaucaccuaucaccaaaauaugaggagaaaauggaauacaaaacaguaccagaaaggacuuagcccugagggcgguacuuuauucaccccuacucuaauucaauaaagauugugaggcauagccaggaauggugguacacgcuuauaaucccagugcuugccagaggcaagccgaugucuguaaauuuuguaggcuagcuuggucuacagagcaaguuccaggacagccagggcuauacagauaacccugugucaaaaacaaaaacaaaaaagaaaagaugaugagacacaaggaauguauugggcuggauuggugggggagaggggguauucucaucaguaaguucuugccugucaggucccaggcccuggguuuaauccucaacacugcuagguacggggagaaugaaaaaagaaaaacauaguaaagauauauagguaguuuauuuuaacaaggcuuguucuugagaaucuagucaccuguggaugaacuuugaguacuagagccgugaucaagaaacaguuugacuccagauggugggaauggccaagacauuguacaccacagcugaacguguccucuuuauuucagugacauuuuacgaauggauuccaccaaugcugaugcucuguauguccggggucuuugccuuuauuacgaagauuguauugagaaggcagugcaguuuuuuguacaggcucucaggauggcuccugaccacgagaaggcuugugucgcuuguagaguaaguucuaagccugguguucugcacguggugguagagcuuccuuucaugucucaugguacgagugaggcuagggcugcagcucaguggugaggugaggugaggugucacgcugucauuccuguggcccuggauuccgucccuccuagcaaagucgggagaaaagaaaauaaagaguagaggaagacucacaggaaugugacagcuccacuugucaguguguuaaaccuucccugugggggccgggcaugcaggggccugugucccgccagacagcugggauugaagagagaacggugagaaagaaagacugagcugagguuuuuugcacugaacugaccgucccuugcuucucuccagaaugccaaagcccuuaaagccaagaaggaagaugggaauaaagccuuuaaggaaggaaauuacaagcuagcauaugaacuguacacagaagccuuggggauagaucccaacaacauaaaaacaaaugcuaaacucuacuguaaucgggguacgguuaauuccaagguaaguacuugaucuggggugucagaggucuucagagaugugcuuagcaagagcaagccagauaaaagaauggugucccucauccuguaaggaacugccuucugagaaacgaacuugccuuuuuguguguaguguugagaacuugagaggcagcuuggcugaccguucccuccuguuuuccccaguugucucuugugagagcaacuagcaaguuugugccauuuuaacaaguguugucacuucucauuugagcaagaacuuguuuauuauucaggacaaagacagagaagguugacagcauuaauuaggcuuuuauaaauugcugaauacguguaacugagaaugaagcugggcagugguggcgcacaccuuuaaucccagcacuugggaggcagaggcagguggauuucugaguucaaggccagccuggucuacagagugaguuccaggacagccagggcuacacagagaaacccugucucgaaaaucaaaaaaaaaaaaaaaaaaaaacguguagcugagaaugaccauaguugucccgcguggccgugugccccauaagagagaaagguucuguagaauccuaguaguuaaaaauugcagucuuucuggucuuuguaguugguucauggaagaguggacuuccaugaacaacaaacaaaacuucuguuuguuguuuugguuaaacaggcgacacaaagaggcacuuuaaucaguguguguggcuuuuaucacauaguaaagaaaccaguuugaaauuugguguccuuagcccucugauuuucccagggaacaagaauauaguaggacaggaaucuaggcguguucauauuguguagacucccuccgucaguggcaauaugaagugugauugcucucucucucucuguccugaagcuuaggcaacuggaagaugccauagaagacuguacaaaugcggugaagcucgaugacacuuacaucaaagccuaccugagaagagcucaguggugagugcucuggaggagccaggggggcugccacugguuaacuaggggaauugcguugugauugacaaaacagacccagggauguugugaggucauuugguccuucccccugccucuaggugggauuguuccaguccuagacuaucuuuauagaccuccagcggaggagauugcacacgcucccucagucucccaugccugugucuaacgccccucacggucaguaaguuuccucugaugccugacccaaauuccuuucauuaacauaugaguccauuuccuuugagacuuuuuuuguguuguucacuucugcucuaacuuggcacagugcuuggcacgucugugcuugcccaguaaguguuguugaaugaauguguggugcucggaagagggaagaagaagaaaguauucuuacaguugaggagugccugcuguuuaccaugagcagggagaguacaguugaaagcaauuucacuuacucaguggugcaaauauauauauuaaagaaauacucuucuuugauagacccaggauaaauaguucaugccaaguauucagagccaagagggcucugugaaaaggaucgugccuguccggauuuuucccagaugcugcccagccuuuuuguucauuuugcucuuucaucauccauccuccacagaauuuucuucagacagaacaguaccaaggacuaaaccucucaaaaagcgugucuucugacacaccuaugucuagguguggggacauagccuguauguaacucuagcacuuguaagguugugcaaggccagugugggcuauagaaugaauuccaaaccagucugaacugguggggagaugccagcccaguggggaccugagaucagaucuccagaaccaacauaaagucugaugucuguaaucccagcuccuccacagugagaugcagacagacaggagaguucccagcagcucacaggccaacuagccuggugcauuauacagugcuaaaaaagaggcccugucucaaaguggaaagugaacaccaacauucaagguaguccucccgucuccauuauguguuccuuggugagugugagccuucgaucccacagaagcauucacacaccagucuggguuuagcaccuggcucaguggacagaacaagucauuucauuuccuccugcucucuaagcaaagaacuuccuggguuugguuuuguuguuucauuuucuugaaagugacuaagcuggccuugcuagacuuucuguuguagauagugaugaugacauugaacuucugaucuuccugucuccaccucugacaagugcuaggauuggaggccagcaucaguacagcuuuauuguguuuuuauacaggcuaggaaagcaguauacaugccaagcuaccuccccagcccuguggggucccccaccccaccccugucucagccuggagcagugauacugguuuuagagauccuaaaggaaaaggaaguucuugguuaucguuuuuccaaugcccauuuuauuucuaauuauaaacuguaaaaguccacaggacaagcacuacuuaacuaaugcuugagccaaaacuuccuggucaguaguacagagccccucagauccucaccacuaagauauaagaacugcugguaugugugauuuuuuuuuuaauaaaauuaaguggaacaacaacaacaacaaaaauagccgggcgugguggcgcacaccuuuaaucucagcacucgggaggcagaggcaggcagauuucugaguucgaggacagccagggcuauacagagaaacccugucucgaaaaaacaaaaaaauagaaaaaauaaaauaauaaaguggaugacuaagucuguccagugaaaacauacgugaauuguauuaucaguucugagagacuagcccuuauucagcccagaaucauaugcacugucacacagaaauggaagcuugggcuggagauauagcuuaauuguauagacccugccuagcauguuugagggccuggauuuacugucucccugccccuuaccccacagaagagaauggaaauugguagggcgcuugccuagcguacacagaugcaguagcuggcacucuacaaauggggucacgugucuguauccccacacuaaagagggaggucagaggaucaggaguccagggcugggcuagagagaugguuuacuggguaaaggagccuaccaccaccaggcuggaccaccucagugccauccacaggaccaaaugugcuagaaagaaagaauugacucccaagaguuaaugaacucugaccucuacacauacuguauaguuaagcacacgagcacacagacagacacaguaaauguauuuguuuguuuauguuuuaugagacuggguuucucuguauagcccuggcuguccuggguuagacuuacuguguagaccaggcuggcuucaaacucacagagacacaccuaccuuugccucccacgagcugggauuaaagggauaugccgcaacugccuggccagauuuuuaaaaauugacaguucagccaggcaugguggccuacaccuacaccuuaaucccagcacuuggguaccaguggcaaagcggaucucugauuccgaagccagccugccuggucuacaaagugaguuccaggacagccagggccacacagugagucucaaaaaaaaaacccaaaauguucaaggccagucugggcugcaugaaacuauaucucaaaaaauuaaauuaauuaaaaaacaaaacaaaaacccaacccuuugacccaacugaaggcuuuaagcaacacaaaauguacagaauuccuugcaauuuuuucuaacagcaaaagaacagaauccucuggcaccuacagccccaauucucuguacuaugguaacaggaaacaugaagaguuguucauucuuaguuugcuagaagacaguagaauaggauguguguguguuguguguguguguguguguguguguguuuacagucaacaaaaaugagaaguuuuacugacgguuccuuguuuugugucugagugucuuugccucugaaacuccaccccaguguggggcaguggacacuugggcacagugggcugagaauguagcagugguccccagaggcacugaucugcuugaccaccauccagcugggcucagccuucaagugcaacagaugagagcuguuugucucuuagcacaggcuccggcucuuccucucucaaagcccuaagagauggggaaagauuucuugaguuuaugugaaauacugcagauccuccugugcaguucacaccugcaauccuaguacuugggaagcuaagguauggccaguucagggccagguuggacuacaaaguaaguucuaguucagccucggcuacagaaugagaaagaccucaucacaaaaaagaaaaaaacaaaaaaccagaagaaugcaagucagugcccugguacuuguuuauuacgcuacguagaggccuagugaucaaggcaaucacucagaugucagguucgguguuguuuguuuguuucgggacagguuucuccauacagcccuggcuguccuggaacucacuauguagaccagacuggccacaaacucacagagauccaccugccucugcuuccugcgugcuggcauuaaaggugggggccaccaccaccuggcaauguguguuaaauuacuguauuucagauuaucugacacuuugaccuguaaauuaguucucuauuauguuccuaguuacccugugucugcagggcauuguguuuuuuguuuuuauuuggcuugguuuuauugagaccaagucucacaaugucaagcuggccgugaacucagagauccuccugucucugccuccugauucuacaauuaaaggcauugugccaccaugcccagacuggacauuguuuuggggggugugugucuaugugugcuuuauuuuuuauaagucaaagaugaaugaauguauuuccagaaauucagagagccuaauuaucacacuucucuuuggccagccacauugguaucagucuuccugcccuggucuccaaagcugaugugcguuaagauggacuagugugauggaaguguggaccgccucgggguguagcagcuagcugcacuguguugacucugcccauucuuagcagaugugucuguuagauggagagaucaaucuuggugccaucacaugguucgaauaccacgugguucugugggaagcagcacuuccagaguccugguacccugccuguuccaggcacucuucucauucuggcccagaguuuccucuuugcuuuugugcuauggaaauagaaacaagacugugcugcgagucccuucuucugucucaccucuaccucugagauggauugaucuuaguggaagcauuugucagcagcuuccacccugaccuugauccuucuaguggcucaacuaaccccacuuguagccuugguuggaacuggcccugcaugucuggcacggaaggugucaaagcucuuucacagcaguuugucucacauggucauuuuucucuuguucagagcagucaaguaggugcugucacagugucuuugcuguugggcagcgcugugacaccgagaacuccuccuuagcccuugccugcuuagagcaggggacugcugacugggugcaaugccagccuugaggcacugagaguucauucaucuucuuuagauaagggauucugcuguuugaugaaacauccuaccaaaaguguguaucucuugcaugagccauaccuucucccuagaaggucccacaggccguuacuauuuaugucugagugcuguauuacccuguacuuccuucucaguuacauggacacagagcaguuugaagaagccgugcgggacuaugaaaaaguguaucagacggagaaaacaaaagguacgaggacaaaggggcagagacguguugcucgggggggcuguggucuucucgguuguuggucgcagcacuuaggaccauuccauuugcucacuagccuggaagccagcaguuccugggaggggcucaggcaccuguguucuggcucugucuccucccuguuagucucacuuccuauauauucagaagaaagcaccaaaagagucccuguugugguuaccaaaguuucuaccccuuaggcaggcagcugggcugucuguugaugcugccuuucucccuccagaacacaaacagcuccuuaagaaugcacagcuggaacugaagaagagcaagaggaaagauuacuacaagauccugggaguggacaagaaugccucugaggacgagaucaagaaagcuuaccggaaacgggccuugaugcaccauccaggugagcgcuggaggaggugcagcagagcccacagcgcagaugcagugggcacccaggagaucgcucuucagugggaaggagggggugcuggacucccuguccuacaggcugugggaggugccacauuccaaacuuggacaauaauagacuuuguuuuccugugucccugguuucacugaauccucuagaucggcacaguggggccagugccgaaguucagaaggaggaggagaagaaguuuaaggaagugggagaggccuuuaccauccucucugaucccaagaaaaagacucguuaugacaguggacaggacuuggaugaggagggcaugaauaugggcggugaguugguuugggcaucuacaaugaaaauggucccuguaccagaaaagcccccauugaaguuaccaaggcuucugcccucggggcagcuggguugggacaccccagaggggaggucuacaaguacucagccagcgacauaagccaauaaauaggcuguuaaaaaaaaaugagcuagggcaggagccaucagaacuguugugaccuggacuaaagcgucagggucuccaggacugguacaguggcuuugguaacacugaauuugagccuucucagcacggccccagcauuauaggagggcagaugcagauggcguuccuagcuagguaagaagcccacucggaggcaggggaagcuucccuucuagacuucacccggaagggcacagaucccagaagcagggucagcagguucugccuggcugacauggggagaggcuugcuaacaucuaggcugaaauggaagagcagagugagccucagaagucuucugcaucagguuccucagaucuuucugauuucccccuuuuuugcccuuuccuuccuaauuaccagauuuugaugcaaacaacaucuucaaggcauucuucggugguccugggggcuucagcuuugaagguagguuugccugcugcucgcucuuaggagcucccaggugacagaccagcacuggccccucacucagcagcaccuggggaaucugaguggagacagcuggauccuuguucagcaggacaggugucuaugcucguguggcugaugaggcuccuggguuuauuuuucuugggaccauucucagugcaguuagcaaagucagagaagcauccccaagccccguagugucaugccuucuccauaagagcagggguguugagaagcuacacacaaagugcgcuucagcccagugguagggcgcucacccugcaugcuggcccuugugcucuaggcuuagacugccugauacccuuggagucucuguuuggauuaagcugcucuuuaagacuuugguauaacaacagugguuuuccuaagaaaaccacagagccaacuaacaagccuuucuuuuuccuuucagcaucuggcccagggaauuucuacuuucaguuuggcuaaugaaggccaacuacuuaaaacccagaaaaugcagacuugcuugguuuaaccaugaguguggacaguucacuuccuccaucaugucccuguguacuuagagcaguuucguuuucucagucgggugcccugugucuguaugaggggugaaggaaagggggccagugcugaggacuagggagggagggaagccagggguagacagggaagcaggcagcuugugaauuuuuguuguauuguuuaacuuuauuaaaaaagaaaaagaauaaaauguuuugaccguucuuugguccuuggcuuuggcagcugcucuguaccugagguucuuccaagagcauaggcaccagguguuguaugaguguguguguguguguguguguguguguguguguguguguguguguguuuucucacuauguaggcucaggcuagagcaguccuccugccucagcccucuccagugcugggauuaagguauaagucaccacacuguccggcuccuauagcagggcacuggagcuugagggauauggacaagaggacaaaauucugcuccugccugccagugguggugcauguuuuuaaucccagcacuugggaggcagaggcagguggauuucugaguucaaggcuagccuggucuacagagugaauucugggacagccagggcuacacagagaaacccugucucgaaaaaaaacaaaaaaauucugcucuuucaaagcauggcaggcagcuccuggucucgggccuuugcuggcuuaaggcucaaacuguuggaaaguguucucugcaaaugcaugacuggucuccucccgcuuacaugaggcaacauaaagggaucugcacacugcucagcuaaguugcuguucuaggcagacacaagaggcucugaagcuggacugcaggugcugauggcacagauagcuagggagagagaggccuugaaccagagcagcagg

SEQ ID NO: 6380 - RNA, 7726 nt, Mus musculus
acaggggaaaaaaaaagcuuuauuguucccuccgagggauuaaugccaaggaaugaaugguccuccugcccccaauccuggagggacagauagacaacaguguaggauaagccaaggccccucaugguuccuccagucugggcuguuuccaugugaaggcuacucacugaauaguccuggcccugggaaacaggcauggggaccaggcucaggaugcucagccugcauggcucuauaaggaccaacaguucaugcccuggccaccagacauucuacaacgggcuggccccagaccagacgucuccccaaggugggaugcaaggaagguggaaagagagcugcuggcuugggagugagugccugcuggccagaaagucuguaagaucuggggucccuggcuggaguuucuccagcugaguccgggagagggggccgggagcccccaaacggaucugaggagauggagguggauguugcggaucccagcugggggcuacuugucgaugagcccucccucuuugagcuugaaguagaagaacuucuccagggcacuggcgcagcgacaguauucgcugucugggggauuguacucccggcaguuggcgaugacccgcugcaggucagcuacgaagagcuuccgggucacauaguagcgacugcgcaaccguucugucauggucuucaggucugggucacgagagagaaggcacaugacuuuaagaggugaagggcuguaacuggggcugcccaccaugguacaugcagacaggagucaggcuacccugucaagacugggggcuuaggcuggggagugaguacaaggguccucaccaauggggaaacggauaaccucguaguagucaggagccucugacuucuucacagguuccaugaagggccaggcacuggggugugacuagagagaagagaggagcugaggacaggcccaguguucaccgcccaaccgaagaccgccacccacuucaguuaccgacaagaagaccuuggccucccaccuugaucugagccagcagguuuuugagggucguauauagcugaucaggauccuuaagcuccuugcuggaaaugacagauaccgaggcugaggucuggguccuucuugcccuacuacacaaacacacacacacacaaacacgcacgcacacacgccuccauuccuguggucacucccccuugacugaauggacacuuaccccuucuccuuucccaguggcuuccagccugucucuccugcagagggggagaaagcaucccucagaaugccuacccaugcccugagaaugccccccugcccucucagccaaggccccugcucacgaaugccagggacgcucuccaccgggaucugccucacucccucuuugaagcagcugaguccaggguagaccuugcggaucugugccuguuugcgcucaaucaacuucuugaugaucugaggaagcgagguucugagggggccaacucaggcccaaucacccccaagaccauggucaguaaaugguaacauuuacuuuuggcuuuuucuaagaggcagggcaggaaccuaaaaccuggccugucucuaccacacauagacauacacaccucuuucuguuucuugaugaugugggacagcucuguguaggggauucggggauucagcucacacuccaucagcgucgcuccuucauaguccuugauguagcccagauagcggcucuugggcaccuugaugucuuuggagaagcccuacaugaguggagaguuaucacaguccaucagcaaggacucgcuaacguucacagccacuucuccaggauugacugagaagacagcacguagugcauuucuuccuguaucucugaucaucaggguagcagugugagaaccgucccugccccugcaaaggcugcaggccggcugcuccucaccucuugccaucccccaaaggaccuuccaaucccuggccuuguucuucacuggguggcaaagguagggagaagaaaggggugggcccuuucucacuggugccaggggacucuacuacuggaugcugcacacacaaaucagggccccaggcagcagguaugagccuggugagaccaaggcuuaccugcuuuuugaaguagccaauggcguacucgucagcauaggugagaaaguaaaggaugcuguguuugaugugguacuccuuuaggugguucaucaggugggugccauagcccuguggggaagauggaacaggguggaaaggagauggggaagccaaggcagagaggacagguggcuaucagaggcucaguguuuauggagggggagggaaggcuuucuaggugcuugcucagggccagacucagcacuugagucuucaaagacccauuugacaguuagcccacgaccagguauuaaaagccccauuucacgggaaaaacaacaccaaaaaaccccccugaaagccaguuacacaaagaacagucugaggucaguggaccacgaacggaugcagcagagcugggcuccaacccaacaccgcuguuggccccacaccugggguuuuagaauaaagggggagagcagaaaggggucacagaggccuguucaugucaggacacaaaacaggagaaugaaaagcccaaaaggaguuuguuguaaaaagaaagacagaagcugggacuaucaacuuccccaagguauggaaauguuccugugaagaaaccaagggucacuuuaaaaguguggcugccuugggguagagcucaguuaguacaacaccugcucagagugcacaaagaccuggguucaguccccggcaauggauaagacccgguguggcagugcacaccuguaacccuagcaaccuggaggcaggagaaggggaucacaagucuaagguccccgggacuacacagggugcuuaaggcugggcuuggcgacaugagaccuucucugaaacagaaagucccuaagguuaacauaaaaauauugauuguugggaguagaacucacugguagagcauuugccuagcgugcacagggcccugcauucuaucccaacaucagaaaagaacaaaacaaaacaaaacaaaaaucacugcugcuuuggguauuuuuucuuguuuguuuccucaggacaggguuucuuuguguagcccuggcuguccuggaacucucacaguagaccaggcuggccuugaacguggagagaucccugucucugccucucaagugcuuggauuaaaggcaugcaccaccacugcccagcguagugcguuuuuuuuuuuaaaaaccaguauuuucucaaugaucaguuaucaagauaaagcugccacccugugggaguauguggaaaugucuggucgcuacaagaagggcuggggcacagauacccugccauuuuggcuggcuugguccauauucagaggugggugguagaacgggguuguggccaggggcacugugcucaccuugaccugcucauuugaggugacggcacagaagacgauuuccgugaagcccugagugggaaacaugcggaagcaaaugccaccgaugacccgcccauccuugaucagggccagggucuugugcuuccuaagagagaggggacaugucauggaacucaccuguccucuccucgcuccccaggucccucagcccugaaagagggaagugucaucagggaugagaacagagggcaggaacggaacccugaaagguggagcccuguuauuaagagagcguccgguguagugggauggaaagagaagcagcucaggggcuggaguccuccccggggacucacgggucaaagacgaggcgggcgauauauuccuugggcauucuuggcagcuggugggaaaagacauucugcagccccacgagccagagcagcacgcgccgguuggccuugggcgucagggaguugccaaugacguggaacucgaugauuccucgccguucuuccaggcgagccgucucaucucgagcugcguuggccgaaagcaggcuugucuaggcagaagaagguguaaagcaagggccuugggguggagugaagguggggauccccucccccacaggccaacagacugggcucccuaccucaggccccagcauggcagcggggucagugaucgucagcaugaccucauugaccagcuccauggggaugucccccaucacgcggagccgcuuggcauccuccagggucagguucucaggaagcuuccucuucuccccugcuggggaggaugacagggucaccccggggguagcaggaaacguggaggcaagggugaaugugggccaguggccaguggccaaguacccaccuggcaugggcucagucccugcggaaucuaggcucagggagcuguugcugccuccucccauggaaggacugaagcuggguacaacuguugcacugaccguggcugcaagagagaggaaauccaggauggggggaguggaggguguggcagagagggcauggcagggccuuuagaagcauccaggccaucucagcccugucugagccccaagguaucuucccguugccaccauaccccaccacuauuaucccagaggcagcaggccagggcggccaagcagacccuauacagcuauugugccacuuaccuggccggggcaccagcuguguccccuccgaagguggcauggugaagccugacucccagaugggagaauuugccccguagaucucuuccucaagcauggacaggaaucuguagggagaguacaacugucccacgacuccagccuucaaugaggaguugccugggccagaccccagagggaugagaggccagacagacagacccuguucucagugggugggaggagacagcagcuucugcugucugggaaggcgcaguauguugaguggggaucagguccucuucugcucaggauaggacauagccaggauagagacuggagacccaauuuugucaugauguguggccaaggagaacgggucugagcggaugccauccuaugcuguguggcuaggcagggcacccacccagucaccugaauugccuuaguccccucucuaucagacuggucuagaaugagccaaucuugucaccucuuguucccacaugcuuguucccagauucaaaugggaagaagauguggaacaacagaggcacagagauagguaauggcuucacuucaaaaguaaacucuaagccaggcgugguggcgcaugccuuuaaucccagcacuugggaggcagaggcaggcggauuucugaguucaaggccagccuggucuacaaagugaguucccggacagccaaggcuacacagagaaacccugucuggaaaaaacaaauaaacaaacaaaaaaaguaaacucuagacuucucagagcacugugguaggaggggcucuggggugauauccacacacccagaggaaacuaauuaguaacuaucuaucagggggcugaaagaggguagcguuagcuugggccauguaccugccauccccagacuagcacauacuagcaaguagcuucugggccaugggcaaaucugccagguagacacccagaucccagaaggcccauggagggagaggagggaccaauccaggaagccuuccuggaaaaaaggggacaacagcaaggacaugaauuugggguaaaaucccaggaggccagacugagccuuacuuggggaagugagugaggaugaggguccucuucucaggcaccaguuuguccuuuuccacccgaaauuuuuccaguagcugccggcgggugacagugaaaauggaccguagaaggcuucggccaaacacguggguggucucguagcgggggaggcugucgcagcucuggggcacguggcaguaacagagccaucugggggagguggagcggcaggugaggguggagaccgccagacuggcuguucaagccuccccuguaaggcccugucugggcuuaccugguauaauugacuuuguagguagcgacauccucagacugggaccgcugccggaauugagcaggggucuccagcuuccaguaguuaaggcagagcaggaacaucuuugagagcucaaacauugucuggcgcucucggggggccagguggcuaaauuuguacugcacaaaguucaguacacccugaggaguaaggaggggacaaaaucaggaggagguguggacagccaacagaggcaugucaaauaggagggauucugugaagagaaccucugacccuuccaacuuccacacccacucugaggucagcaaacaccaugucccuuccuugaaccucuccccuguucucagcuugaggaaauaaaccagacucuccacccucuuaagucgccuuuaaucuugcuacaugcccgcccuaccuguucaauguuaggcuucucaaauggggggcugccuagagaccccuccaccacuggccgugucaucugcagaaugcacuuccgcaagagcuguaaggaagagggaugggcagaaacaggaguagcagagcucagagagcaggauccccaacacacaccaaagcuucaccaucuuuacuccaugagaacucaccuugaagagguagaaauagacuuguuuggugucuguguccucuuccuugugaacagacaugaacagauuuucuacaucuacuaccauucccaagagccgguuaaucucguccucugacacauucuccaggugggacacaugguccgcugcaagaugguuacauuagggcugggaagaacagaagagcuccacggggcuugauuccuguaccuccucuaacuagccagugacacacccuugauucuccaauucuugacagacagggagacccaguguucucaguucucccaucagcccuugguagcuaccugcuaccaaggcagaucuccuuuuuuccuuccaugggacauucacauuuauucccuacccaauauuuccuuagaaggucuccaagaagcucugugguacuuaugucacccuguucaaacaggaccuggcuccugcccuccgccccagcuccaaagguggugccugccuuacccaaagggugcucacagcuacggcacaacucgcucagguuggcagcuggcugcuggagguccaugcggggugcgguggggggcuugggguuuuuccagccauuacacuugcagguuucauuggccuggagggggaagguucaguucccugaugcugucugcaucccaagcgcaagagcggcucuauggcuagagcuucgccccccauuccuaccccagaccuuggaugccccaagccccgccccuuuugcucuaggccccgcccccaccuugcaagcugagaagaccccuaguuucucaagcuucuuggcacgcggcagaccccggacuugcgccuuccucuggcuagcgcgcugcugcuggcucaggccaggucgagccggaucccccccacuuccuaccccggcgcccccacucccugugcucccagcuggggcugcagcuggggcaggggcuggugccggagucggagccggaguggaggcugaagccggacugggcgcaggagucgaaguuggggcaggggcuggggagugaaggggccggggcugcgcugccgggaccggguuuggggccugggaagguuccgccauggccucccccgcagcggagcggcgccgcgcucccagcccuagggccgcaugggcaaccggcgcaca

SEQ ID NO: 6381 - RNA, 8189 nt, Mus musculus
uuucaaaugaggcccaguguugcucucucuuccugcugucugucaaucaggauguaaggcucucagccaccucuccagcaccaugucugccugccugucaccaugcuucccaccuugaugauaauaaacuguaagccagcuucaauucaauauuuucccuuauaagaguugcuguggggggcuagagagauggcucaguggauaaagagcacugacuguucucagacgaccugaguucaaauccuagaaaccacaugguggcucacaaccauccguaaugagaucugauacccuucuucuggugugucugaagacaguuacaguguacuuacauauaauaaauaaaucuuuaaaaaagaaaagaaaagagguucuguggucaugauguaucucugcacagcaauaaaacccugagacagcacccaaauaaggcaguuugcuuuucaaaucauaaagaagcgaauaagcaaaauguguggucuucaagacagaagggaagggagguggggagaggagaaauggcuaaagaggcucagcugagaagagaugcaagguuuuccccaaguccugaagaccagcugagauauccagucucuugaaaaaccacuggguucuuggaccuuccaucuguagacagucacuguuggacuagcugaaucacagccuguaagccauucuaauaaauucccugugugugugugugugugugugugugugugugugugugugugugugugugcgcgcacuggcuuugaacucauauacauaaaauaaauaaaucuugaaaaauaaaaaaagaaacaauauuuagccagguggugguggugcaugucuuuaguccuagcauucaggaggcacaggcagguggaucucuaaauuugaggccagccuguucuacagagggagucucaggacagccaaggcuacacagagaaacccugcuucauaaaacaacaauagcaauauaauauuuaauuugaggagaaaaaaagaacuuaagcugggauucacagggacuggaaauauagcuaacuugguaaaguuuuugccuagaauauuaaagccauaaauuccaacucaacacugcauuaaacugggcgugguggccugacgguaaucccagcucucuggaaguauuggcaggaggaucaagaauucaaaguuggacuagagagauggcucagugguuaagagcacugacuguucucccagagguccugaguucaauucccagcaaccacauggugacucacagccaugggaguaaugggauucgaugcccccuucugguugucugaaaacagcuaagauguacucauauacauuaaauaaauaaacuuuuaaaaaaaaauaaagaauucaaagucaguauuagcuaucuaucaaguucaaagucauccugaacuaacaccaugauucaaaaaaggggggaggggggcgggcaggaaggggguuaggaggaguggcuggagagcccucagcacuuacugccauuucagaaggccaagucuucuuucaucccuguuagguggcucacaagcaucugugacacacacacacacacacacacacacacacacacacacuaaaaagaaauauuucagggcuagcacuggcugcucuuccaaaggaccaacguucaauucccagcacccacauggcagcucacaaacuguaacuccaguuccaggagaucuaagccucacacacagagacacacacagguaaaauaucaaagcacuuaaaauaagaaauaagggauuaggggacaauguugugaaaucacaaagaaccaauaaaaaaauguuuaaaaacaaaauaaauauuucaaguagguuuugguuuuuuaauuaauuuguguauuugguuuugcuuuucugagauaaagucaguaaauucagacacaccaauuaccaggaaaauuugauugacccauauaugacaaacugcuguaagccauccuacuuaaggaccugccauaguauaacugacugugucagcuugucuguagaaggggguggguugcagucugucugucuguauguaugucugucuuggagguuucuuagcagauugccuauggcacacacugcauucagguuuaaggccaccuagguggaagucauuuucuuuaacuaauuuuguggagauuuacagacuggggacaacuuuggauauuuguuuguugauguuuuguuauucuuuuauuuauuuuauuugaggcagggacucucuauauagcccuggcuguccuggaacuuacuguguagaucagguuggccuugaacucauagagcuccuucuaccucugccucugaacguggagauuaaaaguaugcaccacaaggucuuauucacaagcuauuauuuacccuguaaggcagcaccugcuauguagcccacacuggccgcugacuuaguggagccauuccucuuccccagccucucccaaaugcagggauugcagaugcauuauguagaauggguuuuugguuuguuuauuugguuuugugguuuuuuuuuuuuguugguggugguggugguguuuuuuuaagauauggggcuggagagauggcucagugguuaagagcacugacugcucuucagagguccugaguucaaaucccagaaaccacauggugguucacaaccaucuguaaugagaucugaugcacucuucugggguguuugaagacagcuccaguguacucauauaaaauaaauaaauuuucaaaaggugaggagggaggcaaacaucccuuuccaaaaagaaagaaagaaagaaagaaagaaagaaagagagagagagagagagagaaagaaagagagagaaagaaagaaagaaagaaagaaagaaagaaagaaagaaagaaagaaagaaagaaagaaaagacguguagcucagacuggccuugaacuuguuauguagcuguagcugugggugaccuuguccucuuuugggugggggguguggagauggaacaggaccuuucucuuucuuucucucucucucucuccuucucuuucuuuuuuugguuuuucgagacaggguuucucuguguagcccuggcuguccuggaacucacucuguagaccaggcuggccacgaacucagaaauccaccugccucugccuccugagugcugggaucaaaggugugcaccaccacugcccggcugaccuugaccucuugcuggcacauacccuagggcugcaacaacuagucugcacgaccacaccucggcagcugugguuuuuacuugagucugaaucugcuccugaauggaaagcaagcacucuuuccacacacaccucccugucuuucucgacgaucuugccacccuggccuuaacucccuccaucugccaaccugagccagcaacucaacaaguuaccuuuuagguaacuuguuccuuuaagaacauuccgccccacccccggguccucccagucaggccggauuuccugcccaagcccugccuuuuaaagucaucacuucaacuuucaggacugcgaccagacacacugagggacccugaggggucccggggugcugaaaguaagcagaaauaggcugugacagguguauauauauacccagggcucuacugggaaacgggaccagggcagggaagauccugagagaaagcaaagucacuugggaguggguaaaaaugucacgcccagcccucuccucuuacgaaggagggaggagcugucagagcuguucuucuagcucgagaagcaaggaugccaguuaguaggaugccagauucuuuuugguuuuucgagacaggguuucucuguguagcccuggcuguccuggaacucacucuguagaccaggcuggccucgaacucagaaauccaccugccucugccucccgagugcugggauuaaaggcgugcgccaccacgcccggccagggugccagauucuugagggucucucuuccauauugccugccuaacagggcccuggcuuccuaccaccgucgucuccuuccucuguuuucuguaugcggcggagugugugggaagacaugguuaucccccucacaccccauuccauuccauuccucucccaggagcuccuuggagaugcuucugcuguggcugcugcugcugcugcuccuccucgugccccugcuggccauacucuggcagcagaggucucggggugccaggccaugcuggcugaucagucuccaacaccgaguggccugggggaugcugggcugggcagccgccuggcagcaguggagacuagaccggagcacguugaaugugggccagagccagcagcaggcccucauguggugucugaagaaagcccagggcuccugcugucuccccagggaggacacagguguguuucuggcaccugggggaggugacccaaggagagaaaauagcccacaaggcagucagauucuagaacucaagggccccuucauuuaccaccaauaugauguggccuggugcagagcccuaccauggcuuacaaccugacaccuauuaggauggguuuuccuuugcugggcccuggucuagccuucaccucauuucccaggcccuuucuggguuccuuucucaaggcucuccacagucuucucacuuccugaggaguuucugauuuuuuuuggggggggggucuacagauaugagaaccuuccggaaucaucuuccacugacccaaaccagccacacucaggagcaagaaagugaagagacgcucccauccccugccuccccccaguaccauggagacgccucuuugcagguaaacagagguaccuccaccucacaacagcagaccccucccaaaaggagguacaaagaaggcccgcuaugguagcuggggucugguucuaaggucugaaugacaggcccuccugucucccuccaggccacccugcugggucuaauaacccuaaacaaggccuacccagaagcgcuggcuccaggaaguacugccugugugaccccuacaucgccauggcccugcucuguccccuggcuugggcacgcccugggccggguaagccccgauggagccaaggacccccggacccugcugcuggaggcauugauauccccggggcugaggguacuugaggcaaggacugcaguggagcuccuggaugucuuugugggcuuggaggcugauggugaagaacuggcugaggccauagcagcugggauucugggaacgcuucuccccaaacgagccgcugagcugaaggaggcccuagagcagggaccccgaggauuggcccgccggcucuggccaaagcugcaggugguggugacucuggacucaggaggacaggcagaagcuguggcugcccuuaggguccuguggugccaagggcuagccuucuucucuccugcuuaugcugccucaggaggucagcuugaugcggggggggauuggauggaugcagguggggcugggggcagaugucauacagcuagcuaccaugcauugaggcacauacacuuaccuucuucaacccuccucagugccugggaugguauggguuacuagcucugacuaacagccgagcacacuaagguucacugagacaaagugucucaggcagacucaggugguaccaggauuuguuuccaccucugaucccugccagaaccacagccucucugccugcuucugcucagucaagaccaggaaagagcaggcuggcccuggggguggucuccagagagguugaaucaggagggccaggugcuuagaggagccgggccugcugucccgagugaggcguuacuuucugcuguugccuggcagaacggaaugcaccaugagguugacaagaagauuguuuugcucucuauaggagugguggcccuaaaccuguggccagagcgaccccaaggauccuaucuucugcccccuggaguccccuuuauugagcugcuuccaaucaaggaaggaacccaagaggaggcagccuccacucuccuccuuacugaugcccaaagggagaaggaguaugaguuggugcugacgaaccacaccagccugaccaggugauucuccuacuaacuggcucuugucuacucugaugagaaccccggccuugggaagggacauaagcucacucuucucucaacccgcuccuuaggugccgccugggugacgugguccaggugguugguaccuacaaucaguguccuguggucagguucaccugcagguaggugaccccggggggaugacgaggggcugucccugugccuugggcccacuccuucuuccuuccucaggcuggggcaaacccugaauguucgaggagaaguuacugaugagacuguauucucuguggcccuggcccaagcaguggggcaguggccaggggccaagcuguuggaccaugucuguguggagagcagaguucuggguaagcaucucuaccaucuccuaccuccguuucuugggucuggcuauccacugacccauguucgcccugaccagagacaucuaggaaggagauuaaucacacccuuccccacuguuccuaaagaaagucccucucuuagggcuagagagaugguucagcgguuaagagcacugacugcucuuccaaagguccugaguucaaaucccagcaaccacaugguggcucacaaccauuuguaaugagaucuggccccccucuucugguguaucugauggcagcaacaguguauuuacaugaaagagaaagaaagaaaagaaagaaagaaagaaagaaagaaagaaagaaagaaagaaagaaagaaagaaaggaaggaaggaagaaaaaagaaagaaagaaagaaaggaagaaaggaagagagggggagggagggaggaagucccucucuauaucuaacuuccaucccuacagucuccaccucuuuucuuuccugaucugucucauauuuagaagucauuuguagguuccccucuauucaucucuuaccccauuaagcuuagaagaggggagaagugagggugcagggugucagcccucgaagcugccuuguccucagaaagucugcuuuccuguggcuuuauccucagacuccugugaggguucugccccacacuacgaaguguuuguagagcugaggggguugaggaaucugucggaggaaaaucgagacaagguaaaugaugagaccugggucugauucgaagucucuuuugcucuacaagcucccaguugucauggagaugagagaguuaagggaagaggaugggccuuagggagggggcggcacccccuuucagagaaucuagaaaggaaguaugggucccacaacacaccaaaauccuaagugcauguggccuuggauacggucaugcauauccaguacacaugccaccgcaucgcaucauggccuuaacucacuauucugcccuuagcuugacaacugccugcaggaagccuccgcacaguacaaguccuugcgauuccggggcaguguggguccugccaaaguccaucuggugaggccagggagcuucaggguucuccgggaagcacuggcagccuucuccuccuccuccugccgcccuccugaaaugccucgggucaucaggcucaggcaccuggcccagcuccugcagaagagggugauauccuaaccaaggcagccagccuuccuguuucugccucacucuuuccucuggaacaucucuggauguugaguccuggaccagaugucacauaacaguggucugauuggguccaauuggacucauuggcaaguuuuaagaugccggcuuggagcacacagcugaacccaucaucgauggucucccgucagccuauccuucgugagacugcugguccuucucaugugcuuggccaagguacagcaagggcugaaaguguaggcagugcuccuggagcagaugaagaaaccucaggcucagggguggugagauggcucagcagguaagagcacugacugcucuuccaaagguccugaguucaaaucccagcaaccauauggugccucacaaccauccgcaaugagauccgaugcccucuucuggugugucugaagacaacuacaguguaccuacauauaacaauaaauaaaucugaaagaaagaaagagagagagagagagagaaagagagagaaagaaagagagagaaagaaagaaagaaagaaagaaagaaagaaagaaaga

SEQ ID NO: 6382 - RNA, 55704 nt, Mus musculus
uaauuaugcauggaggcgugucuuggccaguggcggcuggguggggauuggcuggaggggcuguaauucagcgguuuccggagcugcaguguagacagggagggggaaccugggguuccgacgucgcggcggagggaacgagcccuaaccggaucgcugagguacaaccccgcucggugucgccugaccgcgucggcuaggagaggccaggcggcccucgggagcccagcagcucgcgccuggagucagcgcaggccggccagucgggccucagccccggagacaggugaagggggugcaggguggggccaccuccccgacggcacgggggacggcaugggggaccccacgguucgucagcugugggggugcuuagagcugugaauggacacuuacauggggcaggaggauaggaggagacacacagggucgucccggcggcacugacguccggaugacaggaaccagccugggaaaggaagggacgcuguaaguuucgagggggagaugcggagagagaguggggaguucugggggguguaggaccgugggggggaggacauucuaggcugaggguaacagaacugacagaagcggcccuccugugacugcucccggaggcuagggacguucgggccaccagagccacugccacucagguggagaucauugggguggaggcguuagaaggagccuccuuccugccccugugcugggccuggccguuccuugccuagccacuuucuuugccuugcucccguuccuucuguagucagcuguacccacuuaggaggugggaacuguugugucucuccuccugccucuccgccccucccccucccccuccccccccccccccagccucugggacuggcuagauuuuuuucuuaagaaucagauuuccuauagaaaauugacaaacuuguauccuuucuaaauucucucccaucucuuucuguguuaagcuaugauuucccccaccuuguuaagaacacuuuuuuuuuucccaauucaaaauaaaucccuggccaaaccagcucuaaagagcaacaaaccucuuuccucuuugacauuguucucucauaaacaccugguaaacucgacgagacgauaaauaauugagccauugcauuuacuggaucgugguguugcuuaauugcacaggccagggugagccaaucaagagugggaguuuucugucucauagccaagcucuuguguaaaagcagaagcuagggaaacaaagacaggcuggccuuggcugaguucuguguguaaacuuuaccuguugggggguguguggcuauaaauugguaaguuggcaaaauccagacuguugcucaagucacuuuuuucauaccugguccacaucccucgguuguaucaauugauguguguauggguacugucagugcuuauucaguuuccuuauucagaguguguguaguuuauaccugcuguuuacuacagugcuuauuuguguaugcauugugaauguugggcugucaguguaggugcagcauggacgugaauauauuaaagcaauaaaucacuucuaucuucuuuuuaauguggaauuagacuguuaggauuugagccagccauuuuuucucuuuuuauauuaaauaaugucuauguuccuugaggaaacauguuuguuucauuauugcaugugccggaccagaacacuaagcgggaucuuuuaauuuuuuuuuaguuuuagacuuuauuuaucuuuguucuauguguaugaguguuuugccugcaugcacgucugugccagugugugcccagugcccuagguggccagaagaggacaucagagcuucuggaacuagugacagaugguugugauccaccaccuggguccugggaaucaaaccuagggcuuuuggggagaaccacugggaagagaaucuggaauaauaauaaugaaaauguuggaguguuuguucuuaguguuagcacacuccccacaaagaaccauuagcagauucaugaaucuuuuauuuucaucuguaguucaucgggacaaauaaccacuuagagauaauccucaguuaugaggcucucgauaggggcugagagauagcuagguggcucacugaaugcuaaccucauuuuguagauaaggaaauugaggccaauaggccuagacacuugccuuaaggcaucgugaguuacaaugguuuaacgucugccuuuuacauauuucuugguccaugcuuaaguauucaguuucaauuuagagugaguauguucccuguugagaaguaucagagaaaaucugaauaaugaaacauuggcagcugaaagccaaaguaacuguucugugucucacccucucuccucccucuccccccucucuccuuuccccucccccuucccccucucucccucuccuguuagcauaauuuacugucaaacuucagcuauuuuuuuaauggagauguuuaggcaaauuuuagcuaaagggcggcugugaccucaaugacauuucagccggagagccuuguggucaguggucguuucugucuguagaaaguuccuuuuucuuuugucuugacauccaaaugugagaagggcgcggagguagugagcaccuuccuugaugcccaagcccagaagccuuuuagcugauguuuucuaagagauggugaugguguacagcucagagaauacuuaaccucucugacauugugaaaagugcuagggagagugacaucuuguguguagauuugcaggcuguuggagcaacuugauaaaugcuuuauugucuaauacaacacguugaugucauuaaggagagcaaggcauuauuacuuacaccugugccuucugucccucccugcucucuucuuucccucaguuucccucccuuuuacucuccuuuucucccuuucuggggacgaaaccuagguugcuaacaagcacucuaccacggaacacauuuuaugucauucggauuuuaaaguucuagccaaauaaaaaaaccaaaaaacucaucuaaagagugcuugaaggauagcccuaaaucuugaaggacuccuggugcuguggaccggccucagugagaugguggaggauggcauuggcuugcugucuuugauggugaaaagaauguuuggcuugcucuggugcagauaguugggauuaccagauuguauuugguggcaaauucuuggaaauaauuuguuuaaaggaguaacauuuggaagaaugaauuucuacuaugguucucauuuuuuuauguuauguuugcuauaacuuuauucagcuaacauacacacacacauacacacacacacacacacacacacacacgcaugcacacaugcuagacggaugaauggugcuggcggcacaugcccuuaauuccagcacuuggaaggcagcagcaguggaucucuaagaauuaagggccagcuggucuacaaauugaguuccaggccagcuaagacccuggcuuaagaugaacaggaacaaaacacuaagcagaagcuggccauggauguuucaugucugcaguuuuagcauguggcuagccaagaacugaggccaaaaaaaaaaaaaaaaaaaaaaaaaagugaguuugaagcuagccuggguuaccuagugaauuccaagucugcuuugaguagcuaauaagacccugucucaaaaaaggcuaggcaggucugcugguauaugcuugcaauucaaggauuugggagacacuggcuggaggcccacuaccaauuuaaggccagguauucugcguagcuagcuggagacuaccuagcaaagccccgguucaagaaaaaguauuuucacagagacaggaggauugcugcaaauuugaucaagggaagccugggguucaugguuucaggccagcuggggcuauguagagaaccccguguuaaagaaccaaaccagaacaaaaccacagcagcagagaguagaagcugggcaggagccaaggagaaugaguauucaaaaccccacccaaguucucauggaacuguaggccuaguggggaccagagugcacacuguugcaguauucaccuaaggcagaggagugaguggcucaagucugaggcuacggaggcagagagaccugggauccgauccuggauucacugcuucuuggucagaagcuaagccucaguccugccugucccaccacggccaccccccagcuccccuccugucccaccacggccaccccccagcuccccucugguuuuuuuuuuuuuuuuugagacagaguuucucuguguagcccuggcuguccuggaacacucucuguagaccaggcuggccuccaacucacagagaucugccugacucugccucccaagugcugagaccaaaggugugcaccaccacugccuggcugagccucaguuuucuuaccuaacuuuaaaaaaaaaaaaaaaaaagacagacaaaaggguggggggaaggucggucuguuggcauguuggcacaugccuacaacuugagguauacagggagacccucucucaugcaagugaaauguuuagagcaugcagcuccacagcaagagcccuguauaucuuaaguucuuaggaaaagguccaaggauagagaggcucauucuauacaggggugagagguuacaggagggcuaguuuccgggaacaccagagcacuuacaggaggguuaggaauucuugcagagcuuguacaguucuuucaagguggugggggcguggaugugcugagcuuaaaacagcauaguggguuuaggggcuaaaaguggaagcucuuaauugaggagaaggaaacaggaaggccacagagccacaucuuuuaugccuucucuucugaucaugucacuagaacuguguuuuaaaaagauugaauucuuuucaugauaguaauauaugcuguguuaaaaagcuuuaccuguuuuccuguuaauaguucaguguguguuuucccagacacucuuuaacuuaccaguucauuuuggaucuauuuuauugaaaaucauuuuaacagcucaacaaaauaauauggaaggcaaaucuacccccauaagaaagugauguuuagaccuuggcuuuccaucuugccagcucuaucugugguaauaaaugacuuuacucaccacugaacaauugaccugaccuuugaccuuuuaaaugcgucagucaagaaacucacauucugagcucuccuaagguaacuauugcuugggugaugugcuugaggguuuugugguacauggacagacgcaauggcauucuaaagcagcgcuaugaggccagacaccuuggguuugaauuuucagauacaacaccucuuuguccuuaaggcugguugcuuuaacaucucugaguuucaauuucuuuguccacaaacugccugcuggguccacucacaggguagcugugaagaccgagugagaucauuuguuacaucauaagaaauuuugcguggugccuagcacguagcuaacauucaaaugauaucaauuaacacugaaaucuucaaucuuucucucugguuaccaaguugggcaaguuaugauucauggcaccauuagugaccugaaggaaagaaagaguaauuaggagauuuugaccuacaggggaagcuaagugacuagggacuggggauuuacauggugacagaggagauauaucuuugacauagagauauagacauggcaaacuguacauuccuguuacauagaggcucucaugauaagccucuuugcagcuucaaagaccuaugauccacuccauguauuuuaauagucaacacauugaaaguuaucacuacucaguaauagucccuuggaguuuuucaugcucuuaagaaguauagacagcuacaggcuaggaacauggcugaguugguagagugcuucucuaguguguaugaagccauggcuuccaucccuaggacuagauaaacccagauuuaguggcacacuccucuaaaaccccuuguuggguggagauaagaagaucagaaguuugaggucaccauggacuacacugggaguaugaggccagucugggcuaugugagacacugucuugagacaugggugguggugguggguguugcugguggcauggcucaguggguaaaggugcuugccuucaggccugaccacuugaguuugauuucuuucuuucuuucuuuuuuuuuuuuugagacaggguuucucuguauagcccuggcuguccuggaagucacuuuguagaccaggcuggccucgaacucagaaauccaccugccucugccucccgagugcugggauuaaaggcauacgccaccacaccgggcuacgaguuugguuucuggaaccugugugauggaaggugagaauuguuuuccacaaguuguccucugauguccacaccugcagcaugguuuaugugugcauacauaugcacaacuagaguaauagacuaauguaaaaugauuuuauuuauuuauuuuaaagaauauauauauauguguauguauguauauauauguguguguguauauauguguguguguguaugugaguguguguguguguguguacacucuacacucuagcugucuucagacacaccagaagaaggcauuggaucccauuacagaugguuguugcugagaauugaacucaggaccucuggaagggaaguuggugcucuuaaucacugagccaucucuccagccccuaaaacaauuuuuuaaaagggaagcagagagaauaugauuggugguguguguucauaaaccccagugaugcugaagcugaggcaggaagacuagguguuugagaccagccuggaacuugcucagauucugugucagauuuuugaaaaagggccagagauauauaacucagugauagaacauauuccuaaugugaacagagcuuuggguucagucuccagaaccacacauaauuuuauacacuauauauauaucacauacauacacacacacauauauaucacauacauaaacacacacgcauauauaucacauacauaaacacacacauauauaucacauacauauacacacacacacacacauauguaauguguguguauauguauauauguaugaaugagagacagagucucaguauguagcucuggugguggcaggccuggaacucacucuauaaaccaaguuggcaucaaacucagagaacagagaucugccugcuucugccucccugguauuuguauuaaaggugugugcuaccauagcaaaaagauaagggacagauacucuuggacaguugaaggguagaggagugguuaggguugaaucuuucuuaggaaggaggagacgggagaggggaagaagagauccagaaggcuuggacguuggaugacauccaugaaugacccacaugaugcuggaaguugcuuugcuguguccugugcagcugauagcgucucucuucacaucuguguguguguguguguguguguguguguguguguguauguguauacaagcaugugugagggcgugaauggacgugcagauguucacaguuacccuucacuugauguguauauacagcuuuaucuuccuguucuguaacuuuucuuuguaccuaacaagugaauagccucacagauaacaaccuagcucccaugagucaaauuuacuauucaccucuuuaaguuuggguuggagaagacaggaauggaccugcaaccaguccaacccagugggcccauguggaacagaaggaagccagcggagcuagaaagagaaagugaaacuuguaacuaauggcuuccguguuguggaggaggggcgcaguuuauuacggggauguuuggguaguuuuuguagaugccauuucugaaaacugcuugggauuaggaaagaaaaacccugccugucuguguagccaucugcuuucccgacggcugauugauuuuauuaguuugcggugucccgaccucuuguucucgguaugagagucugugcuuugagucuggacucugcaccugcuuaggugaaagcuuacuagcaaguuuccccacauuguaucuaaugcuaaauuuguuuugcuuuuagagagcucgcuuuuuuuuuuuccuggcagaaucuaaaugcauuagacuguuccuuugucucccccucccacccgcacaaaaauccuaaaaaccucaaaacccaaaugcaagcuguguaauuaccuuucccguaagccaaacaaugugaguuaucauuaaaauaguuagccuuugaaguuuuuccuacuugugguuuggacacaauaaauauuuaauguaaagcugacuucccuuggcaaaucaguguuguuguggucuuuuuucugucaaaauguuuaggaaaaacaaacuucuuaacauuaaucaaaguaaacucaugcauaagagggggugagguaauuaaagagcucugaagccgguguguauguaaauauaugugugugcauauaaauguguguguguguuuuaacagguuucacugucuagcccaaagaucucuccacauuccucugccucagucucuuuaauacucauuccuaauuacaugugagaaaaaaaauccaguaugacuucguucaucagggcaggcucuucguggaacggggaguguucugggcgugggacgcuuucaagccccagugacuguauugaagauucucagggucacggagucauugggaaagucagugucuacagugggggcacugcacaugagagcaggugggaggaacugggaaugcuguacccugcucaguuuugcugagaaccaaagcugcucuggaagcuaaauguggugggcuacacuguaguccuuguacuugggcagaaacaggagcgccuuggugaaucugagggcacuugggcugcauaaccaguaccagaccagccagggccucaguggggagcaccucaaaaugccaacugcaagcaaauaaauaauaaguagauaaauaaauauguguaauuuccucuauauuuuuaaaaagcugauuucaaaguuuauuaauuaaaaagugauuuuuuuucccugcagaaauaucugggugcccuggaugacaaguguucuguggggucuggggucagcauggggggacagugcaugccuaagccgugcagagcccugaaaggaugacagaggagcuggggugugggaugugagcagacacugacuuaaacaugagaagagaagagaagguggcuuuguccaagggggaaaaguggugauauuuguugcaauuuguaacauguaacauuugaacuuagaaaacgauuaaaaaaaaacuguaaaaaaauugagcuuagcaguaaaaauuaaaaaaauauauacuuccccuauucaguaguuuccuguuauuaaugaauguaaguaacucuucaguguuaucggaugugauuuuuuuuuuuuuuuuuguaugauggagacuaaaacgugucagcguuuaaguuugugcaucuuaaaagcaauguuuucuaaaugacuaauguuuauuacaaaggcacguuggcagacauuccaugaaagguaccagguagagggcgucuuaauguagccgagggugaccccagagugcacaccuaccuguccuguggagcuaucaccuggcaguguuuuaaauggcauuaaagauuccagauuacuuugaaagaguguguaaucugcuauuugcuauucagcauaucuggaugaagccagcucucgauggaguaaccaaagcaauauacugcaacaagcauauguaagcuguucugagacuccaacagcucuuucccucccucccucccuucccuuccuuccuuccuuccuuggcucucaugcauguuagacucaguuacuuagccacgguuagcccugaacaccgaauccuucugccuucaccucucaagugcugggagaauacaccugaggcauugcacccacccagcuuuaacacuuuucuauuggaccagaaauuagauuacuaaaauuuucuauaaaaaaaaaaaaaugcaguucugggagagccagggcuacacagagaaacccugucucgaaaaaccaaaaaaaagaaaaaagaaaaaaaagguauuauuagcugggcagugguggcccacaccuuuaauccagcaccugagagacagaggcaggcagaucuuugugaguuugaggccagccuggucuacagagugaguuccagaacagccagggccacacagagaaacccugucuugaaaaauccaaucaaaucaaccaaccagacaaaaggcacauuuaauuuuaugauucucuguaugugcaggcauguguguggagaucagagagcaauuuucugcuguccgaucucuguuuccacuuuuauauggguucuggggauggaacucagggugccaggcuuguaugguuggcaccuuucccucaacuccucugagcccucucugcagcccuacauuugugaaacuuucagcggugccgcuuuucccacugauuucucccccuucggaacaugugguuaccuuucauaggcuauuccugcgacuuauguuaaugugcugugcacaguuaauugcuuaaaugaacuuuguuugagacagugucuucucgugcaaucuauuaggcuggccugggauuuagggaccuuccauuggggccucuuggccagcuuauacuuauaacuucuauugauaggugguaucuaauagguauuuucugguguuuugagucaaggucuuguauuuccaaguacccuugaacucacagauccuaagcuggcuucaguuuugugguaauccuucugccucagccuccauugugcugggauuacaaguacaugcuaccacuacaaauuuuuaggcaucucuaauaaauauggucucuguaaaugaagcuuuguuaggguccuuaaauuuugauagcaagaccaguccuaaaaacagugcauuuugagaacuguuaaaaacuauuaaaacagccgggugugguagcacacaccuuuaaucccagcacuugggaggcaguggcaggcagauuucugaggccagccuggucuacaaagugaguuccaggacagccagggccauacagagaaacccugucuugaaaaacaaaaaaacaaacaaacaaaaaaacuauuaaaacuauuaaaagguuuugguauaaauauucuugagcuguuuugaggagcuaggguuggggagggagaugacaucuauggcucugauuaaguggucucgggacauuguaaccacugugccagguaucaugguacagauggguccguaauuugagaaacacuuuuacaagggccauaaauucuucagaugaaugaaguccugucuagaaguuuggaaguuauugucuuaaagaaaaacugcuuuggagauuccuuuuuaucuugauuuucccugguauuuaugucucuaagaaugaaucuuggauugcgucugauugacaaaagagccauaccucaccagauucugguagcuucugagugcuugguugauuucuuuucuuguuuuguuuuucuuuucuuuucuuuuuuuuuuuuuuuuuuuuuuugguuuuuggagacaggguuucucuguauagccuuggcuguccuggaacucacuuuguagaccaggcuggccucgaacucagaaaucugccugccucugccucugcugggaucaaaggcgugcauaaccacacccggcuuguuuuguuuuucuaagaaagggucuggauaacccuagcuguccuggaacucaacuuuauagaccaggcuauccucaaacucagagaucuaucugccucugccuccugagugcuggaauuaaggcuuucaacaccacacgcagcuauaauuuuuaaagauaauucugaugcgaauuacaguuuaauuuggaaagaaauguugacuuaaaucagauauaaaaggaaguuuuuuucuugcuguagugacuguccuuggauguuaucugccaugcacucacuucccuuuaucagcuguagucacuucucucuccugucccucucuauaaaaugggaaagacuuuuacugggagccugcugauaucaucaguacccucaggguucccucugguugagagagugacuggagagauuccuugugaauucuugcuuccggcacagguuacagcucucccugaaaccugaauaggguuguuguuguuguuucccuccuccuccucuuuuuuuuuuagcagaguuucucuguguagccaugacuguucuggaacuuacucuguagaacagacuagcuuugaacucagauccaccugucucugccucugcuggaauuaauggcuuguuccaccucugcccagcuuguuccuuucuuaaaaaaaaaaaauuaaaauuaacuuuauuuaguguauauguauccccacauauacacuaggucagaggacaagcuucaggagucagaucuugcuuucuaucauguggacccuggggauugaauuuuggucuucagguuuggcagcagccccugcugagccauuuucugacccuaauauuacauuguuguugccuucugugugggagccaaucaugagagcagucguucuuauuuauucuucucaguauguuauuaauuuugugaagacuucauagaaaagcuuguguaguuaaucuuucuggggucagacugcuuguuuuguuuuguuuuugcuucguuuguuugagacacggucuuuaucccaggcuggccucauuguauagcugaacaugaccuugauuuuuguuuuuguuuuuuguuuuuuuguuuuuuuguuuuucaagacaaacccuugcuggguugcaacuggcuuguagaccaggcuggccuugaacucacauagcugcccaucucugccuccugaaugcugggauuauagcauaugcuaccauagcugguuuauguggugccagguaugcuagguaaacacucuaccaacugagcuacaucuccagcucuaggcuugucuuuuuuaaagcuuuccauaaaguuaaauucauuucaaacacacacacacacacacacacacacacacacacacacacacacacacguuugagucauuguuauaaagcucugugugggccuguugcuugauauauagucuucauuggccuuagaccuauggcaauccuccugucucugcuuccagagugcugggauacagguagguugacaaaguagaaaauaccucuuacuuucccuguccaguuucuccauugcuagcaucuugcauuagugugauacauauuaugcaguugauaauagcagcuauauguuguuauuaauuaaagaauacacaguuucuaucacacuuuacuguuacauauucuuugcuguuugauaguguuggagacauguugucuguuguagcucaggaugcaaguaaacuuggaaucugcccaucucagguucuggaguccuggcauuccaggugugccccucugugcuugggccauuuuguggauuuccacagacaugcuguguggccaccagcacaguaccacuugaaguacacucugccuccauagcccggugcucuacccacucaccccucugcagccccugccagucgcucauccccuuuuucuaucuccauaguccuguuuuucagaauauucaucugacaucauguaagcaguagccuucuaggcagcaguggcccagugccucucugguucgccuucuuucacggagcaguaugcguucagcuuccuccuugccuuugguagcuuugcgaggaacacugccuuguaugacccuucccuuagugauguucccuucaucugaagggcaucuuggcuuugucguuugggcugauaggaauaaagcuacccauuauuguuuggguuugcacucuucuaaugaccaggcuggccucgaacucagaaaucugccgccucugccuccuaaguacuggcuuucauaugccgucuguguacucucuuuggugugauaucggaucagacuuucucccaauuuuguuccauauuuccguacaauggaaauugaauuuaggguuccacagcuggguguaguggcauguuccuuuaaucucagugcucaggagacagaggcgggcaaaacucuguugaguuugaggccagacugaucuacagagggaguuacaggacagucagggcuacacagagaaacccugccucaaaacaaaaaagcaagcaagaguuuaggguccuacuuacuggcaaguguucuuuaccacugagcuacaccccgauccuuauuuuaaaaaauuuauuuugagaccagggucucauaacuuugaucaggccagucuugaaguuguguuguagcccaugcaggaccugaccuugggaagcaccugucuugguuuucccaguagcugggcuuacaggccugcucugccaggcccagcucucacccagauuuacacggagauuuuuuuuuuuaaauuguugagaguuuuaaaaguuucucagucuguauuguauauacaaguguacauguacauuugggggaggagaccagggccauaacacacaaggcaagcuccaacacugaucuguagucauaguuuucuuucgauguauuggguuuuuuuguuuuuuuguuuuuuuguuuuuuuuguuuuguuuuuguuuuuuucaugaaacucaaugucuuaacacuuguuagacugggcuaugccucuagcccgccuccuuuuuagguggcauauaguuuuaaguuuuucuuguuggagaauucagucucaugcagacacuaaugcugugagcuugaagucagagacaaggaagugaaguacuuguaucucaccagcccaaauggauaauuaugaucuuaaccuuuagcuccacugccuuuagauaaggcugggcauggggcugcagccccaacuacauaccaaggugcugacacuucuguucugacugcugucucugcucuuagaccuguccccuggauuauuucugacuccuccuuuggaacugagccuugcugacuuggaucuugcccagcuucuacucucuguugcugcuguuuuguccugguuugguuccuuaacacaggguucucuauguagcccuggcuggccuggaacucaauauguagaccaggcuggccucaaauuugcagcaauccuccugccucuguggaagugguuuuuuucuugaaacaggauccaacaagcuacguacaaaaaauggucuuaaguuacugcuagguauguaaccuugggcaagcauugacauuaaggcacacccccaaccugaaaaauaauuguuugagaagaaucagcauuucuagaauuauucuucuugguuuuuaauuuaauuuuauuuuuuaaaacuuaaaaugugugcagaugcaugguguauguguuguggggggaugcaggugcuugguguuuguauagaggucagagaucaauuuuguggaguuauuuuuucuucuaucuuuaugugagucccagguuaaauucaggucaccaggcuuauacaacaugcccuuaccuacugggccaucuuauuggccuucuuggggcccauuuuaaucucugucuuuugggggguauaaauuaaaggaaaaaaguaaaacauagccuuccagggggcucugggcuuuauuuaaauuaaaauuuucaaaaugauuuuauuuuaucuguauggguauuuugccugcaugaauaccugcaguucacggaggccagaaaaggacaucagagucccuggaacuggaguuacagagguugggagcaccugugugggugcuuggaaucaaacccagguucucuggaagagcagccaguacucuucuuaaccagugagccaucucuccagcccuuuuucuugagucuuacagaccuuuccuuaugcccuuccuuuccuggucauccuucuucugaacucaaagguugaagagccuuugcccucucugggugggguucucuucucuucacuuucuguguucucuauguagguuauuucagccacugcuuugauguauguauguauguuacauggcuggggaguaaacccagggcuuugugcauggaaggcaagcgagcacccuaccgacugagcuagguccccagcucacuuagccauuacuuuggccauaauucugauaaugaccaccagguguucaucuccaccccuguaggcuucuagcacccaccucgugcugcuuuccgacauuucuccauggguaccuuguguguacuugccucuugguccuacuguugaaaacuuaaccccauagccaccucucugaaagucugugcuucucucuucguucaacaaugaaauaaaugauaguucuuggucugcugucuuaguuacugcucuauugcugugauaaaacaccaugaccaagggaacuugaaaacauuuaguuuggaguuuaugguuucagagaguuagagaccauaauggcagggaaccuggcagcagacaggcagacauagaacugaaguaacugauagcucacaucuugagauguaaucacaaggcagagagagagagacagacagacagacacagacacauggggcagggagacugagacacagauacagagagaaugggagacacacugggaauccuguuagucuuuugcaaccuccaggccuguacccuaugauauacuucuuccaaugaggccauacuuccuaauccuucccagacaguuccaccaacuggggaccaaguauuuaaacacacgagugugugagggccacuccuauucaaucaucauacugugcaagccagagccccccagccaaccuugacuccuucccucccucauccuccugcuucuguucagaucggcagcgagucuugaucucacaucucgaguuuccucaacuccccuugacugucaugucccuucugugguggugaugcuaaaauugcuccuguacaagacucgaaaugcuggauaaauggagcucuccaguaaaaagaaaacuuaagaugcaaaagcagauagucucaucaaaagaaagaacagaugcaggccuggaguguuucaucccacaccacuucuaaguauugauccccagucacagcccuaaaaugccucaggcuuuugagugcugcauuauaggcauagaccaucaugcuaggcuucaggaguucucacucccaucccuucacaccuugaccuggcuucacugugcagcccauagcccaggcuggccuugaacucaccauucuccuacucuagccucccaaguccugggcuuauaggcuuguguuaccacauccagcuuauaggaucaucaccuauucuccugcuauccgcugaggcuucugaccugccaucuacuguaccuuccaccuccagcuuugggcuguuugagguuguaggccauacugcacauccaacagcacuuuggugcuauuuucuuaccugugcuagcucagguaccaugcugcacucucuggguucuagaguucuaugagcucccccccccaaucccuuccaucuugcuuuucauucuuuguccaugugcuuagguucugaucacucagaagauucgucacauuccuuguuuucacacgcuguucccuuugcuuagacuggcugccccuuccucuccagaauggccaugucuccuguagcccugcuaucuuugugaaacuuuccagcucucauucuuagggcugccauuccaucaaaacagugcucggugccuuagacaguaggaaccaagcugcguagagcuugcggggacucuuugccuuaccagaugcuaccccaagcugccucucaggcuuugucuuugucuuagaggaggcucugacucuaccuguguuucucugggcuuagcagagcaccuggcaaagaguugcugaaauauucagcaagccaguggagcccuguacggcuggccugaauccauagaucggucagaaaaccacagagaaaagaaaagcaugcauuuugcauguugcucuaccaaggccacaauuauacucuuucuuuuucugagauagccucugagcagucucaacuauucucagacccacaaagucuuagucaucuaaguggugguguugagaggcagacaccagacucuggugcucaugggcgaggauggggcuagaggugagaucuagggacugccggaguguagagugugcuuugaaggagugagacugcaugaaucauuuagaaagugaguuguagagaaagcaggagguuuauauuaagagaguuuuacagcaaagccugucccuguaaaauugugaaauauuuucucaugaauguuagacucuguaaagauugcauucagucauucauuugggaaaaauaucuuuggaaucaacaaacacagugaaccaccuugaacuucaugcuuaauagacaaacauuguguuaacucuuucuggggcagggauucuggagacauggcaggggguggggggcgcuugucuucacugugugauaucuggguaucagcugggaagccuugaacaucugggcuuuucuuuaguucccagcccaggccuggccuagcaugauugcagcugugaugguagaucaacugcauguggccucuuugucugucuuguguuucuuguagaauggugguuggguucuggagcgccuuuguccuuucaggagaaucccaacagagguguuggagauuucauaucaagcuuggucucauggcacaggucugaaauccuaguuacuugggaggcugaggcaggaggaucucaaauuuaaggcuugcuuauacuacugagugauuucaagaccagacugagcaauuuaguaagacuuuguuuaaaaacaacagaccccccccccaaacccucgaaagucagguuuaauuccucagcaccacaaaugagacagugcauuucacacuuucagcacugugaugcugggcuagggauggcuuuagccagguccaggggaaggggagcaaaggaugaggaaggggacagguucuccauccaccgcuggacgcuugggugugaggcucuccuacaaauccacuaugagaugacgucaagggaaaggagcaggugugugccaccauacacccuggagagaagaauuuccucccuccucuucccuccugagccccucccucccuccucuccucccuccuucccuuucuuuuuaccuccuuuuugaggcagagucuuaccuuguaauccaggcuguuccugaacucauggccauuuuccugccucagccuucugagugcuaauauuacagauauaaacauauagguucuuagcccacuuuagccucugcugaauaacaaagggcuuccuuggggucacuuaaaggaaaagugaccugaauaaauuuggggaauuucuuucuuuucuccaguaaucauugagcuacaucguaggcuugugacuuugaaauuccaaacuucauuuccuuuaucagauccuguaucucuaccucccuagcacuggcucccaagcccacgcugcaggugcugggacccaaacauagguccuaugcuuauguggcaggcccauacagggcuaucuccucagcccugaaauguuuguuuuugauuugaguaacauuucucuuguuaaaagaucccuaaaaagucguugaguuuuccaaacagcaaaacagaagagcuggacuccucaaugaauacuuuuuugcugggagugugucuucacuuuggaaaaugugguccccuuagccaggagugguggcacacgccuuuaaucccagcacuugggaggcagaggcagaaggauuuuugaguucgagacuagccuggucuacaaagugaguuccaggacaaaacaaaacaaaaaaauguaguccccuuaaugccagauaauucccuccagcaguucaucaguucuacuacacacacacacacacacacacacacacacacacacacacaugcuuucuguucaucuguuaggaacuggacacugugcuggaugcuggagaggggggcacauuagugagccgaagccaagguucuuccugucaucauggaccuuagaaugaaggaguugaagcaaggcauagguccccugauacugaaggcaagcacacaugugaaggcccgugaacggaggaguagaguagccaagugaguguaggaguguagcuagcaggcaaguggcagccagacagacacagggcuaucuugucaugcauguuugcucuguccugcuagcuuugugugcuuuaaguccggucugacacugacccugugaagugaguacaguugucuucuauuuuucugcauaaggaaggcuagacaccuggcacgcaucucggaggggagucaggguccacaggcuguugcuuucauaguugaugauuuuuagucucagagcaaaaaguggugagccuuuauggacguggauggcagcucuucagaaagccuggagggaugcaggcagaugugcagauacagguaaaagcuccuagcuguggguuuguagaagccugggaguguuuuagaaacagcuagaguacagacucuggacaucugacccuuuugguuaaaugucaaccugcuuuaucucugcgcauguuuauuauugggaugcagcggucucagugucccaagugagcggagcugaaauggcuucagaggccgugcagccccuugcccuccuggagucugcauuauggcugugauaccucaaggaagagcaucuccauguaagugucagaugcaacaggaacgaggcagcugccccguacauaacucucuucaugccauugcccagugaaguuauaucugagaggucuguuuuuuggagacggcuucucagcacugacuguccuggaucucacucuguagaccaggcuggccuugaacucacagagauccuccaugccucugccucccaaguacugggauuaaaagcauuugacaccaccacccaguuuagaauuccauuuaaauugucaucuacacaaugacugugaccucccagauguggccaggcacagcaagacuaacagacccuuuggcucaggcgccauacaucuguuggaacucuggaaaaguucuuugacuuagcaucguucuugacucaugacaaaauucccagaucagaauccccaggagcucugacagcaggcugcaucaggaugcugcuccaugccauuacugccugugagauccugaauaaaucaugucaaauucugggccuucauuucuccucgguaagaugaagauaaaauauugucuugaccaaugagauggcucaacagguaaaggugcuugcagcugagcccgacagcuuacguuugaucccuaccacccacacagugggaggagagaaaugacuccuugaagauugucuucuggaugcaccacaucaucauuaucaucaaugguuagcacaaagaugagaugaaaguuccacacgguauucagcuauagauacugguuuucuucuuuucuuucuuccuucuuuuuuuuuuuuuuuuuuuuuuuuuuuugaagacagggucucauguagcccaggcuaucuucaaauucacuguauaauaaggaugaccuugaacuucugaugcuuuugccuccaccucccgagugcuugcgugugcacaucuccaugccaugccugguuuuaugugguguuggcaguggaacccagggccucguacgugcuagggaaucucuucacuaacucagcuacaccucuagcuuuuggauuguucuucaaccaaggcucuuguugacauucaucuuuuuauuuugaauaguacuuaguggguuuuucauuguaugcugcugguggugguuuuaagacagggucuagcauaguccagguuggcuucaaacucaccauuuaguggaaggauguccuuaaacugaucuucccauaucuaagcucuaaggauaggaauugaaagcaugcauuuucaucuuuaguguuauuaggccuagagcuauccugugcaaaauauguguggagagauuugaucaucuucagacaucuguccugagguagggucaccagaugcuaauuccccccaccccacccccaggauaugacagcaggguccauuauaaugcacgugcuucuccauaucagggaaagcucugugguugucucugauaacaccuagggaauuggaugaacuguuugcucuuuggcuuccugaggcacugagaaauggaauuccuguuaaaugagagggucaaagacucagaaggagcaacuacuguucaccugugacgucacuuaaguuuaguaccauccuuccgaggcgggguagucccuguugugcugaagaggaggccuauucagcagucaagccuuguagagagaguggaagggucacagccuggggaggugaccuuacgcacaaacugaguccuuuuccuuuuuucuagagcuagaggcagcucugaccgucgacuuagugguugacaaagcacgucuggcugugucaaucuaaagguuugcugucuucuggcuccuuuuaucuacaauauuugaaaucaaauauggugcauaucccauaucaguuauggauuuuuguaguaaauauuuaaucucaauuggggguuucuaccccaccuuagaucauuuaguucccagauaaaagacccaaaacuuuuauauuuauaauaagccuuaaacaacacuaaagcugagcagauaucaucucucugugucuauuuugucuacuuucaggcaaauaacccugagcuaugacuugccguguuccacuugagccgcucuuacuccacuggccagcccucauggccagaucucacaaucucuuaccccauggugucuuccucucuccaccuucucucucuucccuuucaugguccuuucucugaccccaagcccagaaaccaaaauucuacccaccucucuucugcccagcuauaggcuguaggugucuuagucaaccaauaguuuuaaacuaaggagcaaaguugcauaacaugacuugguguguuugaggauuuccucaucccuggggcaaccgacccuggggccaguauuccgcaucacaguacauaggaauaggucagugcauuauuuguuuuguguucucucugucuccuuccccuaccccccuuuuuccugacuuucaugcuggaagugaagaggaaguggugaaucacaccuuuaauccuaguacccaggaggccaggcaggcagaucucuugauguugaggccagucugcucuacauauccaauuucaggucagcccgagcuacauauauggccccaaagaaggcuuuuugacacacugugaaauugaacaggaauuguccucuuuuaaagauagagucccacuuagcucaggugggcacugaacuuauuauguagcugaggcagacuuuaaacuccugagccugcuguuucuuccuuccgaaugcugggauuaagggugagucccauuacacucgcuucagaaaugucucuguaucacuuucuguuguggauuuuuauuugcauuugcauuuugucccucucuucauccuccauuuuagguuuacugguucauuuauguucauacaugucuuagagaguuuaggaaguugugugauuaaaucccuucuaucuguggucuccugugguuccccuaguuucuuuagacugaacuauacaaaugaggacuguuacuuuaaugauaauuuuucuauuaagaaguuccuuauuagacugaaauuauuuuccuuaugacuuacuguugguagguuauuccccacagggcuaagaaauugcuguuuggaaaagucuagaaggauuuggugacaugcuguuucauuuuccuuuucucuugagcuauagaaacuaggaucaucagggacuagagagauagcuuguuaguugagagcacugacugcucuuacaaagaacacaaguucaguuucuagcacccucauggccauucaucauccaacuguaacucuacuuucaggaaauucagcgcucgugucuggccucugcugguacacacacaaacacacacacugcacauauauaauauguaagcaaaacuuuuauauacauaaaauaauaaaucucuuaaaacagaagaaaauagggucacagcaucuuaguuacuguucuguggcugugaagagacccaugaccaaaacagcucuuacuaaagaaagcauuuaauuuggggcuugcguacaguuuuagacgguuaagcacugcucaucaugacaggaagcagucuggcaagggacaguagcugagaacuuuauauccucacaguagcaggcagagaaagauaaggccugauaugggcuuacagugacaaaccuccagcaggccacaccuccuaauccuucccaaacgcuuccacuaacugaugggcaagcauucaaacauaugagcagcauucucauucaaagguucacacacacuuuaucuuuccucugaacauuugcaaugauguucugcccaccucagccucaugaaagccagcagagcagcaagcuugugucauacucuaacccauccacuggagcaaugacuugacuucuacucuggugcccaggaugguacuuggcauucaaacuguugguagaucacuuuuuguguucuggcuucugagagcugguuauuaaagcacaggcuucaagugauuuuugaagacaaaaguuagaucuuaacagaagucgggcaugaugugugcccuuccagucuugguacucagacugaggcagggagaucagccagccuacacuacccagccauagcacguagaguggaucagauuaaguuguuuauguugguguuugugaugcugaggaugcaacugagcaugcuggguaagcacuguaccacuaagcaauguccccagccucuuaaaucaguuucuaacuugaaaaacagacuugaggugguaaagugucuucuagauguuuuccaggaaaacaaaugcagcauacggacuggcagagguuuccuggacagcuuggcugacgaucucuaaacgcccagcugucagugugcagaaugcuuagucuaguugcucuuguguugauuaguauggcuugcagcuaagcagcaucugaggacauggcuguuggacacucagggcuaaaccauggcacccacacgcccauguucuccugaaaauaacaucugcgcuuugcuuuuagcuuaggauaauuuucuucauguagaauaguuuggcaguauuaccuaucuugguuagaucaaaacaaaacacaaaauuagucguucuugaugguccaguuaauuggaaaaaggcacaagcuggucucugguuaagaaaaagccauucuaccagcgaaauacaccaaacaucaacacugaaacaagccucuugaguuacagacagaaauaagucggcuauggguaacuuagcuuuuuucuuauguuagauugaaaauguucccccgacuggaguggucaucugugauggaguagguagagugggugagguuuuaugguuuuuaucuugggacuggcucugcauuuguguccaagauaaaugaugaaaucaucugguuuuguaacuuauagcauuggaauuuacuauuucaagcagaugauuuaauuaggaucauggcauuuuuuuuacaguguggcccagaacgacagugucuuugauuuucauaaauagaaagcgggucacauaugucauacuacauuuucuuuucuuaagguuuuguuuguuuuguuuuuguuuuuuagaugggggucucuguguaguucuggcuuuccuggaacucacuauguagacuaggcuggccucaaacucacagauaucugacuaccucugucucccaaguacuaggauuaaagauaugcaccaucacaccuggcauguuaaauuuucuaguaacuguauuaaaaaaaaaaaagaagugggaagaauaauuuugauaauguauaaaaccuaacauuucuaaaauaauauuucaacauugagauuuguacauuuauuucuuucacuguuuucaaaugcugcauauaugggugugagcguccacacuuccuuggcccaguggccacagguggguggugucucccaugcucaacaacgcaaucuuuugguucaauggaguccugugcagugauguuuacauaaacugucauauagauuuucuuuuguguuucuuugugcacauguucaugcauguguagguacauguaugugcaggucaaagggcaaccgugggugucauuccuucgacuuuuguuugacacagcaucucauuagccugaaacuuugccaaguaggcuagaccaacuggccauugaacuuccagggguccacaugucuccaccuccuaucuugcccucauuggcauuaugggcacaccaccacacccagcuuuuuauuaauaugugaguucuaggaauccaaucucagguccccagcaagcaugguaccaacugaaccuucuucccagcuucaaauugguauggacugcuauguaagucagguccugggaaccacaggacaacaggaagcuuuucaucuaggagaggcugauucugacuuggccuccauguaagagggcccugauagccuuuggugccuuacuggggcacugcacggagaggcacagcgcuucaggcuggagcauguguuccugcaggcggcuuuuauuccaccuaggguuugcuguacacauaccacucccuaaucuugggcucuuacucaugguuauuuuuagaccuccaguguucuggagagacauugucaugagugguuagcugggucggguucucguagccgagcguuggaguggggcaguccccaucucaggauuaaguuguuuacgugguauucagcucuccuuccuuucuuaccccagauuuagaaaaaauauauuaaaaucuauuuauauaaauguauauuuauauaaauaauuccuuuuguugagugggcagaguccaggcacauggcucuuguccuugugagccugccgcucugcucucuguccucccuaagcaccggucugagccagugcagguuuccugucuauagccgcacggauggccuggaugcagcaggugugugugggagggaaggaaccgaaccgacgugugcuggacagcugcugggcgcuguauucuuagaugaggcuuuaggaauauuccuucagcggccccaagaagugaucaucuguauucuagagaccaggaaacagaaauccagaagaaggaaaccagccagcuucacgugacauuugcuuaaccccgcuugaccucugguagagaauaggcuuguuguugucauuuggucagguuuuuagauuuauuuuauuuauaugaguacacuguaguugucuuuacauacacuaaaagauggcaucagaucccauuacagaugguugugagccaccaugugguugcuaggauuugaacucaggaccucuggaagagcagccagugcucuuaaccucugagucaucucuccagcccuggucaguuguuuuguuguugaagaugaugauguuguuucuuuguuuguuuuuuaaauuuuuuauuuuguuuuauucuaaugagcauuuuucccaaauguacccauguguacuaugugacuuguccagugccuucagcgaucagaagacucugucagauagauccucuggagcuggggauaaguauacugugagccaccauaugggugcugggaauugaacuugguccucugcaagagcaacaagugcauuaaacuacugaaccagcucuccagcacaugugcucucucucccccuguguaugugugggaauggaggugguggcgaggguuuagggcucaggcuggccuugaccugucugucaugauaucauaggaguucugggauuacaggcaugagccgcugugccuggcuucaaaguagauucuagaacuuaaaaucacaccuaauuguaacagaagaaauugcguggcagccuugaauggcagcucaugccugaaauucaagcacuuaggaggcagagguaggaaauaacaaggcuagccugagacccuguuuuagaaaaucaaggaccuggagacuagcucagugguggagaacuuguauaguguuugauccccagcaucaggagugggcagagcuguggugguaggauuugugaaugcaaacacguauuauucaaaggacuacaaaaaacauacaagcuccuuuucagagucaccaggguauccccuaugaguacuuguggugaccacauauauauuuuggcuuacagucgagaccccugacugcagcaggauggcucaguggaaccagcugcagcagcuggacacacgcuaccuggagcagcugcaccagcuguacagcgacagcuuccccauggagcugcggcaguuccuggcaccuuggauugagagucaagacuggugaguccuucuugaaaacucccugacuugggggguuuagcauugagucaggacacaaccuguucuagguucacaccuuacuaacccuuugaucagacaugugagggcaggugcgggggaaggauugggagaacagagguaacuuagucucuuaacgcaucuguucacagugcauaugacagcggccucuuugcacuuugaaacagcuugcugguagauguuuuggagucagguuugagucucacuuacuuggugagaucucugcacauuuugagucuagaacagugagauacagauguuuuuccuuuuuaaaucuaagaauucuaugucagguagaaauuggggucuaccacacacguggcuuccccugguaaagaggaggcaugggaugaggagggaacuagaggcauagaggaaaugccagcuguuuaccucacuuuaguguauucaggcccgugugcuaguucuggccuaagucagcccuaucugcgugugaccuacuuuuuccagaagacauaccugauuuggugaugggccaaagagguguggaucacaccucagccuggcauugcucauuaagcuaagaagcacuuauagacacuagucugacugaauacaggguuggccaagaauuuaaggcaaacaaccuuaucuguccuuuaaaaaaacaaaaacaaaacauuuaccaguaugugugcacguuuguauagauucaggcgugugugcauucguguaugcguguaggccagaagacaaccucaagugucauucuuaagaacgccuuuuggguucguugagacugagucauucauugguccagaguuaaccaauuagggcagaccuucaggaucuaucucugaugcccagcgcugggcuuacacgcaugugcuacugugcccagcauuuucuuuuuuuaauuuaaaauagauuuuuuuaaagauauauuucuggcuauguuuucucuucccccaucuccucuaagaucuucccuaacuccccuccuacccaaauccacacccuuucucucucucucucacuagaacacaaacaggcacuaagaaacaguaauaagauaaggcaaacaaacuggaauaaggugaaauagaccaacagaaaaaaaaaaagagccaaagagaaaguauaagaaugauaauauauuugccagcauuuuuaugugaguucuguggaugggagcucagguccucaucgcucucacgguugaaccaacugcccagacugcaucuguccuuucauugucaucauuguuguuguuguuugguuauuguuguguguauaugguauuggggcagcgcguggacaugccgccgugugcacgcggaggucagagggcagcuucaugaagucaguucucugcucucuaaggauuaaacuaauguugccagguuucccaaccaagaacuuuuaucuguggcgccaucucaccauccccuguuuuuguuuuguuuuuguuuuaagacaaggucuuguagucuaggcuagccugcuacuugcugcagucagcugagggucccuugaacuacuuaccuuccugcuucuaccuccaaguauuaggacuguaggugugugcugccauacuaaggucuggguuuguuuuuuguuuguuuaugagucaaaaagucgggcuggugagauggcucagugaguaagagcacccgacugcucuuccgaagguccggaguucaaaucccagcaaccacaugguggcucacaaccaucgguaacaagaucugacucccucuucuggugugucugaagauagcuacaguguacuuacauauaauaauaaauaaaucuuuaaaaaaaaaaaaaaaaaaaaaagagucaaaaagucuuacuauauagccuaaaacuggccuugaacuuacuauauagcccaggcuggucuucaacuuucaauccucuugccucagcuucucaaguaguucucagauuacauacguugcaccacuagacuuguaucugugcaucuugcucaaauauuuuaguccuauagauuauaagaaugaauaacaguaucuggaaacauucucauauuaaccuuuaaccuuuuuuuuuccaugcuggggaccaaagccagagccuugagcacacuaggcaggugugugucacugagcuacaccaccuauugaugguacuguugaucugagaaugagaaauggaaaaugauggauuuguuaugacaucagauguuauaacaaccccuugaugguggauucuggggguauacguuuuagaguccuauuauuacugccuuugagagaaugucauccaaacuggcuuggaacucucuagguagggaaagcuggccuugaacucuugauccuccugucuccaccaccccguauacagaugugugcucucacaaaacgcucuccaaauuacucaugcagcuuaccuccucuuccuagggcauaugcagccagcaaagagucacaugccacguugguguuucauaaucucuugggugaaauugaccagcaauauagccgauuccugcaagaguccaauguccucuaucagcacaaccuucgaagaaucaagcaguuucugcaggugcggugggaaauggaugugagacggcagccccacagaguggagugcugauguuccugcccggaaguuuuccuuacuuggcuaagugacgccugucuuguacucuaaaucaaaggagaaguaauuagcuccuucucaauucccuguacacuggcccugggcaccauuaccagaaauucacuucuuauguuacaguugcagcaauaagcaagggcuuaauguuauucuguuauaaaagcacacuauuaacaccuacuugucauaggcacaugacucucaggucuaaauguuaaaaguuuagccauuaacuggguacuccuggguaaagucagucauuucccuauaaagucagaugacccacggugccaggaugaccucacacuucuggcuucugccaucacagaggccacaugcuccugccuucccuucccuccccauggauuucagucagaugcugaagccuuugaucugugguuucauggaggcucugaggaagugacuuaaguuagccaaguucacuccacaccuccuuagccggcuauagcuuccuacucuccaucuugcuuacagagcagguaucuugagaagccaauggaaauugcccggaucguggcccgaugccugugggaagagucucgccuccuccagacggcagccacggcagcccaggugagagcaagaagaagcaaaguggcgagcaggggacugggaagcaagcgauuguauaaauaaguggaacaguaaugguuuagugccucugaagaggagaucacuagacuacauuaaagcccuaaacauacauugaaaaugacaaaaaauuucauacagucucuauuccacucccaaccaacaguguugcugaagggugaacuugagcucagauuccugagggcugggaguugaggugcucacaccacauccuauaagugaggugcuaggggcagaaccagggcugccugcgugguggacacacacucggagacauauucccaaccccggauuguugauguuguugaucggguucuugcuaugcauagcugacuuccaguuugggauaaucuuccugccucugccacccaagugcagggguuucggugaugccaccaaacuucccacacguccauuucuuguuuucauuuucagcuuuugagauggagucacagucugauacccagcugccuagaacccugugcgugggcugagcccuuucaaacccacaccagucccuugcuucagucucuagucauugagauuuuaggcaugggccaccaggcucagcuuccuuuugagacagagucucaauacauacccccauaugguaaacucuagauccuccugccucagccucccugugagccaccaugccugauccacagggacuucccagugccugaccccugaguuagaacuugggaguuggcaaagcacaccucccuagcaauuuguacggagcuugagagacucuagaccacugcuuggggaacauagaggugguuuuuagggacaaagccuucauucuugccauaggcaaguuuaggagauaggagauaggagagggagggacccagcuuuggggcugggcacugugaaggucugucuguaguacuucuuuaugucuuaucagucagggucgaucccacaggggaaaaauguaguggcuggguuguuuuuccaagucuucugagaggcuguuauacuauaguuugagcauccaugagaagugggaagagcgccugucucuaaaaugccuguucagcucuacuuuggagacucguggucguaguagagagaacagaccagaagugagagguuguagaagcaaaggucugggcuggaggacagaccuggcuucaguuccuagcauucaagagguggcucacaaccaucugcaauuccaguuccagggaauccaacacccauuugggcaccaggcacacaugcuggcaaaaacagccacacacauaaaaugaaguaaauaagucuaaagaauagaaaacaaaacaaaguaaaaagaaguaaaaagccggcaguuggaaccugacuggagcccuugaccagugcgaugggugugagggagugguuagcuguaggcccagggugugagcauuucuagcuuugaaaacuggauggauaacaucucuccuuaucauagucuucaagauccucaggcugcugucaggcuaucugguugguucuuaaagcaucuacuuguuaguuucugcucccagcaaagccccaucauuuuaccuaugaccccuuaaggcauuagccucuccgggcugggcagaagccuuggaagcacaauuuuaaaaguccuugggaaauguuuuuucauggaaauauguuacacuuuguugucaucaguucuuaauuuauuuauuaauauucucugagcacugggaucaagccugggcuucacucauuuaggcaggaucuccaguacugagcuguaccccagcucuuucuagauuuuuuuuuuuuuuuuugacaguuuaccuuuaggcugcuugaaggaugaggcaucuuaguucaacaugugggcuccugguuuaauguggagaauggguuugcaguguuuccuguugauaaaaagccaguggcacagagagaacagugcaagcacccucccagcacccuccccuuuggaugggauggagcucagacgagaggguuccacaaauccaugugugugcuaaucuuaguuauuuauuauuuauuuauuuauuggcagcaagggggccaggccaaccacccaacagccgccguagugacagagaagcagcagauguuggagcagcaucuucaggauguccggaagcgagugcagguaaucgggccucacccagggagccgcgcugugcugugcggcugcagagugugguccugcgugcacgcuuucauuaucuucaaaacuuucuuuucccuuuuucccaaagguaaccuguguuuuacuucuguuuuugguugguuuguuuguuuaaacaggaucuagaacagaaaaugaaggugguggagaaccuccaggacgacuuugauuucaacuacaaaacccucaagagccaaggaggcaagcgagcuguggggacggggcagucugugcaaggcuacgccgugucacugagucucagggccugccuuccaugguaggaggaggagcugcuggcccuucacgggacaauuuuugcauuguuuguuuuugagaugggauuugaccauguagcucuggcugaccgugagccuacaaccaucuuacuucagcucucugaguagccgggacugcaggcgcacagaugguguagagccuuguuaagaaggcuguggugagucccucugcucaaggagucuuuccuccuucccuuagacaugcaggaucugaauggaaacaaccagucugugaccagacagaagaugcagcagcuggaacagaugcucacagcccuggaccagaugcggagaguaagcgaucuggaugcuuccugagcaucgcacgccuagcguggaagacaguuucugauggcuucuuucucuagaacugacuagagacugcgguuagacaugggcugggguaauguguucugacuugguuuugguuuccaaacagagcauugugagugagcuggcggggcucuugucagcaauggaguacgugcagaagacacugacugaugaagagcuggcugacuggaagaggcggcagcagaucgcgugcaucggaggcccucccaacaucugccuggaccgucuggaaaacugguaagaguuggaagaaaggcuucuuuuucuuuagucacgggccugcaaggggggggggggggggcggggcggagcggggcggaggcggggcaugcugcucccucgccaugcuuuugcuuuugcuuuugcuuuugcuuuuucaugcugggguggaugugugguagacaagugugccagagccacuggacuacacuccuagugcuggacacuauugcuaagauggcaccuuuuuuuuucuuugagaaagaaucucacugagcugcauaggcuggcccucauacccacuccauagcccaggcuggcccucauacccacuccauagcccaggcuggcccucauaccuacucuauagcccaggcugaccuugaauuugcaauccuccugcuucaucuucccaaauggaauuaucugggauuauaggcaugcaucacucugccugccuuaagguggccuuuuuuacacagucaaguuuaguccaagaauuaaaaccauuaccuaauuuuaacuuuuuuguuuuuuucugagacagaguuucucuauuuagccuuagcuguccuugaacuugcucuguagacuacacuggcucaaacucauagaggucugccugccucugcuucccaaguacugagauuaaagacaugcaccaccauugcccaaccaacaaauuuuuaauuaaaaagaauaaauuaauaaagcuuagaucacuaauuuaagauauuuaaauaauacuuucaguuguauuuaacacuaaauucuccauuuuaguuauuuuaauaaucuaaaacaauauauguuauuugcaaaggggggaaauaacugaauauauauaaaacuaauaaaaugaaauaaaaaaaaugaaaaucuagucuuugaguaguaccagcaagucaccagacuuugugauagucauuuuguaggcaucugucgugauuaaacaugugauuucaugacuauacaugugaugucauaacuauacaugugaagcuagaaaucgaguuguccgucuccuuccucccuuccuuccuuccuuccuuccuuuguuguggugggauggaugccucagggucccuuugcuucagucuccugagugcuggggucaccacuaggggacagaggugacuggaacuuccuuccauuauggcaggauaacuucauuagcagaaucucaacuucagacccgccaacaaauuaagaaacuggaggagcugcagcagaaaguguccuacaagggcgacccuaucgugcagcaccggcccaugcuggaggagaggaucguggagcuguucagaaacuuaaugaagagguaacuuguaagagaugacguuccgaagggaggaaccggcagaagacuggucaccacagcgucugagaugccauccuuuucccuuccagugccuucgugguggagcggcagcccugcaugcccaugcacccggaccggcccuuagucaucaagacugguguccaguuuaccacgaaagucaggugggccuguccuuacacuuuggguggaguuuugauugauguccaguccucuucccugaggauuuuaagggaaggaagguucuguggugccauagcugaggggccccauugggugagagaugaagcccacuccucaccuggcucagaacacgugcaguauuucucauugaaugcuuuuuauugccuucccgugagaagucucuuacaacuugcuucacaugcuuaggcaucucaguacuuucuagcugaaggguuaguguucacuuuuaaugucagagaugacucugcggaaguagaauuuggguuuguaaaaauaauauauauauauauauauauauauaugcgugcgugcguguguguguguguguguguguguguguguguguauuuuucaucuagacaggucuuuguagcccuggcuggccuggaacacucucuguaaacuaggcuggcuugaacccagagauucaccucccuuugccucccaagugcugggauuaaaggcaugcaccaccaugcucagcaauauuuuuacaucuuaggaauugaaguauuaggggguuuauauuuuaacgagaucaagguagggagccuacuaacuuuccuugacuauauuuuuuaauagguugcuggucaaauuuccugaguugaauuaucagcuuaaaauuaaagugugcauugauaaguaaguauucuuuauguguguguguguguaaguguauaauuuuuauuauuuaaaagcaacuguuaaauucaugcuuugcucauauucuucccuucucccaaguacauucagaucuccuccuccuguacucacccaaguuucucaaaaaaacuaaacaaccaaaaccccaauacaacaaaauccccaaaagacugagaacaaaauacaacacccaaaaagaaaaaagaugggacuaaaauugugauuaaauaagagcaugcacaacaaacuauuuguuggucaacuguccugcucacgagacccgcacugagugguugacaaagccagugcugcucccagcagcuccauugcuaaucuuucacccuagugguggguuuacauucauucauucauucauucauuuuuuuuaauguaacaaaauaaaauauaacaaagcaaaacaaaggcuaugacauccaaguuggacgagacaaaccaacaggaggaaaagaacccaagagaaggcacaggagucggagucccacucguuugcacccugggaaucccaugagaacacuacaugggaagccacaauauuagcacagaggcccuggugcaggccccugcaggcccagggcaugcugcuccagucucugcgaguucauaugagcuuugcucguggugauucagagggccuugugguuuuggugaccucuaaccccucugguucuuaauguuuuuucugcugcuucuuccuugguauucccugagcucugaggggagggauuugcuggagacaucccauuuagggaaugaguguuucaaggucuuucucugcaugaugucuggcugugggucucuauauuucuucccaucuuuggacaggaggacucuucucugaugauggcugagcaaggcacugauaucugagucuagcagaaugucaccuggagucauuuuauuguuuuuuuuuccuuucucuuuuuuagaucaguauuauuuaguuuuucccuagguccuugggcuaucuagucucugguucuuggccacccaagccuuguuggguaugaguuucaucuuguauagugagccuuaagacucuuguugguugguuacuuccacagguuugugccaccauugcccuagcauauccugcaggcaguacacuauuacagauagagguuugaggcuggcuugcuguucacacuucucuuuugauagcaugcagaguaccuuccuauaacaaagacucuggcauacaguggggggcucuauggaggcaccagcuucacgugcccauguucagugaguuguguagguguuauccucaacaguggggccuugcugucaguuguggaaagcaaccgauggucuugauaacagcguggauuguuugaggauucccuuuggccaacaauucaauuagacuuaacccuaacccaguacuggaagcuuuauuugguggcaagagaucgccaguugggaccccaacucucccccauuacuuggcgauugaaucuagaucaccuucacauaugugaauguuuuaggagguuccuacuguacgagaugucgauacuacuccacggaugcuccauaaguguugccgucucccauuguucccucccaccaccagcucuccucuccccucggcuuccccauuugcuccuccaaguucagaccucgucuauccagaaucccucaucuauccagaaucccucaucuauccagaaucccucaucuauccagaaccccuucuauuucuuuuuuccuaauuagaucuauuuguucucuguaguuccuuagucuguauucacccucugugguucuuaaggauugcagcuugguuaucauugacuuaauggcuaauauccauacauaagugaguacacaccacauuugucuuucugggucuagguuaccucacucaggaagauuuuuuuuuuccuaguuccaucuauuugccugcaaguuucuuuuuuuuuuuuuuaauggcugaguaauacuccguauguaaauguaccacauuuucuuuauucauucuucuguugagggacaucuagguuguuuccagcuucugguuaguauggagagaacagcagugaacgugguugagcaagugucugugguaggaugaagcauccuuuggguaugugcccaagaguggucuaacuggaucuugagguagauggauucccgucuuccugaggagcggccauacugauuuccauaguugcugcaugagcuugcauucccaccagcaauaugugaugguggcccuuacuccacauccucgacagcaugagcugucacuuguguugaucuuaacuauccuguuaggcauaugauagacucucacagcaguuugauuugcauucccugauccuaaggauguuggacauuucucuguuucucagccacuuggguuuccucuauuaagaauuuucuguuuagaucuguaccccauuucuaacuggucuguauuuucuugauauuuauuuucuuaaaauucuuuucgggcauuuguccucuauuggauauguaguugguuuaaaagaaaaaucccguucuguaggcuaccaauccguauucuuaagccuaacucuuguuuucaaaugagggauggagaagcaagaacuuggacagacauuugacuuuagagaugucuccauucagggaucuucuuuuugugaacagcuguguucaaaacccuugcaaacccugcccgguuugccugaagcauugaaaagaaaaguuugagugugugcagcucaguauugcaggcucaccuagcacgcacgcaugcacgaggcccggguucaacccccauacugaaaaauaaacguguaaauaaguaaugcuugaaaauagaguauauggaaagagaacugguuugaaguuaauaaucuucuuccacaaacccaccaacacaugcuauuuguagguaaaaauauagcaauggaaaagaaauuuuacuuaguuuuauuuugagagagcgucugacucuacaacccuggcuggccuugaauucacagugacucaccugccugugcuccccagugcuaggauuaaagguaucugacaccaagucuggcuaagaagaacuuguaaaauaguguucugaaauaagauaaagacagaaaugucauaauauaaaaagauggccugucagagacaggcagcaguggucacgugaggauagcauuuccagcugccuugugggagguggugucaguuuuugguaacaacauaccuuucuggaaaacccagcguggcuccgauaauaaggaaauucaccacccguguaacuggaaaugcaguuggggcaaguaccuaaggaugaggcuggugacucacaggugucuucaggaacccugggucuuccaugccauccuuaccgugccauccuuaccgugccagcuguagacagguucccuuccagguggucucauggcuguggacagaagaucagccuaggcuauugccuccuuggucuggcugagaacaggccuuuaaucccagcacccaggaggcagaagcaggugaucucugaguucaggucuacagagcaaguuccacgacagccaggagggcuacacagagcgcugucucggaaagccgacaaaacagacaaggcagaccccgucuucaccugcucuguggcuuccucuguucugaugaaugcagugaucgggguucccuggagauagauggcucugccaucccuuacugagagaauggagcuuuccuuaggaagggaaagaagcugugguuaggcccccagcuaaggcuacuguuuaagugcauacagaguuguguuucacaccgaaaauguaacugagcaucgaaaggcauguuccaucagaguagguucuggaaagaaagaggggcucuaaucucagcuuuuauuaacccuugucuguguucuuuacagagacucuggggauguugcugcccucagaggguaaguugggccuccuuuuguucuuucucauccaacuuuacccucuggcuacucagcgcucacuguguguugguuuuucucccaugauuuaggucucggaaauuuaacauucugggcacgaacacaaaagugaugaacauggaggagucuaacaacggcagccugucugcagaguucaagcaccuggucgguguccgaggggagaggaggcggcacaggccagguggcagaggaggggggagagacuggcacagccucaagugacacuugccuccuucuucuuccuuucuuccagacccuuagggagcagagaugugggaauggaggccgugccaauugugauguaaguaaguuuuguucgggcuaaaagcaauuguuuucuuucuuugaggaagaaagagaaagcucucucgcucucucucucucucucucucucucucucucucucucucucucucucucucccucucucccucucucccucucuccaacccagaauuaaaacuuuaacccacuacuucagauguuuguccuuuagaaaaguuggucgcucugggccagggugacaugcucagaagucacaggugcuguggaguuuucuagcgagaaacauuucccugaguguuggggaguuggcucccuuucagcagugggaagucccucgccaagcuguuacccacacccaucugguagaaaagaaguuuccacauugcccggggcuucccagagucccuugcuacuaccugccagcuggcucccuuuucagugccuggugagacaaaaggaagacaucaagucagccagucagagcuaaacagaaaaaaaaacaacaacaaaacaaaacaaacaaaaaaaaaccaccaaccaaacugugcucaggagcugaggcaggggaauugugaguuugagaucauucugucauucagcacauacauguaaaagagcuggaaauucauuccugagaauucaucaguaauuuguguacuaauugaugagggucuguggucccgugcaggucccaguuccucuuucagagcuguagaguauucugcugccuacaccacagcucaugaccacagguagccacauugcuugacugcuuguguggcacugaagguuaucacagucacuuuagaaagugacuuggcauaaaaaugagcacacccuguaaaccggcaguuccagucuuaggaauuaacaguaaagaaagcuuugcauaggugaacuaaggacagauaacacagucacagccauuggucauugacacagcucagaucucucagcacuggggucaugagcugugguguaggcaguggaguacucuacagcucugaaagaggaacugggaccugcacgggaccacagacccucaucaagguggggguggggugucaggagcaggaacacacugagagugcaguucacugugugaaguacacaugcuuggagaaacaaccaugaacacgguugggaggagcugggagacagcagagacaaagacacaguaaagugcagagaagggggauucaccuggggaaucucggugauaauggcaacuuaugcgggaugauaaugcuaggcuaucgcucaguguuggggugcacuuagaugcaugagacccugaguuugcucccuagugcauauaaaaggaaggagggagagagagaagaaaccuaagaagccuuccuuuauuccuuccuauucuccccuccuuccuucccuuucucccucccuccuuuccucucuccucccucucccucccuccucccucucccucccucucccucucuccucccucucccucccuuccucucucuccccucccuccccucccuucccucuuccucccucccuuccuuccuccuuccucuuucucuccccucccuccuucucccucccuccucccucccauccucccuuccucccucccucccucccucccucccucccucccucccucccucccucccucccucccucccuuccuuccuuccuuccuuccuuccuuccuuccuuccuuccugugugucuguguuuguguauggucgcacaugugcgauggugugaaugugaaggucaaguugccacuugaaggacuuguuucuucuuccaccaagugggucccagggaugaggcucggguuggcaggcagaugcccuugcccacugagccaucuugcuggcccucaaauaaggacguaagcuggguggcuuauccuuggaugcucauugcuuuguuauucuucgugccuugaauguguauuguaagauaugguuauguacuauguagugcauaugugaggaucauguccuugggucuuuggguggaagaaagagggcagaguugugucccugccagugucucugagagaccuuaugcuguugcaggccuccuugaucgugacugaggagcugcaccugaucaccuucgagacugagguguaccaccaaggccucaagauugaccuagaggugaggccuucccagaaccaggcggcucgugugcgggggugcgugugcagggaggccaggacagaacgccugccgggaugauggcugucugcccagccuggauuuguuucucauuaucuaucucagaaacgucccugagagccacccuguccccaagaguaaagucuugcuugaguaccuguuaugaaaaucuauauuagugauuguuuagaaucgauuugaugaaguuugggcaagugggucuuaguagccgccauuuagauuuuauuuuccugcuugcuugcuugcuuguuuccuuccuuccuuccuuaaagauuuauuuauuuuauguaugugaguacaccauuacucucuucagacacaccagaagagggaauuagauuccaucacagaugguuguaaagccaccaugugguugcugggaauugaacucaggaccucaggaagaauagucagugcucuuaacugauaggccaucucuccagccccuguuuuccaucuuucuugaucuuauuaaguuuagaccuggaaaagcagacauccuuagguuugauuucuaacaccucagcuucauggaaagaugcagguuguuuggagguugccuuccaggucugucucuggagagucgggcugagggccuggguuagccuuaguguuuggguuaguguuaguuguuuguuuguuuguuuuuaaagguuuguuuguuuauuuauuuauuaugagugcacuguggcugucuucagacacuccagaagagggagucauaucuuuuuuauggaugguugugagccaccgugugguugcugggauuugaacucgggaccuucggaagagcagucagugcucauaacugcugagccaucucuccagcccuaguguuaguuuuuagggccugacuuugaacaagucacugaugauguucagacaucagugcugaugcaggcugguccugaugcaggcugguccugaugcaggcugguccugaugcaggcuggucuuucuccucuugguguucuugcuccagccugcacuugccgugagggguggccauggugugauuuuuaauucuaacuuauugagaugcgggugacaaggguugggagcugugagagcccagcugucccacuaagucauucaccgccuguccccauacucuacagacccacuccuugccaguuguggugaucuccaacaucugucagaugccaaaugcuugggcaucaauccugugguauaacaugcugaccaauaaccccaaggugaguuucccacccccaacccucucugaaaucccugaaccuugcugcuucuccacccccggugcaggcugucagugucacucucucauccaagugggugcaggcugucagugucacucucucauccaagugggugcaggcugucagugucacucucucauccaagugggugcaggcugucagugucacucucucauccaagugaacaaauguguucuuuucaauagaacgugaacuucuucacuaagccgccaauuggaaccugggaccaaguggccgaggugcucagcuggcaguucucguccaccaccaagcgggggcugagcaucgagcagcugacaacgcuggcugagaagcuccuagguugacagcuucagacaugucuggccugggggguggucauucagucgggguccccaugucagccuagggcaaggcaccaugccaggaccagguugcuaaguguguuugaagagcauguuucuuucuuuaaaaagccaaagacaauaguuuuaaauuuuuucuccccuuuaaaaaaauaucuggacugaaaguaacuuugaccugugcuccuacaaaaaaaaaaaaaaaaaggcuccugaccccagcugccagcuuugucacuguguguugccaguucucagaccacacaaggcaaggacaagcagggguccaacaggacaucugugcuggccuaaucuagggacagcuguugggcuugggugugugugggcauguguggcacacacccuguaaguacauguacaaaugcauggccuuuuuguaaauucugcuuaagaaauagcuuuggccaaggcugaaauccgguuguuguuuucucuuccagggccuggugugaacuacucagggugucagaucacaugggcuaaauucugcaaaguaagugauccuguugauucccucaguuaggagguagguguggggugcccaggaccccuuucuccagcagcugucaggagcugccugaggauagaggaaccugaggguguaagaaggcucuggcaggaaagagcuggggugaguggugguggacuugcuuucccauucuuuucuccaggaaaacauggcuggcaagggcuucuccuucugggucuggcuagacaauaucaucgaccuugugaaaaaguauaucuuggcccuuuggaaugaaggguaagguuaaacucugcaguaaggcugcccuguguaacgagucaccuacucccagcaagcccgugacugguuguccuuggcugcagguacaucauggguuucaucagcaaggagcgggagcgggccauccuaagcacaaagcccccgggcaccuuccuacugcgcuucagcgagagcagcaaagaaggaggggucacuuucacuuggguggaaaaggacaucagugguaagaacgcuugccuccuguaucacuugcuccaccugcuggccacuggcagcacccggcuacuucauguucuggguacuacugcccccugaagggcagagagggccugugccuccugaagagguggccugccaguuuguccuguucacucauuuggcuaacauuuguguagaaaagugugauugaaaucuuacuucuguacucccuuuccugccuaccccguuaauacauuugcggcagguguuuuugccuaugagccagcuggaucucuacaagcccgccuggauauugccucaguuccaagucacugggcagggcauucagagucuccagcacucacuccacuggcauaaucucuccuuccaugguccgugacaggcaagacccagauccagucuguagagccauacaccaagcagcagcugaacaacaugucauuugcugaaaucaucaugggcuauaagaucauggaugcgaccaacauccuggugucuccacuugucuaccucuaccccgacauucccaaggaggaggcauuuggaaaguacuguaggcccgagagccaggagcaccccgaagccgacccagguaguuguugacuuuccauggcuuugccuuccuuccuagugagaaaguacgcauccuuggagagacaaggacauggcugaguaucuugugggagcagggcuuggugauuccuucuuuugggaaagagugguuuauuggguuccuugacagggugacuaacucaggauucaagaggaggacagaaucagcccucagggagcuuggaagucugaagaugaaaauaguaucucucccucuuccucucuucucccuuuccaucucccccucccucccaccccgccacuuuaaaacacuagaaagagaaaugaaggcaggucucucuggugcuucuccagucaguggguuccagaagacccgagacagauuugaguccagcaugcuuugcuguccugagugagcagugccaggagucugaagaaaggcuuucuggggcaguggcuguuggcagccuggggcagagcugacaucaagcuggagguguugauguuccagagaugaugacuggagggaauguggacuuggcauuuagaaacaagaugcaucuacucugugggagugcguguggcuguaaaucagcauuucucagccuuucacggagcgcuuaagacuauaggaaaacagagauuuccauuaugauucauaacuguagcaaaauuacagcuaugaaguaguaagaaaaaguaauguaugguuggggucaccacaacaugaggagcuguauuaaagggucauagcauucagaagguugagaacugcugguauaaauuauaugaaaaauagaaauuauguuguguuaagucuguagugucuggggcggucccaguguaaagagucagaggugucuggucugaagccauuucaaacuuguugcauugacgcuugccucuguccuuaugcuggugaggagucugguuuucuaagacuguuguugaucauugcacaugcugagcuccgaggugcccugugugagccggccuccuugcucugaggugcccugugugagccggccuccuugcucugaggugcccugugugagccggccuccuugcucugaggugcccugugugagccggccuccuugcucugaggugccuugugugagccggccuccuugcucugguguuuuuucaccaaccgcuucuguucacauagcaccugcacacagcuuccccggcucugcccaccauucuuggaggagucgcuuguugacgguuacuuuccuuucccuuuguucugcuguugaguucucuucauucuguggaggaguucagcucucacuuccugucugucccuuaucucugcuuccaccuugccuucaguuggaagaucuguuuaucagucccucucacacuggucuuuguucuuuucacagaggacuuugaaguccgagcacugauccuuuugacuaauuuugcuuucaagauccaggccccuggucaggcauccaccuccaucaccauuccuguguaggcugcccagagacauuccucaggggcaaggccugggcaugagaaaggagcccacugccugaugggcuugccugugagccuagggagagugcacugggggcuccggagcccgaugauggaaggguaggggguucagaugauccccuuagggaggugagccuguaugucccuguccucugccccugcuacaggaguauugcaguagagaccuccccggagccucguccugggucuuccuugucugucaggaggcuguaauauacccugugcuccucuggagggauuuugagcaaguucaccaggcagcaacaggauguuccuucucucuuccaucuccagucugugucccgcacuccuaccucgggccgggucaaagaauauuucucucuugaccacuggagaaugaaagucuucucuucuccgcucuaacuuauuguguaugcauguguguugggggugguccuuguuggaggaccuugagggugucagcucucuccuucuaccauguagccccugaggacagagcucaggcuuggugacagaugacuuaagcacuaagccaucucccugauccccucugucucuuuaaggugacaguucucacucuagagaccuuuucuagaacuguaggcagcacaguugccucaauaauuccuuugcuucugugcugaguuaaccuguuucuuggccacaaaugagcuugcauauucaucuaagagcacuuucuaauggcuucucccagggguuugucuugcuggaugcuuguaagccccaguguucugucugugcuuuucuuagccuacccacacagccccaggcccgcugcgagcaucauuaacugaacccccagggcuucaugccaguguccccagggcuuccagauuucuuggccuaacauuucaguccucacauuuccaacauaaacggcagagauggaagacagccaguccugucucuuucucugucccacacaugaaagagauggcgccuuggccagguuuccuggcuguugcacauguucucggaccugguguccugucucccaguggcugggguauguuuuccugauuggaaguggcuuuggagccuccagcacguaagcauuuaguccuguuggugucugggcuggucaccaaacagggaagucaauucacaagugugaccaggucacaggagaagccuaacgcuacacaaagaugguuggucgcucaggcaggguggggaaggaugcacaagaguuggcgguaggccgggcagugguggugcacaccuuuaaucccagcacuugggaagcagaggcaggcggauuucugaguucaagcccagccuggucuacagaguaaguuccaggacagccagggcuacacagagaaacccugucucaaaaaaacaaaaaacaaaaacaaaagaguugacgguaggcuggguagagguggggcaggugucucugcagaagucuuugcagcucaggaaauucuauggaagagauagaacuucaaacugcaagacuggauggcaagcagcaugugaugagggaggacagcccuaagagcuggacugcggugucugggcaguuucuguaagguuggcucacgccgucugggagaggcaggaggauuccucuugcauguucucaaagcaagucacaaucuguuaaagcccggguuuccucucugcaggugcugccccguaccugaagaccaaguucaucugugugacaccguaaguggccgcccuucccaguuucgcauucauuucuaguguccuagugugcucaguuguccccaggaauagggaggacauggggugagaguuaccgugaagggcugguagcugcugggcuuguuuagugcucagagugaccuuguguguuuaaaaagcuugaguuuuuauuuuuucuguuggagaccagaguuugauggcuuguguguguguguuuguucuuuuuuuuuuucccccuccauugugucuugucaaccuggcccuucccacuccugccguccccccuuuccuacagaacgaccugcagcaauaccauugaccugccgauguccccccgcacuuuagauucauugaugcaguuuggaaauaacggugaaggugcugagcccucagcaggagggcaguuuggugaguguuuggagggucaggccccauugaugcuugccuguacagagccagggccugccauccacacugguagaaaucggcucuagagcugggugugguggcccaagccugaggcagaaugaucccucccugugaguucugaggccagccuggucuauaaagugaguccaggauagccggggcucuauuacacagagaaacccagucuugaaaaaacaaaacaaaacaaaaaauggcucuagggccauguucugcuguggaaaugauacucacacacaugcaguuucccaguagccacaguaaaagcaguaagagacuuugacagcuuggguaagcagcagcggcacuucagcaucugagaaaucauggagcuguccuccccugucccgccuccucuacugagucuuugaaauggaguggcuuugaugccuuugauuuaggcuagucucagguggcaguguguggcuaaggcuaccacacccagggcagccucagaccccugaaagagagagugagggcugagguggagacugugcucuucugggagggcaaggcccuccugugaggggcaggaagucuggcuuuucugaccuuguccaugucugaaggaacaggagacuggugguuccugagcccuguccucguacagagggaugaggguuugugagucggcuuuagucagguggcugaacugacacucucugugugucucugcagagucgcucacguuugacauggaucugaccucggagugugcuaccucccccaugugaggagcugaaaccagaagcugcagagacgugacuugagacaccugccccgugcuccaccccuaagcagccgaaccccauaucgucugaaacuccuaacuuugugguuccagauuuuuuuuuuuaauuuccuacuucugcuaucuuugggcaaucugggcacuuuuuaaaauagagaaaugagugagugugggugauaaacuguuauguaaagaggagagcaccucugagucuggggauggggcugagagcagaagggagcaaggggaacaccuccuguccugcccgccugcccuccuuuuucagcagcucgggguugguuguuagacaagugccuccuggugcccauggcauccuguugccccacucugugagcugauaccccaggcugggaacuccuggcucugcacuuucaaccuugcuaauauccacauagaagcuaggacuaagcccagagguuccucuuuaaauuaaaaaaaaaaaaaauaagaauuaaagggcaaaacacacugacacagcauagccuuuccauaucaaggaauacucaguuaacagccucuccagcgcugucuucaggcugaucaucuauauaaacccuggaaugguugcagaucaaaucuguaaaagagauccgagagcuguggcuuggccucugguucaaacacaaaggcuagagagaaccuagauaucccuggguuuuguuuacccaguaugcuugucgguuggaggugugagguaggccaagggcacuggaaagccuuugucaucacccuacucccuccccaacccagacuccagacccuguuucagggucagccugcccugugggugccuuacugggccuagggucaaccugccuuccuuucccacuugaccuugcugguaguauguccccuucccauguccaaaggcccucuguccugcuucuauugggaaucccugccucaggaccuugugucgagagggauugccuuacagguuugaaccugccucagacuacaggcccucagcaaagcucagggaguaugguccuuauucuaugcgcuugguucccagggauaucuguaaccacagggcaaaagcugacauauacuccaggucugcccucauaugagugguguauucuuggccuccccugagacuggcaacugucugcuccccauugggucucccaggugagguggaacacaguuccugcaccuacuguggccuccaugucgcuugcuugcuucgcucacucagcuuacuggaacacugaguguucaaggcaagccuuuccugacagaggcauggcuagauucagugacucaaagccaccucauucagcugaucagugucuguggaauuguuuccuuccaguuaaccagugucugaauuaagggcagugaggacauugucuccaagacgaacugcuugccuugaccaccccagccuucugcuucgagacaguuacugcucucccaccccaucaauguucuuuaguuauacaauaagcugaacuuauaaacugaaaggguauuuaggaaggcaaggcuugggcauuuuuauggcuuucaauccuggggacccaggaacaaggugagggcuucucuggggcugguguuguaccucaggggcucugggaagucugugugccuggguuaaccacccauagugagccccuggaacugcccacuuucccucuccuuggccccacuuggccccagccucacccagccugcagacugcuuagccuuucagugcaguggcuuguguucuggccacugcacucagauuccaauguaaacuuucuaguguaaaaauuuauauuauuguggguuguuuuuuguuguuguuuguuuuuguauauugcuguaacuacuuuaacuuccagaaauaaagauuauauaggaacugucuggcagugggggcuggcuggcuggcgggaccaccuuugccuagguugugcuuggaagaggcagagccgggcuaggagcacaugauaagaggggauagagcagcccagcucgguugaaguucuguuugcuucucauucccagggugaugcaggccccccaccuuacaucagcuaccguccuccagaagaggugacccaggagccagaggucauaguccaguggcaggacagugucagaguggccuccucccucugcccucccaaagcugcuguguuuguucuggagucagauaagcucccuaauggagggcgggagggcugggguguagaccaaggccucuccuuccacaguuggcccauuaucaccuucuuuacaguggggacaacuugcagccacuucccuggcugguggcuacagggccccugggcagucagcaacgauaauugaggaaaaggccacagacaaggcgccugcucacagcaccccccaccuacuccucucccugcucaguaccuuggagcccagcccugcacugggugccucggugagagauaccagugccgccucugcagagauggaagcagggaucaguguucuuagcacgacugaggcagggccagacccugcuuccaauccccagccacccugccugggacaggcugugaacugagcuccuucccccaaacaugauuggaacucugagguaaccugucuuacaguuccucaugccccaacccucaauccucaguagugugcccccccccuuuuuaaaaagauguauaugaguacacuggagcuguacagaugguugugagccuucaugugguuguugggaguugaauuugaggaccucggcuggcuccagcccaaagaauuauuacuauacacaaguacacuguagcuguccucagaugcgccagaagaaggugucagaucuuguuacaggugguugugagccaccaugugguugcugagauuugaacucaugaccuuggaagagcagucagugcucuuaccugcucacuccagcccaggagugugcucuuuaaguccaaggcuccaacccugaguccuggacuaauuguaccugggugccagagguccagcuagggcaaggcaggccucucuguccugacuaguuuccuuugcuuucucagucuauggcagcaguuggcugaugucaccugcuaggcucugggaagaggccaggggaugaagggcuguuguccaggcucucuaaugcccuuggccacaggaagguugacaggcacucuggcccuggccccugugauugcuuagggggcugcuggggagggguagccuggacuauagcuuugcuuucauucuugcaccuucuuuccccaagcccuuaaaccccugcuuuccugggcauguagccccuaacacacacacauuuuccugggcauguagccccuaacaaauacacacauacaccacacacacacacacacagagagagagagaguguuuagcuuucugacacugcuuuagggcagcagcacccuuaagaucacagcagagggagcagagauaacuccaagcuaaaauugggaacaaaacuucaacuuuagugaaaagcccauccaucacacagcccaguaaaccaggaagcagacugguagauuugcaaaaaccaaaccaacaaaaacuuuauucaaaaacacuguuuacauaaauguugaguucuauguacaaaauauaaaaagcaucccucugcuuccuucagagagguuggaagccaggacuccuagucggcuccuccuggcugcucugucacagccuccagggaagagcugcugaagcgauuucugagaccacaacccauggugggacagugcagggcccguucuaggucuugccgcccagcagaguggagcagacugagcgcuccccacccccuuccuucagacaguguguacagguuuugugugcuacagguuuuucgccccagguuuccuccucccagacccccaguauuccccuccuuucugauauaauaagcaagguugcaaacaggaaaggaagaaaggaugaggccacguguggucaugcaugccuguaauccuagcacucuagaaacagguaggaggaucauucauggauagucugggauauauggagagaccuugucucaaaaaagcaaagcaaaaacauaaaaaaaaaaaaaaaagcaagaaggaugaauccaucuggaagggugaggauaucgaauggagaaaagggauggugggaacguggacaaggccguuagacuugaaucucacguccauccacccuggcgcaagaacugacacucggcuguggcagcccucugcuguguugaagggaacagcuuaagcacaccgagcaaucacaaagucugcagcccguauguauacacaaagguauaaagggucacuaagaugaaccccaaucuuccaccugugcgaggacaggagcacaccggucugggcgaagcuucuagcuuaggaguaaaacuccaacuuaguugccuaaaccugccucccugccuuuucuagaauuucacugaaauggccauuggacagaaaaaggacaccggagaaauagguuugucagcaaugauagguucagcucuuacacgagaggcccugggggcccuugaggucugaacaaaaaggucaccaccgcuuuagccacaaacccagaacugugugggcaagguagcccugugaaacgugcaaagccauuguugguaugaacagagauacuacaacugacgugggcuccucacacugaaggugguuuuccaagagaagcauggaguccagcguucaggacagggagcuucuagcggaggugaagagaccagcagguggggagaggcgggcgucgagacuguccaugggccggcguaaaaguucuuccacgugccuggcaacauccaugcucucauccaggucaaacucgccaucuuggucaaggacaggguc

SEQ ID NO: 6383 - RNA, 13887 nt, Mus musculus
auccuuuuagaaaagcagguuuauugguccggcugcucaccagaacacagcaacucaagggacuccccuagagcccacaggaaacugcaucugcccacaacauuagcccaucagcacagaggaccucauccaacacuuacccacccuccucagcuucuccgucuccaagcauucagaggagggaaggggaccaagaaaaaaaaauuaaaaauaaaaaauaaaaagcaaagcuuuguaugguauaaaagguuugugguuuucauccccuccccaccccaaaauaucaaugagcuacaauucuaagaagcagggaauacauguaggugaggagaaggaaguagccuguagcuaucaauugggggagguguugccugcuccugaucagccauuaaagggggaacaaauguguccuuaggagaaaaccuggucaguaacuauaagaaaucaagccuuggacaugaagcagcaccccacucuccccaacuuucagguaaagggggccccaaaggcaaggaacacaggagggucuuggcaagcucuaaaguuucacauuagagaaagauccaugguagaagcagcugagagggaguuagggugggcaagccagcuggcccugcugcuccagcuuccagcuagggagcucagcuccagaggcaccuugcuuuccccagcugccaguucuccacaacucgcugcugcccccugcuggaacccuaauuuuccgggcauggaaaacaaggcuucccggaaggcaguuccuagauucuggaagagagaauccaaucaggcugacgucucuuuggaacacacuuucuaaaacugacuucccuccugacccggaagcugcccugcugucuugagauccuaccaaagugggacucuugaauuucuuuguguuguuaacaagggcauuucuuucuaauuccauuucaacccucuucuagcuuccucucucuuuccaaagaauacucacgugcuccugugugcagguuuuguagcuuuguaaauaagccccucuccccacacaccuaccacccuuucccaggcucuacccgccuucugcuuauuuugguggggccuuuauccaccaaacacucugccuuuuaccucacccuauugccuuaguucccccaaagacccucaggucuuccagugggccaccucugggcaaaggucucucuacacacauuuuaucuucguggaauuuugaauugcccacccccuccuucuaagcaagggcucuaucagugauacacccccaccaccucuuauuuugaaacugcaucuggcuaaauugcucaugcuggcuuugagcucacucugcagcccaggcaggccuugaacuuacaagucuccugccucagccucucugggagagcaagcuggcacuagaaagcugccccuacaaggguugucuuuaggauuugcucuuuccucuugcagaaauuugggcuuuggagucucccagggugaggaaaaggagaaacagcucaggaaguaggguggugcagcugaguaugaagcuguguuggggaggggccgaggggccuaacuagggagcuaaaauaaaagcauccuggaucaagacaaccagggcaugggucauucuucccauauccuacccagacuguguccaaauugaggcugucgcuggugagagaccaccuccccucggucuaaggccugugcuuuggagggcugcucuucggggggggggguguauucccccccccccgguuuguuuaaaaaaaaaaaaaaaagcccaaccagacuggggcuuagaaugcaaaagagaaaguuugaaaagggaaaggcggugugggcaggggugggggaucagggggcggcagggucaggcgccggccuccagggcagagcccugcgaguccugcucagucgcugucgcucuuguccaccaggacggcguccgacuccucggugaucuccagcagcgugugcacgucggggcugcucccgcgcagcaggucaguggccucgccgcgcuccgcgccaaccucgucguccucgggacccaccuccaccaucucgguggccuucagcaccuccaccucgcccucgcggaucuucuugacguggaaggugaaaggcggcaccuuguagacagcggucuuggagcgcgcauacaccacauggucgggcgugaaggacuugcgcagcuugucccgggaugucuucagcuucucucgucgcuccacgggcaccaggcgcgugcccagcuuguucaugcgcuucuccagcgugugccgugucuucuccagguucuccuuggucuucaggcgcgucuucuccagguucucacgcgugcgcaccuuggucuucuccaucuucuccuuggagaaggccuucuugaagucguccacgcgccgcaggccgcugcgcuugaugcgcucggcgcgggacuccucgaucaccuccuccaccuccaccgccucgucggacgacagcucgaucgccgcggugucauccucgggccgcucgcccucgcccagcucgucacccuccuucucaggcagugccuccgacucuuucagcgacuugcugacgcucaguuuggccggcagcuugacuucauccuaagaggagaacagagcagacaugagaaaugccacuggaaagggcagagcgagggcuggauaggaccccuggugaagcugaauagggugcuggcgauucuggggagagcauugggguaccuauguggugaggaugaaauccacuagacuuguucacucucgaacaccccagugccugguauggaacuggucacgaccagucugucgaaugguccuuauacaggcagcacgcggagagagcaaagcuucgggucagaaacugaucaccauuaugauuacacuaaauauucccagggacccuuacacaaaccgcugugacuucggaagagacugcuuaacuuuuggaaauagcagagcgcccucuggugcccuaacuuacacgcugucccaaacgggacaaaaaaaaaaaacaguuugggagaguuuagaaguugaagccuccagcggauagguacaaagccgaccccccauccccaccccccggcccccaaaagagcgauguagcuuuaaacuaaaguaauggaaguuuguucucgggauuuuaaccaguuugggggaaggagagcucugccuacagcagaccauuuucauccuugacuuucucauacuggcagaacuccaaggaucuguuuucuccccagucugaacauuucuucugguucuguuuucucugcccuggaauagaagggagggcggcuauucuagucuugucuuguuucccaggccagaguuuaaagagccaggcauggggaggcugguuuucccauccaggacugccuauaacucuagaacucuaagcuagcuccucucuuccucucagagacccuagcaccaguccuagucuugagucuguggacauuuuuuaauaaccugacuugcgaucaacaguucaucauuuuacgguucccccaacauaccacuaccaaagaguaguugugggugcacauagaacagaaacaagucugacccagaucuucaaugggagaucugaaaauggcccagacucguuuuagguauuuaaguccaaggaauaagggagaagggcacauuuuuuuccaaaauguuuuuuccaggccaguuuccagaauucuaagaaaaucccaucuccugagaaaacaacauaaauucuucccauaaacagacacacacacacgaaaaggauacacagagacacacacaucuauucauaggcuacaugaaaucuuuauaccaccugcuacagaaauuccuuccccauccccaaucccuuuccuauucccucccauucacauccccuaggguuuccugguuuacacuagaaacuaggaacaccuccucccaacuuccuucccuccuugucaauaacauuagcaggaacaaaaagggaauaccgucuccacuucgucucccaacugggcaccagcucugucgggcaccaagccauuucacgcuaucuauuacacuacuacaccucccagcaggcaagguauccagagcacaaggcaugcugggauuuguagucuccaccugccacaaauggggcuuaguccuaccauuggaauccuagggcaugcgccaucccuuugccucuuauucacugaggcgcugaaggaaugcuuuccuuguacugaguguaggaaggccccagccucucccagcauuccuucugacuucaguaguacccuuugagucucuugcaaucaucuugucugugcccagagacuucuaucaagacugacauugggggagggggggggaucugcaacccuauagguggaacaacaauaugaacuaaccaguaccccuccccucccauccccccaucccccucccccccagagcucgugucucuagcugcauauguaucagaagauggccuagucggccaucaguggaaagagaggcccguuggucgugcagaccuuauaugccucaguacaggggaacgccagggccaagaggugggagugggugggugggggagugggugugggagggugggggacuuuugggauagcauugaaaauguaaaugaaauaaauaccuaauaauaaaaaaaaagacugacaucauacacuucauuuuaggacugccuaggaagaaacccucugccaccuuuuccaugccucucaacucagauucacguguaguaccuauauagauagagauagauagauagauagauagauagauagauagauagauagauucucuugggccaggcuuggugguguauuugcaggucuuugaucucagcacuugagaggcagaggcagguggaucucugugaauucaaagccagccugguuuauaaagugagauccaagccagccuggacuacacacagugagacccuguuuaaaaaaaauuuuuuucaccucuuacgccccagacugaaagccuacccauaucucaccaaagugugaaaaagaacacacacacacacacauacacacacacacuuuuaauaaggucccacaaucccacaauaugaauggaauaaaagguaggaaaaagucucaguuccugaagggcaauucccugccccacccccacccuacuccugugacucuccuccugucccacccuaaccccugaagauggagcuagcugauuuuucuggccucuagcuucuagauuaaggucuuugccagcugagcucagaaaauaaggcuaagcugggcaugguggcacaugccuuuaauccuaguacuugggaggcagaggcaggcggauuucugaguucaaggccagccugguccacaaaguguuccaggacagccagagcuauacagagaaacccugucuugaaaaaccaaaaaaaaagaaaaaaaggaaaaaaaaaagaaaggcaggaaggaaggaaggaagaaagaaagaaaauaaggcuaaggagaacaccacaggcuuugccugccuaccccaacuuccauuguuggggagugguccaagggaggaggaguuuaugccugggcuuuuccaagaaaagugccuaggaaauguaacuuucuucaugaugggcuucccugggacugauggcuucuaccaauggcaccaucuucuggcuggaaggcugggaguugggcaaggaagaacuuggccugaguuccugcaggacguccuauaggcuggcucugaacacaccacaucaccauuagcuuuucccuccauuaauggauuucucauuuccacccccauuuccaagccaggcuucccucaugacucauggccuuggagugcuguguugggcccacccagucugucgguugcuacaacagccagcaacacaauccaaaugcagcuccccuuacucugggcacccaggccaggcaccuuugucucaccccugcggaucuggcagagugauuagggcaacggaggggccuuguggagagcaagaagggaggguucugcuuguuccaauuucccguuuuuauuaaacaaaaccaccacucccaacaggcuugguuuccagaguuaccuuuaaugaccaggucugaacaaaagcaugcacggcuuccccggccccugccaagcacacauagcgaguucccuaaggcaggaaggcaccaggccaggccagagguaaagaggcccucagggagcgucccacuacuuacacuucaccucccaacccugcugcagaaaggaagagcuucugguuuagaaaugucacuauaagauuauaaucugcugggcauggcagcgcacaccuuuaauccucaggaggcagagguagguggaucucugugaguucgaggccagccuggucuacagagaguuuuccaggacagccagggcuguuauacagagaaagaaacccugucucaggaaaagaaggauaaaaagauagauuauauuguaacugagcacccauuaugcucuuggcggagcuucucuugacucagugcuagagaaagacacuggagagcacagagaagaggcuacauuguggcacagaagaugguuaugaagaagaaaugaaagaagaguccuaaaagcccaagaccucggcuuccgguuacccagaaaaggcaagaaggugcuuucucuauaacucccucagcagcgagggcauuguucccaagaggaacagaacugacucucaggaagguagcagggucucuguuauuuaggacggcuccaaagaaccccguuccauaaacaaucacacagcguaucuauaguauuaaauuuucacgagggagguagaugggggaaaaaaauccucaaugguuccuuagggggaaaggaagagaagacaagcagagaagcugugugcguggaggcagcuaaaauguccucccuucgggccucucugagcuggcagcuuuggggugccccacccaagguaggaucuggcaaacauaagggaucccuuugcaaaacauuuucuaaaagaaaauuuaaaaaaaaaaaaguaagcguaaauguuuuccucagcuacagggagugggugaagagggcacggaacaacucccaggccugggccuccccuccaaagaggcuugaagccaagcuggccagucccugagggguagggcgugagggggcagggaagcgagaaccagaagacacacccaguuucaugcagcuucaugcaaggcagccuucgggugcagcucaagucuggugcugggcgagccacaauuuaaagagaagucaaggggguaccguucuguggucaagcauuugcuuagcaagcagggaguucugggguccauccgcagcacgggagagcaagacauccccaccaccacccaaggaggggagaacccccccucuucacccuccgcacccaccacacacacaaaauauuugcccgagcacugcagaauacaaccauuuuccaacacccauugccagcccauaauggacaacagcuugaaaggacaggccaugaaggcucugacuuucaucaaaugaagagccaauaggaaccaggagggacacccugugcccaguggggccccgugucccaggagauccuagauacucccaccagccguuggcucuucugggguggaucggagcccaggcucuggguaauagggcaguggauugggcaucugcucaaaggcugggcggucagacacugauucaggcuucaggugaaagggcucagucucaggcaggaggucaagaggcacgaucuugggcguggcugggccagagggugcauucggcuucuucuugggcuaagaugaggaaaagggguuuaaauggcacuugggauggaugcagggagauugacagaaagaaggccucuguggcacgcagaguggggucugguugaagagggagaggccccggaaugaacuagggugugccgaaagcacauuugaaacgcuucucuaggagggccccagggcuggaaggggugggacgaacccaagcccaugaauuaauaaacacggcuucaacugaaaccccuuccaucuccuuccugucuuccagaagguuccuugguccucuccuuugguucacacccuccauugucaugccacuguucugcacgagacggucauggcuacugaggggcuggagagaaaggggagagagcucgccaggcauggggaagggcuguguuugagaucaguugguaaauccuagcaggaaggcucaucugaguagaagagacacacacucccuuccuucuuccuauuccccaaggcagggugggcaggccugggugccauccuggaucagaaaagggacaggcauacaagaggggcacucuggcuacuucuggcugcgcuucuaccuugugcuucuuuugcuuuccagggcuuagacuaucagacacuauaacacagagagaaaucagaaccuaaaaccaagcugucuucaggacaggugggccuaugggguucccaggggcagcuuccgacccucuccagagcucacacucuugaacuugggagagggacaguuggggaaacagcagacucagacaauagcgauguucaguaaggcauguaaaacuccaaggcagcaacaggucccagccugcagaguccggggaagagacaggaacaucagggagguggguggaaaaugacucuccuagaaaggacgccuaagccagggacaccccuggcuggccuggagcuuacuccuuacuccaggaacuucuuccccugcucucuugugucuggguaaccagucuuugcuuuuauuucagccgcuaauggccaucaauacuccacaguuggccacuuguaaccaacauagcacaugugucuguauacacacacacacacaccacagcaccccaauaaggagcaacagacccagcuucuugcccaguuugcccagucagugucuccuguagcucagguugaccucaaacuggcuauauagcugagagggacauggccacccagcuaauuuauguggugcuagagauggaucccagggcuguaagccaguaccccagccaacaaagugagaguccuguccccuguuugcuuguuugggguggugguuguuguuuugagagggucucccuaaguagcccaggcugaucucaaacucacaguccugcuuccauaggguccagagagcuuggaggccagcugugcacuaccacacucagcuggccccaguuuuaacguuaccucaucgcuuaagugacaauaggcauguaacuuccccuggucugggccccagcuuccuaagacacacaauggagaggaugaagcugguuaucuucucagagggccagagccacagacggaugaaauauucacacagauaguguugcauuuagcuuugcuaccccaccuaagcuccgggaacgggccgcccuccccucaucucugaggcuguugcuuaguggcaugcuacccuguccccucuugcuaccagcugcuggcuuuauacccuugucccaccuuuuaaacuuugacuuuuacaauagucagauuugacuuuuaaaacggggagguaggugagcagauaguaagauuuccuucaguccugggaaugccccuaaaaauacccugucugcuuuggauugcacgaccaagaaaagaagcccaaagccaucaguuaggcuugguagacacacgccacagggaugaggcuaaggggguaaaagggagcguagcaacaagcugcaaguauuuuuagauaaagguuuaggguucuucuagagaaagguaccggugauccaccaggagcacaggaaggaaggaauuaaaggcuggugaaauuuugaggagaagccagcaaacccucauuccagccauacuguccucuccuuuagugucugugaguaaucugaucucuucaaggcuucuggguccucuccccaggccggggagcaaauccaaaggguaucggcuuugccucauccaaacuagcccaccuuugggggauagagggcaaugguaaaucacuuugccuagggcacuugagcuuggaaaaguuacaaugucaagaaagccuuuguuuccauuuugucucgccuucuagauucuaaucuagagcuggaagugucagaaucuucacuguacgaguggcuguguggauuucagcucuccuggguugcaagguguuucagccgccuccaucugcacaaauuacccagacuucccagaggcccccagucuacaacuuuuagacuucacuacccuguccaguagugguggcacacaccuuuaaugguagcacucuggaggcagaggcagguggaucuaucucugaauuugaggccagccuggucuacagagggaguuccaggacagccagagcugcacaaaaagaaagaaagaaacaagcaagcaaaaagcucugucucaaacaaaacaaaguaauaauaacaauaauaauaauaauaagaaccuccccuucacuagcuguugccuauaacucuuacccuauaggacagaaugagacgccaaaccacuugcuuuuguugauggccacauucgggauccccacaccaggaauacggcauggguggccagacauccugaucccagcacuaagacacccagacccuuggguucugucuccuaugauaucccuuuugccauaucaagacuucccacaccuagagggggaauuuagaaucuccuuucugcuuucccuaaaaacucauaucauaugggagcccuuuuccagucggugcccccccuccacuccccaccccugccuuccuugcucucucugccuggccaucuccuuauccugaguuucccauaaacucugccgcccccagucuucccuauuaggccugccaagacacagggcuauuuuuacccuauucuuuucucagaccguggaccucugcagacccgggaggagagcaggccgcuuuccuccaacaugggagguuccacccccucaccccaccuggaacauccuuggggcagcucagggaaguuuugcaacucugagccccaucccauguccuggaagcuggguccuuaccucugagcuugucccugucacuuaagugacagagacacuucuuucuuuugagauuuauuuauuuuuuaaauuuugcguauggguguuuugccuguauucaugucugugcagcacccuugcugaggcagaagaggguguugaaaccccuagaacuggaguuagauuguuguuagccaucaugggggugacugguucucuggaagggcacccagugcuguuuaugacugagccaucucuccacccccagucccaagccacucucccuuaauucuucccuccucacucacuggcuugguguuucagauacagucaaagccaucuagugcaugccccaccccaccacacuagucagauagugaugacuguccgaugcuggagcuggaacagaucagagaggaggaugaccccaucagagaagucguccacccacucaacacuuguccuuucucucagaaucacccuccucagccuggggagguuuaccuccagguugagaauguccccagacugcacaaccugguccauuuaaugagaaagucaccuguccaaguucuuugugacaagcacagaaggagcgagcuagcuuacuucucuuucccuaaacaucaccuguguggcaagggccgcaccggucucaaaaacaacccacaggacccacaccuccugcuuccaagcauuagacugaguggaaauggcuuucuaagucaacacucuucuccuacccagugggugcuauaaaugggagacgcaaagcuuuuuuuguuuguuuuagacuggguuguguuauaugucccagguugcuuuggccucugaaaugauuggggccccggguaaacaccagccgggcaaagcuuuuugcaggccccuugagagaguaccccagcaguauguagaggcaggagcugggagcaggccugcucugccucuggccuaccaccaaggauuccaagaauauggucugcuccauucuuccccagacacugucccaucugcaucgcucaugguuacucuuagggaaacuaagcgaagguccucaucucacaucacaugguuacucuggggcaucuuaaucaagaaagucucugagcuuggugaucacagccccuuuacaaagaucuuugaagguagagcacguuuccauucccuucaggagcauaaacuaacccuacaaccaucacuccuauuaggaguagaagcaucaacuaggcccaagcaggaggacgcagagcucagcacauucccucccagggaaagagcacuaaguccacacucagcucagccuuacucucaagggggucagggauggggagcgcagggacaaaucugcacugcacugacucucagaugcuuuagggguuaagauaucacaguuauauccaggcuggaggaacccagaaaggugcaaagaaugcaacggguggagcccguggagugcggcagccuccacccaccagcaccuucacagcucgggacauggcccccgcaaucaugcggggguggggugauucacugcgcccagaccgccaccuccacccgccccacuuacacuccuaacgcccacccuaccugccccacccgcucccagcaggcgccaagggcgcccgcgcacugcaagacccuugggaacugaaagugccuggaggccaggggcagaucgcggccuagggacaugcguggguagccgagguuggugcgggggcgcggggauaggguguggggggcugacgaucgugucccuugcauggcgcccccgccacugcgugccugagcccugaaucacccgcuauaucgggcccgcagcgccggaggccccaggucccgggccccaccuuuagugucugcuuacagaggggcauacagagaccaccagagaccucgggcauucccucccuuuucccucucuccgccccaccaaaaaaaaaacuuccuccaaguggaaaggcguuugacagagacaagcugggagcauucagcguucccaagucuagcccgcuaacuuuuccgauaggaguuagagaccguggggaggagccuggagaggaaggcgcagggugcgccccucugugagccccaagaguuugccacucccuaaaccccacuccaacuggguucacaggaaggggggaggagcuccugaccgcucucaccaggccgggcuggcggagagacgagccucggccggguguccccacccggaucccaggccgggaccccagcucugggcgcgguccgccccgcgggcucaccugguagaucaugacuuugaaguugcggcgccucagcagcuccgccucguugaccuccaguuucuuuaucuggccggccuggcgcuccaggcugccgcgcacggucuucacguugacgcugaccuugcgcaccuucuccagcaacuugcucacgguguugcucgugguggcgugcgccuugcccagcuugcucagcucucccuggaugcucugcacagcgcccuccaucuccgccugucgcuccuccagcugggcuugggucagcuggaucuggucaacggcgccgaugauuuuauccagaaggcucagcaccagcacaccguucaccugguccgacuugaucagcucgucggagccgguccccgacggcuccuccguggcccgcgccuccccuugggugggcuccgggcccucugaggaagcaucgggaaauccggaauacggccgcucaacgauauggagcgugacauccuccauggcuucccggagccgugcggggccgaccggguggaacuggagcgggagaccgggagagaaggaggagcgagagacuggacagcgagcaggagcccagagcggaggaaacucgagccacguccgugcgcaccgggacucuagccagaacugug

SEQ ID NO: 6384 - RNA, 13887 nt, Mus musculus
cacaguucuggcuagagucccggugcgcacggacguggcucgaguuuccuccgcucugggcuccugcucgcuguccagucucucgcuccuccuucucucccggucucccgcuccaguuccacccggucggccccgcacggcuccgggaagccauggaggaugucacgcuccauaucguugagcggccguauuccggauuucccgaugcuuccucagagggcccggagcccacccaaggggaggcgcgggccacggaggagccgucggggaccggcuccgacgagcugaucaagucggaccaggugaacggugugcuggugcugagccuucuggauaaaaucaucggcgccguugaccagauccagcugacccaagcccagcuggaggagcgacaggcggagauggagggcgcugugcagagcauccagggagagcugagcaagcugggcaaggcgcacgccaccacgagcaacaccgugagcaaguugcuggagaaggugcgcaaggucagcgucaacgugaagaccgugcgcggcagccuggagcgccaggccggccagauaaagaaacuggaggucaacgaggcggagcugcugaggcgccgcaacuucaaagucaugaucuaccaggugagcccgcggggcggaccgcgcccagagcuggggucccggccugggauccggguggggacacccggccgaggcucgucucuccgccagcccggccuggugagagcggucaggagcuccuccccccuuccugugaacccaguuggagugggguuuagggaguggcaaacucuuggggcucacagaggggcgcacccugcgccuuccucuccaggcuccuccccacggucucuaacuccuaucggaaaaguuagcgggcuagacuugggaacgcugaaugcucccagcuugucucugucaaacgccuuuccacuuggaggaaguuuuuuuuuugguggggcggagagagggaaaagggagggaaugcccgaggucucugguggucucuguaugccccucuguaagcagacacuaaagguggggcccgggaccuggggccuccggcgcugcgggcccgauauagcgggugauucagggcucaggcacgcaguggcgggggcgccaugcaagggacacgaucgucagccccccacacccuauccccgcgcccccgcaccaaccucggcuacccacgcaugucccuaggccgcgaucugccccuggccuccaggcacuuucaguucccaagggucuugcagugcgcgggcgcccuuggcgccugcugggagcggguggggcagguagggugggcguuaggaguguaaguggggcggguggagguggcggucugggcgcagugaaucaccccacccccgcaugauugcgggggccaugucccgagcugugaaggugcugguggguggaggcugccgcacuccacgggcuccacccguugcauucuuugcaccuuucuggguuccuccagccuggauauaacugugauaucuuaaccccuaaagcaucugagagucagugcagugcagauuugucccugcgcuccccaucccugacccccuugagaguaaggcugagcugaguguggacuuagugcucuuucccugggagggaaugugcugagcucugcguccuccugcuugggccuaguugaugcuucuacuccuaauaggagugaugguuguaggguuaguuuaugcuccugaagggaauggaaacgugcucuaccuucaaagaucuuuguaaaggggcugugaucaccaagcucagagacuuucuugauuaagaugccccagaguaaccaugugaugugagaugaggaccuucgcuuaguuucccuaagaguaaccaugagcgaugcagaugggacagugucuggggaagaauggagcagaccauauucuuggaauccuuggugguaggccagaggcagagcaggccugcucccagcuccugccucuacauacugcugggguacucucucaaggggccugcaaaaagcuuugcccggcugguguuuacccggggccccaaucauuucagaggccaaagcaaccugggacauauaacacaacccagucuaaaacaaacaaaaaaagcuuugcgucucccauuuauagcacccacuggguaggagaagaguguugacuuagaaagccauuuccacucagucuaaugcuuggaagcaggagguguggguccuguggguuguuuuugagaccggugcggcccuugccacacaggugauguuuagggaaagagaaguaagcuagcucgcuccuucugugcuugucacaaagaacuuggacaggugacuuucucauuaaauggaccagguugugcagucuggggacauucucaaccuggagguaaaccuccccaggcugaggagggugauucugagagaaaggacaaguguugaguggguggacgacuucucugauggggucauccuccucucugaucuguuccagcuccagcaucggacagucaucacuaucugacuaguguggugggguggggcaugcacuagauggcuuugacuguaucugaaacaccaagccagugagugaggagggaagaauuaagggagaguggcuugggacuggggguggagagauggcucagucauaaacagcacugggugcccuuccagagaaccagucacccccaugauggcuaacaacaaucuaacuccaguucuagggguuucaacacccucuucugccucagcaagggugcugcacagacaugaauacaggcaaaacacccauacgcaaaauuuaaaaaauaaauaaaucucaaaagaaagaagugucucugucacuuaagugacagggacaagcucagagguaaggacccagcuuccaggacaugggauggggcucagaguugcaaaacuucccugagcugccccaaggauguuccagguggggugaggggguggaaccucccauguuggaggaaagcggccugcucuccucccgggucugcagagguccacggucugagaaaagaauaggguaaaaauagcccugugucuuggcaggccuaauagggaagacugggggcggcagaguuuaugggaaacucaggauaaggagauggccaggcagagagagcaaggaaggcagggguggggaguggagggggggcaccgacuggaaaagggcucccauaugauaugaguuuuuagggaaagcagaaaggagauucuaaauucccccucuaggugugggaagucuugauauggcaaaagggauaucauaggagacagaacccaagggucugggugucuuagugcugggaucaggaugucuggccacccaugccguauuccugguguggggaucccgaauguggccaucaacaaaagcaagugguuuggcgucucauucuguccuauaggguaagaguuauaggcaacagcuagugaaggggagguucuuauuauuauuauuauuguuauuauuacuuuguuuuguuugagacagagcuuuuugcuugcuuguuucuuucuuucuuuuugugcagcucuggcuguccuggaacucccucuguagaccaggcuggccucaaauucagagauagauccaccugccucugccuccagagugcuaccauuaaaggugugugccaccacuacuggacaggguagugaagucuaaaaguuguagacugggggccucugggaagucuggguaauuugugcagauggaggcggcugaaacaccuugcaacccaggagagcugaaauccacacagccacucguacagugaagauucugacacuuccagcucuagauuagaaucuagaaggcgagacaaaauggaaacaaaggcuuucuugacauuguaacuuuuccaagcucaagugcccuaggcaaagugauuuaccauugcccucuaucccccaaaggugggcuaguuuggaugaggcaaagccgauacccuuuggauuugcuccccggccuggggagaggacccagaagccuugaagagaucagauuacucacagacacuaaaggagaggacaguauggcuggaaugaggguuugcuggcuucuccucaaaauuucaccagccuuuaauuccuuccuuccugugcuccugguggaucaccgguaccuuucucuagaagaacccuaaaccuuuaucuaaaaauacuugcagcuuguugcuacgcucccuuuuacccccuuagccucaucccuguggcgugugucuaccaagccuaacugauggcuuugggcuucuuuucuuggucgugcaauccaaagcagacaggguauuuuuaggggcauucccaggacugaaggaaaucuuacuaucugcucaccuaccuccccguuuuaaaagucaaaucugacuauuguaaaagucaaaguuuaaaaggugggacaaggguauaaagccagcagcugguagcaagaggggacaggguagcaugccacuaagcaacagccucagagaugaggggagggcggcccguucccggagcuuaggugggguagcaaagcuaaaugcaacacuaucugugugaauauuucauccgucuguggcucuggcccucugagaagauaaccagcuucauccucuccauugugugucuuaggaagcuggggcccagaccaggggaaguuacaugccuauugucacuuaagcgaugagguaacguuaaaacuggggccagcugagugugguagugcacagcuggccuccaagcucucuggacccuauggaagcaggacugugaguuugagaucagccugggcuacuuagggagacccucucaaaacaacaaccaccaccccaaacaagcaaacaggggacaggacucucacuuuguuggcugggguacuggcuuacagcccugggauccaucucuagcaccacauaaauuagcuggguggccaugucccucucagcuauauagccaguuugaggucaaccugagcuacaggagacacugacugggcaaacugggcaagaagcugggucuguugcuccuuauuggggugcugugguguguguguguguguauacagacacaugugcuauguugguuacaaguggccaacuguggaguauugauggccauuagcggcugaaauaaaagcaaagacugguuacccagacacaagagagcaggggaagaaguuccuggaguaaggaguaagcuccaggccagccaggggugucccuggcuuaggcguccuuucuaggagagucauuuuccacccaccucccugauguuccugucucuuccccggacucugcaggcugggaccuguugcugccuuggaguuuuacaugccuuacugaacaucgcuauugucugagucugcuguuuccccaacugucccucucccaaguucaagagugugagcucuggagagggucggaagcugccccugggaaccccauaggcccaccuguccugaagacagcuugguuuuagguucugauuucucucuguguuauagugucugauagucuaagcccuggaaagcaaaagaagcacaagguagaagcgcagccagaaguagccagagugccccucuuguaugccugucccuuuucugauccaggauggcacccaggccugcccacccugccuuggggaauaggaagaaggaagggagugugugucucuucuacucagaugagccuuccugcuaggauuuaccaacugaucucaaacacagcccuuccccaugccuggcgagcucucuccccuuucucuccagccccucaguagccaugaccgucucgugcagaacaguggcaugacaauggagggugugaaccaaaggagaggaccaaggaaccuucuggaagacaggaaggagauggaagggguuucaguugaagccguguuuauuaauucaugggcuuggguucgucccaccccuuccagcccuggggcccuccuagagaagcguuucaaaugugcuuucggcacacccuaguucauuccggggccucucccucuucaaccagaccccacucugcgugccacagaggccuucuuucugucaaucucccugcauccaucccaagugccauuuaaaccccuuuuccucaucuuagcccaagaagaagccgaaugcacccucuggcccagccacgcccaagaucgugccucuugaccuccugccugagacugagcccuuucaccugaagccugaaucagugucugaccgcccagccuuugagcagaugcccaauccacugcccuauuacccagagccugggcuccgauccaccccagaagagccaacggcuggugggaguaucuaggaucuccugggacacggggccccacugggcacagggugucccuccugguuccuauuggcucuucauuugaugaaagucagagccuucauggccuguccuuucaagcuguuguccauuaugggcuggcaauggguguuggaaaaugguuguauucugcagugcucgggcaaauauuuuguguguguggugggugcggagggugaagaggggggguucuccccuccuuggguggugguggggaugucuugcucucccgugcugcggauggaccccagaacucccugcuugcuaagcaaaugcuugaccacagaacgguacccccuugacuucucuuuaaauuguggcucgcccagcaccagacuugagcugcacccgaaggcugccuugcaugaagcugcaugaaacugggugugucuucugguucucgcuucccugcccccucacgcccuaccccucagggacuggccagcuuggcuucaagccucuuuggaggggaggcccaggccugggaguuguuccgugcccucuucacccacucccuguagcugaggaaaacauuuacgcuuacuuuuuuuuuuuuaaauuuucuuuuagaaaauguuuugcaaagggaucccuuauguuugccagauccuaccuuggguggggcaccccaaagcugccagcucagagaggcccgaagggaggacauuuuagcugccuccacgcacacagcuucucugcuugucuucucuuccuuucccccuaaggaaccauugaggauuuuuuucccccaucuaccucccucgugaaaauuuaauacuauagauacgcugugugauuguuuauggaacgggguucuuuggagccguccuaaauaacagagacccugcuaccuuccugagagucaguucuguuccucuugggaacaaugcccucgcugcugagggaguuauagagaaagcaccuucuugccuuuucuggguaaccggaagccgaggucuugggcuuuuaggacucuucuuucauuucuucuucauaaccaucuucugugccacaauguagccucuucucugugcucuccagugucuuucucuagcacugagucaagagaagcuccgccaagagcauaaugggugcucaguuacaauauaaucuaucuuuuuauccuucuuuuccugagacaggguuucuuucucuguauaacagcccuggcuguccuggaaaacucucuguagaccaggcuggccucgaacucacagagauccaccuaccucugccuccugaggauuaaaggugugcgcugccaugcccagcagauuauaaucuuauagugacauuucuaaaccagaagcucuuccuuucugcagcaggguugggaggugaaguguaaguagugggacgcucccugagggccucuuuaccucuggccuggccuggugccuuccugccuuagggaacucgcuaugugugcuuggcaggggccggggaagccgugcaugcuuuuguucagaccuggucauuaaagguaacucuggaaaccaagccuguugggaguggugguuuuguuuaauaaaaacgggaaauuggaacaagcagaacccucccuucuugcucuccacaaggccccuccguugcccuaaucacucugccagauccgcaggggugagacaaaggugccuggccugggugcccagaguaaggggagcugcauuuggauuguguugcuggcuguuguagcaaccgacagacugggugggcccaacacagcacuccaaggccaugagucaugagggaagccuggcuuggaaauggggguggaaaugagaaauccauuaauggagggaaaagcuaauggugaugugguguguucagagccagccuauaggacguccugcaggaacucaggccaaguucuuccuugcccaacucccagccuuccagccagaagauggugccauugguagaagccaucagucccagggaagcccaucaugaagaaaguuacauuuccuaggcacuuuucuuggaaaagcccaggcauaaacuccuccucccuuggaccacuccccaacaauggaaguugggguaggcaggcaaagccugugguguucuccuuagccuuauuuucuuucuuucuuccuuccuuccuuccugccuuucuuuuuuuuuuccuuuuuuucuuuuuuuuugguuuuucaagacaggguuucucuguauagcucuggcuguccuggaacacuuuguggaccaggcuggccuugaacucagaaauccgccugccucugccucccaaguacuaggauuaaaggcaugugccaccaugcccagcuuagccuuauuuucugagcucagcuggcaaagaccuuaaucuagaagcuagaggccagaaaaaucagcuagcuccaucuucagggguuagggugggacaggaggagagucacaggaguaggguggggguggggcagggaauugcccuucaggaacugagacuuuuuccuaccuuuuauuccauucauauugugggauugugggaccuuauuaaaaguguguguguguauguguguguguguguguucuuuuucacacuuuggugagauauggguaggcuuucagucuggggcguaagaggugaaaaaaauuuuuuuuaaacagggucucacuguguguaguccaggcuggcuuggaucucacuuuauaaaccaggcuggcuuugaauucacagagauccaccugccucugccucucaagugcugagaucaaagaccugcaaauacaccaccaagccuggcccaagagaaucuaucuaucuaucuaucuaucuaucuaucuaucuaucuaucucuaucuauauagguacuacacgugaaucugaguugagaggcauggaaaagguggcagaggguuucuuccuaggcaguccuaaaaugaaguguaugaugucagucuuuuuuuuuauuauuagguauuuauuucauuuacauuuucaaugcuaucccaaaagucccccacccucccacacccacucccccacccacccacucccaccucuuggcccuggcguuccccuguacugaggcauauaaggucugcacgaccaacgggccucucuuuccacugauggccgacuaggccaucuucugauacauaugcagcuagagacacgagcucugggggggagggggauggggggaugggaggggagggguacugguuaguucauauuguuguuccaccuauaggguugcagaucccccccccucccccaaugucagucuugauagaagucucugggcacagacaagaugauugcaagagacucaaaggguacuacugaagucagaaggaaugcugggagaggcuggggccuuccuacacucaguacaaggaaagcauuccuucagcgccucagugaauaagaggcaaagggauggcgcaugcccuaggauuccaaugguaggacuaagccccauuuguggcagguggagacuacaaaucccagcaugccuugugcucuggauaccuugccugcugggagguguaguaguguaauagauagcgugaaauggcuuggugcccgacagagcuggugcccaguugggagacgaaguggagacgguauucccuuuuuguuccugcuaauguuauugacaaggagggaaggaaguugggaggagguguuccuaguuucuaguguaaaccaggaaacccuaggggaugugaaugggagggaauaggaaagggauuggggauggggaaggaauuucuguagcaggugguauaaagauuucauguagccuaugaauagaugugugugucucuguguauccuuuucgugugugugugucuguuuaugggaagaauuuauguuguuuucucaggagaugggauuuucuuagaauucuggaaacuggccuggaaaaaacauuuuggaaaaaaaugugcccuucucccuuauuccuuggacuuaaauaccuaaaacgagucugggccauuuucagaucucccauugaagaucugggucagacuuguuucuguucuaugugcacccacaacuacucuuugguagugguauguugggggaaccguaaaaugaugaacuguugaucgcaagucagguuauuaaaaaauguccacagacucaagacuaggacuggugcuagggucucugagaggaagagaggagcuagcuuagaguucuagaguuauaggcaguccuggaugggaaaaccagccuccccaugccuggcucuuuaaacucuggccugggaaacaagacaagacuagaauagccgcccucccuucuauuccagggcagagaaaacagaaccagaagaaauguucagacuggggagaaaacagauccuuggaguucugccaguaugagaaagucaaggaugaaaauggucugcuguaggcagagcucuccuucccccaaacugguuaaaaucccgagaacaaacuuccauuacuuuaguuuaaagcuacaucgcucuuuugggggccgggggguggggauggggggucggcuuuguaccuauccgcuggaggcuucaacuucuaaacucucccaaacuguuuuuuuuuuuugucccguuugggacagcguguaaguuagggcaccagagggcgcucugcuauuuccaaaaguuaagcagucucuuccgaagucacagcgguuuguguaagggucccugggaauauuuaguguaaucauaauggugaucaguuucugacccgaagcuuugcucucuccgcgugcugccuguauaaggaccauucgacagacuggucgugaccaguuccauaccaggcacugggguguucgagagugaacaagucuaguggauuucauccucaccacauagguaccccaaugcucuccccagaaucgccagcacccuauucagcuucaccagggguccuauccagcccucgcucugcccuuuccaguggcauuucucaugucugcucuguucuccucuuaggaugaagucaagcugccggccaaacugagcgucagcaagucgcugaaagagucggaggcacugccugagaaggagggugacgagcugggcgagggcgagcggcccgaggaugacaccgcggcgaucgagcugucguccgacgaggcgguggagguggaggaggugaucgaggagucccgcgccgagcgcaucaagcgcagcggccugcggcgcguggacgacuucaagaaggccuucuccaaggagaagauggagaagaccaaggugcgcacgcgugagaaccuggagaagacgcgccugaagaccaaggagaaccuggagaagacacggcacacgcuggagaagcgcaugaacaagcugggcacgcgccuggugcccguggagcgacgagagaagcugaagacaucccgggacaagcugcgcaaguccuucacgcccgaccaugugguguaugcgcgcuccaagaccgcugucuacaaggugccgccuuucaccuuccacgucaagaagauccgcgagggcgagguggaggugcugaaggccaccgagaugguggaggugggucccgaggacgacgagguuggcgcggagcgcggcgaggccacugaccugcugcgcgggagcagccccgacgugcacacgcugcuggagaucaccgaggagucggacgccguccugguggacaagagcgacagcgacugagcaggacucgcagggcucugcccuggaggccggcgccugacccugccgcccccugaucccccaccccugcccacaccgccuuucccuuuucaaacuuucucuuuugcauucuaagccccagucugguugggcuuuuuuuuuuuuuuuuaaacaaaccgggggggggggaauacacccccccccccgaagagcagcccuccaaagcacaggccuuagaccgaggggagguggucucucaccagcgacagccucaauuuggacacagucuggguaggauaugggaagaaugacccaugcccugguugucuugauccaggaugcuuuuauuuuagcucccuaguuaggccccucggccccuccccaacacagcuucauacucagcugcaccacccuacuuccugagcuguuucuccuuuuccucacccugggagacuccaaagcccaaauuucugcaagaggaaagagcaaauccuaaagacaacccuuguaggggcagcuuucuagugccagcuugcucucccagagaggcugaggcaggagacuuguaaguucaaggccugccugggcugcagagugagcucaaagccagcaugagcaauuuagccagaugcaguuucaaaauaagaggugguggggguguaucacugauagagcccuugcuuagaaggagggggugggcaauucaaaauuccacgaagauaaaauguguguagagagaccuuugcccagagguggcccacuggaagaccugagggucuuugggggaacuaaggcaauagggugagguaaaaggcagaguguuugguggauaaaggccccaccaaaauaagcagaaggcggguagagccugggaaagggugguagguguguggggagaggggcuuauuuacaaagcuacaaaaccugcacacaggagcacgugaguauucuuuggaaagagagaggaagcuagaagaggguugaaauggaauuagaaagaaaugcccuuguuaacaacacaaagaaauucaagagucccacuuugguaggaucucaagacagcagggcagcuuccgggucaggagggaagucaguuuuagaaaguguguuccaaagagacgucagccugauuggauucucucuuccagaaucuaggaacugccuuccgggaagccuuguuuuccaugcccggaaaauuaggguuccagcagggggcagcagcgaguuguggagaacuggcagcuggggaaagcaaggugccucuggagcugagcucccuagcuggaagcuggagcagcagggccagcuggcuugcccacccuaacucccucucagcugcuucuaccauggaucuuucucuaaugugaaacuuuagagcuugccaagacccuccuguguuccuugccuuuggggcccccuuuaccugaaaguuggggagaguggggugcugcuucauguccaaggcuugauuucuuauaguuacugaccagguuuucuccuaaggacacauuuguucccccuuuaauggcugaucaggagcaggcaacaccucccccaauugauagcuacaggcuacuuccuucuccucaccuacauguauucccugcuucuuagaauuguagcucauugauauuuugggguggggaggggaugaaaaccacaaaccuuuuauaccauacaaagcuuugcuuuuuauuuuuuauuuuuaauuuuuuuuucuugguccccuucccuccucugaaugcuuggagacggagaagcugaggaggguggguaaguguuggaugagguccucugugcugaugggcuaauguugugggcagaugcaguuuccugugggcucuaggggagucccuugaguugcuguguucuggugagcagccggaccaauaaaccugcuuuucuaaaaggau

SEQ ID NO: 6385 - RNA, 1161 nt, Mus musculus
caccaggccgggcuggcggagagacgagccucggccggguguccccacccggaucccaggccgggaccccagcucugggcgcgguccgccccgcgggcucaccugguagaucaugacuuugaaguugcggcgccucagcagcuccgccucguugaccuccaguuucuuuaucuggccggccuggcgcuccaggcugccgcgcacggucuucacguugacgcugaccuugcgcaccuucuccagcaacuugcucacgguguugcucgugguggcgugcgccuugcccagcuugcucagcucucccuggaugcucugcacagcgcccuccaucuccgccugucgcuccuccagcugggcuugggucagcuggaucuggucaacggcgccgaugauuuuauccagaaggcucagcaccagcacaccguucaccugguccgacuugaucagcucgucggagccgguccccgacggcuccuccguggcccgcgccuccccuugggugggcuccgggcccucugaggaagcaucgggaaauccggaauacggccgcucaacgauauggagcgugacauccuccauggcuucccggagccgugcggggccgaccggguggaacuggagcgggagaccgggagagaaggaggagcgagagacuggacagcgagcaggagcccagagcggaggaaacucgagccacguccgugcgcaccgggacucuagccagaacuguggggcggggaaucugcgaguugcccggcuccuagaccaaacccggagucccgucggccauuggcuggccccaccccagaaagggaggaaccggggcaggaggggagaccaaccccggaggggcagcagaggggaacccaagagcugggcgccccacccuguucaggaugguuggaauaguuggagcgggagucuagggccccccuuggcaguggaggcugcggcagcgggacuggggcagaggaaugugagcugcggaaaggaauuaggucuucggagugugcucuacucuuucucuuuccucacccacaaacccacuccagccuuuuaagaucaagcugagguccaaauggcgcgugaauuggguguaaacgaguaguuugugucuaugccucauguccuuggaggauccuugcccuauacaaucuuuuu

SEQ ID NO: 6386 - RNA, 1161 nt, Mus musculus
aaaaagauuguauagggcaaggauccuccaaggacaugaggcauagacacaaacuacucguuuacacccaauucacgcgccauuuggaccucagcuugaucuuaaaaggcuggaguggguuugugggugaggaaagagaaagaguagagcacacuccgaagaccuaauuccuuuccgcagcucacauuccucugccccagucccgcugccgcagccuccacugccaaggggggcccuagacucccgcuccaacuauuccaaccauccugaacaggguggggcgcccagcucuuggguuccccucugcugccccuccgggguuggucuccccuccugccccgguuccucccuuucugggguggggccagccaauggccgacgggacuccggguuuggucuaggagccgggcaacucgcagauuccccgccccacaguucuggcuagagucccggugcgcacggacguggcucgaguuuccuccgcucugggcuccugcucgcuguccagucucucgcuccuccuucucucccggucucccgcuccaguuccacccggucggccccgcacggcuccgggaagccauggaggaugucacgcuccauaucguugagcggccguauuccggauuucccgaugcuuccucagagggcccggagcccacccaaggggaggcgcgggccacggaggagccgucggggaccggcuccgacgagcugaucaagucggaccaggugaacggugugcuggugcugagccuucuggauaaaaucaucggcgccguugaccagauccagcugacccaagcccagcuggaggagcgacaggcggagauggagggcgcugugcagagcauccagggagagcugagcaagcugggcaaggcgcacgccaccacgagcaacaccgugagcaaguugcuggagaaggugcgcaaggucagcgucaacgugaagaccgugcgcggcagccuggagcgccaggccggccagauaaagaaacuggaggucaacgaggcggagcugcugaggcgccgcaacuucaaagucaugaucuaccaggugagcccgcggggcggaccgcgcccagagcuggggucccggccugggauccggguggggacacccggccgaggcucgucucuccgccagcccggccuggug

SEQ ID NO: 6387 - RNA, 7817 nt, Mus musculus
ugggcaugcgcagcgucucaucgggccgaggauguuucauagggucacgcacccuccagccacgagcgcggucagcagacccugaccagugucugaguccggaaaccagguucuccgggcggguagcaggagccaaccuucaggucacguggcccgaggucggcagccgauuggaugcuggcagcccugccccgcgggcccggagcuugguauugguugugagggggcagcggccgcgcgguuggcaucauggaagccgcggggcuggccgugauucugggguuccuacuccuggcugggggcucugugggugaugaggcucgggaggcaaaggccgugcgggaacuggugguccggcuacugggacccgggccggcggccaauuucuugguguccguggagcgcgcgcuggcggacgagucgggccuggacaccuacagccugagcggcggcggcggggugccagugcuugugcgcggcuccacgggcguggcggcagccgcggggcugcaccgcuaccugcgugacuucuguggcugucagguggccugguccagcgcucagcugcaccugccguggccgcugcccgcugugcccgacgggcugaccgaaaccacgcccaacagguauugaugcugugggucccagacggcuggggcagcugccugcagccucgggacagccaccguuggugaggaccagcacaccuaagucggggcugcagcuacagacucgccuggagacugagaaggaagugcuggcucggggaucugugccuucaaaucuuggcuccccucuagcuguauauucuugagccaaaucauuuagcuucccagcccccacugcuggaaauaaugacaaacuauaggaacugugagcccucuucaugagagagaccaauuuugccuuauggcacugacacccuaagacaccacaggaugcacagcaggagcucugggcauguugaauaaaaaugaaguuauguauucacaauagcuacuagcuagggaggucugcgggaaguuccagcuucacccgagguggauuuggaaugagcaggagaggaggcacauugaaaccuuugcccacuguccuguaugcguacuguguugggguuaguagcugccucuggcugccucugaaguguuccagaggggugagugaggcaucccauauguccccaauaaugugccccuacccgcagguaccgcuauuaccagaaugugugcacgcacagcuacuccuucguguggugggacugggcccguugggagcaagagauugacuggauggcacugaauggcaucaaccuggcucuggcuuggaauggccaggaggccaucuggcaaaggguuugugccaaccuggccccucacacucuccugccugccuuacauacaccccugccccugggaaaccgaggccuuccagggugggacaaaguaucuggcaguauaugucuguaaucccaggacucagguagaggcaggaagauucaagauugaguuccaaggcaggaacucaaucagggcagguaccuggaggcaggaacugaagcagagacuuuggagcaacacugcuugcuuccugacuuggucagucuuucuuauauacccagaaccaccugcucagggauggcacagcccccaauaggcugagcccuuccauaucagucaccagucaagaaagugcccccacaggauugccuucaagccaaucggauggggguauuuugucaauggaggcugcuucuucccggaugacccuagcuuaaguaaggaugacgggggggggggggggggggggggagccagagacucuccgugguuugagggaagccucuuugugucccagagagucacccaucccacagacauggagcuguuuccuggaccgugagcucccuguaggcugagguccagaucugucuuaguagcaguaguccccagcucagagagguggugagcaagaacuuguccaaugacgugguuuauagguaggggcucuuccugcuccacagguauaccuggccuugggccugacccagucagagaucgauacguacuucaccgguccugccuuccuggccuggggacgcauggguaacuugcacaccugggauggcccccugccccguuccuggcaccucagucaagucuaccugcagguaaagaguggcuaaggaaugguggaaugggggcugaguguucacagagccagggaugggugcuuagcuagccucggggcucuugccugaucuauagaucuguguucccuuccugagggagcaagggacaccccccagcagagguccugucacauugaccucuaucccucccagcaucgaauccuggaccggaugcgcuccuuuggcaugaucccagugcugccugccuucgcagggcauguccccaaggccaucaccaggugagguccucccucccugcucagcucuaagggaaaagggucgcccugcagaaggaaaugcugaaacuccggauauuggcucggcuugacuccugccucugcugucagccacugcagauugcuggaugacucugacucgguuuccuugcuugucaaauagaaucauugcuggguaugauggcauacucuucugagccugguacuuaggagccuggggcaggaacacuaccaguuccaggccaaccugagcuacauagagaaacccacccauggggcgggggccugcugaagagaugccucggcucuuagcaccugcugcucuugcaaaggaccaugguucaguucccagcacccacgugguaguucccaaauccugaggagcugaucgccuuccuagcacacaucaugcauacggugcacagacauaaaugcaggcaagcauucauacccagaaaauaacaauaaaucaaucuaaaguauucccaggauuccuacauuguuaacaucaaauuuagacaacucaacaaauuuuuaaagguuuucauuuauuuuaugugugugaguguuuugccugugcauauaggucuguguaccauauuugugccuggugcucucggagaacagaagagggcacgggaugcccugaugcuggagugagagauggcugugaacuaccaugugguugcugggaaucaaaccuggguccucuggaagagcagccagugcucuuaacugcugaacucucucuucagucccuaacuuuaauauguguaugugugaauaauuuauauauguuauguauaaguacauaacuuaauuauuuaauuagggaauauuuaaagaaaaggaauggaaaauuacuaaguaacaagauggcuccuuuaccugcuguccugagugcugccaggcacacaauguuagugaguagcugcucuugguggccuagggagugugcuggucucugcgcucguguuugaacugucuucucuucuguggcuggagagaccuucaaggucuggaugaggcuccuccuccuucaugaaguucugucauccagcaccugcaaggacccuuaucaccaagccaguuaggaccuggcucccaccacugucacggcguguggugcugguugccggcugccccuccaucuugcucaccaagcuguggaaacuucauucuuuucauucagugcaccuuuacccaggugucuacagaugucagauccgguccuguguuagguccugaggaugcucaugugugcccguggcucugucccuaacaagagaucauuggcagagggagauagcagaaccuuuuuagacaggugacucucagggacagugaggaaggaccagguggauaagccuuagggguggagggaaggauaccaggcaggggacagagcaugaguaagcaugggggcgagaggaacccaggcacaguccaggaagccacagacgugagacuggugagggguguaaagccaagacaagcaccguaucagccucuaucaacucuaaaccuuccccccaccccacccccaggguguuuccacaggucaaugucaucaaguuggggagcuggggacauuucaacugcuccuacagcugcuccuuccuucuggcuccaggagaccccauguuuccccucaucgggaaccucuuccuacgggagcugaccaaggaguuuggcacagaucauaucuauggggcugacaccuucaaugagaugcagccucccuucucugaccccuccuaccucgccgcuaccacugcagccgucuaugaagccauggucacugguacggugcuugggauaggaaccccccuagaacaucagggagggaggcuggaugggaggaggaccuguauccgggugauaccaugcuuuucugcccagcaagccuuugugcacauaugccaucccacuuagccccacugggcgccgagugcccagugaccuaugaccuugggcauauucuuucccucccaguggcuugcucauggaugccuagcccuguuuuuuaaaaaaaaaaaaaaagucauugaguacaaccuaaucgaaaagauuuuaagccaggcaugguggcauaugccuauaacaccggugcuugagagguagaggcaggaggaucaggaguucaaagccagccugggcuacuugagagccuaggcuacuucaaaaggggguggugucagcaaggagauggcuugagcuugauccaugaaacccacacaaagauggaaggcgaggagaaccaacuccacagaguuguccugugacuuccacguguguguucacauaaacaugucacacacaugaacaguauccaucaccaccaccaccaccaucaacaucauccacguuuuuauuuggaaccaggcacgguagcacacgccuuuaaucuuggcagucagaagguagaggcaggcagaucagaucucucucaguuugaggccagcuuggucuauggagaaaauaucaggacagccaaggcgauauagaaagaccuugucucaaaacagaacaacaacaacaauuuuuuuuuuuuuuugcuuuucuguuuguuuauuuuuucgagacuggguuucucuguguagccuuagcuauccuggaacucacucuguagaccaggcuggccucgaacucagagauccaccugccucuaccccuccagugcugggauuaaaggugugcgcccaaccuucuuaauacugagacccuuuaauacccucauguggugacccccagccauaacauucauugcuacuucacaacuguaauuuugcuacuguuaugaaucauaauguaaauaucugaugugcaggguaccugauaugugaccccucugaaaaggucauuggacccaauggaguugagacccacagguugagaaccacugcuuuuagagucccccccucccccuuuuuuuccuuucaguugaaaguuacauuuauuugcgugugugcaugugugccucaccuggugugcauauggaaaucacaggguaguuuguaggaguccguucuuuccuucuaccaugugugagcuugaggguagaacucugguugucagguucagcaugaaauaccuuuccuagcugagccuucuucuccaaggcccaagacuugaccuuuuuuauuuuauuuuuuuuuaagauuuauuuauuauuauaugaaaguacacuguagcugucuucagacacaccagaagagggagucagaucuuguuacggaugguugugagccaccaugugguugcugggauuugaacucuggaccuucagaagagcagucgggugcucuuacccacugagccaucucaccagcccagccaucucaccagcccuugaccuuuuuuauaucacaguggagaucagcaugaacuuuaaccuuuaaucgugagacuuugggaagcaguuagcuuuuuuuuuuuuuuuaagauuuauuuauuauuacauguaaguacacuguagcuaucuucagacacaccagaagagggcaucagaucucauuaugggugauugugagccaccaugugguugcuggaauuugaacucaggaccuucacaagagcagucagugcucuuaaccacugagccaucucuccagcccgcaguuaagcuuuauguaaacccaaauaugccaguauuuggacauaaggguucucagacccagcucguggauguccugauuggcaggcccagaauuuggggcccaggcauccaugucuuaauuucucugaguagcucugauagccaagacgcuagaucagucguguccuggaguuucaggagacaagaugggcugaggagcccugguuacggcagaauggcagguagaucagucacgggggauggcgugagcuguaauaaaagcccgauuuccucaacaaaaccacuucucucauugccucucucugucuucuccccacuguaguggacccugaugcuguuuggcugcuccaaggcuggcucuuccagcaccagccccaguucuggggccccucucaaaucagggcugugcuggaggccgugccccguggucgucuccugguucuggaccuguuugcugaaagccauccuguuuacaugcacacagccuccuuccauggccagcccuucaucugguguaugcuccacaacuuugggggcaaccauggccuguuuggaccccucgaggaugugaaccgaggcccccaggcagcucgccucuucccuaacuccaccauggucggcacuggcauagcccccgagggcauuggccagaaugaaguggucuaugcucucauggcugagcugggcuggcgcaaggacccuguaccagauuugauggccugggugagcagcuuugccauccgccgauacggggucucccagccugaugccguggcagcuuggaagcuccuacucagaagugucuacaacugcucuggggaggcgugcagugggcacaaucgaagcccguuggucaagcggccgucccuacagaugaguaccgcugucugguacaacagaucagauguguuugaggcuuggcgacugcuguuaacagcugccccaaaccugaccaccagcccagccuuccgcuaugaccugcuggaugucacccgccaagccgugcaggaguuggucagccugugcuaugaggaggcaaggaccgccuaccugaagcaagagcuugaucuccugcucagggcuggaggccuccuggucuauaaacuccugccuacacuagaugagcugcuggcuagcagcagccacuucuugcuggguaccugguuggaucaggcccggaaagcggccguaagugaggccgaggcccaguucuaugaacaaaacagccgcuaccagauuacccugugggggcccgagggcaacauuuuggauuaugccaauaagcaacuggcaggacugguggcugauuacuaccagccucgcuggugccucuucuuggggacucuggcucacagccuagccagagguguccccuuccaacagcacgaguuugagaagaacguuuucccacucgagcaggcuuucguuuacaacaagaagagguaccccagucagccccgaggggacaccguggaccucuccaagaagaucuuccucaaauaucacccccagccugacucuuugugacagauuagccaucgcagggaccugcuggaauagguccucaaauccaaacaagcccagaaugcgccccaccccacccccgggccugggaggagacaggguaugacagugagugacaaugauggcuuggagggaaacaaggugcuuucuuccacuccagacuuggggcuuaaaguaccauuuucuguuaucaauaaagugcugaauccaccugggccuauuacauuaaaguauuggacguugcuggcau

SEQ ID NO: 6388 - RNA, 3102 nt, Mus musculus
uggugaucagacaguaaagaagauuuaucagauggaaagacccaggcuggagugcaaggguuacuuuuucagguuggguagcucaggaaaacagcaaagaccugacaaaucaauacaaucacagaccagggaaagugaaccaguuaaaagacggcaaguguaggcacuggugacccacaccuuugaucucagcacuggggagacagaggcaggcagaaucugaggccagccuggucuacaguuucaguucuaggacagccagggcuacagagaaaccuugucucaaaaaaacaaacacaaagaaacaacaacaaaaacaacuaucaaugaagcuuuuaaggaggucaugagaucagaaggguauacagaugaaaaagagaaaggauucaggugcacauggauaaagcccagagaaccccauucagauauccagaacccaggucuucccuucguguccucuuguaaugccagcacuaggcagacagggaccuaggauccuggggccaagguguuagacuagacaagcuggaaucauaggcuccaaguccagugagacuccgggucaacaaauaaggagcaacucaagauuccugacuuuaacuguggaucuccacacaugcacacacacacacacacacacacacaccugcccauauacaugggaacacaugauuauguguuagugguggggaccacaagccuggcccuaguuucacaaggagaggacagagaauuagacauuucagucauccuuaguaacauagcaguuucaaggccagcuauucaacgcuauucaacaaaaaucgguggugguuguuaaagccugucccaacuugcuggcuuauggguuagaagcucuuacaguucaauccagaagaccugaguucaaucauugaaccuuguagugggagagaguacaaacuugucaccugaucuccguacucugugugacugcgacgauggaaugugucccccuccacaugauacaugauaauaauaauaaauaaauuuauuggaaggaaaaaaaaaacccuuagccuagcaccuuggauaucagcccucuuaucuugacccaugaagaugcuggcacuauuucaaaugauucugagaagugugugguugcacacaucuaaggucccagcacgcaggaggcagaggcaggugggucuuuaugaguuacuggcaacacagggcuacauagugaaacccugucuuaaaacaaaacucauucuaaaauaagaaaaaagagaugcuggcuuagaucuuuugcugguaacaugaauuguccugacccgguuuauccgaugcagaccaccccaauucagaugccacccuagggauugcacauucagggaggcaaaugagggcgcuggaggccguguccgagacccccgggacuugggccccagccuuggcauucuccugggucugcagauuagagaaggcuucuuggugcauggccgcgacauagcugcugccacugggauccucugugcgcauucgggccagggguaggaagcgguucguggagaaguagcgcagcgcgggcugcggggcucgcauugcagucaagaagagcugaagcaggaagagcagcgcgugucuguggggcaccccuggggguguauuaccacgcccccacccagaaacggugcccgagacuccguuugcacucaccuccgucaccuccucuggguccugcgccucgcucagggcuugcucauaaccacgcagguagugcgcaaagagguggcgggucugggcaucugcucguuccagagccccgccggggccgcccaccagcuuuucauagaaggcugugugcacugccccacacucgaugaggcucacacugcggggaaggggaaagggugaugcaacagcaaccgguuacuagcagggaccacaaacuuggcccugguuuugcaaagggaaggcacagaaaggggcugaacgcuggaagcagaugcuggcagaacuauggagauugcagagcugagugugcuagggaaggguucucauguccauuugggguccaguuaccuacccgcucuguuuacucaucccgguaugccuuaagagcuagggcggcuugugaagugagauaaccugugccaagugcccugcauagugucuagcauggagaaggaaggccagaggcagagcaucugcaagaucuggugcugggguucccaagcuuuagaggguccuggaagguugguaacucacuggacuccaaagagcggcagcaggaucgccagacucucgcacaaaccuucgagcgcaaacuugcuggcacaguacacuucguggaauggcaguccuagaaggggagacaagguugcagaggcccuacggcuccucccuguacucggaaccucuuacucugucccuuucgcucacccaucaagccucccacacucgcggucaccagcacacgcccagaguggcgccucuucaugucuggcagaaaggccugcagcauccgaauggucccaagcacauucacauccaacacagcacccacagcguucaauucaugugcuucuagcggcccaaacaagccgcggccagcauuacagacugaggggagagagaacagaccccauuugugcaccgcucuuuccccucccacaccguccucccauguuccuugaacucgggacauaauuuggacacuggaggguaaagacuccuaucgcauguuucagggcucacccaguacauccacacgacccucagucacgcaugccugggcagcagccacagauuuggagucucugacauccaauuccaguaucuccaaggagccaggagggcauccuugaguccuggcggccuccaacaauggucccugugccuucaggucccgcaauguggcauaaacuaaaauuugggagaggacgaagauucaucaucgugcuuaccucuggggggcucuccccuggccuccaggccuuucccguccuauaccuuugaagcucugggaacggucagaagcuaggcgaacagccaagugcaugccgauuccagaggagcaaccgguaaugagcacuaccgugggguccauguggaauaguacuaaaguucagagcaagcaag

SEQ ID NO: 6389 - RNA, 4059 nt, Mus musculus
cgccucgccccgccccaggagucucucggcgaugcuuuguuugauugcucugaguucccguagcuccacgcuuugaggcugguggguagugcuuccgggcugcagccuaggacgccuccacggcgguguaaguagaagcagaaucccaagaacucacugaguagggaagcagcccgagccacagcguccccucuagucccucgccuccgagucuucgcagauggccgguucagccuaacaagaggggcugggauuccugaagccccagucccaugacucagggguuccuggcggguucccccugccaggauuccgguuucuaucagcgaacgcuccccugcccugcuccaggucccucuugaguccgaguuccccuacaggccucggccucagccugccuagucauucucgcuucgucucccugacugucugcaggccuggagagcauggccguguuccgcucaggccuccuggugcugacaacgccgcuggccacccuggccgcacgccugccucccauccugaccucggcgucccgccuggugaaucacacccucuaugugcaccugcagccgggcaugaaccuggggggacccgcucagccucaggccagcccugugcaggccacauuugagguucuggauuucaucacgcaccucuacacuggugccgaccugcacaggcaccuggacgucagaauucuacugaccaauauccaaaccaagagcaccuuucucccugugcuguccucaguccagaaucuggcccacccuccagaagugguucugacggacuuccagacccuggacgggagccaguacaacccuguuaaacaacagcuagagcguuaugccaccaguuguuacagcuguucuccacagcuggcuucuguguugcuguauccggauuauggaacuggagagcugccuuuggagcccccgaaugcccucuuacccucuacuauaaggccggcuuccccgguugccagaucuccaaggcagccugugcguggcuaccaccguggggccguggguggcacuuuugaccgcuugcacaaugcccacaaaguguugcucaguguugcauguguacuggcccaggagcagcuuguggugggaguagcugacaaagaucuguugaagagugagugaagggacccuggacuagggcaauggaaggcagccuucacauuuucuuguucuuccccaaugccaagaucaaggaaggguagggccacuucucaaccuuccaaaaugccacaaugucugacacucuguuauugcuaagggacguuuguuuguuaaaugaauacaugugguaucuuuagucugggguucagucacuuuuuaacugaagucagaacuucccaaaugggaaccaaggacucugcacuucaugguuguccaagugaucggcucggagguuugaaacgcugaagauaaauggauaggagaugauugggggugacccaguacugccaucaacagugaggggacucuaagaauauaguaguucuuggggguucuccaccaacugauaccuauugguccugcugcucuguaggcauuucuuaacuuguucuuggaguacacgucagcucucaaagugacugaugcuuguuuucccuucuguacccccaaaccugucccugucucacccuuucuugcugccacugcuugggaggauuucagugcuaugggacacucuuccccaaauggggaaagaucucaccguuccucgcuccuuccucaggcaaguugcuccccgagcugcuccagccguaugcagagcgcguggagcaucugacugaguuccugguggacaucaagcccucccugaccuuugaacucgucccccugcuggaucccuaugggccugcuggguccgaccccaccuuggaguuccugguggucagcgaggagaccuaccguggggggauggcugucaaccgcuuccgccuugagaauguaacucccgaaggagccuggcagaggggcugggagggggaggcccgugagaagugcuguggucccagagcagggaagggaggguucaggguggaagaacuugucuugucaaguucaggaacuugucuguggaggcgagggguagguagagagacuggggcuccagaugccuucuccuagcucuuacuccuuuccuccuccuccuccuccucccuuuaccucagggcaaagaagaacuugcuuuguaccagauacaacugcugaaggaccagagucacaaugaaaaugaggaggacaaggucagcuccuccagcuuucgccagcgaauccugggaaaccugcuucagccuccaaauguaagccuuccuccucgcugguugggcgugguaagaugcugaaggauagaaacaggcccuccacuggaagcugggcuuuugaacucccuggucacugagguucccucuuaccugucuuuaggagaggccggagcucccgucaggucucuaugugcucgggcucacaggcaucaguggcucugggaaaagcucgguagcucagcggcugaagaacuugggagcauacaucaucgacagcgaccaucugggccaucgggccuaugcuccuggggguccugccuaccagccugugguggaggccuuuggaacagguacuagccagagaaggcuggaaguggccugaggugagaagauggugugaccucuuugcuuagccuucuuucuuugucacccagauauucuccauaaagauggcaccaucaauaggaagguccugggcagccggguguuugggaacaagguaaacacacacaucuucaagaguucuugagauccaugggcgggaaccagugcacucccuagucuggcacaggaagucagucucugcuuaucugcucccaccccaacccccacccccccaccccccaccucacagcuguauuucucaggaaaguuaaccucugcccacucccucugucccccuccccagaagcagaugaagauccucacagauauuguguggccaguuaucgcaaagcuggcccgggaggagauggauguggcuguggcuaagggugagugggagggaugacgggagcagccaaagugggacaguuaagccgcaacacccucugggaucuuccuuggccccaggcagaccauucaccaccuaggacagcauuuggugcgcugacaggcagcaagcgcaaggugcugcuggcagugacuaguaucuccucacaggaaaaacucuguguguaaucgaugcugcuaugcugcuugaagcuggcuggcagaguaugguacacgagguguggaccgucgucaucccugagacugagguaucuggaccccacugcaccccaucugagcccacugcagacggucuccugcucugauccaguagacugggcuaggacccuuccugacccgugugucauccauugcccaggcuguucgacgcauuguugagagggauggacuaagugaggcagccgcucagagccggcugcagagccagaugagcggccagcagcugguagagcagagcaacgugguucugagcaccuugugggagucacaugucacacagagccagguuggugcaaagggaaagacuagguuagguuguggggagggaagguucaaugguuagcuuuucugaccuugccuuuucuuguaucauucuggccuggccaaagguggaaaaggcguggaaucuucuacagaagcgccucccuaaggcuuaccagaccaggaacugacaguggauuuucuauggcgccaaacuggcccuugaaacuaacaaaucuaauggugaggagaaaugggggccuugauguuuacccucuaucuggccucaggggcuuuaagcuaagcugugcaggacacagagaagcuuggaaguccgccuagcaugcuggaauuuguccagcaaugaggacacagcuaauggggagcgauccgcucugagguucuguccgcuuuuuggugguggaugugaugucuaccuaguguugauggguuuggugaagucuggacccaguaacugaauuaaagauguuuccaagugcugc

SEQ ID NO: 6390 - RNA, 5801 nt, Mus musculus
uccccuggaaucuuugcccaaaggacuccuucauuacuuucuuugccccacaggaggaaguuggaauagagacagaugaagaucauaauguuuugcuccccgaccccugaggggcccuugguggaggugggaacagagcguccugcgcuggccaccuuacuuaguggccuuuuuauucuugcuguucuccaccuuugagcaguggacggagcacaaagccauaguguuagauagaggcuggugaucagaaaggacggucauguccguuuuguacaggccucaacaaggacuuaaaacaauccuaaaagaaaguauuuguaauauuuauuguaauauaauuugauauaaaaauacuuaauuuccucuggaugaucaaaccucccagauaucaaaccuggggaaggcaguaggaaacaugggauaagaguacagaaagggugccauacaccaacauuugagacucccaagggaucgcccuggccuacccccagaagacuugaggaucuccugucccaccuaacucuauccccaggccccaggagaaauggagacaacacacugguggggcagauacacacauuaugcagaagaggcuggggcugcuuuggaggucugcuaagaaguuugggaaacugcauauaacaaaaaugcacuguggguauuuagaagauaaauucaaauauguaaugcugccuuugccuuugggaagacagggcaagagcugaugggacgcuguuuccuguagcaccuacagcagcugaagugggcagcagaacaugaggguagcagggucaggcagcccuacccugagcuggcuagaauacccuggccuuacuuaguauugaccacacagcccuagccuaggcacaagguggccuuuuacccuucauggccauagggcuauuucuuuuccuuuuuucuaacuuaagaacugccaaaauacccaaacuugagccaaguguugcccaagagaccaagcagaggcaaacgauuuccaaauuauguauauagauugugagcaggaacccaguggguagagaaaaggcugaggggcucaggguucugugaggcucccugaacagacucuuguccuagaggcuuuuccuagaaaggggaagguuggguagguucaacauuguggacaauauaauaaauuauucagaagcuuucacaaaacacucaaccccaccgaagcugaagugggguugggaaaaccaaacaccaaguagaaaccagcugaccggugugagguguugcaggccagucucauaggcccagcaguuaguuccauggccacacucucaaaggccucuuguuggcugcucugcaggcuuccaugggcaaucaguagaguugguuuuucaacugaugaaggacaccgaucacaaucucucguagagucuaggaaagacaauguucaggugacacacaggccuuuaagacgccugccuagaguggccaugcucuugaaggcguuuaaaauagucaccccuagccgggcggugguggcacacaccuuuaaucccagcacuugggaggcagaggcaggcaaauuucugaguuugaggccagccuggucuacagagugaguuccaggacagccaaggcuauacaggauaaacccuaucucggaaaaccaaaaagaaagaaaaaaagcuauaaaauagucacccaaggguuggcagcuugguggaguacuuccuagcacucaaagaaaaaaggccuggagagauggccuggcaguaaagccucuggucacucagucucuguggaguccacauaaagaugaaaggaaagaacucacuaaaacguugccucugaccucacacacuaaacaaacuuuuucuuuggugcggggaggguguuagagaugucuccguggugaagaguacuugcugcucuuaaagaggacccagguccuguucccaguacccucaucugguggcucacaaccaccugcaaauccacuuucagggguccaaggcccucuucuggccucuggcaucaggcagacacauguagcacauggauaaaugcagacaaaauaaauacccauguacauaaaauaauuuuuguaaaggaaaaaaggucccugaaauggaguguugccuacuuuuaauuuccaaaucccugaacuaagaugcagacaaagaugagugugucacugguauaacugacaugcuggguaugaguguucacuccaacaguccuugacuguugcaguguuuguguagaguauuucacaaugaaaauguugagaaacauaaaagaaaguggaaaaucugagaaaaaaacggcaggccucaagaguagaagccagcacaauaaaaauccuggggcuacagggagugagggugucuuguaaucugcaaacuuucauguuucuagaaacuucaagcuguuggcuuccauacaggacagccaaggaguagacaggguagcuaaugagucaccaaugacaugggcuaaagcuggaccuggcacugaaugcucacauccugguugccagcugagaccuucacugggcuaggcagcaaagacagaguauuaagcuuuguagacagaaacccaaaggcagcuacacuuuuccuggaguaugguaagagaaccucaggcaccaugaccccaccugccacauaccuguggcucacaguguuccucaauccagcugaagacacaagcugagagcuccuggaagcuggccacagagauagaggcguugaaagacuggaagagggaguccaugaugccuugaaagacguugaacuugaccuggucagagaccugguccucucccucaugaggguuguccugaugugccuucacgauuugcucauaguuccugaaagcaugcaaacaaacagggcugaggugcuauggcagcugucuaccugaaaaguauggagggauaauccaguuggccaugccauaaggggauuccuaggcaccuguggggaugcauucguuaucagcuggauagacgagccuaagucagaaacagugagaaacucuuaccuugauggguauuuacguccuauaugucuguuauauguacaagacuggugggccagucagcugugucuuacagugacuuccuugcugggucaccuacauguguucuccaacauagccucugaacaagagugcacuugaccucagccccccagcccccaauucagcaccccucuuacacuuucauuaucuucaaggcugugacguccuugcgcaguguggauacuucuuccuccugcuuuuucuucuccuuguguaaaaacuggauguagucaauggcuggaguaggagccaagagaaggguugagcacugaggaagucugaaccaggaagagggcuuauuuuguuugcccuuccccuauaaaccaacuuuuccauuaaggcgaccacaccugggugcgaccagguccuagccacuucacagacacuacuacccccccugccccaccccuugccuggacauacucuucuguagaacgauggcuuugcugaguuuuugggagccaauggagaaauccugcugcuggcagguagggacaauggucugaaggucaucauagccucucuggaaauagcagggaaauggguuccuuagcucaggaacagcaaaggcuagcgcacacuuuugauaccaguuccaugcucagacucaaagcacagagggcuggaaggaagaggugcaggcauagaaccagcccagcauccccaccccaccccaccccugcagacaucuggggcugaagggucagggcaggguccuucccugcugcccuggguacaggcuuccagucaccuuaauagcaucccuucucuucuguucagccugagugugcgcacgccgccuccggucuuuguaggacuccuuguaggacuccugcugauaaucacuguccucaucaucuaaacucagagauggaggaaggagagaucacuuuacaguacacuaaauccaauucgcccacccuuccccaguuggaaggaccuggugcccagagauguugaauagaaagaaccuaguuaaucucugaugaggugaaagacagugagccucgggcuuggcacuguuccugccacccccauauggagagcggagcucccuaucuaggaaagauacuaaaaugauggaagagcuaagucuccccaggugugcgacgggcuauguugcugccuaccuguguuggggacagaagaggcacugguggagccgaugcuauuagcucuggacacuacacuccccuugugggugcuuucuacaaaaagcccuggaaaaaagaggccucaagucacuaaggauuggggaacacugccaugccuucagucaccuaugggcacaauggcuucaaaugcugaccucucgccaucaacuccaaagccagucaccacaggccuuccauuucaugcugaaaugcuccugucccagggucuacacugcccagaggacuuauuucuggcucacacaggagcaucuggaugcagugacuaugaccagcugucacuguuuccaucauuucccauucuaaugcagaggaaccaggugugaccaugguugcuuccugccuauucuccagcuccacccucacuucucaagccaaguccuuggcgcagugacaguggacugugcucagguguggcuggcaagaccauaagaaucuacagagccgaaccaggagucauuccugacccgcagacaauggagaaggcacucaccaggauccaggcuguugucacuguaggcauacucgaccugcagcaccaagcaagggagaagccugucaaaccucugccucuaggaaggcacgcgcaauccgcgaaagcucauaccacaggugcagggaccacugaaugguuaagccaagccuuggcugggccuaggggggcgucgcccccucuguaugcuccuaccguccccgccccaucucccagcuaugacccccucguucccgcacacacgcccguuugucuccccaccuuggcacaggccgggugagagcugucuucucugcagccccgggccccggacagcaggggagacucuggggauaguuggggagccccgcgucuuccggacccccuacgugcacgagcccgacccgcccuccccucgccggcgugcgcguccgcgaagcuugccuugacccaaggguccuccggagaggcgcccggcuccgucaucgugaaccuaccgaaccggaaacaagccagcggacuggcccccaaccuccaggaagaggcgaggcucagucacgugauccaacccaccaauccgcaauuguagucgugagcggugugauagcgcugcgcuugcgccgcuccaguuuuuaacugaauguuggaggaggcuaaaucuggccaauucgcuuuaauguaggcaaugucagccccuaaggguccccacuggccuccgaaugagaaucuucaaugguggcgauuuucugugcaauggagcaccuccaaaaagauugucagaggggcuagaaguguaauuaguuuagugguagaacccgagugagaguacuagcaucugucugaacagugugacaccuuguacgcacgcgcacagcugguccgccuggcaauugcugcugggucaagaauuucuccuacaucacaugaucugaucuaagggggcacaaagccaccuccagcaucggucucccaacacucagcaggugcaggacgcuaagucuuauaaaaaugccuuuuaaguuaagcuuacaguaaagucuauaacauacucaaaagcacauaacuagucacugauagguuacacuuuacagcacuccuugacu

SEQ ID NO: 6391 - RNA, 3294 nt, Mus musculus
uccagaggaaauuaaguauuuuuauaucaaauuauauuacaauaaauauuacaaauacuuucuuuuaggauuguuuuaaguccuuguugaggccuguacaaaacggacaugaccguccuuucugaucaccagccucuaucuaacacuauggcuuugugcuccguccacugcucaaagguggagaacagcaagaauaaaaaggccacuaaguaagguggccagcgcaggacgcucuguucccaccuccaccaagggccccucaggggucggggagcaaaacauuaugaucuucaucugucucuauuccaacuuccuccuguggggcaaagaaaguaaugaaggaguccuuugggcaaagauuccaggggagcaaaagagaagaaucacuuacaaagaacugcuucuugcucuugggguagccuucaaggaucgcaucacacagcucuguggucugacaagaaacaaagccccuccuuaugaggugagcagcggcaguacaaggcgcugccugccggcaggaucauuccacaccaacuuccccggugacugucccuuccacaagcacccugggguucccacucaccauccucuuccgcuuccuccacucuuuacaguacuucugucugucucuguacaccugaaaggaaggagugugcuugucugagcuccuugugucuguucacugcagaccugcacaggcagccugcagccuccccacucaccuucuccuucucuucuggagugacaugguugguagcugcuuugauguucuucagucucucuguguauugagcacacuccuucuuuaacuccugaaucucuuucugcaucucaggaguggucagcgcacuuguuaauuccuucagcucugaaaacacauguccucaagagucacuugggacgagugaagaagggauccugccuugcccagcaggcgcgucccagaggugggaggucaacuugcgucuugcucugggaucucucuagaauaggaccccacacucuggaaaagcucaagaaaaggcuuagagcaccaucacucuguuuccuauuuuucuuuccugcuccaucuaaaagcaacagugccuuguaaggcuaagccgagugcuguacagauaauuaaaggaaugggaauaauagaugcagugugaucaaagggccagggcuugucuugcucuguuguacucagaagccauagcuaagucagucugucugucugucagucuuucuuuccuucuuucucuuucucucucucucuuucuuuucuuucuuuuuuucccgcuuuucaauacaggauuucucuguauagcccuggcuguccuggaacucacuuuguagaccaggcuggccuugaacucagaaauccaccugccucugccuccgccucccgagugcugggauuaaaggcgugcgcuaccacgcccggcuucuguguuucuuucaaugcaacaucauaggcaccuggcaaaggggucuuagcugcagucaaggaaccauucuguuagcaauuuaugaccuccaaaccacggcccagucuuaccggccuccaugugucggcagcucugcuguaagcucugcaccuuggcagugagggccacgauacuggcauccaggccguggagguccgcaucacucacugugucaaacugguucugccagccaagagaaauauagcugauuccaugaggcacagagagaaaaauacacaucaggggaggcggcauucaaauauggaagcaccaguaggugaccccuaaacccaacagugggagaggaugcuggggcuagugguacaggcuccucacuccagcaaccuggaaggcugaggcagggggacuaucuguacauuaauuaaguggcugggcauacagcucaauggcaaaguagagcagaauaagugagaccaaaugcuuuagaaagucuaaaaauacaguggagcucuugagccaucuugccagccucaaucugcauuuagauagaucauucaggauacaacauccaagauuaaaccuuaauacaucauuuuagacaggcgggucugacugagagcagugaugacacguuagauuuaacaacugcaaaauaaauaaauaaauaaaauugagcuagccugggccacguagugagggcuaaucucaaaaaagaggguggauggggguaaucagauauaauugacaaauagccacacauaucagguguauaaauaagagagacaaagacuuacauucuaaucucuggguugagaagagagguuuccugacagaaaaaugcuagaaagccaauuagggggcagagaguaagcauucaacauuggccauaucgaugcugguacucaauauuaucuggauaauaauuauccagagagaagucuggguaggagaauguaaauuugauguguuugggguaguggggcagaggaagaggaaaaaugauuuggcaggaaacgauagcagaaacgagacuaggaguugugagucagggucuuccuuuguucauagcucaaaugaacacugaugaaggcagcgugcagcguacaacugacuuaagaguaucugaagcucuuucauaccacugauuagauuauuuugugaggugccucaacacuuuuuuuuuuuccccgaaacagguuucucuguguagcccuggcuguccucgaacugagaaauccaccugccucugccucccaagugcuggaauuaaaggcgugcgccaccacugcccggcaugccucaacacacgaaaugcugagauucacucagacaagcucucaggugaguguuaaucugaguucucaccugaucggcaaaauaaauuuucugcuugccguaggucuucucuuugaucuugccuuccugggccagcugauccagcgccuucacuaccgccuagcagaggagagggugaaacaauuagcgcgaccccagacgggggagauuucuguugugacaaggaaggcaggacccaaggcuaacaagggaguccagcggggagggagcccccgcaaaggggguucucaccgccuugcccaguccauguuccuucuguagguuuccgaacacguccugggcgcuguagggccgguuuuguucuugcagguaccucaggaugaucccgggggcugcgggagacgagguaggauaugggggucaccuccgacccccucuccuauuccccucccgggucuugcgggcuuugccguuaccuccagccgcagccucggcccggcuuuuacucauggccuuucccgccaccaaacucgagagcuggacuggucgguugcuccgggaaacgccu

SEQ ID NO: 6392 - RNA, 41853 nt, Mus musculus
gcauucaucagacggaagagaacacugcgucgaaaugcguucccggcgcugagcgcgauucggagccgcgcacgcgcaacucgcacgacugaagcccgaugaaggaggaaauuucaucugcagaacccagcucccauuggagcggagaacgauuagggguggagcgcauugucuggcgccugcgucuugccggcgagcgcgcuagcggucggcgguguugcuggcgggagagacugcaacgccgaugucugaggagcgaugccgagagaaaucaucacccuacaguugggccagugcggcaaucagagugagcgaaccucccagacccucugccucccagguuccuuaggugcaagaggcccucgcaauaaggucauagcuucggucugucugcagaauccuaguucucccccacaaaggcgauucccaacccugugcccaacugccuaaagccaauggaccuuccccuguccagucauuggccuagacacuagggagucccaaggcuaaucuagaucccuagacccaggcguucaaaucccccacuggcuauuuggaaccuacccagacucacguaucuuuuuucuucaccuuccgccucccucucuuaguuggguucgaguucuggaaacagcuaugugccgagcauggcaucagucccgagggcaucguagaagaguucgccacggagggcacugaccgaaaggacgucuuuuucuaccaggugcucccccaagugacuugaccaggacccuggcgggacuggcagcgcgaucuggugcugggaaacucugaguggauggaugggaacagaguggcuaucuugagggagagccugcaggagccagaguugggaggcuucaggacuugacccauccuggcuucccucugacaggcagaugaugagcacuacaucccccgggcugugcugcuggaccuggagccccgggugauccauuccauccuaaacuccuccuaugcuaagcucuacaacccagagaacaucuaccugucggagcauggcggaggagcuggcaacaacugggccagcggauucucccaggucauuugcuguuccccugaagggcucucaacucugugggugggcacaggcccugugguuuuucuacagaugaaacuaggucagagauguucgagugcugaguaagauagccauggcuccaggagcuaacuggaacgcuaaggacgcagucuagcuagugcuuuguugcaggccauuuaaauacuuucuguguuaucuuuguaaaccucugacuaacccuagaaguaaguaccauggguuuaugauauuuuaucuacuucuucagacucaaaacaaaacucugaaaucaaagauauuucaaacuucacuuagcaaaaccaaugcgcaauggagaaggaaggcuauguugauguaucucguuaccuuauugucagcacucaggccucucacuguagaaaugucugauaacacaccuccaagcuccacggcuguaucaguacuguuuauuuggcagguucuaggaaugugcuaaacaucacauacuagacaaacuuagauugcugagcuaugcaucacauccacagccuugacgugaucuuuuuguuaaauaugaauauuuauuuauuuugagaaaguuucucuacuuagccuuggcuguccuggaacucacuuuguagaccaggcuggccucaaacagagauccaccugccucugccuccuaaauggcgagguuaaaggugugcuccgccauugcccagcuaauaugcaauuuaugauuguaugcccaaaacuaccuuucagaaccugaagaauuuugauuucuaaaaauaucugguccuguggauauuaaauggcgaaguguggaccuguguuuuacuuuuagugaggaaacagauaaaucuuccugaagucagaugacuaggugggcaugagcuacagugguagagauggcuggacauguaguucaguugggaggauacuggucuaguauguucgaagcccuggcuucaguccuuaacacugcauaaaacugggcagagugguccguacuggcaauagacacaggagacgcagaaugucaagguuauccucagcuaagcagagaauuugaugcuagccuuggauacaugaaacccugucucaaaaaaauaaaauaaguugggcagugaugguacaugccuucaaucccagcauuugggaggcagaagcagaggcaggcagauuucugaguuugaggccagccuggucuacagagugaguuccaagacagccagcacuauacagagaaacucugucuugaaaaaaacaaaauaaauaaauagaaaauaaaauacagagcccuuccuagcauaagcaagguccuggauucuagugauucaaaacuauaugugaccaaaucaccuugguuggguuuuaaaguaaccaauguuguaguaacucuugagugcagagcaaggcagcuauggugcauguaagaaucaaggguggagggcugagagagaugucucagcgguuaagagcacagaggucuggagugcaauucccagcaaccacacgguugcucaccaucaucugucaugggagccaaugcacucuucugagugaugcugucuucugucgugcaggcacacacauagaaugcucauaugccuauacguaugcaugggugacuacucugaggucagcuccugucccaugcucugucccaccucacccuucuucacaucuguccagggagaaaaaauccacgaggacauuuuugacaucauagaucgggaggcagauggcagugacagucuagaggugagugucccaggaguaucaguggagcuggucaauguggagcaauaccauuuagaaauuauucccuguuuucaaccauugagauggcugagcagguaacgaugcucguauucaagcuugacaaccugagguugauccguaagacccgugacagagagaacugacuccaaaaaguugugcucugacccugcggguacauaguggugugcacacgcgcgcacacaaugaugauaauuuuuuaaaagcuaccuauuagauucaagaccaacucauugauccuugcauuggacagaggcuacugagucuuauugaagagaggauggagucuccugggaaaugaggggacuugggaagacgaguccaagacauugugggaugugucuaguuggguauuagggcuagagagauggcuaguguggauaagagcauuucuugcucuugcaaaacaucuggguuuaguucccagcacccagcacggugguucacagucaucuauaacugcccucuuauaaccuccacaggcaccaggcacacacauguaugcacacauauguguguguguaugcauauacauagacgcaggcaggcacuuaaaauaaaaauaagcuuaaacuuuuaaaaugaaauccugucacuaaacaccgaaacgcuuacagccccuuucuuacacagggauuuguacugugucauuccauugcuggggggacaggcucuggcuugggcuccuaccuccuggaacggcuaaaugacagguaaguaagccugccuuugggagacuaggugaaggcggguccuuucucuucauuuccuacggccuuuggggcccagcagacauagcucccuccgugcuguagcccuaccauucccuccgacugggaggaaacugaggguacaagggaaaagcccaauagcacuugcagagcuaauaccagcauggaggcccugcuuugaguggccaaggaguguguccagguuuggagccuaggauuuuacagaguuucuucccuugcccuuuuggaguuuugucuuuucaaaagcuacguccuccuguucuacugcuuuuggcccgacucuacuuuuccuauucaccgacaaaugcuccuagaccuauucagaaggcuaauguucaccaagucucuaaucgggugcccucuucucucuaccccaccagguaccccaaaaaacuagugcagacauacucuguguuccccaaccaggaugagaugagugacguggugguccaacccuacaacucccuccucacacuaaagaggcugacccagaacgcggacuguguggugagacauggauucuuguuccugcucccaugccccugucuguucaucuucauuuugagcucucuugugucgaacgcuugagaaaggccauuuggagugaauguuuccgaccauuagguucaaggagagacucggaccaagcucccgcuguuccugcuuucauagaucuucuacucuuugcuaucccuuuuagguggugcuggacaacacggcccugaaccugauagccacagaccgccuacacauccagaacccauccuucucccagaucaaccagcuggugagccccccuccuggagggcaagcccucucucugcgagagggucaucagaggagggacauuccaccuccaccaagccccauaacacaguaucuguucccagguguccaccaucaugucagccagcaccaccacccugcgcuacccuggauacaugaacaaugaccucaucggccucaucgccucgcucauucccaccccucggcuccacuuucucaugacuggcuauaccccccucaccacggaccagucaguaagagcugccucggugucccuuucccauacucuccaggagcugcucuuugcagcucuucuccacccaccuccccagauucuguacucagggacugacugccaccagcuugcagccugccccucccccuccgcuuuguaccaccuuuggcuccugcaggagcagugcccacugggauaauaaaauagcucacugcucaagggcaugggauuggugagcugagagcugugauccugaccccacggcagagacucagcccagaccugaucuaaagacaguccccagagaccacgccaccugcaagcugauggggacagaguugacucucuuccucuguccaugcaucucuggguuccucccugacugaugaccaggucucugaaccccguucucucagguggccagugugaggaagacaacaguccuggaugucaugaggcgccugcuacagcccaagaaugugaugguguccacaggccgggaucgucagaccaaccacugcuacaucgccauccucaacaucauccagggagagguggaccccacccagguaagggaggccccuucacccuagccucaggcccacaggaugguugccagcagcaaccacccccucucugcccaccccagguccacaagagccugcagaggauccgggaaaggaaacuggccaacuucauccccuggggcccagccagcauccagguggcccugucaaggaagucucccuaccuacccucagcccaccgggucagcgggcucaugauggccaaccacaccaguaucuccucggugagcgcagccuccuguugucuuuuuguuacugggaaucaaucccagggcuucaggaaugguaggcagcucucccugcucugagccauaccccuagcuccuggucuuaggccauucugcuccacucccuacugucauucgcuccccaugccccaucuguccccauucugugucuugcgcuggaugccauucugaagauccccucuccagcuguguacgcugcuugugcuuuacccccaucuccguuccuuacacacacacacacacauacacacacgcacauauacacacauauacacacacacacauacacauauacacacauacacacacauacacauauacacacgcacauacacacacgcgcgcgcacacacauacacacacauauacacacauacacacauauacacacacgcacauacacacacgcgcgcacacauacauacacacacacacacacacgcacgcacacacacgcacacaccacacacccuccuagccucuguggagaguaacaguaccucgguucccgggcucucuggacugugccauuucuugauuucuuugugacuggacugugccguuucuugauuucuuugugacuggacugugccguuucuugauuucuuucuuugugacccucccgcuaccccugugccuuaagcucuucgaacggaccugucgccaguuugacaagcugcggaaacgggaggccuucauggagcaguuccgcaaggaggacaucuucaaggacaauuuugacgagauggacaccuccagggagauugugcagcagcugauugacgaguaccacgcggccacacggccagacuauaucuccuggggcacccaggagcagugagucacggacgacagggacccucaucugccuuaccgguuagcccaggcccugccaggcugacuuccccucggagcacagaucagggaccucacaaguccucgcguacacacgcaccgucugucggcuuggggguggguuuacuucuucucugagaguauuuaucuuuaauaaagcacuggauguaaaccaagccaccccccggucucugaauucacacuggggaauggguguggagguacccgcuucugcauagcugacgguuuccuucugcacuuccaacgucuucaacucggggccgaaagccgccucuagcuuugccuuuggccuaauuguggaggacacagauggcucuugacccugcuggaauucuuuuccagaguaaaaggaagcacagauaagaucuuuuucuccguucaaccuccucuggucucaguuccuccacacuguaucagaugaacacuccuccacuugcacauuuccacacuggaguguccuguuugcaugccuauugcaugccuggggccaccacacuaccuaccuccagccuccuaagcagggaagucaaccuaugugccuugcagcucuggccagcagagcagugcugaagggcuggucccagagagucuugacuggagucuaggaucgucaggagaccaggcccaaagcacagucaaaacucauucuguuucuguucucaaugggucuucauucguguaaaguuuuuauuacuuuuuaauccuuuuggauguaacuaugagccuuggggugaguguagaagucagaaaauaacuugggaggaguuucucucccaccauguggguccagggaacggaacuuagguugucagacucaagggcaagccacuuucccugccaagccauuucaccacccuauuuuguuuuguuuuuuaaauuuauuagugauauauggauguuuuagcugcuuguguguguguguguguguguguguguguguguguguguguguguguguguguguguaccauguacauguagugcuagcagaagccagaagagggcgccagguccccuggaacuagacuuacagacaguuguggggugugagcugccauguuggugcuaggaacagaaccaaagugugcuuaaccucugagcugucacuccaggauccauucuuuaacauuccaguuauuuaaaagcccaaugggagaaagaucacagacugaaucuguagcucuuaaacucuuagaguccugcugggcagugguggugcgugccuucaguuccagcacuugggagggagagacagguggaucucugacuuggaagccagucuggucuacagagugaguuccaggacagggcuacacagagaaaugcugucucaacaaaacaaaacaaaaucuuugagauccaagcugggcaguagugguacacaacuuucauccuagcacucugcuggcagguaaaucuccaaguuugaggucagccugcucuacagauggaguuccaggaccuccaaggauacacagagaaacccugucucaaaaaacaacaaaaauccuaccuccuccugcccuugucccugccccuugggacccaaagauaaugaaggacugcaaagggccccacuaaacucuuacauaccccacaggaaagaacuacaaugcaucauguacauugguuuguuuaaugguaauuacaaaccuaugaaagggucgauaucauuaccaaucucauuuuaaaaacgcagaaacagcaaaguagaucacaaggacacccaguuaaguggccuuaaguggcagaguugaaacaagcucugguacaccuggcaucuguguuuguuuuuuuuguuguuuguuuguuuuguuuuuuuguuuuuucgagacaggguuucucuguguagcccuggcuguccuggaacucacucuguagaccaaguuggccucgaacucagaaaucugucugccucugccucccgagugcugggauuaaaggcgugugccaccaugcccggcuccuguguuuguuuuuaaggaauagccaaacaagccauguuuuuagauguauucauuuuauuuccacgcguguguaugcguacuauguguaugccugguugcccacagaggugaaaagaagaagggauuggacccuguggaauugaguuccugaugguuacaagccacuguaugggggcugggaacuaaauccagguccucugccagagcaagugucuuuagcugcuagccccucuucccuuuuuuugagauuauauuauacuacguagcccaggcugaccucagacuugccaugcuccucccccuuccaccuccagccccuccccgaccucaaccccuguuucucugccccugccccugccuuguacuaggacuagguuauauggguccauuauuggcacauacacaccgcauuugugugaugcuggggggcaaacuuagaaccuguguggauuaagcuaagugaacacugugccacuaagcuacacucccagcaacggugacugucacuaaccauggcaauacgcuuccuuuuauaucucccaggacagugucgaaucugcucauuccuggcgggggggggggggggggggggguuuguggccauaagaugagcccaucucguuguccgcucaugcagagaaagcauguuugauucuugucuugagaauaucaucaacugccaaguauccaccucacggcacaagguagcucaggauguuuuaagcaaauacuucacuucucccuaggcugggaggcugaguccauggaagagcccuugccugccucauagucaacagagggaccaguauacaagccagcccccuacgauaauauaaaagccucgaagaacuaacgggcaggaaacaggcagucagacccaagucucagacugucuuaggaaugaggaguccgcaagccuauucggccacgguucaagcggccagccugucccuaucuuuugccaagaccuacagggagcugacucagggacaggcagcauggucaugacuaaccagcugccuauucccucucaaggaggaaggugacuucugugaaagccagugugcaccuggucccccccucagcuccaccuccuauuucugcaccccugggugcuaagcauaguccuucccauuugcugauuuuuuuuuuuuuuuguugagaccaucugccugccucugccucccaagugcugugauuaaaggcgugcgccaccacugcccggccccauuugcugaccuuaguccugaugaccaaacuuuuuucaucuuuuggagaccucugcauaaguggucuacuggcccaucuucagggcgcaagcaaucccugagcccuccuuugugggaaccaguuaaggcagguauggacaccccccccccggggggggcuuaugcugggugugguggcgcacaccuuuaaucccagcacucaggaagcagaggcagauggaucucugaguucgaggccagccuggucuacagagugaguuccaggacagccagggcugcauagagaaacccugucaagaaagaaagaaagaaagaaagaaagagagagagagagagagagagagagagagagagagagagagagagagagaaagagagaaagaaagagaaagaaagagagaaagagagaaagaaagagagaaagaaagaaagagagaaagaaagaaagaaaggaaggaaggaaggaaggaaggaaggaaggaaggaaggaaggaaggaaagaaagaaagaaagagugaggcagggagggagggaggcagggagggaggcagagagggagggagggagggagggagggugaguuagguuugccuagcagggaggaguaacuccacaaggacgccuaugcucucugacuggugaguaccaggugucacaagcaugguccgcacuucaauaccagccucagccaggccccucccccaaggcuauuuccagaucacccaacaccccagacagacaacgggggcagccccucccaguucuuggccagcagcaaaccccaaacugugucauccagagggcagugcagaggccagguggaaagagaggccucugggagucggggcagcaggugguacugguagggaaaaggucuugucgucagagguauugcgaggcacagcuauaaagugcccugacuagacagcaaggguggcuaugaaaacgcuguggagaaagcagaaugcccaagcuuggaacagguuugucuuuaaccaaacgacgacgagagaaagcuagccauuuaaaggcgauguucucagaauauuccaagagaggugauguaacuccaggggcccuggaacgugggugagaccgagcccuggagcaggaagcacauaucccaaaauagacuugagcaagcgagccugaaaccuagggacaguaacuugggagaauguguugagguuaggucaagaggcgacaaagcgacaagcagaaguggcaagggugaauguagccacgagacaaggaguugguaggcucguuaguccaucaagucuuauccaguguucccaucagccauaaacauucuacaccuccccagaaaguggcacuccuccgcggggagccaguuuaaauccaagagaaaacacacucugcuaaugccaccuccaauaugccucaccucauacucuuucuacagugucuuagacgaggaaggcucuacucuggaaaagaaacaaaaaguuugguguuuggggagcugcggagauggcucggucguuaagagcacugguucuugcagagaaucaguucccagcauccacaugccaguugacauaaccaucuguaacuccaagaccaaaggaucugaugcccucugaccucaggcaccaggcacacauguggugcacauacggauacgcaggcaaaacauaugcauaaaauaacucuuaaaaauaaaaaaaaaggagcaaaaaaaaaaaagauuaaauaaaaucgacauuccaguuuuuaacccuaucacaagugguuggaucaccucuuuguuuugugacagggucucauuuuguagccuagccuugucuugaacuugugauucuucugccucagcuccccaaguacuaggauuaggggugcaugcauuugcacccagcugacacaagcauuuccuaaaaauagacacugaaaggcuggccagauggcuuggcagauaaacacucucaugaggaaugguggcuuucugggcccugccugugugucucccugcagccuucccucccgcucucccuuugcuucugugucuuaguguccucuucacuguaaagacuucuaaaaagagagggagacaguauuaaauuccguagaaaauucuggagagucucugcuuuaacugaaugauccauagucugacugacuguugguuuuuuuuuuuuuuccuuuguuguuguuugauacaggguuucucuggcucuccaggaacucauucaguagaucagguuggccuugaacucagcuccaacugccucugccucccgagcacuggaguuaaagguaggugccaccacacccaccaguaguuuuuauuguauccauauugcccagagaaauugaggcuuuaaaaaaaaaaagauuuaucuuuauuauuuucuaaaucgcgugcauauguguuugcauguggguauguacucaugugcaugcaguccccgcagaguccagaagagggagcuggagcuacagaugcuuguaagcagcuggccuuggaacugagcucaguccucgggccuccaacaagagcucuuggcagcugagcgucucccuagcccuuuucuuucuucucucuucuuuucuuuuauaaaaccauccuaauuuuaaaaagaaagaaagaaacacaaguuccucugguggaaguuuaauaaccuaaauucaaucccugcagcccacagugaaaggagaaaaccaaauuccaaaaguugcugcccucugacuucccacacauggcauuaugacauguauucucucucucucucucucucucucucucucucucucucucucucucucucucucucacacacacacacacacacacacacacauacauacacacacacacacacacauacacaaacacacaccacacacacacacauacauacacacacacacauacaggcuaauaauaagucaaaaaguaagaauuaagaacauggggccggggcuggugagauggcucaguggguaagagcacccgacugcucuuccgaaggucuggaguucaaaucccagcaaccacaugguggcucacaaccaucuguaacgagaucugacuuacauauaauaaguaaauaaaucuuaaaaaaaaaaaaaaaaaaagaacauggggccggugagauggcucagcagguaagagcacugacugcucuuccagagguccugaguucaaaucucagaaaccacaugguggcuuacaaccacccauaaugagaucugaagauagcuacaguguacuuacauauaauaaauaaauaaaaucuaaaaaaaaaaaagaauuaagaacauccucaagauuuauuuuauguguaugaguguucugucugcaugcauccacauguaccacaugaggucagaugggguuggcuccggcuggaacuggaacaggguuaugagcugcccugucagugcugaaaacccaaaccaagacacacacacacacacacacacacacacacccgccaacagcuaagacaucucucaaaaccacuaaguagcaauuuuaaaugauaauaaaaacuaaaacuugguugcagggugguuaagcuucaagaggagccccacuuaagguuuccagugauagagggaggaauguaggacugcuaccauuuguacgggagcccuuuacccugcaugauacacucacgcacacacggauuauccuacucucugaggaaggauguuugccauuuaucaucagaaggaaacgggcacaggaagauaaggaacuuccucgaguucacacacugguaagugaaaccccaggaccucuggcucuaaaucaauacaccagucccggugacccagugucuaggaagcacucggaagcgugcuacggugagcacugaaguuggagguucuugagcuaggaggaggugugggugagucuucgcuuuaggauuguucauccggcacugccuuggagaccguugggauuugaauauggaugcuuucucuuggcucauguucuggacaugugguucacagcuuguggccaugugugugugugucuguguuguuguuguuguuguuguuauuguuuugccuguaugucugaccugagcccauggaggccagacauauacaaauaaaaauauuuuuaauagacucauccucuugggaucucaaauccauacuaacaauuccugguggcaaaaaguuaaggacacuuguuuaccggaaagcaggcagaagauugaaagcccauuuucuuuguuuugguuucuuauuuaacuuuuuauuauauuuauuuauguauuugcuuguuuauuauguaugaauauguggcuaccuuaugaaagaucagaggauaauucuuuuuuuuuuuuguuuuuuguuuuuuuugguuuuucgagacaggguuucucuguauagcccuggcuguccuggaacucacucuguagaccaggcuggccuugaacucagaaauccgccugccucugccucccgagugcugggauuaaaggcgugcgccaccacgcccggcucagaggauaauucugaggagucaguugucucuuugccugaacucaggcugucagacagcaaacaccuuuaccugcugagccauuucacugggccaaaggcuuaacuuuaauuuuucucuaauuguuccccauagacauaaaacucugcagaagaucugaaaauaaaaccaaucaguucagguguggccuaugccuacaguccuagcuauggagaagcugagacaggaggaucauuuagguccauaguucugugaggguuggggaguggggguggcggugggaguugggaaguagagcguggguagaaggguguguaguguguggagggggguuguaggaggggauaugggaugugagagucaggaggguauggaggguguucgugugggaguguugacugggaauaaaacucaguugacagcaugcuugccuggcaugcaugaagcucuggcuucaaucccuggagcacguggaacuaggcagggugcugcaaucugaacauuagucgggaagauccaagguucaaggugaucuaaggacacauagugagcuuaaagcuaaccugggucuauauaucaggccaggcauacacccuucuucucugccuugucucucauacccugaagcugcuguggaaaaaccagugagcacagacaccuggacacucucgggggcaaauuuucuggaaucuauauucugggaagucuccgccucgcucaaugaggucugccgcuuggccaccggccagauuacauuuucugggucacgaugaccucuucaaaggccacacagcuccugggauucucccaugcuggcaucuuacuccaacucugucugccucaacggaaccaaacgagccuccauucuggcaccagccugggcacucaucuauacagagaagaucauucuagccucccccaaaaccuaugcccuaaaggacgauggcauuguccccuuuauucaaggucuggcugcguuccaauucaguuaccucuccucugagcuaaguguggugauguguaccuauaauccuagaagcucaccggaugacaguaggagggaccagggguucaagaccaacaugaacuaccugagacccuguuaggaaacaaagcaagccguuggcugaaaaaucacaguugaaacuuccagaaauaacaacucauuuacucuacugaacuacaucccucuggggaaguucuuccagucaagucguucccaacuguaagaugccagguagcgccuucuacaaauacagauguuuucauuccuacugguacaggcagaccuuagagaccaccuuggauguuguaaauuauuacaugacauauuuuaaggugguuuuucauguacccaguauggucuaaaauaaaauaaaauaaaaaucccucuagaaccacauagccaugaauguuucaucucuugccuccaccugccccauguuuuuuaugaauauuuggagguuguuuuuuuuuuuuuuugagcauuuuugccugcauguaugccugugcaccacaugccuaaugcccuuagagguaauaagaggguauuuuuguuuuguuucaagacaguuuuucuguguagcuuuggcuggacuggaacucaccauguauacuaggcuggcuucaaacucagagaaauccaccugccucugccucccggaugcugggaauaaaugugugcaccacagccauguggcuagaagagagcauuucgaauccccuagaacuggaauuauugacaguugugaccugccaugugggauacugagacucgaaccugggccucugcaagagcaaguguucuuaaccacugaaucuucucuccaggcccaacccaguucuuuauuuuuguuucuuugaugcaggaucuuauucuacagguugggcugcccugaaagucacuaugcaacccaggcuagccucuaacucaugacaacccuccugccuuagcuucccaaacacugggauuacaggcaucacacucaucucagaaacuucuaauucugaaaaaccugccaccaagaguuuauuucaagauacaguuuaacugggcauggugacauggugacuauaccuuuaaccucagcacucgggaggccaaggcagaugaaucuuguugacuuugagaucauccgggucuacauaggacagcugggguuacauuguagacccuguaccaaaauagaagauagauagauagauagauagauagauagauagauagauagauagauaauagacagauaaccaagauacaccccaauucuggcuucugacauuucucucucucucucccucucucucucucucucucucucccucucucccucucucccucuccccucucucccucucuccuuccuucugcgaaacaggguccuaauauguaccucaggcuggccuacaaauuagguccuucuccuccuccaaacccucaagugcuggaucacaaaucaguacaccacacccagucuuacaacuguuucaaauagcgcaguucgauuaaaaugucuugguaaucuugcucucagaaaguuguuauuaaguagauuugugaucuugggcaggucacuuccugucccuggcucgguuucaucauucauucagacaaguauuuauugagggacuacuaauuuguagacaccugcuaggugcugaagacaacaaagaugggcaagauaccacagcuguaaaauuccuaggcccauuguucucugucaguguaaauaauucaagcugcugcugugugauuagggcucugaugagggggcuggacaagacacuggaggaacuagaggggaacacuuaagucuaauuaggggugaaggggucugcaaaauaagggguugcaucucuagaaggggucugcucuuauagguugagacguauuucaaaagcacacagagguugcuaggaugcucggcuucagggcaaccgcgugcaauaccagcucugcauaaaugcacagcaggaguuggccaacuauuuaugacccaaaaccuuccggccagauucaauguuaaagcauauuuauacauuugagcaauaugugcacuuguaggaucgaagaaacgaauacgucauuuggcaaaggacucaaaucuagaccuacauaaaaugaacccauccuaaugucuucucucaaacgagccaagugugguggcaaacacccugaaaucccagcacuugagagggagaagcgggaggauggggagaacaaggccagccucgguuagauauggaguugaaggccagacugaaccaucagagacucugccucaacaaaacagaccaaaaauagcagcaacaaaagcugucuuuaaaacaaagcuacaaagaaaguuuucucgccagaaacucuguauucacccugaguacuauugaauuaguaacuuacuagcugugacuuaugccuaagucaaacaccagcuauguacugugcaaaccagugcugaagagaauaaguuacacauuccuaaaagccacaauggagccucccacgccacucuggucuacagagcaaguuacaggaccaccaggacuacacagagaaacccccucagaaauaaaaaugaaaaaaaugagauuuuguuuuguauuaguguauggguguuuugucugugugccgugugcgugucuggugcccuuucaggccagaagaguguaucagauccccuggaacuggaguuuaaugguugugagcugccgugugggugcugggaacugaaccugggucuucuggaagagcauccacugagccaucuuuccaccuuuccuauauuuucuagacuuacuucaguaaauacuuuuauuguugcaaugcuuauuuauugacuggcuucuggauuacuuuucguagugccagagaucgaacucaggaccuugcacauuccagcaaaugcucuaccacugagcuacauccugguugucauauuuaaagauugagagacguuauuuuacacagaauaaaaugugccucuauuuacaaccaugccugauuuucaagauuuauuucuuuuuauguaucugaguguuuugccugccugcaugugugugugucuaccauaugugugccuggugcccuuggaggccagaagacaucagcucccuuggcacuaguuacagauaguugugagcugccguaugggugcugggaauugaacccaaguccuucgcagcugcagcuaguacucuuaauuacggagccaucucuccagccuccagucguguugucuauaaacaaaaaaaaaaaacuuuauuucuuccuuaaaacaauaaaauaaaacaagacaucucugcauuagcaaguaaaagccaauagggauuauaauaagauuuuuuuuuuuuucuguauaauaucuuuuuucucuguaccccagucacuuccaaauagguucugggggaggaagccugcuggaugagggaacacaagauuaaaaucacuuugguuccaaccccugagaacagcagaaaacaccucaagccacgugugucuccggagccaugaacagggucgguauacagcagaaggcagcaggauccugcauguugcucuguuuccagggucccuugguuuauccgcuccuuauuauuagagcacagggugacucaacaagggaucaguuccaaccuguucgguguugguccacccugggaacuuccugguuuacuugcuucuugcuucaccaccaaggugcagauuagaacagcucucaccacuggggacucgucagagguaucacacauccacugugacagucuacgaggcagagcuacccagcuccagggucaacagccagagucuuauucagaguaagcagguaugggaagacacuaggcaggcagaccacagcugcugcucuacaugaaacacuggguguggugggggcacgagacuguaaucccagcacuugggaagaggggccugguggaucgggaggaggagccugguggaucagggaggagccuaguggaucagguuugugaacgacgacgucagaugucgagcccccucaccuuugugcuugcugccuuuagcagcccauccaggacaaacugcuucuaccuccgugcuguaugauaucauuuccuguguggacgcugggggcagggcugggaaggccuaauuaauaaaugaucuccaaguccgguccagcuguagcaugcugucacugcccuugcaaugaaucaacugcaggaugcaagcuggcugcaccggagcggacagaauucguccucauucuacacaaaagccagacagagaaggucagagagagcagcguccccuugaaagcuacuuuuuaauugcguacagcuaaagaacaucaagauuuugaaaauuaaaugcaacccaaggaacaguuaaaaaaaaaaggggggggguucuuucuuuuuuuuuuuuuuuuuuuuuuuuuuuuuuuuuuuuugagacaggguuucucuguguaguccuggcuguccuagaacuugcucuguagaccaggcuggccuccaacucagagaucugccucugccucugucucccacgugccaaaaucaaaguugugugccaccucauccaacugcaaaaacuguuuuccacaguggaccuaaaugaagacuggggaguuaucuauuauggcucugcuaggaggugagaguugaaaaagggacaauagagaucugaauaaaaacugucacagagucacaaaaacuacaccaugagguucuaauaaauagcacaaaaauagacacaguggaguaaggagauggcucaguugguaagaacgcuugcucugcaagcaggagguccugcguucaaauccccagcacccacauaaaaagcugggcauagcuguguauguaucccugaaacaccagcacuggguuacagagacaaguggaucccaggaguugacuggcuagcuaguuuagcagaaaaggcaagcugccauguuauugagagucccuguuuccuuuuauuuucauuucguuuauuuucuuucuuccuuccuuucuuuuucccuugguuuuuucaagacagaguuuuucuguguagcucugaccguucuagaacucacucuguagaccaggcuggccucgaauucauagagauccaccuaccucuggcuccccaaugcugggauuaaagacauacacugccacugcccagggaaagucccuguuucuugagcuggguguggcacaggucuuuaaucacaacacuugggaugcagaagcagguggaucucugugaauuuguggccagccuggucuacagaguaaguuccggcacugccaaaacgacacaaagaagccuugccucuaacaacaacgacgacauacuguggcagaagacugcaguggcggcccugggaugaagcaguuucagggaugcccuccuagauguugcugcugcagaagaccauggcucacagggcggcagaggacugugccucucaggucucaggugcuacagacaccggcagggcuccuuagacuggacugcugguugccaccccuaggauugccgcugccgccgccgccgccgccgccgccgccgccgccgccgccaucugagaagcccuuggucaagcacaaagcaccugauucuggagacuugccaguguugguguugccugccugagaccacucuuagaaccacugcugcucgggaaagaugccagacggcuagggugcaaaccuggguuuagcuucgccucuguuacuagccggugcuaugacucuaucgagcaggaaugcauucagcugcagucaacagaaugcccaauuaacagcaacuuaagcaaacagcacacuguggcuguuuuucuuacuugcuaaaucccgagacaaggcagaccaaggcuggggccccucuuaggaagucggcaagaacauugcgaucugcuaaaguucggaucuugaauauccccccaaaggcccauagguuaaaaagcuugguccccaguguggcccuguugggaaauaaaaaaguuauucagacaagagccagcaaaucugggagaugccucaguggucugagcaacuauccugagcuuggugaguugaguccggucacuggaacucacaggggaaggagagaauugacuccugaaaguuguccacuaacuuccuuccauggcacaagcccaccugcacuauaacacgcacucaugcacauaggcaccugcgugcgcgcacgcacacacacacacacacacacacacacacacacacacacacuaacagcacguuaaaguaaaaggagguagggauugagccagacuuggugauguagcccugacauugcauugcagaggugaaggcacggggauaaguucaaagcuauucucagcuauguggcaaguuugagggacagccucugcuaugugagauccugucugcgccccccuccccaaacccaaacaauaaaggggaggggaugagcucauuguuuaguagauuguuugcccuggguuuaaucccuagcaccaaauaaaaacugugugugguacccaggguugagguaguggaagugggaggucagaaagucauuguuauccucaacuacacagcaaaauccaggccagccuggggauacaugagaccuaguuuuucaaaauaagagucagggacuggcaagaguucccaaacuuauggaggugcauccuuaaaggggacugugggaaccuggcccuccccucuuuguuccuuugccauaugguaaauggguuuguucuaccaccaugagauccugccucaugauauagguagauagauagauagauagauagauagauauacuuugcuuuguugaaaaaaaaaucuccuucucugagguccauacuacauacucugccacuuucuguuccagaacuuuccagugaucgacuucauauuuguuuguuuauuuuucaaggcaaucaacuugaaggggccugagugaaaugccagaaccuucuggcaacaaggguuccuggggaaguggggugugugccuuauguguacuggccagaacauuucagaguguaugcaaugaaggaggagaggugagauuccuguucucaguacaggcagccaugcggcagagcuuuacgugagugagugggugaaaggacucgcccuucagaccagaagauaaaacaagacaagauuaguacaaugaggagcggugagccugcagggacagaaggaccuccugccuaaugccuuacauccacacucaccagacuccucccuccacacaccuucagccuggugacucacucaugccuaggguagcucuccucagaauggccuuucgugaccuuuccaccuccugagccccucacuucucugcucacacuguugcagauucccacgacuggccccagugcugcucuguaacuuuaaacuuuuaaauguuauuuuacuuguguaucuaauauuuuuuagguucuuguuuauuuuauguguaugagcgucucacuguacguaugaguauauaccaccugcaugccuagugccuucggaggccggaagacagugggugucagauccucuggaauuaggguuacugaugaccgagagcuacccagaggucauaggacaacuuuugaagucagguucucuccuuccaagguagguuccagggaucgaacucaagcuaucagguuuacaacaaguguuggguuuuuuuuuuccuuuauuagauauuuucuuuauuuacauuuugaauuuuauccccuguccuaauuuucccuccccaaaccccccaucccauccccccuucccacuguuugcaaacacacccacuccugcuuccuuguccuggcauuccccuacauugggacccuucacaagaccaagggccucuccucucauugauaucccacaaagccauccuuugcugcauaugcggcuggagccaugggucccuccauguguacucuuuggcuggugguuuagucccugggagcucugggguacugggugauuauaccaaguguucuuaacuacugcaucaucucuccgguccuguguuuauuuauuuauuuauuuauuuauuuuuauuuaauuuuauuuuuugagacaggguuucucuguguagccuugacuguucugaaacucauucuauagaccagauuggccucgaacucagagauccaccugccucagccucccaagugcuaagauuauaaaggcauguacuacuaccaaauggcguauuucauuccuuccuuucuuuucucucuuucuuucuuuccuucuuuuguucauucuuucuuucuuucucuuguucuuucuuucuuuuuucuaguuuuuaauugugccugugugaggcgggugucugugcaugugugugcaaguguccuuggauaacugacaugucuggucucuuagaacugcacuuauaccuuagugguggcgcacgccuuuaaucccagcacuugggaggcagaggcaggcggauuucugaguucgaggccagccuggucuacagagugaguuccaggacagccagggcuauacagagaaacccugucucgaaauaccaaaaaaaaaaaaaaaaaaaaaaaaaaaaaaaaaaaaaaacugcaguuacaggcagcugugaaacaccugacauggaugcugggaaccagacucugguccaguacuuguucuuuugcuuagcugcccugggugaacaguaagagcucuugacccucuuaaccacugagccaucucaccacugcaccccuaccccagugcuuucaaccuuaaacuugaccgcuuauuccugugacugcauuuccggcaccucuguuuccucuuugucucacugcguagggcugcuuucucucuaccaagucaucuauggcuuuguggauuuuacauccaucucccuggagucuggaugacccgaucuaauuauuuuuuuacuccgucaucuucagcugaccccucugaugaaacccgggacucucccugccugccugcucucucaguccuccagcggagcaccgaaggagucagggcaagccuaggcggcaaacaguugccauggcaacucaauuuccaaccaggcgaucuuccucuacccccugggcugagaguacuggccugcccucgccagcccucuccuguuuccuaccuuugauucccuccccucuccuccgaauucagaacuucacuccuacuugacagugaaaauacaagcgugcugaagccccgucaacuuccuguccccccacuuccaucucuacugacuuauuuuuaacuacccucauccuuuccuccuuccgguaguuaaucucuccaccugagcccugaauccaguagcuccaccuccucaaagaccuuggagcgccaaaccccugucucuucaguaucuuuuuuuuguuuuuguuuguuuuucuuuuuuuuuuaaagauuuacucauuuauuuauuauauguacacuguagcuguccucagacacuccagaagagggagucagaucucguuacagaugguugugagccaccaugugguugcugggauuugaacuccugaccuucagaagagcagucgggugcucuuacccacugagccaucucaccagcccucuucaguaucuugauauggaaguuuccuccugcauucuaaaaagcugaguuucucacaaacaccacauuccagauccaucaggacacaaucuuccuucuugucugucuuuuagaauucuuauuuuuaaaauuauuguuauuauauuauuagcaguaauuuuauuuuuuauauauuuaguuuuuauuuauuagcauuauuuauaauuuuugauuuauaguuuuuugagacagggucucuuuauauaauucuggcuauccucgaacccauuauguagaacaggcuggccucgaacucacagucaccugccuccagagcacuuguacuaaagguaugcaccaccaugcccagcuucuuaacguuuucaaacuacagaugccuucugcugcauauucucugacugcauaaaauagcauguguggaaucaucaugaaagcuacuguauuguaaauauuguuacaauauuuguaaguuuuaugauaauugggaguuggggucucgagcacauguucuuguaugguugcagagaccagagaaggaugucgguguucugcuccauuacugucuauuuacucccuugagacaggucucucagcaaaccuggauugaggcuggcagccaagaaggcccaaagaccuugaucaacugcucagaacuggaguuacacaggcccucauguggccauguccagcuuaaacaaaaaagaauauauauauauauauauauguauuauauauauauauguauauauacauauguauauguauauauguauauauacauauauauauguauauauguauauauacauauauauacacauauguauguauauacauauguauauauacauauuuauguguguauguguguauauguauaauauauguguauauguguguguagauaaauagauagauauacaaauauauuauauacauauguauauaugaagcugaagagauguuugguccauaggagcaccacuuguuccuucagaggacccagguuccauucccagcaucucuauggcaacucacaacuguccaucacuucaguuccagggcaucugcuacccugaccuuugugaaguuggucuucuccugcuuuuauauggguuccuggggcuaaacccaggcugccaugcuugauagcacaagcuccuuuacccccugaaccaucuugcugguccuauuuucuuuuuucuuuuuuuuuuaguuuuucaagacaggguuucucuguauagcccuggcuguccuggaacucacuuuguagaccaggcuggccucgaacucagaaaucugccugccucugccucccgagugcugggauuaaaggcauacaccaccaugccuggcuccuauuuucuuuuucuuuuuuuaaugauuaauuuauucauuuauuuuauguguauugguguuuuucuuagaagucugugucagggugcuggauccccuggaacuggagauacagacaguuguaaacugccaugugggugcugggaacugauccccaguucucuagaagaacagcuagugcucuguacugcugagccaucucuucagcacccacccccauuuuuuuuuuaagauuuauuuauuauuacaucuaaauacacuguagcuguuuucagacacaccaaaagggggcaucagaucucauuacagaugguugugagccaccaugugguugcugggauuugaacucaggaccuucgggagagcagucagugcucuuaacugcugagccaucucuccaguccccaguuuuuucuuauaaagagcuucuuuggauuccuucacagggauuugcaaaaucuauuuaacuagauuuucauugaugaacacagaaacauguagguuaguguucacauguccuaggguagauuccucaaaguggaacuguugggucaggguuucaagcacuuuauagaagaccuucaggaguauagccacuuaugacaccacgacuacuguacaaaaauacugcacagaagacgcuccaucaacacuguuagcaucaguagcuguuuacagccagccugccucugaauccagcaagggcaucaucccuaggugacaaggaaccgccagugucuguugccauggcaaccgucggccgcacacccucugcgcaugcguuaccugcaccuccuguguuacuuugccauggcccagauagaagacacggacccccuacccauagcucucuucucucuuccgcccuucuuccccucuuucaauaaaggcuucccaaagugaaaacugugcaagcuuggcaugaucuguccagcaaugugccacuuuucaucuaacaaacacuagaugcuaaucagcccuucacaucuguccucaagcaauucaucaucuucaucaucuacaggcuuccuuuuucccauggguaucugugugguuuacaaagcauauaugcauguguacuccucugugugugcacacgaguguuugagguuuccugugcacaugcauacacguauagaggccuuaaguucacauugggugucaucuuccaucacuuucuacuuuauuuauugaaguggagucucucaccgaaccuggaguuuggccauccuggauagucuagcaagccagcccuggggaauccccagugucugugcccugagugcugggauuguaggcagccaugacaccuggccgacuuuuacaagcguuuggggauccaagcucugguccuccugcuugcaaguuaaguguuuaauccacuaagccaucuccccagcccuaaacuaaauuuuuauauuucugacaacuagugagacugaauauuguauaauuuauuaugaacaguuuauuauuauuauuauuauuauuacuacuacuacuacuacuacuacuacuauuauuagaguguuuguuuguaucucccuuuauuuuuuucauuugcccaauucccaaaccaaacuuccagaccugggccaggugccaccuccuccagaaagucaucccugguuauuaguucccaccuaaccacauuuaacccuuuccccugaagucaggcccagcacauuugcaagcuuauuuccucuacaagaccaggagcagauuaguucauggucaagacucuccagcuuaaaacagagccccugacagagugcagauacauaauaaaagauugcuuucggccuuauuuucucuuuccuuuuccuugaguaaacaacaugacagaaaaaguuucuuucauaaucaaaauaugaacuugccacaacucccuucacacagagagcuuugccucuucacaccccaccuuguuuccauuuuucaugcuuuaauuuucaaagauuuauuacauuugugugcaugugcauguguguguacgugugugugugagauuuguggaagucaaagaaaacuugaggaguuugauucuuucuauccaucauguggguccagaggauggaaccuggguucuuaggauugguggcaagugccuuuacccacccauguguuuuacuuuugaaagcugaauuuccugggguaacagauuuccugcuugaggacuggcagcagcuucauguagcuguuguaugggaugagcccacuguucuuccuuccaggcccugggaaauagcuucaugucccaacgucauccuuccaccucucuuugucuccucaagacagaagccugaguuacuaaugcaguaaagccaagccaggcagaauaaaggugcagccaaggaugguggcugguggaucugugaguuugagaccagccuagucuacagacucuauagagugaguuccaggccagucagggcuuacacagcaggagccugaucucaagaaacagagaaaaauaaggaaacguuggugugccugaacccauguuuccucaguguugggacauccccauuaaaagccccuauguuugacauacuuguuuacagauacaacagguauuuugaaaggcaggcugaggccucagacaaagguaucacuuccuggguaauuaucauaaccuggaucagaaacccuugagccaagaaacuccacaccagccauggacaaacagucuugagagccuggaugaaucugagaccaaccaucuaccuaugcuuucugcuugucaguagaauucaaaucugaaacccaaucuguauaaccagaaacaucugaguucagguguuuuguuuuuaguuaauccaauauucauuuucuucacucccugaacaagauggcccaucuguagcgacacccgagcaagcuguaucucugcugcaucucugauuacauccaccgacgauaagauccagcgaugauaagaggagugcauauuccuugaggguuugcuaugcaccaggcugacuaagugcucauucugcaucucacccaagcgcggcugacaauccguucucaacagacaaagaugggaggguccacccucagcucugccaacgugcagauuucucaguuucccacccaucuccacaugacuaggaggagaggcaccucugccgugucagaugaucuacacauucuaaccaugcuugccuauaaacacggauuggaaggcaagucuccccacuugugguagaguagaggaugcaauauggaaggcacuguuauuaauccaagaaggggugaaauucaacucucucacuccucacgcuuucauaaacugcuuacagcuuauuugaaaggcaguaaacugagccccacaggucucacacagugcggaggcgaguucacgcccauuuguccaggcuucuguguaggcuugcagaguggaaggccuggccucugaagaucaucccacccagcagucagaaaaccccugcuccacccucaaacuucaaacacugcagcuaggcccuccccggcgcuuccucuuggggucgauugcuaacuaaccuguaagagaaaggaguucuggcaaugugaugggaugcagacagccaaggccagggagggcuguggggugauuuaaagccuucuacagaagucagaagauucuaggcggagagccuggaaggcagccaaguucucuuuuuaaaaaagaaaggaaagaaaagaaaaacccuugucugaucaugacuugguagaggcacuuugccuaacaauuuucaaugucucccucccagagaaaggcagccagagaccaggacugccagacccaaagaaggccagaagccugcagcugguggcuaacagcccagccagauuguagggagcagcaagcaaucaagcaagcaagguuuggaauguuucagaggccagaggagggggcuccuaccccuuaauaauugguucagagacaauuagacauccauauggaaaaaauaaaauagaucccuaucucacggcaggccuccagauacauuccagaugaaccgaagacuacagggagcaaguugaacuaucccagcacagcuggaagaaagcauaggggacauguggggcugugggacaaacaacacaaggaacaacauggaggaaaagauggugcuaucuacaugaaggauaaacugugaagcuggagacagaguucaggggugaugccugcuuggcucuggggcugggagugggaaacaaaauucuuuuccuuucuuuuuuuaaguugucuuuuccuuucuuuuuaagaauuauuuacuuauuuuauguaugugaguaaacugucacugucuucagacacaccagaggagggcaucagauucuguugcagaugguugugagccgccauguguuugcugggaauugaauucaggaccucuggaagaacaaucagugcuuaaacagcugagccaucucuccagcccuuaaaucuuauuuucaagacaagguuucucuguguagcccagcuguccugggacuccuuguauagaccaggcuagccuggaacuuaaaggucuaccugccucugccuccugaaugcuggggugagaggggugugccaccuuuuuguuuguuuguuuuaacuauuacuguuaaaaaguauauacuguuaaacuauauacucuguguauagauuucuacaaauaaaguucagagggcaauuguguggagugguuucucaccuacauuuggguucugggaauugaacucuugucagcaaacuuuagaaacaaguacuuucccacaaaaccaucucagcagcccgucaaaaucuuuucuaacagccaggcgugguggcgcacgccuuuaaucccagcacuagggaggcggaggcagguggauuucugaguucgaggccagccuggucuacaaagugaguuccaggacagccaggacuacacagagaaacccugucucaaaaaacaaaacaacaacaaaaaaaaucuuuucuagcugacauacccugagacaagacuauauauauaugguauguauguauaugugugcauguguguauguguauuagauuuuuuuuaaagacaaugucuugauuuguagcccacacuucagccaaccacgugcugugauuacaagugugcaccaucauaccuggcugaagaauaucuuuaaacgucuaaaagagaccauccaaagagcaggcaauucagagaggaaaaaacaagacaaacaaacaaacaaaaaacccaagucauaacaaaaguagaauugucaggugguaguaauugucagguggucccagcaaccacaugguggcucacaaccauccuuaaugagaucugacgcccucuucuggugcaucugaagacagcuacaguguacuuacauauaauaaauaaaucuucaaaaaaaaaaaaaaaaaaaaccaacuacuaaaagcaugaccuccacaggugugucaugauacguuccugccuggugccuacacacacaugauauaugcauauacccaguaauaaugaugaaauaaaacuaguaugggcuggagagauggcucaguaguuaagaguacuuguugcucuugcugaggacuggaguugaauuccuagccccugucugauggcucacacccaucuguagcuccaguucuggggguucucacauccgcucugaccucugugcacaccaaacacgcacacaguacacacacacauaagguauauguacauggggacaacacacagaaaauguaauuaaauaaauagcgcaugguggccaggggcugugacugagauggagaacgcuggcugaacaccugcaaggccuuggguuccauccuuaagaacaaauguuuuaaaauuguuuaaagaaaaaugguaagcauauguauauauuauacuauaugaguguguacaggagagaaggaaagaaaagaaaaacuaaauuuaccugggcaugguggcacacaccuuuaaucccagcacucuggaggcagaggcaggcagauuucugaguucaaggccagccuggucuacaaaaugaguuccaggacagccagggcuacacagaguaacacugucucgaaaaaacaaaacaaaacaaaacaaccccaaacaacuaaauuuacauauauaaauauaacuaagucucaaaauucuaaugcacaaaggaaaaaauagguugcuuuuuucuguuauuauauucuaaugucauuuauauaagguuucaggggcuggagaauuagcucggcaguuuaggguacuuguugcucuuacaaaggaacccgccauccccagggaaucugaugcugucuucuggccuuugagugcguauuccuacgugaauacaaaccacucaaauacagaaaauaaucaaaaucaauaaauccucucccaggcuggaaaggucuuggucuaaccucaaagcugaggucagucacaaguucaaggcuagucugggcaguuuagugagagccugucucaaaauaaaaggugaaaaggaguugaagagauggcauggagauuaaggacccugaccaauccuggagggguuuggaggucacacgcacacaugcacacacacacacacacacacacacacacaccacaauuaaaacaaacauuuaaauuuuacauuuauuuuuaaagauuuagcuuucuuucuuucuucuuuuuucuuuuuucuuuuuuucugaguauugguguuugggcugcagcauuugugcuacagcagggaguauuagaaggcaucagaaccucuaggacuggaguuguuaguaaugaugcaguguuggauaacaauuuccucagauugaaacauucuauuuccucgagauugaaacauucuaccuuucuaggaagcuucugaaguaggaaaguuuaaaaagcucaaaagcgcuccaggaagucccugaaacugaccagaaucaauaggccccucccugccagaguaaacaauaaaagcugagagucccuuucagacaagguaaggcugagcugcaaagauucccagaugaaaucaguuuucuggaagaagaaaaaaaacuaaaaagcuguuuggaggagguuaagaccaacugagucauuuggaagggacacuguccaaccugucaagcugccuguugacugugcagugugcuccagguucccagcuuugugagcuguuaccauauggagugggcuuggguaaugcaccgugauucaucucugcuccuauaaguaagccccacccacaucccuguaaguaaccucaauaaaacucacugguucaccaacuuggacuuugguguugucuguacuaucuggagugaguaauguguauguuacaucuccucaggaaaauucuugucacauaauauaagugcugggaaccaaacccagugcucugaacugcugggccaucucugcaacccaaugauguuuguuuguuuguuuuuaaguaaauagagagcugugauuguagcuugaggaaggguacuagccucaugagagcaaaauccuagauucaguucccaacaccacaagaggaagagggaggagaggucgcuaagauaagaauggaucaagcacacgcauacacacaugcauauucuuuauuuuuuauuuaguuuuccauuuuauuacuauuacuauuuuacuuuuuuuuuuuuuuuuuuuuuugguuuucugagacagguuuucacuauauagcccuggcuguccuggaacuugcccuguagaccaggcuagccucaaacucagcgaucugccugccucugccucccaagugcuaggacuaaaggcaugugccaccacugccuggcuuauuauuuaacuuaaaaaggccaaaauguccugacuuggguacaaucuguagaaauccuaaagaaaagaaaugggcagaaacaaguggaaaaguauuagaugaauccuuuuaaguagguagagaaggcaaaucccuaacagaaaggacggucaaugucaagggcuggagaggggcagggccagagggggcggggugagacaucuaagaaggaauauggagcuuuagggaagacaaaaaaauucuggcuguaguggcauaagccugugauguuaggacuugagaaacaucagccggaggaccaagaaaucaagauuaugagcuacagaguggcacugaggucaaccuggaucacaugagggauccaggccucuccagcccccucaaaaaaaaaaaaucaaaacaaaaaggucucacacuuaacaaaagauuaaaauaguaaacuuagcauggcaguggugacguaggccuuuaauuccagcgcuugggagucagagacagguggacuucugugaguucaaggccagccuggucucagacccaauuccaggacagccagggcuacacaaagaaagccugucuccaaaaacaauuugguaccuuuaaaaaagauacaacuaucccuucucugccuuuugguuaaacucagguguaaagguauaacuuaauuaauuaauuaagauacaauguagccugagcugucuuagaauuuauguagauuagaaucacuugccucuggcucugagugcucaacugaaagguaugccucuaucuggauguacuuucuuucuuuuucaaauauauauguauauauauauauauauguguguuuguguguguuuguguguauuuucauuuuuaaaaaaagauuuauuuauucauuauaugucuuaaguacacuguagcugucuucagacacaccagaagagggugucagaucuuguuauggaugguugugagccaccaugugguugcugggauuugaacucaggaccuucagaagagcagucagugcucuuaaccacugagccaucucuccagccccuauauuuucauuuuuauugguuauuuuauugacauuucaaauguuauccccccucccaguuuccccuccacaaacucccuauccccuuuccucuucccccugccucuaugagggugcucccccacccaccuacccacuccugccucagcacucugucauuccccuacccuggaccauugagccuccacaggaccaaggggcuccccucccauugauguauaacaaggccauccucugcuacauauccagcuaugccaugggucccccaauguguucucuuugguuagugauuuaguccuugggagcuuugggggaggggguucuguuugguugauacuguuguucuuccuauggggcugcaaaucccuucagccuccuucaguccuugcccugauuucuccacugggguccccgaacuuaaaccagugucuggacguacuuucuaauuacauuuauuuauuuauuccuugcagguuugcauacuccaagaguacgcauauagagaggucaaaggauaauccaggaguucguucuugauuccuuauuuccaccaugaggacccugcaaucaaacuccgauguggucaggcuuggcaguaagggccuuuaugacaccugccagccugagaugacuuauuuuauuacccagggucucacuauguagcuccagcuggccugauauucacuaaacaggaugaccuagaacucacagagaucugccucccacugucucccaagugcuggggauuaaaggcacgagccaccacaccuggucccagcugacaaacuuuguauuuuucauaguguaagaauaugaaaauagcugaacgcuuuuaaucccagcacucgggaggcugagguaggcagaucuaugaguuugaggcagucuggucuauagagugaguuccaggacagacaaggcuacacagagaaaccugucuugaaaaaccaaaaagaaaaaaaaaaaaagaauauauguaaacacacauacauguacacccacauauaguagcacuucccuugcaugcucacuugaaaagaguuggcuuaaauguagccccucaauuuagcauauccggcagguguaggcaggugacucccacacuuggugcauccaccuggccacuucucccuucccucccccacaccccuggggauccucggcuggccaaauguuaccgugcgcaagcgcacauagugacaggaagcguggccucgcucugcgccugugcugaauuccagcugcaauugcuaagagagaaaaugaugcccaggaugggcucugccgcccgccggcugcggagaggcccacacugcacacgcgcagacccagcgcccgcgucaaaacaucagucgacagcgcguuccccauguccugcgccuccggcuggcaggaguuccucucagucgugacccccgccgccaggccggggcggacgagcuaggucugaucggcgaugccccgggagaucaucacccugcagcugggccagugcggcaaccagagugagcaagcgaccacggugccccgcuucuaucccucugguucaaucccucaggcugcacucaagugccugguacccaucaauccccuuuguccuucccaugauccaccuuuucuauugcgcaugaugauccaggcaagagcugccuccuuagcccugggcugugacaacuuccagacccaggugucuugggucaccuucuggaauguaauagccucugagccugggcuccucaggccuuaaagcuguagcagacuugggccucuuccuccucccccaguuggguucgaguucuggaaacagcugugugcugaacauggaaucagccccgagggcaucguagaggaguucgccaccgagggcacugaccgaaaggaugucuuuuucuaccaggugccccccgccccucccccccagugacuugaccaggaccauggggaccugaagggacuggcagcgcgaucuggugcugggaaacucucugaguggauggaugggaacagaguggcuaucuuaagggagggccugcaggagccagaguugggaggcuucaggacuugacccauccuggcuuaccucugacaggcagaugaugagcacuacaucccccgggcugugcugcuggaccuggagccccgggugauccauuccauccucaacuccuccuaugcuaagcucuacaacccggagaacaucuaccugucggagcauggcggaggagcuggcaacaacuggggcagaggauucucccaggugucacuccuagaguuccuugguaauccuagccuaggauaaggaaaggcucaagccagucuggggauccguccagguuagacuugcaagaaauaaagagacgggggcuggugagauggcucaguggguaggagcacccgacugcucuucugaagguccagaguucaaaucccagcaaccacaugguggcucacaaccaucccuaacaagaucugacucccucuucuggugugucugaagacagcuacaguguauuuacauauaauaauaaauaaaucuuuaaaaaaaaaaaaaaaaaaaaaaaaaaaagaaagaaauaaagagacaaauggguauguugagaggagggacugcuagggaagguuauguaaauuuuaugcaaaucguucacaaaguagcauuucuggguugagagagauucugguugggaagcucaguuucaggauggcaacggagacaauggguggagaucuuggugcugagaagaaagaaccuuuggucugacuuucccuuccccaugucuacauacagggugagaaaauucacgaggacaucuuugacauuauagaccgagaagcagauggaagugacagucuagaggugaggaucuucaacagugaagcaugcuggggggaaagaucaggcaugauucaaucacgugaaacauucaacuccgcauucauuuggggacaucauauagagcgcauuaaggugacuaagccacugccuugggaaaucagaaucucagugcuguccguuauuaagcuucucuugggucucugagucuuuccaaggagccucagagacaaggcugaagucucugagauaccuggccacuaucuuucucucucucucuauucagggauuugugcuaugucacuccauugcuggggggacagguucuggucugggcuccuaccucuuagagcgacugaacgacagguaagccuguguuuaaggagagaucauuagucuugacucuuugggcugguuuacauuguuguuuauuuugggagaggcauaccugucgaugcauacaaguggaagucagaggacagugugcuuggguugguucucuuucaccuugcggagcucaggaaccacugaggucauuaagagugguggcaggcaucuuuaccuuacccacugagucaccuuacuguagugagaauuuggguuucuuuuaaaacucaguuauauuccaugaauaguuuuguuuuaaucccaggugugagcuaagaggcugcuucacagcgggugguugugauuugccuccugcacuagcaggggcaugaucuuugccaucugcagauaguuugguucugaggaaucuggagagagaguaaaugccagaggccugagagggaggggcagggauccccgaggggaggcugcuacuccccuccccaagcccccaugguucugguugcuguuguugguugacaagaagcuggagauaacccugacaugacgauugaccuggccucaagaaacucaacaacccuaaucagcaggaaguagucuaaagagggcuaugcccccuuuucccucuagauuucuuucuccccaucuaguguuggggcauugggagggaucaggguggaauaaagauuggaagggaaguagagguaaaaaauaaauaaauaaauaaaauagccaauacauacauauauacauauauacauaugcacgcccaugccaacaccucaccagucaauaagaagacaguuuugaugaguuauuuacucaucaagcuguccugcuggcuugucuggaagggacugucuugauugcuaauugauacaggaagaccuggccuguuguaggcggcacuauucccuaggcaggaauuccugcacagcauaaaagagccagccagcaggcaaggauccacacguuuauccccucugcccuugacuguggacauccugcuuuaacuucccagaaagaaugcguuguaaccuggaacugaaagccaaauaagcccuuuccuccucagcuuuuggcugagguauuugucacaguaacaggaacuaaagcagaauucccagauaaucucuuuucaugcucucucuucuuugcccuuagguaccccaagaaauuggugcagacauacucaguguuucccaaccaggacgagaugagugauguagugguccagcccuacaacucccuccucacacuaaagaggcugacccagaaugcggacugcguggugagcaaaggaagacugagccaggacuuagcucaccuucugagacuuccccuggcccuucucuggcccuggcucacauaaaacacucagcaaagccaugacaugagggccaagaacuaagauccuaauuuccaaguugcuuccaggauuuuggggcaccaaaacuuucaagagaguaucccccuaucccauuauauaccccauuuugccuauucagugucaucuaugcuugaacucaaaggucacuuuaguagcaaaccuucccccauuauucaggcaaggccagaucccuuuggguauauuuuuaacuaaacuugucuuacuuuauuaguuuaaagugucuuagguggguguggugguuuaugccuauaauuccauuuuucaguaggcugagucagagggaucauuauucguucaaggauagccugggcuacauaauuaaguuccaagccagucugagcuauggacugagaucuagucucaagacuaaaaaugaaaugaagcaggauuuuuacuaaaucugcccuugcugaccucaaacuugugauccuccugccucagccuccuaauuggaaauauaagugugugugccaugucugcuguauuuaucgguaaaagagacuaaauccaagcuauaccuccagccuuguuuaaauaauugcuuuuucacugaacuacaggcccuaggguggcccaauggcuguagucuccagagccaaggcacauugggaacaugcacguauuuguuuacaguguugugucaugucauuacaaaaucucaugguacccuagagauagaauguuucuuuaaagguagcaaauccacuuccuaguuugggaguuuauagacauuaagcauuaucuuauuucaagguccccuuuugccucaaaagguguuauagagccccuguauccugucagguggugcuggacaacacagcccugaaccggaucgccacagaccgccuacacauccagaacccauccuucucccagaucaaccagcuggugagccccccuccuggagggcaagcccucucucugcgagagggucaucagaggagggacauuccaccuccaccaagccccauaacacaguaucuguucccagguguccaccaucaugucagccagcaccaccacccugcgcuacccuggauacaugaacaaugaccucaucggccucaucgccucgcucauucccaccccucggcuccacuuccucaugacuggcuacaccccccucaccacggaccagucaguaagagcucccucggugucccuuucccauacucuccaggagcugcucuucgaagcucuucuccacccuccuccccagauucuauacucagggacugacugccaccaacuugcaaccugccccucccccuccgcuuuguaccaccuuuggcuccugcaggagcagugcccacugggauaauaaaauagcucacugcucaagggcaugggauuggugagcugagagccgugauccugaucccacagcagagacucagcccagaccugaucuaaagacuguccccagagaccacgccaccugcaagcugauggggacagaguugacucucuuccucuguccaugcaucucuggguuccucccugacugaugaccaggucucugaaccccguucucucagguggccagugugaggaagacaacaguccuggaugucaugaggcgccugcuacagcccaagaaugugaugguguccacaggucgggaucgucagaccaaccacugcuacaucgccauccucaacaucauccagggagagguagaccccacccagguaagggaggccccuucacccuagccucaggcccacaggaugguugccagcagcaaccacccacucucugcccaccccagguccacaagagccugcagaggauccgggaaaggaaacuggccaacuucauucccuggggcccagccagcauccagguggcccugucaaggaagucucccuaccugcccucagcccaccgggucagcgggcucaugauggccaaccacaccaguaucuccucggugagcgcagccuccuguugucuuuuuguuacugggaaucaaucccagggcuucaggaaugguaggcagcucucccugcucugagccacaccccuagcuccuggucuuuggccauucugcuccacucccuacugucauuugcucccuccuccccgucugccccuagaggucuguguccuguguugggugccauucugaagcucucuuucccucuagcuuuuugaaaguuccugccagcaguaugacaaacuguggaagcggggggccuuccuggaacaguuucgcaaggaggacaucuucaaggacaacuuugaggagaugcacagaucgagggagguggugcaggaacucauugacgaguaccacgcggccacccggccggacuacaucuccugggguacccaggagcagugacucuacucucugcuguccccuggacaagaagcacaguccccaccacgcccagacccucugacccaacuucgccucacauuuuuguguucaugugcaauuuaggaacuguuccugucuuccuuuucaccccuggcgcuuggcuggcuugguuaaguucuaauaaauaaagcgugaugaugcauugag

SEQ ID NO: 6393 - RNA, 8696 nt, Mus musculus
cuuuguguaaauaacgauuuuuuuucuucuacaaauaaauuaagaaacaaacuagaaaacuguccacacccauugcugcccucggguguggguguacccugucccugcagggccaaaaaaaggguccaugguugccucaaaucucagagcaguccggucucaggcuggaggcaaaagaaaaguccugaccucuuggcaggcuuaguccugcagcugcuucaagcagccagacugucccuggggcucuuccagaacuuggugcuggcugggaggggagguguccggcaggucuuggcuuggaggaccagagcugcugccacugcggcagggccucucgggggagggguuggccaaguaggcauucaccagcuccaugaucucuuccaccuaacaagagggcagagggcagugugcaacagggcccacugggcucucuuuuucuguuuucuuucuaagcucuagaguuccgcuagguagguuccuguaugcuccaggccuggcaaccuucucuccccucacauucagacccguccccuccacgcgccccgcccccccaagugcuagccucagucuucccuaggcccuuucucuugugguuccgcccacaucuuaaggcucuuugugaacaucccuccccacuuagcuggugcuucaggacucuccaguggcuuccuguccaguuccucuuguuacuaucuuagucuaucauuugacucccccaaaucccuggaaagcuccuuaaguuugcuucugaccacagcuggaacccaaguauccacagcuguacauacgccagugucaagucucuucagcaaccccuguucucaccuggggacucugcaggaggagcuggcugucgcccacccucagugcuaaggugugagggccuauuagcuggcaggcggccacaugaccauagcugacacuguggauggguucugucucaccaggccuggagagcgacauggccuuugcucccagacccaggcagagcuucuguggagcaccuccaccaggcuccugcagagagaugggcggggucagggucgaaggcggggccgcugcaucuuuauuucugguaagggagaaggcugugauucgggaagggaagcuuucuugacccuugacugacagcacagguguggcguggccaaaagcaccuggaggugcaagcccaaaagccugagccccuagggguuugagaugggcagcuagcuguucuagaugugacuuaugaaaugauccccauugugggguauagggggaggccuguagcccugggauaaaggugggggcuuggaccaccagaguccccuucucccuucucccccucaccgugcucagcuccagaacgucauaccgagcagcgccgaaccccggacacugcgccgcuagagccagguaggcagccauggcuucagcuuggcccaugccccgcagccgcuuccagccgcccagcaccgcagccgucgugcuggcgccgccaccucccaccugggccgugcuucccguagagcggccgguuccgccgcgccgggcacgcucggcccgccucuuggccaggccggggcuccagagcgccccggccagcagggcagcggagggcgguggccuucggguagggcacggcgguuguucgcgcggcgggaugggggguggcagcaggcgguccaggagcggcagggguccccgcggggaaaagucccggugcaaacucugcaggcgcagcgccgccagggcgcgcagcguguccucgggugggggcggccggccgcgcagcagcagagcgugagccugcaaggggaggcaugcggcgucaguggagaagcuguaaagacaccucccgguacggaaucuggggagguuuggguuuggggaaaaucucccaugggguauccacaauaauuaaaugaagaugguuggaaauuaagaguuguucaagcuguggucgaccuggaggugugaaaaccagagaucccaccugcucaaagaggaaaggcaauucgugacccucuggagauagcccuucugggugcagagguccgugaagacgaagacacagucuccacccgcaguccggcgaguccuccaguccggcuuccuccgaagucaaacugcagaagggaaaaagaugcauugagaccgggaagcagggccuuugggacacaggcuagugggugggaggggcggggcaaagacagguuugggggcggggcccuggcaagcuuuuuaaauaagacuacacacaaccagcggguaaggacuugucagaggaucaaggagcuacuggcacgccuagauaaacgugcucagugauagacaaaagcuaaguggauuggcuaauacagcgcagggcuugggcuggacauuuacuucucaaaccuggugagcacgucggccacgaggguccccccagccagggcucgcuccugggcuccucgcugcucauacaaagcgaaugcguuccggcuccgggccaaaccuagccugcccaccaacucucgagccaccuagaaaaaagggagguggaggaaagucagauaacucgagacagaguucuggaaagagcugauccuacuggagagagucccuuaguuuuugucaccaccauuugcuggcuuuccaacgaaacaaauccgagacuagggguaaacaaugccagagucgggcaugagaagcuaaaaaggguguauacuguacuggagacccugaguucaaccaacaggaccguagguaaacaaacaaacaaagcuggaaggcgaguuucagaaguggaagcagugggaacuuucuuugaccuccucaccucucccgcuguagugugggagucgauagacacaggacaggcuccagcuccgggacagugcacaguacacaacagcuccugccuucugcucagugcggaaaucucugcuagugaaggcaccagcucucggccccguguacggcccagagccuuccggaugaagcgugcauauucugccaguucugagucugggagugccugcuccguccugaaauagagggaauccaaggaccaguguuucaagggcuucuuccuuuccuuuuuccuuccuuccuuccuuccucccucccucccucccucccucccucccucucucuuucuuucauuguauuuauuuuacacgaccaaggguggaaauacauaacucgauaucugcuuagcaugcucgugggucuaacuaaguacgguugcccagaaugaaaaaaaauuuaucacaucuggucaguuuccuccucacaauucauguuucuugacuacaaccuuaaugugucuggguauuuuacauggaccugaauuauuuucgaagucuccugccugcucuccuacaauagccaagccuacuuccuccaacuccaugaucuuggggugauuaaaaucugaaauccaaccacguugguaugcuuccuuaaauccugccuuuuuauauauuuuuuuuccaaagggaguaccuuguugugauucaccuggucacacgugggauaugaucuuguaauucccaugaagguacugaauauauuaucagcaccaggccagcucuugggcauuucucaugccuucuuuagaucuagguucuccguuucucaaacuauuacaucagucugccauuuucucccagcccuguagcuuuuuggcugaggccucugcucuuaccuuuccaaaugcccuaggaggugcccucggacagcuccccccggccggaaggugcagcucaugcaagugagaagcugccaguaucgcaggguugcaggaucuugaguggcagggagcccagggggaccugcaggaccugaggucugcuuagccagcugcaggaaaaguucguccuggagugcaggcaggucccggcaggucuggagcacacccugcaucaggggcccugggcgccgugcccccuccagcgccugcagugccaggaacagccucacugccuccucucguaagggugcguagccuggaccugcgggaggguggggguggagggaugguuuggagaggggauacagagcagcgcccugggaggaaggcacgauccagaggaaggucagagggaguuuaagggcacaagggauggcaugaaaaggaggguacgaguaaaaggaaaagcaaugguccacagacccaaacccucaaccuuugccucccgcaaaacccuucucucuacccugcuuagccuuuccgaguaaggaaaagagaaagucuaggggauauauauccaacccucccccauauucuuuaacugggugcccagagccaucacugugagccagaaaaagaaaaagaaaagaaaagcugcucuggaaacaaaaaaccaggguuccuggcauucuguaagccucuagcuuuaugacuugggccagucaguacucccuuugaggagagacguguccccagaugaggccagcacaauuccaacaaaagggugauuuuuccuacugccuguaaaggugaugugucccagucuuaaagaguauaaugagaaagauaggaagguguaaaugcuucugaaggaagcaaucggaaugugacacguagggguagaugcuggagggaggcagaguucuuagccuguucugguuuugccgaucuccaaucuagacugcuuccagguccacccauguacacucugagaagucaggagauggugagaacccuggaggcuguaaagcuucccccagcuauccaguuuuuauccccaagccuuaccccauggcaucgaggagaacugaccuaggguucacucacucaccuggagcgcugacuucauagggcaggggcaagagcggggcauacaaggcacuacuggugugccucaggauuggguuccgccgguagaugagggccacugcuucugggucuccacagcucuccuagaggucaagagggucacuugauagaggaaaggagcucucuaugagcccugaaagugucuaggaccacaacccugcugguucguauuggagaacucucuuaccuggaugucccugagcagcaguuggguaggggucuccagcggagcuuuggaggcaaucaccucccgcagugcuaccccccagcgcucugccucugccuggcgcggagagcagaggcggaugcuguguuuccggccagacacagugacugaccacagaccugguggaaagagaggccacagagggcaaucagggauugucggguccccuaccaguuagguagggagauucuuaagaugucucaccagucuccuugggccuacgcuccggcccagucacugagcacaagcuugugaggaccaggcuuccgagucgccuugcccccuucccgcugcugcugaacugguccagggaaucucuggugagcacaaaccaggcucugcgugggaguaaccauggccuugccccuccuccacgagguucccgguacagccaaccugaagguuggggguagauagggaagaagagauuaauaagagaagacauuauuucuaggagggcuguguuugagggccuacgaaauugggcccagguguucccaccuuucacaaugaugucaggguccucuuccggaagucccuugucugggaugaggcuccaggucucuucccagcccugcagucuggaccagagaugaaaaauugggcgaggcuuaagggccuccacucugccuccuuauuagggguuccccaaacuacaagggguacaugcucccaagcugggcacccauccuccaggcugugggaaccgcggagccguucugaccuugcaccagaaauaacuaggacccccccuuccuccccgcgcccccggcuggaccgcgcccccccgggaccccagccaaaccacagcguccggcagcacaaggccucucccuuauugcacaacuuugggagggaagaugcaaggaaggggguccugagaacuagcugcaguauccaaacuaagagacucagaguagaagcucaccugucugagaugggcccauuccuuguuggcugagucagaguaacguccagggaacccuagggagauaagcaagaauacacucagaggccuugaccccuagcaccaaugguuucaaaugagcccaggacaucacucauuagauugaggaaggaguguccgaaguccgaccgugaccgggcaggaagggccugagccacucugggauugucccuucuacauacaagucucuguggaccauuagaaaaugcccaggagcuacaagcucuagacuuauauccauuaaccccuugaaaaugcaaccgugggggugggggugggcugggagucaggaaaccuggguuccacugauagaggcuggaccacuuagcaccugccauaccuugcaaaaguccccucccaucucuggggcauaguuucuccauuuuucaaacuggagaugugaugaaguaccuucuacccauggaagccucuucaauuuuuuuccuuuacacccucccccgacuuccuugcucagaaccuccagggaagaagaagaugggcucucagggaaagagcaggacccaagacugggcaagggugguuuacaggguugacugaaggggaagagggacucuuuuauagaagauguucucuaagagcuuuguguguuacucugcaaaugucccggaggaaauggacacacuacccccuugccggggcucaggaggacaagaggcugcuaagcgcauacucuucagaccaagggugguuuggaauuuugcccuucucauacacaaaccccugcuuaggaacuucaauuguaaccuggggucugagguuggucaaaaucaacccggagccaagcuagcuagacaggaacugugccauggucccauugcgcccaggcugcuaaagccaggaggaggguugggggaggaggaccagggacaccugucccugagcuccuaggaggggguggagguggggcacgagggaggccauggccuaucugacagggauccuauccaugcgggaaacuuggggacucccaggucccacucuuucccugggagccuacccguuucuuuucuggagguucugaguggggcuauccaccccucuaccagagggcagguacugaucccaccccaccccaccccccacaacuccccuaaucucagucccuugcuucccuccuccuccccucuauauuuaucugcccucugccucgccaggugcuggcgccugcacuggcugcggugccgcccgccccacccaggaauggagccaccggacuugcuggggaccccugagcgggguuggggggaaaugggagcuggacccaggccacagcacacagaagccugguugccucugguggguaaggacgugagagaggucuccucgaaagauggaggucuuacacaccaacugugccugagugucucucucccaaaggagauuugauuaaaaaaaauuuucagccaccaagucacccucacccauucccucugguuucccaggaaccucaccagagaaggcagagaguucugucuuaaguggcggaauaaugagaaguccucaaagggccaucgucccgagccuuuucuuuguggggucccugaugcagaccccaauucuaggaugucuuuuugcccucgcccaggauacugcggugggagcucccgcaucuggccccagugcucuugaacugagagcagagcgaacccaggcguuccagccgcccagccggccucgccacauuccuuggcucuggcggaggcggaaggagacgggaugggacgcgggcccggcagggaagggagaggcagggccagguugggccacgcgugacgccuccucugccucagggcccccagcagguggacagcgccuugugugcagcgcgaagcccacaggcgcaucccuaguagggcuacuugccccuggagcucccggggcucuggcccucagacaagaaucucccccacauuugcaguuggccaagaggacugcguuuggcccaaguauggagcaggcucaggcgugacggccgguuguagugagaaagauugaacucgguucuaaaucccuguagacuuacccucccgccgcccgcuggacucgggguccuuagcucaaaggucucgucguccucgucuucguccccguccccgcuaagcucgccguccccguagucccggugcagaagagugaagccucgacggcagcagagaagccaccacaaucccccggggagaggcauccgggcgagcagccugggaaugggggcgcaggcaguguugccugagcagcagggaaucugagaaacuggagguacuccgacccgaacuggguagagaagaggugugacgagaggaaagaagggggccggaaggaggcaguguccagcgcugaggugcaaaaggacuaucaccagagcccgcugggggcucgcugucugggcccgggcagaggaggggggagauagcguccagggccgggggaagggagccgggagcaauguccggagcugggaaguaguguucguuguaguguccagcucuguaggagcagugucuggugcagcaaucguggugggcgguuguccaagcuccaaggagggugguguccgguagggcguccgguggccggggcccgggcggcgcgcgcugcgcucccugcagccccgggacuggcgcguugggggcgcgggcagaguucccagaccccgccucccucucugccccccc

SEQ ID NO: 6394 - RNA, 1099 nt, Mus musculus
gguaucugaggucugcacguuuaugauaacuuuccccggaaagcccggugcaauggaacgcgucuucgguuugacacuagcccgagggacgggaggcgggagucagcagucacagcccggaaccuuaaacuagggacccgggccgcgggcuucuccggcucacgucacuagggcgcgacgccuacucuuccagaagccccggcacaugaggucccacggugaagucgaguuccgggacaauaagacacaucacucuugaguccccaggagguuuggaucucagcaucccuguccuagguugaccaccacagggcacaaggcccggaagcuccgacagccccuccaggaaccuguagaacugaguaucagagcggcugcgcagggcacgugcucauccuccccggagugccggcgauuggcugugacgcaacuuccggcgugagcggcgaaagccgggagggcgagcgagagagcaagcagccagcaggcgggcgggcggguggccggccggcacggagggaggggacgagcaagcggugagcaagccagcgagggugcccgggucccgagggcaacggagauuccucaggccccuccggugcccuccccggagcccagagcaccuccggcacccagcggagcggacacggcccggccuggccauggccucguugcugaagguggaucaggaagugaagcucaagguagcggcauagcuccggcccccucaucccucccuucgaacccccagcagucggaucugcuccccacucccuaugucgucuuugucucccuggggacaccagcucugagcuuccgccuggcucaacccagccccccacgccuggagacggcauuggagaggaccguauaggguggcuuucuguccugcuucuggugauggagugcaccagggacuccuccgcggacacguguuaaacucaaugcuuuaggcuaaugacagguggaaguccccuggcccagccacguccccgcccccggacgcugccacugacccugcccuuggaggcuggcuuacugcguaggauggggccaggucugggugggaguuggcacguuugugagcucacuucuucca

SEQ ID NO: 6395 - RNA, 1099 nt, Mus musculus
uggaagaagugagcucacaaacgugccaacucccacccagaccuggccccauccuacgcaguaagccagccuccaagggcagggucaguggcagcguccgggggcggggacguggcugggccaggggacuuccaccugucauuagccuaaagcauugaguuuaacacguguccgcggaggagucccuggugcacuccaucaccagaagcaggacagaaagccacccuauacgguccucuccaaugccgucuccaggcguggggggcuggguugagccaggcggaagcucagagcugguguccccagggagacaaagacgacauagggaguggggagcagauccgacugcuggggguucgaagggagggaugagggggccggagcuaugccgcuaccuugagcuucacuuccugauccaccuucagcaacgaggccauggccaggccgggccguguccgcuccgcugggugccggaggugcucugggcuccggggagggcaccggaggggccugaggaaucuccguugcccucgggacccgggcacccucgcuggcuugcucaccgcuugcucguccccucccuccgugccggccggccacccgcccgcccgccugcuggcugcuugcucucucgcucgcccucccggcuuucgccgcucacgccggaaguugcgucacagccaaucgccggcacuccggggaggaugagcacgugcccugcgcagccgcucugauacucaguucuacagguuccuggaggggcugucggagcuuccgggccuugugcccugugguggucaaccuaggacagggaugcugagauccaaaccuccuggggacucaagagugaugugucuuauugucccggaacucgacuucaccgugggaccucaugugccggggcuucuggaagaguaggcgucgcgcccuagugacgugagccggagaagcccgcggcccgggucccuaguuuaagguuccgggcugugacugcugacucccgccucccgucccucgggcuagugucaaaccgaagacgcguuccauugcaccgggcuuuccggggaaaguuaucauaaacgugcagaccucagauacc

SEQ ID NO: 6396 - RNA, 6116 nt, Mus musculus
ugagcauucagacacccaucuucacagacacucuggcuagccugucgugugugaacuuacuaguugaaccuucauuccucuucacagugcaagaacuaaugggaggugguuccugcuguguguugacgcucaauugugugaaagcugccugucuucaccagauuccagguccuuccuggugauacccugagcugccagcagaggcugcugugguuaugugugggaccagcagcucgggcugacccugucgauccaguccuuuuccuccauaccagcuugccucuacauacauacauacauucauacauacauacuuacuucauacauacuuuuuugagggaacuccugguauugguuuauacugacccacagugcucauaagaggcuuacaucccucuaaaauaacauguccucacuucccuccugacagugagacucuucauugucuauagagguuuaaggucccaguaggggaggggcaucuacucuauucuaucccagaguuuagagccacuagcuaccugcucugccugccugccucccucccucccuccaggguuacuaagcacuugcuguguaaggcuacauuuuaaucaaaagcacuccacagaauacuuuuaugcuuuuuauauauuuauucgguuuuuuuguuuguuuuuuaaagacccuucucuguguagccuuggcuguccuaggaccgcucuaaagaccaggcuggccucaaacucaacagaucggcuugucuccugagugcugggauugaaggcauauaguaccucucccuggcuaugcuuuuuauuuuuuaaggcaggguaucaccuagguugaccuauaauucacucauguagcuuaguugaacucucagcacuccucuugaguguugguauuaucaguauaaaugaccaugccucaugcgccuucauagggaagaaauucaggauauguagccccuuuaaggcuacauaacuuggacuggaucauuguauagaccuaaacacagcucaaccucaaccagucgucucucugacuggauagaguaaggccugggucucccaagucaggcacucauuaggucccagguagagcugacugcucauugcugaguugggcggugggucugggaacugggaauguaauucugcuaagagguguuuuguuaguacuuguguguuagacagggaaaggaaggaguguguaucgaaacugccuucucagguaguucagcuccauuacccaccccaucccucucaccuguucuaaaugaugacacguaguaguuagugaccauuggcagucaaaguuuagggacaggagcaagcuauguaaugucuugagccagagcacaagacagaaaauuggaacagaacuacauaaagcacgaucagagauuuccuguccagcccacaggguggaguuuaguccauuccucuccaucauccugaauauaagccugccacaaugucagacaccgaugagcucucaggacggggggagcuucagugccagccaugaaucucaaggugcugcugcugcuucuggggcugucuuuccucacugucuuugcucuggucuauguccugcugaccaggcaaggcaguuucagccagucuccucgaugcccuuccauaccucccagaauucaucccuggacacacccuagccagagccagcuguuugcagaccugaccccagaggagcugacagcugugaugagcuuccugaccaagcaccuggggccggggcugguggaugcagcccaggcucgacccucggacaacugugucuucucaguagaguugcagcugccugccaaggcugcagcccuggcccaccuggacagaggggggcccccaccugugcgagaggcacuagccaucaucuucuuugguggacaacccaagcccaacgugagugagcuggugguggggccccugccucaccccuccuacaugcgggaugugacuguggagcgccacggcggcccccugcccuauuaucggcgccccaugcagaaaacugaguuuguucagauauggaggcauuugaaagaaguggagcuaccaaaggcacccaccuuucuggcuucugucuugaacuacaauggcuccaccuuggcaccuuugcauucuacugcuagugguuuccaugcaggcgaucgagcuaccuggauagcccucuaccauaacaucucaggucuuggaguguuccuucacccuguggggcuggagcuacuguuggaccacggggcccuggacccugccgacuggguaguccaacaggucuucuaccuugggcauuacuaugcagacuuggcccaguuggaaugggaguuuaaaguuggccgccuagaagugauucgggucccucuacccacaccagguggagcuuccuccuugaggccuagagucacuccagacccuccucuucccccucuucaguucucacuucaggguccccaguauaacauacagggaaacucagugacaucuccccucuggacauuuaccuuuggucaugggguguucaguggcuuaagaauuuuugauauucgguucaagggugagcguguggcuuaugaagucaguguccaggagugucugacaguuuauggugcugauucccccaaaacaaugacgauccgguacuuggacagcagcuaugggcuuggucucaacagccgagcuuugguucgggggguggauugccccuaucaagccacaaugguggacauccauguacuggugggcacggggucaguccagcugcuuccaggggcuguguguguauuugaggaggcccagggacugccccuucgaaggcaucauaauggcaucgggggucauuucuauggugguuuggccagcucaagccuuguggucaggucggugucaucagugggcaacuaugauuacaucugggacuuuaugcuacacccaaccggggcccuugaagcucguguccaugccacgggcuauaucaacacagccuucaugaguggaggagcugaaagucuccucuuugggaaccgugugggagaaagagugcugggagcggugcauacacacgcuuuccacuucaaacuggaccuugauguagcaggugaguucuuagccugagccuugaaggcugggaauggggcacagggcaggaaguccccaaaucaaggagugagcucagaaagguucagggggcauucuaaccccucuggguaugggaagggagaaaggauugagugcagcugcacucacaacugggugucuggccaaaggggaaagggguucugcuaauuccuacccgcugagccccucccccccagauuugcaguuguaaagcuaguuuaguuuaaguauaaugacugggccuggcugcuuuagccuugagagggacucuggggaauggacccugagggaacugaauggagcucccccccccgcccgccccccccuagaucuccauuuuacacuuggggaaacugaggaaggcaggggagaugggguaggaagucuuggcaugugcacauugcacacuauacuugugcuugcuugcuugguuucuuuuuuuuuuuuggugaggguagaggaggucaggaaaaauaagacuaacauaguggcaauagauucuagucugaccuguguacugugaaucuccaauuggaaaauucuuuucaacagcucuggucauuagagagccagcuaccaguuacuagguuuauagugugagcaucauggucacauuuaagggaaccaaaugucugaagccucaagaaugugaugaacuguguuggaugauguaggguuuggaugcagugggauuuaagaagcuccugggugauggaaagcuaugaaucauacuuuugaaagaggcugucacuaguguccccugugcugagggcuggaguccuagaacugggaggagccuacagggacugugggaggggcuugaguuuuccaggucaguucaagacaaaucucucauagucgguaguguuuccgucagcaugugugcucuuccguguauugagcagagccauaaaacaacauuaguuauauuugcuguagacauuuagagagugggaaucagaagcaaacuguucuaaggccuacuggguaggcugauguuaguagaaccuuuggcaagagcagaaacauuuuguauuuagccauauguggcugccaagcagcuagcuagcuagcuugcuuuauuauuuauuuauuuaaggcuguaacauuucguaucuagccuuauguggcuuccaagcgguuuguuuguuugcuuauuuguuuguuuauuuauuugaggcuggguuucacucuauauuaaacagacuuuggacucccucuuauuuauuuaccugucuauuuauuuacuuuaagacagagucuccuuguuuagcccugaucaccuuggagcucucuauguagaucaguuuggccuugacuuugcagucaucuccugccccugccucccaagggcuggauugcagguauguacaauuaucccuagcaauacugagcucuuuaagggcaacuacugugauuggagaaccacauuuuuaauacacauagccacacaugccugaugguuauccuauugaaauaugguagguugaaaaaaaccaggcuagcacuugcucaggcucacgucucugagcacagguguucccugcugccuuuggccagaccagugcuauaggcaacccagggauccugucucaacaaccucaccugauguagaacucucccuuuccuuaaccugacagguuugaaaaacugggugauagcugaagaugcggucuuuaagccuguagcagcccccuggaacccagagcuucagcuacagcgcccacagcugaccaggcagguccugagcagagaggaccuggcugcauuucccugggggagcccucuuccucgauaccuuuaccuggcuaccaaccagaccaaugccuggggucaccagcgaggguaccgaauccagauccacagcccuccuggugugcaugugccucuggagagcagcgaggagagggcucucagcugggggaggugaggagggcccagagaacggggguaagggaagaccuguccccuucagcacucacacauccuggaccugccuuccaauucaaaaggauaacuggaugggaaaugguaucaaucugauccaagggauucuaggcuuguaaagcgcuuugguuuuuuuucccccaacacugccuuucuacaauuccuggccagguaccagcuuguggugacccagaggaaggaggcagagccucacagcagcagcaucuauuaccagaacgacaugcggagcccagcuacgguuuuugcugacuucaucaacaaugaaacccucuuaggggagguugguggguuuagagauaauggggaaagccaucucuuccugaugucuuggcuguccggccucuguccaauacagguuaucccuacuaggcagaaauuagucacagcaguggcacccugcccagguuauuagauauucgguguaggaauguggcuggcagaugcagaagccaggcugaggcuggaggcugggaaauggcagcuaagaggugauucuuagccucccauucuucucuucuccuacaggaucugguggcuugggugacagccaguuuccugcacaucccccaugcugaggacauccccaacacagugacugugggaaacagagugggcuucuugcuccgacccuacaauuucuucaaugaagaucccucuaucuucuccccuggcagcguguacuuugagagggaccaggaugccgggcucugcagcaucaacccuguggccugcacccaacagcuggcagacuguguccccaacuuacccuccuuuuccuaugaaggcuuauaggccugaggcuauggugaggccccaggguaggagggauggaauguggaguggagaaauggcucagcgauuaagagcacuugacuguucuuccagagguccugaguucaauucccugcaaccacaugguggcucacaaccaucuguaaugggaucugaugcucucuucuggugugucugaagacagagacaguguacccauauacauaaaauaaaucuuuuaaaaaauuuuaaaaaaag

SEQ ID NO: 6397 - RNA, 17976 nt, Mus musculus
agaaguuagucuguggggcagacccggcuacuuuuuggcaguggauuuccauacacagacgagaucccucccccuucccccaaccccagcucucccccaaucccaacccugacccagagagcacucugauuuggaaacuggaggacaaagccauguaaggucuguggauaucacugcagccagcucagacccgccucccaacccuagcuccggcuucccugcuccuucccacccuggcaaaagcagacuacaaagaagcucugcuauugccuagcgccugggagaccccagccaaaaggaguccauuucugguagaagccuguccaucaagaagcaaugacccagaagaccacccuagugcuccuggcucuggcugucaucaccaucuuugcuuugguuugugucuugcuagcuggcaggagcggagauggggguggacugagccaaccucuucauugccccucuguucuuccuaguguccagccccggacacacccuagccagagccagccguuugcagaccugagcccagaggagcugacagcugugaugagcuuccugaccaagcaccuggggccagggcugguggaugcagcccaggcucgacccucggacaacugugucuucucaguagaguugcagcugccugccaaggcugcagcccuggcccacuuggacagaggggggcccccaccugugagagaggcauuggccaucaucuucuuugguggacaacccaagcccaacgugagugagcuggugguggggccccugccucaccccuccuacaugcgggaugugacuguggagcgccacggcggcccccugcccuauuaccggcguccuguguuggacagagaguaucaggauaucgaggagaugaucuuccacagagagcugccccaagcuucuggacuccuccaucacuguugcuucuacaaacaccagggacagaaccugcuaacaaugacuacagccccccgugguuugcaaucaggggaccgggccaccugguuuggcuuguauuacaaucucucaggggcuggguuuuacccucaccccauuggcuuggagcuucugauagaucauaaggcccuggauccugcccuguggaccauccagaagguauucuaucaaggccguuacuaugagagucucacucagcuggaggaccaguuugaggcuggccuggugaaugugguauuggucccaaacaaugguacagguggguccuggucucuaaaguccucagugccaccgggcccagcucccccucugcaguuccauccccagggaccccgguucaguguccaggggagccaagugucuucuuccuugugggcuuuuucuuuuggccuuggagcuuucaguggcccaaggaucuuugauauccgcuuucaaggggagaggguggccuaugaaaucaguguccaggaggccauagcccucuacgguggaaauuccccagcaucaaugucgaccugcuacguggacgguagcuuuggcauuggcaaauacucuaccccccugauccgagggguagacuguccuuaccucgccaccuauguggacuggcacuuccuucuggaaucucaggcccccaagacacuacgugaugcauuuuguguguuugaacagaaccagggccucccacuccggcggcaccacucagauuucuacucccauuauuuuggggguguuguggggacggugcuuguggucagauccgugucuaccuugcucaauuacgacuacauaugggacauggucuuccaccccaauggggccauagaagucaaauuccacgccacaggcuauaucagcucagcuuucuucuucggugcuggugagaaguuugggaaccgaguuggggcgcacacgcugggcacgguacacacccacagcgcucacuucaaaguggaucuggauguggcaggugagacaucauuguagguugcucaccaaacaaagauugggguagggggcuaugcuuuccuucagucuggcugggaaaggaggggcugcugaguuucauuuggaucuuagcuuccugcaaagcugccagacucuauacaugugaccuccuuacaacaucuugggaaauggcuaaccccggggagaaggcuaggucccugggguuuauguaggccuccguucaagcaagcaguugcuugcuuuccaacucagcucugucuggccugugguacagcacuggaagacauuuuggcucugcagagucccugugcaugcaagucagucuuggaagaaguauuguucuccauuuccuugggagagaaucucucuucuucccugaucucuuucugggcaccguucacuucagggcaggguaccuggauaugguggagagcagagaguuacagauggcugcugggguuugugauuacagagacagccaaggcucugagauuuccugaagaucauuucucucuuuuuucuucccuacauugagccaucaccuaguugggguuuuguuuguuuguuuucuauucugacuaugaaaucucucaaaacucucaguaggucacaguguuacccucugucccuguuaggccacuuuuuuuuuuuucuuuuuuuuuuucuuuuuuuuuuuuuuaaggauuuucgagacaggguuucucuguguagcccuggcuguccuggaauuuacucugcagaucaggcuggccucaaacucacagagaucuauaugcccucuucugccuccaacgucaaagggauuaaagaugugcgccaccacugccuagccauagaccaucccagaugcucucaguuccaggguccacuguguacagagagcugucccacacaugcuagcaugcuguuuucacguuccacagcugcugacuucccaacaccugcaggaugucaucuccagaaggucuuuccuucugccagcucuagccuacccugagagcuuuucuagugcacugcgguggcacugugguagcacugugguagcaguaucaacaugcucccagguccuggacacacagcccauggcaucucuuuuuuaacaugggcuucacuccuaacuagaauggccuuccaggacuugucuucauaauauccuuuaaggguagacagaaauggugucuuaggaguuggggagguccuguccuguggggcaggaacagggucccacguccgcuccgggcuaggguuacugggcaaggcaggacucagaaaguuuugacugugcacaccccuggaaccgccagguggacguugggcugugagaagcugcaggaccccgcuccgggguugggaaaagaugcaaucugggggugccuguggaacugcuggaguugggcuccaacucuugggcaccaugggcaccacuggguuccauggaagagccaguuuugggaucccugggcugcucggaggccagggaugucagguucucccucucgaacgccacuguaugucauggaagagcugagaacagagugggggccuucgggcagucucuggccugggggcugaagggaaaggggcagggaguagagagcucaggcggguuacuucggagaugagagugcuaggcuccuuggggcagccggcuuaguggugagcagcuuggcuggcuggcuggcugguggcgguggugcagggaggccucccgcugggagguuagacaugcaacucauuaggggaagaccuguuccauugcuccagcauggcggaucccaaugagcagagaugguccaugguuuuaaggcauuuauuguagaaaggcagagagagggagagauuagggaaguagaggccagccauagccacguggagagagggaggaagggaaggcggagaaaggugguagaagggaacaagaguaagaggaagaaaauaagaaggguggggggaagagcaaguagcuccuuuuauaguaggcugggguauccuggcuguugcccgguaacuguggggguugaguccagacagauuaccaggagcuuggggcauugccuaugugacugauggccacacacaucucugcagggggcugugggaggcguagcugcagcugcgacaggagccuggggcccaggagguguggccgaacagcugucuucccuuaaggucaccagggucaccaggguuccgggccugugcucaaaugaaaaccaggcuaucugagcacagcucacagccccacacuaucccugccugugcuauauuccuggaaugcugucccugucucaccgaggccucuucaccaugcaggccuaggcugugucuucucugaccccugugccuaugagagccugaggggagggagggaauuuauucagcucuguucucagggacaaagacagguuacuccaagaaagaaagauggauggagccaggcaugguggcauacgccuuuaaucccagcacucaggaggcagaagcaggcggauuucugaguucgagaccagccuggucuacaaagugaguucccagacagccccagggcuauacagagaaaccccugucucaaaaaaaaaaaaaaaaaaaaaaaaaaaaaguaauaaaaauaaugauugaauuacaucucagagccuuuuccuuuaaaaaaaaauuuuauuuuuggccagacagugaugacacacaccuuugauuccagcacucaggaggcagaggcaggcagaucucugaguuugaggccagccugcuuuacagugugaauugcaggacugccagggcuacacaaacaaacccugucucaaaacaaaaacagaaggauuuauuuuucacuuuuacuugcgugucuguauguaugugcgcaucaguugugcaggccacugggaacagagguguuggacccuccuggagcuggaguucacaagcuagagccugugaguggcccagcguggguucuggggcaugaucccagcccgguggaagaacaguagguacucuuuuuguuugguuguuugguuguuugguuacaauuuauagguuaauaguuuugccuaaaggauuggggagaucuucggacugggagggaagcaaagaacacagucuuuggucucacucugcagucagguagauggcagaaauucccacagugguggaaugacuagagcuuacacacuuuacacagggcugaagaacugggccugggcagaggauauggcuuuuguccccacgauuguaccuuggcaaccggaguaccagaugcagaggcugcaggugacucggaagcugcuggagacagaggaggaggcugccuucccacuggggggcgccaccccacgcuaccuguaccuggccaguaaccacagcaacaaguggggucauaggcggggcuaccgcauccagauacucagcuuugcuggaaagcccuugccccaggaaagucccauagagaaagccuucaccugggggaggugaguggugagugaucagagggcguggggaagugagcagcacauggucugagcaggagcgagggagggauacuuagaaacaguucaauugucucuguggaugcugggguugggguaaggaugucauuuccccuuggagaacuaaagccaggaaagaacucuuucccguucagggcugugggguguggguuguaccaugaaauggcgggggugugacauggcccuccaggauggugaugggaauucuacuacucugugaggagcuaugaaagcuggggucagagcauuuagccugcuuccaucaugcagcuuagagacaauggagaccuaaccagugcucuucuagguaucacuuggcugugacccagaggaaggaggaggagccuagcagcucuagcaucuucaaccagaacgacccguggacccccacugugaacuucaccgacuucaucagcaaugagaccauugcuggagaggugagcugauggugggaugggcagaaauggaccgccaugaugagcuucgcuuucucacggguggguccccgaaagccaucggaacuccacagaggcggagcugacuccuugccuuuuauacuuuaucagaugugaccauuuccuuuagcgcagugguucucagccuucuuaaaacuucgauccuuuaauacagcuccucauguugggcugacccaccccccccaaccauaaaauuauuugguuguuacuucauaaccguaauuuugcuacuguuaugaauuauaauguaaauaucugauagccaagauaucuaacaugccauccuguggagucaagacccuugggcugggaaccaguguucuagacucuucucgaguagagaagucaugugcaaacaacugcauccuucagaccuauagcccucaaagugccagcuuuggaaauugaauccuuuucaggccugaggauucauacagggcuggaaguuauuagagaaaaccacagaccacaguucccaucucugccuugauggguguauuauccuucuaagucuuggccaucccuguuccacaauucucuguguuauacuuuaaggacucuuagagaaugagggaaggaaagccgaaguggccuguagugagcgcccucuugggugggugggugaaagguguuguaaugggaagcacgagagauggagaugcaagccagccucccucggggagacagugguuguuuccaauaugcaaugagcuuuuaauguuuauccuucugggacauccaaaagagacacuguuuaaaaagauucaagaucuauggucuugugaauagcuucuucccugggaggcggcuguguagagagggugugucuggccaaccucaccauccucauuuccucucuccugcuaggacuugguagccugggugacggcuggcuuuuugcacaucccucaugcagaagauauccccaacacggugacugcggggaacucagugggcuucuuccuccggccguauaacuucuuugacgaggaccccuccuuucauucugcugacuccaucuauuuccgggagggccaggaugccacggccugugagguuaaccccuuggcuugccugucccagacugccaccugugcccccgaaauuccugccuucucccaugggggcuuugcuuacagagacaauugaacuguuucuaaguaucccucccucgcuccugcucagaccaugugcucacuuccccacgccauuaaguguccccaagauggacaaucuagcuaagagcugggaaguagcgcaacagccgggcaguacacagagcaauucgauugaagaucugguuccuucuguccccacaucuuugauguccccucucucuucugcugcccuccuugucucucccucucugcuuggagcauccugagcccauggaaaccugaugcacagggacacugaacuuuguugguugugccuguacugaguuccugccuugggagaauagccuuguuggagccuggaguaauggcuauguuuuguuuugcuuugaauauggcuccuuuuccccacccccaccgcacccccuauuuggcuuucauuuaaaagcuuaugauagcuuugaggacucugcaaugaggauaacucucuagagacccccaaaguagggucucucugagucucucacauccacagauucuucaucuacaucccuuuccuacuuaagccucuuucauuuccauucucucccucucccuccccgcccccucuccuuuccucccuccccccucccuccccucuuccuggaguuccugcuugcucauacaugcuaggauuccuacucaguccaaaagcgauguccguccuaagaguucucugagcccucauucucaaacugcagucucuucuccuggacccgagucuguggaaaucucaaagauguaaugcaaagccucaugggagaggaccaggcuuuucuaucuccuaacguucgucacauaucaggaaggaguagggcuugucccugcgguagcccugcuuugcccucuuuacaagaagauggaggugcuaugauuaugacgaaugguuauuuuauucuauggcucugcuccacuaauggcucuggucucugugcaguagccugcaggagccagcucgggacagugagauaggauggggucugcccaaucagaagcaggcaugcaaaugagccugagucugaucugccuuggugggaccuguuucaggguuucucuuugcugcuugucuuugcugagaccuggacaggggcugguacacacaugacucaaaacaacagauacaucauucccuagcagucuggccagccccguuguuaacuaauguuauuacuguaguuaauggaagaaaggcuggaaagaugugugugcacuguucuugcaaggggcccaaauuccguucccagcauccuuauuaaggugcucacaacaaucuauaacucuaucuccaggagagccggugcccucuucaggggcaccuaaacuuaaugcacauaccuucacacagacacauacauauaaauacaaaauaaaagaacucagccuggcacggugacacaugacuuuaaucccagcauuggaagucagagguagacagaucucugagcaugaguccagccuggucuacagagugaguuccaggacagccauagcuauacagagaaacccugucuugcaaaacaaaaacaaacaaaccaaaagagaguucuuuaaagacaaaagaaaagcuaaaaaugaguaggcgauaaguguacauuuguuuauuucugcugcauuccuugagaacugaguaagaccaguuaccucugaggaggaagacagcugagagggaaucagguucugccugcccuucugaacaucauggauuggaaccaugugaucauauugccccgucaaaauaaauaagugggcuauacacuaacugucuugucuuuccuuuuaaacaugcuguguguggcuugccuguguucuugagaccuagaaaaguagguagccugccauacaguccuugucuuuccuuucuuguauaaauucggaagcaauagcuuccuccauccccauucuuucucucgaaggagggaauaaugagaagcaauggaaaugggggcuucugauuggccagaugcccaggcuaaaccaagaggugaaguggcagaaacaguguugggugcugcucaguuucugaccagagaggcgacaacauucaagagaucagacaccuggaacauuucccugacuucucucuguccaaucuaauguucuccuagagguugauguggaaccaugguuggggggcggggggggguagucagugagcggaaagaaagcagacuccaaagaucaagggggaacucuucaguaaggagcagggcuaacaguggcuggcuucauuuauaacauggucugggguggguagagaaggauaaaggacaagcagaugcugcagugaggugggagccaaagggcaugugcgcucaguugugaguucugacuucacuacaccacauccuuccaaccuaaagaauucaagucuccuuuauaugcccaucuuuuuguucccaccaggacuggcuaguuuuaugucaacccuacauaagcuagaaucguuggagccucgauuaagaaaaugucuccauaagacuaggcuguaggcaagccuuuaggacauuuucuuaauuugugacuuauaggggagagcccacugagggugguaccauuacugggcugggucuguaagaaaggcugagcaagccgugggaagcaagccagcaagcagcaccccuccauggccucugcaucagcuccugccuccagguccugcucuguuugcguuccuguccugacuuccuucuaugaggggcugugcugugaaccugugagccaaaaaaaaaaaaaaaaucauucccucuccagguuguuuuuuuuuuuuuuuuuuuuuuuuuuuaaagauuuauuuauuuauuuauuauauguaaguacacuguagcugucuucagacacuccagaagagggcgucagaucucguuacggaugguugugagccaccaugugguugcugggauuugaacuucggaccuucggaagagcagucgggggcucuuacccacugagccaucucaccagcccuuguuuuugguuuugacccugauguuucaucacagcaauguuaucccuaauaaagacaccguucuuuuuuggccccuucucaaagcugguggcagcaucugggcuggugagaaaggaaacagaggaacacuacuugccaucaccaaguucacuugaaacucauucccaugaugcccagcucuagacuaugugguaguauggauauguauguaugagcaaacacacaguucgaaaaugugaucugugugucuaugucucacuaccuuccugagcucacugauagugguggggguggugggagcagacaucuaggucauuggaaccucagcccaacucaagccaggaggguugcaaugagacuccaguuucgccgggcuugguggcacacgccuuugaucccagcacucaggaggcagaggcagguggacuucugaguuggaggucagccuggucuacaaagugaguuccaggacagccagggcuacacagagaaacccugucucaaaaaaacaaaaaacaaacaaacaaaaaagacuccaguuuccugccguaucuggucucuucuguagaccacugccauugucuauaguguuggccuuagauucaucagauagcaaggagugaagagcaagaggaguuugacauccugguggauugaaugaaccaagcaacguucagagcuuuaggauggaggccugugguccugggaggaagcugggcaaggggauccccgagacugaacagggagaauggcuaggccuucucuggugucuuagucaggguuucuauuccugcacaaacaucaugaccaagaagcaaguugaggagaaaaggguuuauucagcuuacacuuccacauugcuguuuaucaccaaaggagaucaggacuggaacucaagcaggucaggaagcaggagcugaugcagaggccauggagggauacuacuuacugacuugcuuccucuggcuugcccagcuugcuuucuuuuagaaccaagauuacuaucccagggauggcacuacccacagugggcugggcccucccacccuugauaacuaauugagaaaaugccuuacagcuggaucucauggaggaauuuucucaagggaggcuccuuucucugugacaacuccagcuuggggcaaguugacccacaaagccagccagcacaucugggaaugaagacucagacacccacugcggggcauacaagagaagccagauaccucucccccaaguucaguuccagacuccagcuccacacaccuaaagggauuuuuuucuugcaguaaagaguuucacagaagucaagcauagugguuuauaccuauaaucucagcacugaagagucuaugguuaaaggaucaugaauuuaagacuagacagagcuacuguuaugguuugaauauauaaugcaaccccauggauuaaugauuugaauauuuggucucuaaaauggugguguuguuuugggaggcucuauaaacuuagaauaugaugccaaacuggaggaaggaggucacugggugagcccuuggaaacuauaaucucuggcugcuuccagucuugcucccucugcuuucugguccacugugauucacagugcuaugcuucaccacacuguccucaccacgagagacagaaccuucugaagccaggaacuaaaauaagucuuuccuccuuacaucgauuuuguaagaucuuuucuaucaugccccccccccagucucuugcacauaugaacgcucuugcccacgcacacacacaagugcaacaauugcaaaccuaucuuaguuaggguuucuauugcuguauaaaguaccaugaccaaaagcaacuaggggaagaaaaggguuguuuuagcuuauuguucuuagcuuaucauccagagaagucaaggaacucaagauaggaacauggaggcaagaacugaugcaaagcaaagcccgugacagacacgugccuacuggcuugccuuccccccgcccccccccuugccauuagaagacacagacauuuacacuacgauucauaccaguaccaaaacugacaacuaucaauuagugaugaaaauaacuuuccuguuggggguccccagaacaugaggaacuguauaaaaggggugcagcccuaggaaaaaggcugaggaccacgguccuagaggaugggauaucuacauugaucucacagagaacuaaagguugccuggggcggaggggugagagugugaagacacucgaggacagacagcaauguguucaguugcugaucaaaggcugacccuccccaccaaucaauccccuuucugggaagcugacuucccaguaaauggucagaucgcucguguacacuuacacaacgcucagggugaguuggaaaaaaacauaauaaacccuggaacguguagaggagccccuccccaaccaguuuuuuuauuuuuauuuuugacaggcucucacuauguaacacugaauggccuacaauuuaccacaucaaacagacuggccuugaccuuacagagaucuaccugccucugccucccgaggacugggauuaaagguggaagccauuacgcccauugguuucuuuucauuaauucacaccacccccaucuguggaggcaaaaccuccacuucagcaacucaggaauauucugcugucuucucgcuguguuuguuuacucauuuagguuuuugagaaaaggucucaauauguagcucaggguggccuggcuugcuacacagcccuggcuagccucgaaugugugguucucuuuucuuagcccccugagccaguuggaaaucuguucuucaaucuccagauacugacaggcucuucccuggggaccugcaucuugugaagccucgccuggccaugcagcuccagugggccggaguagcucugucuucaccugcacacaccccuuccuccaaaggguccuacacugcaugggucuaguugcuguucucaggaaaucacccuucaaccccacuguccuuccaguggugaucacgggccauggguccuacuuuggcaaaugucagcaugacaucuucaaugggaaauuggggagugcuuccugcugcuuccggagccccuuccugccucccagucccacagucccuccuccucuaccuuuguucuuucuaagaagaauuuccagggauuucuagacgcucuucccaggucuguucucuuggccuuccauuuuuuccagauauuguccuguguacuucaaacuguggauaugagguguuggcuuucuuagguaucuuuguaucaaaacuacccuguuucacaacagcacguugccuuaacuuccuuacacgugcucauacacacacauacacacacacaugaacacacauacagccaccuacaugcacacuaggcauguacuuguaugagcacacaaauacaagcacauacacacgcacacacacacacacagaaauaugcagacacauacaagcagaaacaugugugcauauguaucuaugaauacaugcauguauaagcacacauauguauaaauagacacaaagaacacacacagaugcaaagauaaauaugggaccaagcauacacacaugcauguacacacaaaaaaugcaauacgcacugugaacaaauggccagaaauauaaauguauaugguauauacacagacauacuuaugcauacaaaauacacguguacacacacaaacaaacauaaucacacaaaaacaugcacauacaugcucacagauguacacacauauuuuuacucacacaugaacgcacagauauacaugcaaauuaaacacgagugcaugcacucacauaaacacauaaacacauacacaaauacacuuacauguacacaugcauaaccucaaacacuaacauacacaaacauacauguaugaacacacauagauacagagucauaacacacaaacacacacacacauguucacacacauaaccacagauauacaagcauguacaugcacacaaauacaugccugaacaaacauguacaaucacacacacacacacauuuucuuucuaaaucuuuuuugcuuuucuuuccuucuuuguuucuuuuuuuccucucucucucucucucucucucucucucucucucucucucuuaaaaaaaaaaaaaggguuucucuauguagcccuggcugccuuagaacuuccuaggcuggucucaaacacacagggauucugccucugccucccaagugcugggauuaaaggugugugccaccaugcucagccucuuucuuucuuucuuucuuucuuucuuucuuucuuucuuucuuucuuucuuucuuucuuucuuuccuucuuucuuucuuucuuucuuucuuccuuucuuccuuucuuccuuuccuccuuccuuucuuucuuuuuuuugaauuacaguauuuuauugaacacuugacaaauuuuaguauacaguaucuacuaauuuauuuaaaaagacguauaaguucuguaaucugaggauuugagauuaaauaugagacagagucagaguucaaagguuuaucacuuaucaaguaacauaaaaacaaauuaauaguacaugggaaucaaauaaaagaaaaaaacaauuaaaaaauuguauuaccauguaaguccugauccauauuuauaaauauaacaaaauauuuuuucuaaucaaacacgucuuuguauggaaacaugaaacauggacauuaugaguguacuuuagagaauguauauaugguuuauguuuauauaguacauaguacauaauguauauacaagguuuacauacaauuccaguuccaggggaucuuauugccuacguacacauacauacacacacacacacacacacacacaaaaauaaauauauauauauguauauaguuuuuuauauaguacauauacauguacauauuacuucauuauguuagaaugacuucuccaagauuaaaauuguauauguagcucuuuauagaaauaacaguucuaaauucauuuucauaugauauaaaggugccuuugcaguuaagaauacuugaugcucuugcagacgauacaaauucaauucucagccuccauauuaagcaaccuacaguucuuagcaauuccaguuucaggggaucuuauugccuacguacacauacauacauacauacauacauacauacauacauacauacauacacacacaaauaaauauauuaaaauaggcugauuuugcuaugcaaaacauaauuauuaaaaaauuuuagaggaaauugaaauaauaaauccaacaauuuguuuaauaguacaaauuuagaucuuucaauggugaauauucuguagaucucuuucuccuucacccucacagauuuauuuuuagaaauaagaucaagaagugauaauauuaagugauauggaaaggcagaagacagacaaaggacaccggagcauugaaagaggauaugaagcuaaaugauuuucugcuuuaacucugucuuuuuuuucuuuuuuucuuuuuuuuugggggggugucagugcauaaaauguaacugauaguaaauauguacagucaaaguuuuacaauuucauaauggucauucuaacuguauagaaguucaccaagguguaaaauuuauuacuuucuuuuuaaaaauauuuuuauuagguauuuuccucauuuacauuuccaaugcuaucacaaaagucccccauacccucucccccacuccccuacccacccacucccacuuuuuggcccuggcauuccccuguacuggggcauauaaaguuugcaaguccaaugggccucucuuucuagacuaggccaucuuuugauacauaugcagcuagagucaagagguccgggguacugguuaguucauaauguuguuccaccuauaggguugcagaucccuuuagcuccuuggguacuuucucuagcuccuccauugggggcccugugauccauccaauagcuucuuucuuuuuaagaauaaaaaacacagccgggcagugguggugcaugccuuuaaucccaggacucuggaggcagaggcaggcagauuucugaguucgaggccagccuggucuacagagugaguuccaggacagccagagcuauacagagaaacccugucuugaaaaaaaaaaaaacaaaaacaaaaacaaaaaaaaaacaaaaacaaaaaagaauaaaaagacaugggcuggagagacugcucaaugguuaagagcacugacugcucuucuagggguccugaguucaauucccagcaaccacaugguggcucacaaccaucuguaauggggugcagugcccucuuuuggugugucugaaaacagcuacaguguacucauauacauaaaauaaauacaucuuaaaaaaaagaauaaaaaaauacaaaguaaaacagguucuuacccugaagcucagacaagccuagagcugauggcaucacccagacugucuggaagcacauggcaaccacacagccuuaaugcugggauuacagacaugaacccuaacucccagcuccaaaaccugcugcugcugcugcugcugcugcugcugcugcugcuguuguaguuggugguaguggugugugugugcagguucauucagagaccagaagagggcgucugacccuuggagcuggaguacaagcaggcguagcugccguguggugcugguaauggaaccaggguucucugcaagggcaaccagugcuauuagcugcugaguccaucccuucagccccuaacacuuuucucaauaaacgccaacucugcuucagaagcacccauccugacguugcuuuccaaggcacugugauggauugaaugcaaaacgugucgucgucgucccccacacaccccacacacccccuccacccccacccccacccccgccaccaaauagucucuggcauuucagcccuugcucacuagguggcccugucuggggaggcuaaggggugaggccuuacuggaggaaguuugucacuggggauggguuuugagaacauaaagacuugugucauuuagagucuauucugcuuccugugugugcuucaagaugugagcuccagccaccaugucugccaccuauugccauggugaccccaucauuauggaccccaacucucuggaaccauaucuuaaaguaaaacccuucuauaauuuaccuuggucaugguguuuuaucacaauagaaaaggcacuaacacagggauuuaagucacuaaugauggcuucuucuggagcagaaauccccggggagggggggagguggagggggcggagccacagcuagguuaaagauucuacagaccugacuaauaauuagaauguuaugguguggagggagaguuagaauguugcagauccagagcuaaauuauccugggcggccuucaguuucuuuaauagacacuuuugugucugaccuaacaucuuugcaacuguaaggcaaacccuuuugaauaguaguaugguugcuugauccaguaaucccagcacgugaaggguggaagcaagaacuucaggagcucaaggucauuguccaucacagagugagugcaguaccagccugggauaccugagacccugccucaaaacagaagccacccaaucaaccaaauaagggaacaaacucuuuuagcaaaccacuggcauccagcuacucaaaagcuaagaacaguauggggaggauaacaucugaaaccuguaccagagauccccuuacuuugcugaaucccccagaccugaggcuuccaccaauguauuugaaaauguccuggcuuaugauuuuucuuaggucggaaacuccgugaaaugguucccgaguugggauaugcuacuugagacaaccuaaacuugugcucggcggcagggucacgcauauuuggcccaggaauaaacucuucuuuugauauguuuuguauucacaccu

SEQ ID NO: 6398 - RNA, 274 nt, Mus musculus
aaugguaaagaaaacugaaaucagccagcacgccaaguacucuugcucuuucuguggcaagaccaagaugaagagccgagccgucggcaucuggcacugggguucaugcgugaaaacugcggccagcggggccuggaccuacacccccaccucugcaggcacagugaagucugccaucagaagacugaaggaacugaaagaccaguagaagcccugccgucugagacuugccuagccugcaauaaacggguuauuuacguuaaaaaaaaaaaaa

SEQ ID NO: 6399 - RNA, 2735 nt, Mus musculus
cuuuuuuuuuuuuaagauuuauuuauuuuauguauaugaguacacuguagcuguacagaugguugugagccuucaucugguuguugggaauugaauuuaggaccucugcuugcucugcccaacccugcuugcucagucccaaagauuuauuuauuauuauaaauaaguacacuguagcugucuucagacacaccagaaaagggcaucagaucccauuacagaugguugugagagcagucaguguucuuaaccacugagccaucucaccagccccggaugaucagcuccuaaguauaauuuugaaaugaccagaucuaggagauguggcuaguacaugccuaguguagauggguuccuagagcccuggguuuaauccugagcuggggagaaaaaaaaagaagcugagcuuguuggcauacaccuguaauccuaccacuucagaaauggaggcaggaagaggcagaagauaguuugaggcaaaucuggacaugguaugccugccugaaaucccagcaauagagaagcuggggggugaggacugccaugauggcaagauccuguuugaaaagaacaagagcugaauuguauauuagaaaauaaugagcuacacaguaucucaguuauagcuaguauuacaggugaagauaagccaguccaguugcauccuggccuucauaugacaccuguacugugcacagaggcaaggauugcucacagcuugugauguguugaauguccugugucacuuugaccucuuucuaaugagucacucgcuguuuucuaagcagcaaaggcagaagaugccaagagagcccgggagacggggcugcaccugaugcggcgagcgcuggcugugcuccagaucuucacuguuagccagcugggcugugccacgggccagaucccucaaaccuuguggcagaggagccaggcagacagagacuacucccacuuacugaaaagacuggaaguaucggucgacagaguaaagcagcuagccuugagacaucagccacaugaccacgucaucacuucggccaaccuccaggaccucucucugggaggcaaggaugagcugaccacgguugugcggaaggagcugacaguggcugugagggaccugcuggcccauggacuguaugccuccuccucugggaugagccuugucauggccccccuugcuugcuuguugccaguuuucuccucagcccccgagaccaugcacccaugggagcucuuuguaaaguacuaccaugccaagaauggccgugcauauguggaauccccggcccggaagcucucacaguccuuugcucugccuauaaugggugacacugcugugacccccaaacagagccuucugacagccauccaccuggugcugacagagcaugacccuuucaagcgcagcgcugacucagaacugaaggcguuggugugcauggcacugaaugagcagcgccugguguccugggugaaccucaucugcaagucagggucccucaucgagccccauuaccagcccuggagcuacauggcccacacagguuuugagagugcccucaaccugcucagccgccuuagcagccucaaguucagccuuccuguagacuuggccgugcgccagcucaagaacaucaaagaugccuuuugaugggaaugccuaaccuuagcccccacacaccuugcucuaaagacguagauguccuagaauuguagauuaaaagccagggagucggaggaaggguuggagauagguuuuuuccacccuuuucagguggucagcuaauggaggcaaagccuguucuuagcguuuuagaaagacgugccagagccucucaucaaaaauaguguuggggcugagagacagcucgccaggucaagaugcuugccauuauaccuggcagucugagggguacaagcagagaacagagcucucacuaccuguccucuuaccuccacacaugaacuauggcacaugggaaucccugcccaaacacaaaucaauguaauaguaaaaucuaaaacagaaacaguaucaggaccagagguguagcucggugguauggugcaugcgaagcgugcacagccagugcuguggauguuaaaagcaaacagaaggcgcugacccuagcccaccacagugugcccggcccgcuguuggagccugugguaacaaaaucaauuaccacacagcuaaugcccaacucaccgugccaugucugaauuuuagaaaauguggguugugcccacccuucucuugcuguaugagggaguucuggaagacacugacugaccuugagucuccugcuagacaagcugggaacagucuuccuuuaccagaagcagcuuugagagcccuagggccagaacuguaagugcaguugugaguucugauuccccuuuguucagagggaguuuuaagaugagccuaagaugaagucucccugcugaggcgauccucacacucagucagcacuccucugguuauaaagaaugacagcugaucuccugggcuguuucucgaaagucacuuucuuccgugggccucucaggacugacccagucuucagaagugaaagcacucagaagaauccgucaggagcauacugcacugguggugaugggugccacagcccccuggggugugacucauuggcaccacuuguuggagacaggagcgugcagagcggcaugacugaaggcucgcagugggcacuugcuccagggcucac

SEQ ID NO: 6400 - RNA, 9680 nt, Mus musculus
cgagcaaggccccgccccacccacugguguccgcagccugcgcucuuccugacgcgugucccgcccuucccagcugugcaccgguucuguacagcugggaacgcacgucgcgagucuagccauguccgcggagagggaagcagcugaggcggccacuguggcagcggcgaccgaggccggggcggagaccgggaccggagccggggagggugcgccuucgcagcccccgacagucgagguggcaagcgacccgcagccacccccggcccccgaagcgucagcauccgcuucggcaccgccacugcgcugccugguacucaccggcuucgguggcuacgauaaggugaagcugcagagccggccggcggugcccccggccccggguccgggucaauugacgcugcgcgugcgagccugugggcucaacuucgccgaccucaugggccgccaagggcuguacgaccgacuaccgccucugccggucacccccggcauggagggcgcgggcgugguaguggcagugggcgaaggcgucggcgaccguaaggugagcgguagcagggcaggagugggcgcgugccggggguguggccgggccgggaagccagcaaggacgcggguggacuaaacauggaacacauggaaagcaauuuaugucuccaggcgucugggaaaaggauuuacugggaacuggcaacaguguuauugccccuucccaaagcauuuuuuaguaguggccgccgccccaagcggaguuggggggaaaacaauaaggcgcccaggcgcaugcgcaggaugaccugcucgccccccucccacccccuuccccaaguaaaaccacaccuguaccccugcccacuaaacacucccggggcaguugugguuugugacucugagugguggcuaacucccccuucccucccgagggagcuuugagaagcuauguagaugggguuaggcggaggcucagaggccgugccagagcgcuagucacaugcagccccgugguguauggggguguaugacggccccuccccgagcugggccaaaggggacacacccaucauggagcccagagaggcuggcuucccccaccgccacgggccuuacgcuacuacucggguauuugacgugggggaggcgggaaucagucucccaucuuugucuugggcuugcuuucucgugacugcaacuccaucccuucuucagugacucagcuagcaggccacgacccaggguuacccuugggaacuuccggcccaaaccgcugcuccuccucccuuucagaggaccccagcccccgaaauccaggcggagcccauuuggacuaggguagggagguguggcaccuugagcagguuggcccagcuuugccggucuguuucucguuuaucauuaaucacagccauaaccuuggccacaugagacuuacagaagaccagcuuucugagagaucccgauugaggccucuuuauaucaaguguuuaggaguuucuuuucaaauccagcaccuucaugagaugcugccccagagcagucugagccuuugcuaaccugcuggguuugcugcauuuguugaacaucaaaacagcuccuccuuaaagucguucuuucugaauccagcuguggucacacccuugcccugacuuagauauaauccuacucuuggauggugcuaaaaggacuuuggaggguagggguuggaaggggaaguuaauaguucauguuacugcugaaggccacccaccuauccacuccuccccacacuuuccgccugguaaauacaggauuuccugccucaggcaagaaucugcuguaagagccuggauucuauggggagggcuuucccacccuccugguggcugaguuggggaggggucauggcccugaguugggagggcuaaagguuagguaugagucagauuaagugauacuuguucggauuacaucugggacuggcuggcuguccugcuagcuuauugcucuguagcuagcucucuuggcuugcuacugugucuucuggacuugaguuuugagguuccuugcccaggccagaacucacagaaaggcuguccucuucaaugcaauacagggacuugauuacauguaaagggggccuguguagaggucucauucuccuacccuguggauccuaaauguccuguaaggagcuaagaugagccuugauugucuaggacagcacccacacuucucucuguguggucuucagagagccaggaggacccauugcugaccugauucccccuccuccugcccagcuaguggcuaaacuggauccuucugucuuugucccuugccuccugcagagagacccuggagcaagugccagagacuaggaaugaaagauaaugccuuuucguuguggcuggaauggguugcucuucgugagcucgugagcgucaggcuugcgugccaugucuggguucauguauuuucuagggcugccauuguaagccuauauacaacugaagaagacccugggcuggccacacccaaccguuuacuguuuacaacuggggcacauuuaccugcacuacagcguggcccuugcucugugcagcccucucucuacaguuauuugcugacuuccucuccuugccguuauugucauugcuguuagcuaacauugcuaaguuauuaacuauaugauauacaucacgcuaucacugaaugcuguuguuguuguuuuccuaauuaggagaucuuaaaguuccccuccugcagaugagaaaacugguuaaauaauuuuuauuugcucggggcugcccugucauuaaaacgguggagcccacuuuuguaaucaaagcaguuugaucucuugaacaauaguuacacuugccccaacuguaaguuucucgcagucaggaaucuuaugcaauaaugaaguauaugaucuguuauguggagauaagggcagcccagcgcugcugugaggacugacugaacacuucccucugaagcuccagguaaacacucaggagguggugcuguuaaugcuacaaccggcugugucugcuacuucaucuccaagggaccgggacauggcagagaucaguaaggcaccuguggguaaaugaaugaguaaucacggacauucuuccuuuuuuuuuuuuuaaggcaggggaucgggugaugguguugaaccggucagggauguggcaggaggaaguaacugugccaucagcccagacuuuccugaugccugaggccaugaccuuugaagaagcugcugccuugcuggucaauuauaucaccgccuacaugguucucuuugacuucggcaaccugagaccgggccauagcgucuugguacacauggcugcaggugacaagucccuuccuuuauuuuuuuuauuuuuuuucacccgaccugauuucccuuccaggccccucucuguagccuaucuggucuguugucauagcaacaccagacugccuggccuguggagcccagaggccucugcagcauaguugccgugguaacauuuagacaccagguccagccugccauucuuagcagccugcccucacccccacacaccaucuccuguccagucucugucccuccaguucucaauuguggaauuugaaccugggccccaaaaggagcuaaggcacaaugaaagugauggacuaaguaccuaagugacuccgugcccgcuucuugcugcagguggcgugggcauggcagcccugcaguugugccgcaccguggagaacgugacaguguuuggaacggccucagccagcaagcacgaggugcugaaggagaacggggucacacaccccaucgacuaccacacgacugacuauguggacgagaucaaaaagaucucccccaaaggugggggcagggccuggaaauggggagguuggcacagcacagggagauggggcgaggggucuccagaucuguggguauuaauggguugucccucuuugacaggaguagacaucgucauggacccucuggguggaucagacacggccaagggcuaccaccuccucaaacccaugggcaaaguugucacuuacggugaguuguuaguuguaccaaacgcagagaaguugccugggacaguaggaugggacuaauucauaauaaugaauagguagagaaucccaccgauagggugggauacaggggcccgagcuuuugaauaagggaggaaaggggaguccagagcucuacagugaggcugggguuuggaaggguccuggauauuuaaaugagauugacagccacucacucucuuucauaaaucuccugugagucaucguaaauugguguuccuauuuggggauuauuccugaugcaaaaccagccagccugcuugcuuccugcagcaccaccugggcuucuugggcaagcuggauauuuauuuuaaaaccuacuuuacacacacacacaaauguaaauagaaauaugagagcaauuuugggagagcacgagcccucucuuucucugccaaggucuccugauucuucccucuccagccuucauguccugagugcugaggugacaggaauguggugccauaucuggggggugcaaucuuccaucuccuuuucuucccuuuuuggcaguuagagggagacagggucucacuacgaagcucuagcuggccuggaacuccuagagauccaccucccucucucucccgagaaauagaauuuaaauuguguguuacgacuguauccggcucucuggguuuguuuguuuguuuguuuguugagguaagguuucgguauagaacacugccuucaaacccacuguauagucaaggaugagcucaaacgucucgucuuugucucugcuucccaaauguugagauucaggcucacaccacacauccacgugauuuacauaguucaggguaggcaaccaucccagccgagcuacgucccuagcccuuguguguauaauuuuguuguuggugguuuugcuuuguuuuccguucuugagacaggguuucucuguguagccuuggcugugcuggaacauaaucuguagaucaggcuggccucgaacucagaguuugccugggauuaaagguaugugccaacaaccaccuggcuaugcauuuuuuuguguguguuuuuguuuuuguuuuucgagacaggguuucucuguauagcccuggcuguccuggaacucacuuuguagaccaggcuggccucaaacucagaaauccgccugccucugucucccgagugcuaggauuaaagguaugcaccaccacgcccugcacuuuuguuuuuuuguuuuuuugguuuuuuuuuugguuuuucgagacaggguuugcuuuuuuuuuuuuuaauguauguuuauugugugugcacauaaaggugccauggugcacauguggaauucagaggacaacuggcaggaaacaguuccauucucuucuuccguguguguguguguguguguguguguguguguguguguacacaaagaauuaguuugggccuaauccuaaguuccaggauuguccguguguugaguguuaacaaggagaucaaggagccaggcagacauggauucagacacaccugauguaccgagauguaccuggcagcuggauuacuggacgugucauuccgucccuuaggaauggcuaaccugcugacgggccccaagcggaaccugauggccauggcccgcaccugguggaaucaguucagugugacagcucugcagcugcugcaggccaaccgagcuguguguggcuuccaccugggcuaccuggauggagagguggaacucgucaauagcguggucacccgccucguggcucuguacaaucagggccacaucaaaccucgaauugacucagucuggcccuucgagaaggugagcuugaggacccaggggcagaugguuccugucgucuuuagccgggcucuguaaguggggcggacagcaucagggacggucuucucuuucucuccagguggcagaugcaaugaaacagaugcaggagaagaagaacauaggcaaaguccuccugguuccugggccugagaaggagaccuagggccagagggcugagggcccuggagagccggggagggagaagaugggaaguccugucguguugcccaccagccucucacauuucauccugucacgaugcucuacccucccucccucccccagagaaggucucugcugaugacugcuucccugcucugagcucgcucuugcccuucgcucagggcucucccucccccccaccccuuccugcccucaggagagguugggaagugaccacuuggaugucugggcccugccaaggggacagggggggucagcaggaggcuggcugcuuccugcccuccccccucucccugggccuaccaugcugcuuuugugccaagguuagccaaucccucccugcccuauccugugugcuuccaccucagccucauccucccuccugccccacccccacccaaagaaucuaugcgucagcucaggacguggggccgaucugugugaguccagcauguaccugugucccccguaguauccccgcagcccaggccgacgaggcccaccccuggacuugaucaguauucaaccuugucuccuguccccaaugucguaagcacaauuagacuucuuccggcuugaguuugcugccuccuacagcaaggacaggaaucagaccgacucccuagcuuacgcucugggagggguacuggguaccccacccuucacugaggccuuuggauuugucucagugccuuagcaucugaaaaccugugcuuguauauguguguguauguguaggggcagccccuaucucuggcuccuuuuccacccuucuccccagugccuuccucguccugguggagcugaggccuacuccuccccaguccaacacugccaaaaaucuguguaugugccaggggucgggggucuggggguaggggacagcuccagccucuggggaccaauugcuuuuacuguggucuguggccuguccugucucugucaguggagaagaaaggcagugagcuggaucagccagaguucugggagacaacgcugggucuuauucugggaccaaagugagaauucaagcacauuucuuuccuuugcuauguagggaggcugcugccuucccagagccuggaggcagcucugcuguucagccccaaacuuuguuuacacugcuagggaaggaggagcuccggcaagggaauaacuaggcugguuaaaagagucagggcuacuggagccaagguggggaccuuugaggcuaggugggggucaccugcugcuucugagcuuggauuagagaaagcucuuaacuccagccacugucagagggaguguggagggagggacccggccucucuguugucaaauugaggccuccaugugggaagugugauuucugcuuuugugucccauccccaccccaccccauuaccacagcugccuuugugucugugucaauaaaaagccaaacccugaguccugaccagauguuguaucugagaguugcuggagaaugggugguagugaugcgcaccuuuaaucucagcaguuggaggcagagacaggcagcuuggaguuacaggccagccuggucuacagagggaacgucuggaauauacagagaaaucuagucucaaaugaaagagagagagagagcgcgcgcgugcacgagcgagccaugggaaagccagugucaaggucugcguucugcccucucucucagcuaucuugaaguaaagaagaccaucacaccagguuggcacuuugaccguucuugguagcauuaggcaguaagugauccuaguccccagcagguggacaugcaggccuagcuugacucggaagugaagauagccaggcccugcugcccugaaggcacaacugucagggccuccaccuccccgcccccacgagugggcuucuggaaguggaucucaaggaugucaugcaguuccugggcauccaugacaucaggaauauuugucaccagcacugaaugaggggcuugcuggaauuugaucuagaaaaagagacaggaaaugaaugaauugcaaggguucaugggaaugcagggcaguggcgagcagaggcuggaacaaggaccaucccacaaaaaacaugggaugggucuggaagcucaggcuccuguguaggcuggagaggcuggggggcccugagcucuccccgacaaggagacgcuuccccagccccaccuucacguaccucggcuuucuggaucucaccacucacauagggagagacccucaggaggaccugcugccgguccagugggacucugaacuggccaaucuggcauaagugcugggccacugugagagacagggaaggguggccuugaaggcuucucgagucucgugcacccuggcccccuaccucuucuguaggacccuuaccuucuucaucagcaaacccuagcaugacggucccuugcagcaucucccgggucucuacauccccaccuccauucuuggccuugccaaagaagaucuccagcuuguccaacaguuccucuucacucagccuaaguccagcaggaaaaccacuaacgagcacccugugguuaucuggcuggcuggacaccuagcaggagacagggcaggcucagcugacccacucauccauaggacccaaaugcugaaucccaccuguugcauggaggacccugccacucugucaccugaauguuggucaccacaggcagcuccaagggcuggaccugcacccgcagccggcaguccucuaaguuaacucuguguuccuuuuguuguagcaaccgaucaaccacuguggguggagagacagggucacuauuaggaaaccuuauggccuccccucggagccuccccacacaccaaggcuaaccuuugggguccucaaaggugaccagagcagaaccuucaggcagagggcagcagaccuucaaguuagaaacuacaaacuugggcacuugccugcccugcuuaguuuggccuuggaauaccagaggaacuucagguacugagaaugggaucuggagguugggagaggaagguacguaacaaccuugagaaguaggagaggucccuaccacucccuucugggcagaauguguccccugauucuguuugauugaugugcagugcagaaagccuucauagaagagcuggauuguguggguacaggcacgacacaccagccaguuuucauacaagcucucguccucaugcaagccugggagguagguaacuucaccucacagaugagaaaacugagagcaaagagaucaaacaauguucuugagcucacauagcaagaaaauaaguaauuaaauauauccaugugcgugugcauguguguguguguaucuccagguacccguccaggccaggagaggguguuguuucuccugcaacuagaguuacagguaguuaugagcugccccauguaggggccaggaauugaaccuauguccucugccagagcuguaaaguguucaccacugagccaucucuucaaucccuuucuaccaccaggaacaccucaguucccaccugaccuuggcuccgggagagccugugcgcucccuuuugagcugcugcagcuccugcagccucaucuugagccuggcuugcuccuccugaagacu
